United States Patent 9,205,144 (IDENTIFICATION OF CONSERVED PEPTIDE BLOCKS IN HOMOLOGOUS POLYPEPTIDES) - sequence listing, part 12

SEQ ID NO: 419963 - protein, 573 aa, Influenza virus
  MOD_RES (1)..(85): Any amino acid
  MOD_RES (97)..(156): Any amino acid
  MOD_RES (168)..(236): Any amino acid
  MOD_RES (255)..(260): Any amino acid
  MOD_RES (273)..(303): Any amino acid
  MOD_RES (315)..(324): Any amino acid
  MOD_RES (345)..(400): Any amino acid
  MOD_RES (413)..(413): Any amino acid
  MOD_RES (428)..(453): Any amino acid
  MOD_RES (477)..(506): Any amino acid
  MOD_RES (532)..(547): Any amino acid
  MOD_RES (571)..(573): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXIGPPHCDQFLEXXXXXXXXXXXXXXXXXXXXXXXXXXXXXXXXXXXXXXXXXXXXXXXXXXXXXXXXXXXXSDSSFYAEMKWXXXXXXXXXXXXXXXXXXXXXXXXXXXXXXXXXXXXXXXXXXXXXXXXXXXXXXXXXXXXXXXXXXXXXPQVNGQFGRIDFHWLMLNXXXXXXFTFNGAFIAPNRXXXXXXXXXXXXXXXXXXXXXXXXXXXXXXXIVSSLPFQNISXXXXXXXXXXVKQKSILLATGMRNIPEKPKXXXXXXXXXXXXXXXXXXXXXXXXXXXXXXXXXXXXXXXXXXXXXXXXXXXXXXXXLIGRTNQQFELIXNEFTEIEQQIGNVIXXXXXXXXXXXXXXXXXXXXXXXXXXIDLTDSEMNKLYERVKRQLRENAXXXXXXXXXXXXXXXXXXXXXXXXXXXXXXTYREEAMQNRLKIDPVKLSSGYKDVXXXXXXXXXXXXXXXXAMGLVFICVKNETCSALFVYSLRXXX

SEQ ID NO: 419964 - protein, 573 aa, Influenza virus
  MOD_RES (1)..(241): Any amino acid
  MOD_RES (254)..(404): Any amino acid
  MOD_RES (416)..(507): Any amino acid
  MOD_RES (521)..(547): Any amino acid
  MOD_RES (559)..(562): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQSGRIDFHWLMLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTNKQFELIDNEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYRKEAMQNRIQIDXXXXXXXXXXXXXXXXXXXXXXXXXXXAMGLVFICMKNXXXXCSALFVYSLRK

SEQ ID NO: 419965 - protein, 573 aa, Influenza virus
  MOD_RES (1)..(241): Any amino acid
  MOD_RES (255)..(508): Any amino acid
  MOD_RES (524)..(551): Any amino acid
  MOD_RES (567)..(573): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQSGRIDFHWLILNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTGSLQNRIQIDQVKXXXXXXXXXXXXXXXXXXXXXXXXXXXXVFICIKNGNMRCTICXXXXXXX

SEQ ID NO: 419966 - protein, 573 aa, Influenza virus
  MOD_RES (1)..(241): Any amino acid
  MOD_RES (255)..(509): Any amino acid
  MOD_RES (522)..(573): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQSGRIDFHWLVLNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAESLQNRIQIDQXXXXXXXXXXXXXXXXXXXXXXXXXXXXXXXXXXXXXXXXXXXXXXXXXXXX

SEQ ID NO: 419967 - protein, 573 aa, Influenza virus
  MOD_RES (1)..(243): Any amino acid
  MOD_RES (255)..(510): Any amino acid
  MOD_RES (531)..(573): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRIDFHWLILSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXESLQNRIQIGPVKLSSGYKDXXXXXXXXXXXXXXXXXXXXXXXXXXXXXXXXXXXXXXXXXXX

SEQ ID NO: 419968 - protein, 573 aa, Influenza virus
  MOD_RES (1)..(516): Any amino acid
  MOD_RES (528)..(573): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIQINPVKLSSGXXXXXXXXXXXXXXXXXXXXXXXXXXXXXXXXXXXXXXXXXXXXXX

SEQ ID NO: 419969 - protein, 469 aa, Influenza virus
  MOD_RES (20)..(58): Any amino acid
  MOD_RES (72)..(83): Any amino acid
  MOD_RES (95)..(95): Any amino acid
  MOD_RES (126)..(126): Any amino acid
  MOD_RES (208)..(210): Any amino acid
  MOD_RES (253)..(258): Any amino acid
  MOD_RES (308)..(311): Any amino acid
  MOD_RES (338)..(338): Any amino acid
  MOD_RES (391)..(397): Any amino acid
  MOD_RES (414)..(414): Any amino acid
  MOD_RES (468)..(469): Any amino acid
MNPNQKIITIGSVSLTIATXXXXXXXXXXXXXXXXXXXXXXXXXXXXXXXXXXXXXXXERNITEIVYLNNTXXXXXXXXXXXXYRSWSKPQCQIXGFAPFSKDNSIRLSAGGDIWITREPYVSCDXSKCYQFALGQGTTLDNKHSNGTIHDRIPHRTLLMNELGVPFHLGTKQVCIAWSSSSCHDGKAWLHVCVTGDDRNATASFIYXXXLVDSIGSWSQNILRTQESECVCINGSCTVVMTDGSASGKADTXXXXXXEGKIVHISPLSGSAQHIEECSCYPRYPNVRCVCRDNWKGSNRPVIDINMXXXXIDSSYVCSGLVGDTPRNEDGSSSSNCXDPNEERGNPGVKGWAFDSGDDVWMGRTISRDSRSGYETFRVIGGWTTANSKSXXXXXXXVDNNNWSGYSGIFSVEXKSCINRCFYVELIRGRPKETRVWWTSNSIVVFCGTSGTYGTGSWPDGANINFMXX

SEQ ID NO: 419970 - protein, 469 aa, Influenza virus
  MOD_RES (1)..(2): Any amino acid
  MOD_RES (18)..(58): Any amino acid
  MOD_RES (72)..(83): Any amino acid
  MOD_RES (95)..(95): Any amino acid
  MOD_RES (126)..(126): Any amino acid
  MOD_RES (208)..(210): Any amino acid
  MOD_RES (253)..(258): Any amino acid
  MOD_RES (308)..(311): Any amino acid
  MOD_RES (338)..(338): Any amino acid
  MOD_RES (391)..(397): Any amino acid
  MOD_RES (414)..(414): Any amino acid
  MOD_RES (468)..(469): Any amino acid
XXPNQKIITIGSISLTIXXXXXXXXXXXXXXXXXXXXXXXXXXXXXXXXXXXXXXXXXEKNITEIVYLNHTXXXXXXXXXXXXYRNWSKPQCQIXGFAPFAKDNSIRLSAGGHIWVTREPYVSCDXNKCYQFALGQGTTLYNKHSNGTIHDRTPHRTLLMNELGVPFHLGTRQVCIAWSSSSCHDGKAWLHICVTGDDRNATASLIYXXXLVDSIVSWSQNILRTQESECVCINGTCTVVMTDGSASGRADTXXXXXXEGKIIHISPLSGSAQHIEECSCYPQYPNVRCVCRDNWKGSNRPIIDINMXXXXINSSYVCSGLVGDTPRNDDSSSSSNCXDPNDERGNPGVKGWAFDNGDDVWMGRTISKDSRSGYETFRVISGWTTANSKSXXXXXXXVDNNNWFGYFGIFFVEXKSCVNRCFYVELIRGMPQETRVWWTSNSIIVFCGTSGTYGTGSWPDGANISFMXX

SEQ ID NO: 419971 - protein, 469 aa, Influenza virus
  MOD_RES (1)..(5): Any amino acid
  MOD_RES (20)..(58): Any amino acid
  MOD_RES (72)..(83): Any amino acid
  MOD_RES (95)..(95): Any amino acid
  MOD_RES (122)..(126): Any amino acid
  MOD_RES (165)..(166): Any amino acid
  MOD_RES (205)..(210): Any amino acid
  MOD_RES (223)..(227): Any amino acid
  MOD_RES (253)..(258): Any amino acid
  MOD_RES (274)..(275): Any amino acid
  MOD_RES (308)..(311): Any amino acid
  MOD_RES (338)..(338): Any amino acid
  MOD_RES (391)..(397): Any amino acid
  MOD_RES (412)..(414): Any amino acid
  MOD_RES (468)..(469): Any amino acid
XXXXXKIITIGSVSLIIATXXXXXXXXXXXXXXXXXXXXXXXXXXXXXXXXXXXXXXXKRNITEIVYLNSTXXXXXXXXXXXXYRDWSKPQCQIXGFAPFSKDNSVRLSASGDIWITREPYXXXXXGKCYQFALGQGTTLENKHSNGTTHDRTSHRTLLMNELGXXFHLGTKQVCMAWSSSSCHDGKAWLHVCITGDDRNATASXXXXXXLIDSIGSWSQNIXXXXXSECVCINGSCAVVMTDGSASGKAETXXXXXXEGKIAHISPLSGSAQXXEECSCYPRYPDVRCVCRDNWKGSNRPVVDINMXXXXIGSSYVCSGLVGDTPRNEDSSSSSNCXDPNNERGNPGVKGWAFDYGNDVWMGRTISKDSRSGYETFKVIGGWTIANSKSXXXXXXXVDNSNWSGYSGIFSXXXKRCINRCFYVELIRGRPQENRVWWTSNSIVVFWGTSGTYGTGSWPDGANIDFVXX

SEQ ID NO: 419972 - protein, 469 aa, Influenza virus
  MOD_RES (1)..(7): Any amino acid
  MOD_RES (20)..(58): Any amino acid
  MOD_RES (72)..(83): Any amino acid
  MOD_RES (95)..(102): Any amino acid
  MOD_RES (124)..(126): Any amino acid
  MOD_RES (149)..(149): Any amino acid
  MOD_RES (164)..(188): Any amino acid
  MOD_RES (208)..(227): Any amino acid
  MOD_RES (253)..(258): Any amino acid
  MOD_RES (274)..(287): Any amino acid
  MOD_RES (308)..(311): Any amino acid
  MOD_RES (323)..(323): Any amino acid
  MOD_RES (338)..(338): Any amino acid
  MOD_RES (391)..(397): Any amino acid
  MOD_RES (413)..(414): Any amino acid
  MOD_RES (427)..(430): Any amino acid
  MOD_RES (453)..(455): Any amino acid
  MOD_RES (468)..(469): Any amino acid
XXXXXXXITIGSVSLTITTXXXXXXXXXXXXXXXXXXXXXXXXXXXXXXXXXXXXXXXEKNITKIVYLNSTXXXXXXXXXXXXYRIWSKPQCQIXXXXXXXXDNSIRLSAGGNIWITREPYVSXXXDKCYQFALGQGTTLNNKHSNGTXHDRISHRTLLMNELXXXXXXXXXXXXXXXXXXXXXXXXXWLHVCVTGDDKNATASFIYXXXXXXXXXXXXXXXXXXXXSECVCINGTCAVVMTDGSASRKADTXXXXXXEGKISHISPLSGSAQXXXXXXXXXXXXXXKCVCRDNWKGSNRPVIDVNMXXXXIDSSYLCSGLVXDTPRNEDSSSNSNCXDPNNEKGNPGVKGWAFDYGSDVWMGRTISMDSRSGYETFRVIDGWTTANSKSXXXXXXXVDNNSWSGYSGIFSVXXKNCINRCFYVELXXXXPQETRVWWTSSSIVVFCGTSRTXXXGSWPDGANINLMXX

SEQ ID NO: 419973 - protein, 469 aa, Influenza virus
  MOD_RES (1)..(8): Any amino acid
  MOD_RES (20)..(58): Any amino acid
  MOD_RES (72)..(83): Any amino acid
  MOD_RES (95)..(103): Any amino acid
  MOD_RES (126)..(126): Any amino acid
  MOD_RES (164)..(188): Any amino acid
  MOD_RES (203)..(227): Any amino acid
  MOD_RES (249)..(258): Any amino acid
  MOD_RES (273)..(312): Any amino acid
  MOD_RES (338)..(338): Any amino acid
  MOD_RES (369)..(373): Any amino acid
  MOD_RES (391)..(397): Any amino acid
  MOD_RES (414)..(430): Any amino acid
  MOD_RES (454)..(469): Any amino acid
XXXXXXXXTIGSVSLTIAIXXXXXXXXXXXXXXXXXXXXXXXXXXXXXXXXXXXXXXXERNVTETLYLNHTXXXXXXXXXXXXYKSWSKPQCQIXXXXXXXXXNSVRLSAGGDIWVTREPYVSCSXNRCYQFALGQGTTLDNEHSNGTIHDRIPHRTLLMSELXXXXXXXXXXXXXXXXXXXXXXXXXWLHVCVTGDDGNATXXXXXXXXXXXXXXXXXXXXXXXXXSECVCINGSCIVVMTDGSASGXXXXXXXXXXEGKVVHISPLSGSAXXXXXXXXXXXXXXXXXXXXXXXXXXXXXXXXXXXXXXXXDSGYVCSGLVGDTPRNDDSSSNSNCXDPNEERGSPGVKGWAFDSEDDVWMGRTISMXXXXXYETFRVIGGWATANSKSXXXXXXXVNNNNWSGYSGVFSVEXXXXXXXXXXXXXXXXXPQETKVWWTSNSIVVFCGTSATYXXXXXXXXXXXXXXXX

SEQ ID NO: 419974 - protein, 469 aa, Influenza virus
  MOD_RES (1)..(8): Any amino acid
  MOD_RES (20)..(114): Any amino acid
  MOD_RES (126)..(141): Any amino acid
  MOD_RES (154)..(234): Any amino acid
  MOD_RES (253)..(262): Any amino acid
  MOD_RES (274)..(313): Any amino acid
  MOD_RES (326)..(347): Any amino acid
  MOD_RES (367)..(367): Any amino acid
  MOD_RES (379)..(431): Any amino acid
  MOD_RES (455)..(469): Any amino acid
XXXXXXXXTIGSVSLTIAAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWVTREPYVSCGXXXXXXXXXXXXXXXXNEHSNGTTHDRIXXXXXXXXXXXXXXXXXXXXXXXXXXXXXXXXXXXXXXXXXXXXXXXXXXXXXXXXXXXXXXXXXXXXXXXXXXXXXXXXXGSCTVVMTDGNASGKADTXXXXXXXXXXVHISSLSGSAQXXXXXXXXXXXXXXXXXXXXXXXXXXXXXXXXXXXXXXXXSSYMCSGLVGDTXXXXXXXXXXXXXXXXXXXXXXGVKGWAFDNGNDVWMGRTIXRDSRSGYETFKXXXXXXXXXXXXXXXXXXXXXXXXXXXXXXXXXXXXXXXXXXXXXXXXXXXXXQEARVWWTSNSIVAFCGTSGTYGXXXXXXXXXXXXXXX

SEQ ID NO: 419975 - protein, 469 aa, Influenza virus
  MOD_RES (1)..(432): Any amino acid
  MOD_RES (444)..(469): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXETTVWWTSNSIXXXXXXXXXXXXXXXXXXXXXXXXXX

SEQ ID NO: 419976 - protein, 469 aa, Influenza virus
  MOD_RES (1)..(434): Any amino acid
  MOD_RES (446)..(469): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGVWWTSNSIVVXXXXXXXXXXXXXXXXXXXXXXXX

SEQ ID NO: 419977 - protein, 469 aa, Influenza virus
  MOD_RES (1)..(442): Any amino acid
  MOD_RES (454)..(469): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLVVFCGTSGTYXXXXXXXXXXXXXXXX

SEQ ID NO: 419978 - protein, 597 aa, Influenza virus
  MOD_RES (18)..(24): Any amino acid
  MOD_RES (61)..(79): Any amino acid
  MOD_RES (99)..(125): Any amino acid
  MOD_RES (137)..(163): Any amino acid
  MOD_RES (175)..(197): Any amino acid
  MOD_RES (209)..(216): Any amino acid
  MOD_RES (228)..(228): Any amino acid
  MOD_RES (242)..(245): Any amino acid
  MOD_RES (259)..(267): Any amino acid
  MOD_RES (283)..(307): Any amino acid
  MOD_RES (322)..(335): Any amino acid
  MOD_RES (352)..(352): Any amino acid
  MOD_RES (373)..(377): Any amino acid
  MOD_RES (447)..(447): Any amino acid
  MOD_RES (523)..(523): Any amino acid
  MOD_RES (537)..(543): Any amino acid
  MOD_RES (578)..(582): Any amino acid
SKSRGYKMNTQILVFALXXXXXXXGDKICLGHHAVANGTKVNTLTERGIEVVNATETVETXXXXXXXXXXXXXXXXXXXCGLLGTLIGPPQCDQFLEFXXXXXXXXXXXXXXXXXXXXXXXXXXXLRQILRGSGGIXXXXXXXXXXXXXXXXXXXXXXXXXXXGSSFYAEMKWLXXXXXXXXXXXXXXXXXXXXXXXPALIIWGVHHSXXXXXXXXLYGSGNKLITVXSSKYQQSFTPSPGXXXXVNGQSGRIDFHWLXXXXXXXXXFTFNGAFIAPDRASFXXXXXXXXXXXXXXXXXXXXXXXXXGGTIVSSLPFQNINXXXXXXXXXXXXXXSLLLATGMRNVPENPKXCSPLSRCRETRGLFGAIAGFXXXXXLFGAIAGFIENGWEGLIDGWYGFRHQNAQGEGTAADYKSTQSAIDQITGKLNRLIDKTNQQFELIDNEFXEIEQQIGNVINWTRDSMTEVWSYNAELLVAMENQHTIDLADSEMNKLYERVRKQLRENAEEDGTGCFEIFHKCDDXCMESIRNNTYDHTXXXXXXXQNRIQIDPVKLSSGYKDIILWFSFGASCFLLLAIXXXXXFICIKNGNMRCTICI

SEQ ID NO: 419979 - protein, 597 aa, Influenza virus
  MOD_RES (18)..(24): Any amino acid
  MOD_RES (61)..(79): Any amino acid
  MOD_RES (98)..(125): Any amino acid
  MOD_RES (137)..(163): Any amino acid
  MOD_RES (175)..(197): Any amino acid
  MOD_RES (209)..(216): Any amino acid
  MOD_RES (228)..(228): Any amino acid
  MOD_RES (242)..(245): Any amino acid
  MOD_RES (259)..(267): Any amino acid
  MOD_RES (283)..(307): Any amino acid
  MOD_RES (322)..(335): Any amino acid
  MOD_RES (352)..(352): Any amino acid
  MOD_RES (372)..(383): Any amino acid
  MOD_RES (444)..(447): Any amino acid
  MOD_RES (478)..(481): Any amino acid
  MOD_RES (511)..(511): Any amino acid
  MOD_RES (523)..(523): Any amino acid
  MOD_RES (537)..(543): Any amino acid
  MOD_RES (578)..(582): Any amino acid
  MOD_RES (597)..(597): Any amino acid
SKSRGYKMNTRILILTLXXXXXXXADKICLGHHAVSNGTKVNTLTERGVEVVNATETVERXXXXXXXXXXXXXXXXXXXCGLLGTITGPPQCDQFLEXXXXXXXXXXXXXXXXXXXXXXXXXXXXLRQILRESGGIXXXXXXXXXXXXXXXXXXXXXXXXXXXESSFYAEMKWLXXXXXXXXXXXXXXXXXXXXXXXPALIIWGIHHSXXXXXXXXLYGSGAKLITVXSSNYQQSFVPSPGXXXXVNGQFGRINFHWLXXXXXXXXXFSFNGAFIAPDRVSFXXXXXXXXXXXXXXXXXXXXXXXXXGGTIISNLPFQNINXXXXXXXXXXXXXXSLLLATGMKNVPEIPKXCSPLSRCRKTRGLFGAIAGXXXXXXXXXXXXGFIENGWEGLVDGWYGFRHQNAQGEGIAADYKSTQSAVDQITGKLNRLIEKTNQQFELIDXXXXEVEKQIGNVINWTRDAMTEIWSYNAELLVAXXXXHTIDLADSEMDKLYERVRRQLRENAEEDGXGCFEIFHKCDNXCMASIRNNTYDHSXXXXXXXQNRIQINPVKLSSGYKDVILWFSFGASCFILLAIXXXXXFICVKNGNMRCTICX

SEQ ID NO: 419980 - protein, 597 aa, Influenza virus
  MOD_RES (18)..(25): Any amino acid
  MOD_RES (61)..(79): Any amino acid
  MOD_RES (99)..(125): Any amino acid
  MOD_RES (137)..(163): Any amino acid
  MOD_RES (175)..(197): Any amino acid
  MOD_RES (209)..(216): Any amino acid
  MOD_RES (228)..(228): Any amino acid
  MOD_RES (242)..(245): Any amino acid
  MOD_RES (259)..(267): Any amino acid
  MOD_RES (283)..(307): Any amino acid
  MOD_RES (322)..(335): Any amino acid
  MOD_RES (352)..(352): Any amino acid
  MOD_RES (381)..(384): Any amino acid
  MOD_RES (406)..(407): Any amino acid
  MOD_RES (447)..(447): Any amino acid
  MOD_RES (475)..(481): Any amino acid
  MOD_RES (510)..(523): Any amino acid
  MOD_RES (537)..(543): Any amino acid
  MOD_RES (578)..(582): Any amino acid
  MOD_RES (595)..(597): Any amino acid
SKSRGYKMNNQILILALXXXXXXXXDKICLGHHAVPNGTKVNTLTEKGIEVVNATETVEQXXXXXXXXXXXXXXXXXXXCGLLGTVTGPPQCDLFLEFXXXXXXXXXXXXXXXXXXXXXXXXXXXLRQILRRSGGIXXXXXXXXXXXXXXXXXXXXXXXXXXXGPSFYAEMKWLXXXXXXXXXXXXXXXXXXXXXXXPALIVWGIHHSXXXXXXXXLYGSGSKLITVXSSNYHQSFVPSPGXXXXVNGQTGRIDFHWLXXXXXXXXXFSFNGAFVAPDRVSFXXXXXXXXXXXXXXXXXXXXXXXXXGGTITSPLPFQNINXXXXXXXXXXXXXXSLMLATGMKNVPETPKXKRKRGLFGAIAGPRPRRGLFGAIAGFIEXXXXFIENGWEGLINGWYGFRHQNAXXEGTAADYKSTPSAIDQITGKLNRIIEKTNQQFKLIDNEFXEVERQIGNVINWTRDSITEVWSYNAELXXXXXXXHTIDLADSEMSKLYERVKRQLRENAEEDXXXXXXXXXXXXXXCMASIRNSTYDHSXXXXXXXQNRIRIDPVKLSSGYKEVILWFSFGASCFLFLAIXXXXXFMCVKNGNMRCTXXX

SEQ ID NO: 419981 - protein, 597 aa, Influenza virus
  MOD_RES (1)..(3): Any amino acid
  MOD_RES (18)..(25): Any amino acid
  MOD_RES (61)..(79): Any amino acid
  MOD_RES (99)..(125): Any amino acid
  MOD_RES (137)..(163): Any amino acid
  MOD_RES (182)..(197): Any amino acid
  MOD_RES (209)..(216): Any amino acid
  MOD_RES (228)..(228): Any amino acid
  MOD_RES (242)..(245): Any amino acid
  MOD_RES (259)..(267): Any amino acid
  MOD_RES (283)..(307): Any amino acid
  MOD_RES (322)..(338): Any amino acid
  MOD_RES (352)..(353): Any amino acid
  MOD_RES (365)..(390): Any amino acid
  MOD_RES (447)..(453): Any amino acid
  MOD_RES (478)..(482): Any amino acid
  MOD_RES (504)..(525): Any amino acid
  MOD_RES (537)..(543): Any amino acid
  MOD_RES (577)..(582): Any amino acid
  MOD_RES (596)..(597): Any amino acid
XXXRGYKMNTQILIFTLXXXXXXXXDKICLGHHAVTNGTKVDTLTEKGIEVVDATETVERXXXXXXXXXXXXXXXXXXXCGILGILTGPPQCDRFLEFXXXXXXXXXXXXXXXXXXXXXXXXXXXLRQVLRESGGIXXXXXXXXXXXXXXXXXXXXXXXXXXXGSSSFYAEMKWLLSNSDNXXXXXXXXXXXXXXXXPALIVWGVHHSXXXXXXXXLYGSGNKLVTVXSPKYQQSFTPSPEXXXXVDGQSGRIDFHWMXXXXXXXXXGSFNGAFIAPDRATFXXXXXXXXXXXXXXXXXXXXXXXXXGGTITSNLPFQNVNXXXXXXXXXXXXXXXXXLATGMRNVPEKPKXXRRRGLFGAIAGXXXXXXXXXXXXXXXXXXXXXXXXXXEGLIDGWYGFKHQNAQGEGTAADYKSTQSAINQITGKLNRLIDRTNHQFELIDNEFXXXXXXXGNVINWTRDSVTELWSYNAELLVAXXXXXTIDLADSEMNNLYERVRKQLRXXXXXXXXXXXXXXXXXXXXXXASIRNNTYDHTXXXXXXXQNRMQINPVKLSGGYKDIILWFSFGASCFIFLAXXXXXXFICIKNGNMQCTIXX

SEQ ID NO: 419982 - protein, 597 aa, Influenza virus
  MOD_RES (1)..(29): Any amino acid
  MOD_RES (61)..(79): Any amino acid
  MOD_RES (94)..(125): Any amino acid
  MOD_RES (137)..(163): Any amino acid
  MOD_RES (175)..(216): Any amino acid
  MOD_RES (228)..(228): Any amino acid
  MOD_RES (242)..(245): Any amino acid
  MOD_RES (259)..(267): Any amino acid
  MOD_RES (279)..(307): Any amino acid
  MOD_RES (322)..(340): Any amino acid
  MOD_RES (352)..(353): Any amino acid
  MOD_RES (365)..(420): Any amino acid
  MOD_RES (447)..(453): Any amino acid
  MOD_RES (482)..(482): Any amino acid
  MOD_RES (506)..(525): Any amino acid
  MOD_RES (537)..(543): Any amino acid
  MOD_RES (578)..(582): Any amino acid
  MOD_RES (595)..(597): Any amino acid
XXXXXXXXXXXXXXXXXXXXXXXXXXXXXLGHHAVANGTRVNTLTGRGIEVVNATETVENXXXXXXXXXXXXXXXXXXXCGLLGIITGPPQCDXXXXXXXXXXXXXXXXXXXXXXXXXXXXXXXXLRQILRGSGGVXXXXXXXXXXXXXXXXXXXXXXXXXXXDSSFYAEMKWLXXXXXXXXXXXXXXXXXXXXXXXXXXXXXXXXXXXXXXXXXXLYGSENKLITVXSSKCQQSFTPSPGXXXXVNGQSGRINFHWLXXXXXXXXXFNFNGAFIAPDXXXXXXXXXXXXXXXXXXXXXXXXXXXXXGGTIASSLPFQNINXXXXXXXXXXXXXXXXXXXTGMKNVPEIPRXXKKRGLFGAIAGXXXXXXXXXXXXXXXXXXXXXXXXXXXXXXXXXXXXXXXXXXXXXXXXXXXXXXXXINQITGKLNRIIDKTNQQFEMIDNEFXXXXXXXGNVIDWTRDSVTELWSYNAEFLVAMENQXTIDQADSEMNKLHERVRKQLRENXXXXXXXXXXXXXXXXXXXXASIRNNTYDHNXXXXXXXQNRVKIDPVKLNSGYKDIILWFSFGASCFLLIAIXXXXXFICIKDGNMRCTXXX

SEQ ID NO: 419983 - protein, 597 aa, Influenza virus
  MOD_RES (1)..(42): Any amino acid
  MOD_RES (60)..(86): Any amino acid
  MOD_RES (98)..(165): Any amino acid
  MOD_RES (182)..(229): Any amino acid
  MOD_RES (241)..(268): Any amino acid
  MOD_RES (280)..(355): Any amino acid
  MOD_RES (372)..(422): Any amino acid
  MOD_RES (440)..(456): Any amino acid
  MOD_RES (474)..(483): Any amino acid
  MOD_RES (509)..(555): Any amino acid
  MOD_RES (578)..(585): Any amino acid
XXXXXXXXXXXXXXXXXXXXXXXXXXXXXXXXXXXXXXXXXXTLTERGVEVVDATETVEXXXXXXXXXXXXXXXXXXXXXXXXXXXIGPPQCDLFLEXXXXXXXXXXXXXXXXXXXXXXXXXXXXXXXXXXXXXXXXXXXXXXXXXXXXXXXXXXXXXXXXXXXXPSFYAEMKWLLSNTDNXXXXXXXXXXXXXXXXXXXXXXXXXXXXXXXXXXXXXXXXXXXXXXXXSKYLQSFTPSPXXXXXXXXXXXXXXXXXXXXXXXXXXXXSSNGAFIAPDRXXXXXXXXXXXXXXXXXXXXXXXXXXXXXXXXXXXXXXXXXXXXXXXXXXXXXXXXXXXXXXXXXXXXXXXXXXXXAYRKRMTRGLFGAIAGXXXXXXXXXXXXXXXXXXXXXXXXXXXXXXXXXXXXXXXXXXXXXXXXXXXQITGKLNRFIEKTNQQFXXXXXXXXXXXXXXXXXINWTRDSMTEIWSYNAEXXXXXXXXXXIDLANSEMNKLYERVKKQLRENAEEXXXXXXXXXXXXXXXXXXXXXXXXXXXXXXXXXXXXXXXXXXXXXXXNGYKDVILWFSFGASCFVLLAIXXXXXXXXVKNGNHAVHYCI

SEQ ID NO: 419984 - protein, 597 aa, Influenza virus
  MOD_RES (1)..(86): Any amino acid
  MOD_RES (98)..(168): Any amino acid
  MOD_RES (182)..(355): Any amino acid
  MOD_RES (369)..(462): Any amino acid
  MOD_RES (474)..(486): Any amino acid
  MOD_RES (510)..(597): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXIGPPQCDRFLEXXXXXXXXXXXXXXXXXXXXXXXXXXXXXXXXXXXXXXXXXXXXXXXXXXXXXXXXXXXXXXXXXXXXXXXYAEMKWLLSNNDNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAYQKRMTRGLFGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSITELWSYNAEXXXXXXXXXXXXXADSEMDKLYTRVKRQLRENAEKDXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419985 - protein, 597 aa, Influenza virus
  MOD_RES (1)..(168): Any amino acid
  MOD_RES (182)..(355): Any amino acid
  MOD_RES (371)..(463): Any amino acid
  MOD_RES (477)..(597): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYAEMKWLLSNADNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAYQKQMTRGLFGAIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMTEVWSYNAEFLVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419986 - protein, 597 aa, Influenza virus
  MOD_RES (1)..(170): Any amino acid
  MOD_RES (182)..(361): Any amino acid
  MOD_RES (373)..(466): Any amino acid
  MOD_RES (478)..(597): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEMKWLLSNSNNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXARGLFGAIAGFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVMVVYAELLVAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419987 - protein, 597 aa, Influenza virus
  MOD_RES (1)..(361): Any amino acid
  MOD_RES (373)..(597): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPRGLFGAIAGFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419988 - protein, 597 aa, Influenza virus
  MOD_RES (1)..(362): Any amino acid
  MOD_RES (375)..(597): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTKPRPRRGLFGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419989 - protein, 515 aa, Influenza virus
  MOD_RES (1)..(10): Any amino acid
  MOD_RES (38)..(63): Any amino acid
  MOD_RES (79)..(87): Any amino acid
  MOD_RES (113)..(113): Any amino acid
  MOD_RES (127)..(127): Any amino acid
  MOD_RES (149)..(150): Any amino acid
  MOD_RES (198)..(255): Any amino acid
  MOD_RES (308)..(318): Any amino acid
  MOD_RES (401)..(401): Any amino acid
  MOD_RES (418)..(425): Any amino acid
  MOD_RES (458)..(460): Any amino acid
  MOD_RES (478)..(479): Any amino acid
XXXXXXXXXXGVVNTTLSTIALLIGVGNLVFNTVIHEXXXXXXXXXXXXXXXXXXXXXXXXXXTYNNTVINNITTTIIXXXXXXXXXPLPLCPFRGFFPFHKDNAIRLGENKXVIVTREPYVSCDNXNCWSFALAQGALLGTKHSNGTXXDRTPYRSLIRFPIGTAPVLGNYKEICIAWSSSSCFDGKEWMHVCMTGXXXXXXXXXXXXXXXXXXXXXXXXXXXXXXXXXXXXXXXXXXXXXXXXXXXXXXXXXXGRMTDSIKSWRKDILRTQESECQCIDGTCVVAVTDGPAANSADHRVYWIREGXXXXXXXXXXXKIQHLEECSCYVDIDVYCICRDNWKGSNRPWMRINNETILETGYVCSKFHSDTPRPADPSTVSCDSPSNVNGGPGVKGFGFKXGNDVWLGRTVSTSGRSXXXXXXXXEGWINSPNHAKSVTQTLVSNNDWSGYSGSFIVXXXDCFQPCFYVELIRGRPNXXDDVSWTSNSIVTFCGLDNEPGSGNWPDGSNIGFMPK

SEQ ID NO: 419990 - protein, 515 aa, Influenza virus
  MOD_RES (1)..(10): Any amino acid
  MOD_RES (38)..(63): Any amino acid
  MOD_RES (79)..(87): Any amino acid
  MOD_RES (111)..(113): Any amino acid
  MOD_RES (127)..(127): Any amino acid
  MOD_RES (149)..(150): Any amino acid
  MOD_RES (198)..(255): Any amino acid
  MOD_RES (308)..(318): Any amino acid
  MOD_RES (401)..(401): Any amino acid
  MOD_RES (414)..(425): Any amino acid
  MOD_RES (458)..(460): Any amino acid
  MOD_RES (478)..(479): Any amino acid
  MOD_RES (515)..(515): Any amino acid
XXXXXXXXXXGIVNTTLSTIALIIGVGNLIFNTVIHGXXXXXXXXXXXXXXXXXXXXXXXXXXTYNSTVVNNITTTIVXXXXXXXXXSLPLCPFRGFFPFHKDNALRLAEXXXVIVTREPYISCDNXDCWSFALAQGALVGTKHSNGTXXDRTPYRSLIQFPMGTAPVLGNYREICIAWSSTSCFDGKEWMHICMTGXXXXXXXXXXXXXXXXXXXXXXXXXXXXXXXXXXXXXXXXXXXXXXXXXXXXXXXXXXGKMTDSIKSWRRDILRTQESECLCIDGTCVVTVTDGPAANSAHHRVYWIREGXXXXXXXXXXXKIKHLEECSCYVDVDVYCICRDNWKGSNRPWIRINNETILETRYVCSKFHSDTPRPDDPSTMSCDSPSNINGGLGVKGFGFKXGDDVWLGRTVSTXXXXXXXXXXXXEGWINSPNHVKSITQTLVSNNDWSGYSGSFTVXXXGCFQPCFYIELIRGRPNXXDNVSWTSNSIVTFCGLNNEPGSGNWPDGANIGFMPX

SEQ ID NO: 419991 - protein, 515 aa, Influenza virus
  MOD_RES (1)..(10): Any amino acid
  MOD_RES (37)..(63): Any amino acid
  MOD_RES (79)..(87): Any amino acid
  MOD_RES (113)..(113): Any amino acid
  MOD_RES (127)..(127): Any amino acid
  MOD_RES (149)..(150): Any amino acid
  MOD_RES (198)..(255): Any amino acid
  MOD_RES (307)..(318): Any amino acid
  MOD_RES (401)..(401): Any amino acid
  MOD_RES (414)..(425): Any amino acid
  MOD_RES (458)..(460): Any amino acid
  MOD_RES (476)..(479): Any amino acid
  MOD_RES (492)..(492): Any amino acid
  MOD_RES (514)..(515): Any amino acid
XXXXXXXXXXGAVNTTLSTIALFIGVGNLAFNTVIHXXXXXXXXXXXXXXXXXXXXXXXXXXXTYNNTVVNNITTTIIXXXXXXXXXSLPLCPFQGFFPFHKDNAIRPGENKXVIITREPYVSCDNXHCWSFALAQGALLGTNHSNGTXXDRTSYRSLIRFPIGVAPVLGNYKEMCAAWSSSSCFDGKEWLHVCITGXXXXXXXXXXXXXXXXXXXXXXXXXXXXXXXXXXXXXXXXXXXXXXXXXXXXXXXXXXGKMRDSIKSWRNNILRTQESECQCLYGICVVAVTDGPADNKADHRIYWIKEXXXXXXXXXXXXRIQHLEECSCYMDIDVYCVCRDNWKGSNRPWVRMNNETILETGYICSKFHSDTPRPVDPSTISCDSPSNINGEPGVKGFGFKXGSDVWLGRTVSTXXXXXXXXXXXXEGWINSPSQAKSITQTLVSNDDWSGYSGSFIIXXXGCFQPCFYVELTRGVXXXXDEVSWTSNSIVTXCGLDNEPGSGHWPDGSNIGFMXX

SEQ ID NO: 419992 - protein, 515 aa, Influenza virus
  MOD_RES (1)..(10): Any amino acid
  MOD_RES (38)..(63): Any amino acid
  MOD_RES (79)..(87): Any amino acid
  MOD_RES (113)..(113): Any amino acid
  MOD_RES (125)..(127): Any amino acid
  MOD_RES (149)..(150): Any amino acid
  MOD_RES (196)..(255): Any amino acid
  MOD_RES (269)..(270): Any amino acid
  MOD_RES (308)..(318): Any amino acid
  MOD_RES (364)..(364): Any amino acid
  MOD_RES (400)..(402): Any amino acid
  MOD_RES (418)..(425): Any amino acid
  MOD_RES (449)..(461): Any amino acid
  MOD_RES (478)..(479): Any amino acid
  MOD_RES (496)..(498): Any amino acid
XXXXXXXXXXGVVNTALSTIALLIGIGNLVFNTVIHGXXXXXXXXXXXXXXXXXXXXXXXXXXTYNKTVINNITTTITXXXXXXXXXPLPLCPFKGFFPFHKDNAIRLGENRXVLVTREPYISCXXXGCWSFALAQGALLGTRHSNGTXXDKTPYRSLIRFPVGTAPVLGNYREVCIAWSSSSCFDGKEWMHVSMXXXXXXXXXXXXXXXXXXXXXXXXXXXXXXXXXXXXXXXXXXXXXXXXXXXXXXXXXXXXGRMADSIKSWRKDXXRTQESECQCIGGTCIVAVTDGPAANNADHRIYWIRKGXXXXXXXXXXXKIRHLEECSCYVDTDVYCICRDNWKGSNRPWMRISNETILETGYVXSKFHSDTPRPTDPSIMSCDSPSNVKGGPGVKGFGFXXXNDVWLGRTVSNSGRSXXXXXXXXDGWINSPNHAKSLTQTLVSNNDWXXXXXXXXXXXXXCFQSCFYVELIRGRLNXXDDVSWASNSIVTFCGLXXXPGSGNWPDGSDIGFMPK

SEQ ID NO: 419993 - protein, 515 aa, Influenza virus
  MOD_RES (1)..(10): Any amino acid
  MOD_RES (38)..(63): Any amino acid
  MOD_RES (75)..(87): Any amino acid
  MOD_RES (113)..(114): Any amino acid
  MOD_RES (126)..(127): Any amino acid
  MOD_RES (149)..(152): Any amino acid
  MOD_RES (198)..(255): Any amino acid
  MOD_RES (270)..(270): Any amino acid
  MOD_RES (283)..(283): Any amino acid
  MOD_RES (308)..(319): Any amino acid
  MOD_RES (345)..(346): Any amino acid
  MOD_RES (361)..(375): Any amino acid
  MOD_RES (388)..(402): Any amino acid
  MOD_RES (418)..(425): Any amino acid
  MOD_RES (457)..(464): Any amino acid
  MOD_RES (478)..(479): Any amino acid
  MOD_RES (491)..(515): Any amino acid
XXXXXXXXXXGSVNTVLSIIALLIGIGNLIFNTVIHEXXXXXXXXXXXXXXXXXXXXXXXXXXTYNNTVINNMTXXXXXXXXXXXXXSLPLCPFKGFFPFHKGNSARLIHHTXXIVTREPCVSCDXXNCWSFALAQGVLLGTKHSNGTXXXXTPYRSLIQFPIGTAPILGNYKEICVAWSSSSCFDGKEWMHVCITGXXXXXXXXXXXXXXXXXXXXXXXXXXXXXXXXXXXXXXXXXXXXXXXXXXXXXXXXXXGRMSDSIKSWRKDIXRTQESECQCISGXCVVSVTDGPAANSADHRIYWIREGXXXXXXXXXXXXIQHLEECSCYTDIDIYCICRDNWKGXXRPWVRINNETILETXXXXXXXXXXXXXXXDPSVVSCDSPSNXXXXXXXXXXXXXXXDDVWLGRTVSINGRSXXXXXXXXEGWIDSPNHAKSITQTLVSNSDWSGYSGSFIXXXXXXXXPCFYIELIRGKPNXXDDVSWTSNSLVXXXXXXXXXXXXXXXXXXXXXXXXX

SEQ ID NO: 419994 - protein, 515 aa, Influenza virus
  MOD_RES (1)..(11): Any amino acid
  MOD_RES (38)..(64): Any amino acid
  MOD_RES (79)..(92): Any amino acid
  MOD_RES (105)..(115): Any amino acid
  MOD_RES (127)..(168): Any amino acid
  MOD_RES (198)..(270): Any amino acid
  MOD_RES (282)..(291): Any amino acid
  MOD_RES (306)..(321): Any amino acid
  MOD_RES (337)..(347): Any amino acid
  MOD_RES (369)..(380): Any amino acid
  MOD_RES (392)..(403): Any amino acid
  MOD_RES (418)..(434): Any amino acid
  MOD_RES (446)..(466): Any amino acid
  MOD_RES (478)..(515): Any amino acid
XXXXXXXXXXXVVNTILSTKALLIGIGNLAFNAVIHGXXXXXXXXXXXXXXXXXXXXXXXXXXXNNHTTINNITNVVLXXXXXXXXXXXXXXPVQGFFPFHKDNXXXXXXXXXXXVTREPYVSCDYXXXXXXXXXXXXXXXXXXXXXXXXXXXXXXXXXXXXXXXXXXLGNYKEIRIAWSSSSCFDGKEWMHVCMAGXXXXXXXXXXXXXXXXXXXXXXXXXXXXXXXXXXXXXXXXXXXXXXXXXXXXXXXXXXXXXXXXXXXXXXXXXRTQESECQRIDXXXXXXXXXXPAANNADHRVYWIRXXXXXXXXXXXXXXXXHSEECSCYVDIDIYCXXXXXXXXXXXPWMRINNETIVETGYVCSKFHXXXXXXXXXXXXSCSSPSGIEGRXXXXXXXXXXXXDVWLGRTVSISGRSXXXXXXXXXXXXXXXXXVKSVTQTLVSNXXXXXXXXXXXXXXXXXXXXXFYVELIRGRPIXXXXXXXXXXXXXXXXXXXXXXXXXXXXXXXXXXXXXX

SEQ ID NO: 419995 - protein, 515 aa, Influenza virus
  MOD_RES (1)..(173): Any amino acid
  MOD_RES (188)..(406): Any amino acid
  MOD_RES (418)..(436): Any amino acid
  MOD_RES (448)..(515): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEICVAWSSTSCFDGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLGRTISYSSRSXXXXXXXXXXXXXXXXXXXAATQTLVSNNDXXXXXXXXXXXXXXXXXXXXXXXXXXXXXXXXXXXXXXXXXXXXXXXXXXXXXXXXXXXXXXXXXXXX

SEQ ID NO: 419996 - protein, 585 aa, Influenza virus
  MOD_RES (18)..(23): Any amino acid
  MOD_RES (42)..(42): Any amino acid
  MOD_RES (67)..(91): Any amino acid
  MOD_RES (104)..(144): Any amino acid
  MOD_RES (156)..(161): Any amino acid
  MOD_RES (178)..(241): Any amino acid
  MOD_RES (258)..(261): Any amino acid
  MOD_RES (282)..(334): Any amino acid
  MOD_RES (348)..(349): Any amino acid
  MOD_RES (528)..(536): Any amino acid
  MOD_RES (563)..(568): Any amino acid
SKSRGYKMNTQILVFALXXXXXXGCDHSDNADKICLGHHAVXNGTKVNTLTERGVEVVNATETVERXXXXXXXXXXXXXXXXXXXXXXXXXTGPPQCDQFLEFXXXXXXXXXXXXXXXXXXXXXXXXXXXXXXXXXXXXXXXXXGFTYSGIRTNGXXXXXXRSGSSFYAEMKWLLSNXXXXXXXXXXXXXXXXXXXXXXXXXXXXXXXXXXXXXXXXXXXXXXXXXXXXXXXXXXXXXXXXRPQVNGQSGRIDFHWLXXXXNDTVTFSFNGAFIAPDRASFXXXXXXXXXXXXXXXXXXXXXXXXXXXXXXXXXXXXXXXXXXXXXXXXXXXXXSLLLATGMKNVPEXXTHKQLTHHMRKKRGLFGAIAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYRXXXXXXXXXIDPVKLSSGYKDVILWFSFGASCFILXXXXXXLVFICVKNGNMRCTICI

SEQ ID NO: 419997 - protein, 585 aa, Influenza virus
  MOD_RES (18)..(30): Any amino acid
  MOD_RES (42)..(42): Any amino acid
  MOD_RES (67)..(91): Any amino acid
  MOD_RES (103)..(144): Any amino acid
  MOD_RES (156)..(161): Any amino acid
  MOD_RES (178)..(241): Any amino acid
  MOD_RES (258)..(261): Any amino acid
  MOD_RES (282)..(334): Any amino acid
  MOD_RES (348)..(349): Any amino acid
  MOD_RES (369)..(371): Any amino acid
  MOD_RES (435)..(435): Any amino acid
  MOD_RES (528)..(536): Any amino acid
  MOD_RES (563)..(568): Any amino acid
  MOD_RES (584)..(585): Any amino acid
SKSRGYKMNTKILVLALXXXXXXXXXXXXXGDKICLGHHAVXNGTKVDTLTEKGIEVVNATETVEQXXXXXXXXXXXXXXXXXXXXXXXXXIGPPQCDQFLEXXXXXXXXXXXXXXXXXXXXXXXXXXXXXXXXXXXXXXXXXXGFTYTGVRTNGXXXXXXRSRSSFYAEMKWLLSSXXXXXXXXXXXXXXXXXXXXXXXXXXXXXXXXXXXXXXXXXXXXXXXXXXXXXXXXXXXXXXXXRPQINGQSGRIDFYWLXXXXNDTVTFTFNGAFIAPNRASFXXXXXXXXXXXXXXXXXXXXXXXXXXXXXXXXXXXXXXXXXXXXXXXXXXXXXSLMLATGMKNVPEXXAHKQLTHHMRKKRGLFGAKXXXGFIENGWEGLVDGWYGFRHQNSQGEGTAADYKSTQSAVNQITGKLNRLIDKTNQQFELIDNKFXEIEKQIGNVINWTRDSITEMWSYNAELLIAMENQHTIDLTDSEMNKLYEKVRRQLRENAEEDCTGCFEIFHKCDDQCMESIRNNTYDHKKYRXXXXXXXXXIDAVKLSSGYKDIILWFSFGASCFLLXXXXXXLVFMCVKNGNMRCTSXX

SEQ ID NO: 419998 - protein, 585 aa, Influenza virus
  MOD_RES (18)..(30): Any amino acid
  MOD_RES (42)..(42): Any amino acid
  MOD_RES (67)..(91): Any amino acid
  MOD_RES (104)..(144): Any amino acid
  MOD_RES (156)..(161): Any amino acid
  MOD_RES (178)..(241): Any amino acid
  MOD_RES (258)..(261): Any amino acid
  MOD_RES (282)..(334): Any amino acid
  MOD_RES (348)..(349): Any amino acid
  MOD_RES (361)..(361): Any amino acid
  MOD_RES (528)..(536): Any amino acid
  MOD_RES (563)..(568): Any amino acid
  MOD_RES (585)..(585): Any amino acid
SKSRGYKMNIQILILALXXXXXXXXXXXXXADKICLGRHAVXNGTKVNTLTEKGIEVVNATETVETXXXXXXXXXXXXXXXXXXXXXXXXXTGPPQCDLFLEFXXXXXXXXXXXXXXXXXXXXXXXXXXXXXXXXXXXXXXXXXGFTYSGIRTDGXXXXXXRSESSFYAEMEWLLSNXXXXXXXXXXXXXXXXXXXXXXXXXXXXXXXXXXXXXXXXXXXXXXXXXXXXXXXXXXXXXXXXRPQMNGQSGRIDFHWMXXXXNDTITFSFNGAFVAPDRVSFXXXXXXXXXXXXXXXXXXXXXXXXXXXXXXXXXXXXXXXXXXXXXXXXXXXXXSLLLATGMRNVPEXXIHKQLTHHMRKXEKRGLFGAIAGFIENGWEGLIDGWYGYRHQNAQGEGIAADYKSTQSAINQITGKLNRLIERTNQQFELIDNEFNEIEQQIGNVINWTRDSLTEVWSYNADLLVAMENQHTIDSTDSEMNKLYERVKRQLRENAEEDGNGCFEIFHQCDNDCMANIRNNTYDHTQYRXXXXXXXXXINPVKLSSGYKEVILWFSFGASCFTLXXXXXXLVFICIKNGNMRCTICX

SEQ ID NO: 419999 - protein, 585 aa, Influenza virus
  MOD_RES (18)..(30): Any amino acid
  MOD_RES (42)..(42): Any amino acid
  MOD_RES (64)..(91): Any amino acid
  MOD_RES (103)..(144): Any amino acid
  MOD_RES (156)..(161): Any amino acid
  MOD_RES (178)..(241): Any amino acid
  MOD_RES (255)..(261): Any amino acid
  MOD_RES (282)..(349): Any amino acid
  MOD_RES (363)..(363): Any amino acid
  MOD_RES (375)..(378): Any amino acid
  MOD_RES (400)..(400): Any amino acid
  MOD_RES (418)..(418): Any amino acid
  MOD_RES (528)..(536): Any amino acid
  MOD_RES (563)..(568): Any amino acid
MKSRGYKMNTQILIFALXXXXXXXXXXXXXADKISLGHHAVXNGAKVNTLTERGIEVVNATETXXXXXXXXXXXXXXXXXXXXXXXXXXXXIGPPQCDLFLEXXXXXXXXXXXXXXXXXXXXXXXXXXXXXXXXXXXXXXXXXXRFTYSGIRTNGXXXXXXRSGPSFYAEMKWLLSDXXXXXXXXXXXXXXXXXXXXXXXXXXXXXXXXXXXXXXXXXXXXXXXXXXXXXXXXXXXXXXXXRPPVNGQSGRIDFXXXXXXXNDTVNFSFNGAFIAPDRAGFXXXXXXXXXXXXXXXXXXXXXXXXXXXXXXXXXXXXXXXXXXXXXXXXXXXXXXXXXXXXXXXXXXXXKKKKKKRGLFGAIXKGLFGAIAGFIXXXXEGLIDGWYGYKHQNAQGEGTAXDYKSTQAAIDQITGKLNXLIDKTNQQFEMIDNEFNEVERQIGNVINWTRDSIIEVWSYNAEFLVAVENQHTIDLTNSEMNKLYERVRKQLRENAEEDGTACFEIFHKCDDNCMASIRNNSYDHSKYRXXXXXXXXXIDPVELSSGYKDVIIWFSFGASCFLFXXXXXXLAFICIKNGNMQCTICI

SEQ ID NO: 420000 - protein, 585 aa, Influenza virus
  MOD_RES (1)..(30): Any amino acid
  MOD_RES (42)..(42): Any amino acid
  MOD_RES (65)..(144): Any amino acid
  MOD_RES (156)..(161): Any amino acid
  MOD_RES (174)..(244): Any amino acid
  MOD_RES (256)..(261): Any amino acid
  MOD_RES (281)..(350): Any amino acid
  MOD_RES (363)..(381): Any amino acid
  MOD_RES (393)..(403): Any amino acid
  MOD_RES (424)..(424): Any amino acid
  MOD_RES (452)..(452): Any amino acid
  MOD_RES (482)..(493): Any amino acid
  MOD_RES (528)..(536): Any amino acid
  MOD_RES (563)..(568): Any amino acid
  MOD_RES (585)..(585): Any amino acid
XXXXXXXXXXXXXXXXXXXXXXXXXXXXXXADKICLGHHAAXNGIKVDTLTEKEVEVVNATETVXXXXXXXXXXXXXXXXXXXXXXXXXXXXXXXXXXXXXXXXXXXXXXXXXXXXXXXXXXXXXXXXXXXXXXXXXXXXXXXXGFTYTGVRTDGXXXXXXRLGSSFYAEMKWXXXXXXXXXXXXXXXXXXXXXXXXXXXXXXXXXXXXXXXXXXXXXXXXXXXXXXXXXXXXXXXXXXXXXXXINGQSGRIDFHXXXXXXNDTVTFNFNGAFVAPDRASXXXXXXXXXXXXXXXXXXXXXXXXXXXXXXXXXXXXXXXXXXXXXXXXXXXXXXXXXXXXXXXXXXXXXXKKRKKRGLFGAIXXXXXXXXXXXXXXXXXXXIDGWYGFKHQNXXXXXXXXXXXSTQSAIDQITRKLNRLIEKTXQQFELIDNEFSEVEKQLGNVINWTRDSXIEIWSYNAEFLVAMENQHIIDLADSEMNKXXXXXXXXXXXXAEEDGTGCFELFHKCDDDCMGSIRNNTYDHSTYRXXXXXXXXXIDPVKLSGGYKDVILWFSLGASCFLLXXXXXXLIFMCVKNGNMQCTICX

SEQ ID NO: 420001 - protein, 585 aa, Influenza virus
  MOD_RES (1)..(45): Any amino acid
  MOD_RES (64)..(244): Any amino acid
  MOD_RES (256)..(361): Any amino acid
  MOD_RES (373)..(382): Any amino acid
  MOD_RES (403)..(404): Any amino acid
  MOD_RES (437)..(464): Any amino acid
  MOD_RES (487)..(501): Any amino acid
  MOD_RES (524)..(543): Any amino acid
  MOD_RES (562)..(570): Any amino acid
  MOD_RES (583)..(585): Any amino acid
XXXXXXXXXXXXXXXXXXXXXXXXXXXXXXXXXXXXXXXXXXXXXKVNTLTEREVEVVNATETXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMNGQSGRIDFYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRRGLFGAIAGXXXXXXXXXXDGWYGFRHQKAQGEGTAADYXXTQSAIDQITGTLNRLIDKTNQQFKLIDNEFTEXXXXXXXXXXXXXXXXXXXXXXXXXXXXAVENQHTIDSTESEMNKLYERVXXXXXXXXXXXXXXXFEIFHKCDDRCMTSIRNNTYDHXXXXXXXXXXXXXXXXXXXXSGYKEIILWFSFGASCFFXXXXXXXXXFICVKNGNMQCTXXX

SEQ ID NO: 420002 - protein, 585 aa, Influenza virus
  MOD_RES (1)..(361): Any amino acid
  MOD_RES (373)..(467): Any amino acid
  MOD_RES (486)..(570): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRKRGLFGAIAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNQHTIDLAESEMNKLYERXXXXXXXXXXXXXXXXXXXXXXXXXXXXXXXXXXXXXXXXXXXXXXXXXXXXXXXXXXXXXXXXXXXXXXXXXXXXXXXXXXXXXFICVKNGNMRGTNWI

SEQ ID NO: 420003 - protein, 585 aa, Influenza virus
  MOD_RES (1)..(361): Any amino acid
  MOD_RES (373)..(571): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKKRGLFGAIAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXICVKNGNHAVHYCI

SEQ ID NO: 420004 - protein, 471 aa, Influenza virus
  MOD_RES (38)..(61): Any amino acid
  MOD_RES (73)..(81): Any amino acid
  MOD_RES (161)..(168): Any amino acid
  MOD_RES (194)..(194): Any amino acid
  MOD_RES (245)..(267): Any amino acid
  MOD_RES (285)..(286): Any amino acid
  MOD_RES (309)..(309): Any amino acid
  MOD_RES (332)..(333): Any amino acid
  MOD_RES (387)..(392): Any amino acid
  MOD_RES (416)..(416): Any amino acid
  MOD_RES (454)..(454): Any amino acid
MNPNQKLFALSGVAIALSVLNLLIGISNVGLNVSLHLXXXXXXXXXXXXXXXXXXXXXXXXENTYVNNTTIIXXXXXXXXXSYLLLNKSLCNVEGWVVIAKDNAVRFGESEQIIVTREPYVSCDPTGCKMYALHQGTTIRNKHSNGTIHDRTAFRGLISTXXXXXXXXSNSDFMCVGWSSTTCHDGIGRMTICXQGNNDNATATVYYNRRLTTTIKTWARNILRTQESECVCHNGTCAVVMTDGXXXXXXXXXXXXXXXXXXXXXXXLKGSARHIEECSCYGHNXXVTCVCRDNWQGANRPIIEIDMNXLEHTSRYVCTGILTDTSRPGDKXXGDCSNPITGSPGAPGVKGFGFLNGDNTWLGRTISPRSRSGFEMLKIPNAGTDPXXXXXXRQEIVDNNNWSGYSGSFIDYWNDXSECYNPCFYVELIRGRPEEAKYVWWTSNSLIALCGSPXPVGSGSFPDGAQIQYFS

SEQ ID NO: 420005 - protein, 471 aa, Influenza virus
  MOD_RES (38)..(61): Any amino acid
  MOD_RES (73)..(81): Any amino acid
  MOD_RES (161)..(168): Any amino acid
  MOD_RES (194)..(194): Any amino acid
  MOD_RES (240)..(267): Any amino acid
  MOD_RES (285)..(286): Any amino acid
  MOD_RES (309)..(309): Any amino acid
  MOD_RES (332)..(333): Any amino acid
  MOD_RES (387)..(392): Any amino acid
  MOD_RES (416)..(416): Any amino acid
  MOD_RES (428)..(429): Any amino acid
  MOD_RES (451)..(454): Any amino acid
MNPNQKLFASSGIAIVLGIINLLIGISNMSLNISLYSXXXXXXXXXXXXXXXXXXXXXXXXENTYVNNTTVIXXXXXXXXXNYLMLNKSLCKVEGWVVVAKDNAIRFGESEQIIVTREPYVSCDPLSCKMYALHQGTTIRNKHSNSTTHDRTAFRGLMSTXXXXXXXXSNSDFICVGWSSTSCHDGIARMTICXQGDNENATATVYYNKRLTTTIKTWAKNILRTQESECVRHNGTCAVXXXXXXXXXXXXXXXXXXXXXXXXXXXXLKGSAKHIEECSCYGHSXXATCVCRDNWQGANRPVIEIDMNXLEHTSRYICTGVLTDTSRPSDKXXGDCNNPITGSPGVPGVKGFGFLDSGNTWLGRTISPKLRSGFEMLKIPNAETDPXXXXXXRQEIVSNDNWSGYSGSFIDYWDEXNECYNPCFYVEXXRGRPEEAKYVEWTSNSLIALCXXXXSVGSGSFPDGAQIKYFS

SEQ ID NO: 420006 - protein, 471 aa, Influenza virus
  MOD_RES (38)..(61): Any amino acid
  MOD_RES (73)..(81): Any amino acid
  MOD_RES (157)..(168): Any amino acid
  MOD_RES (194)..(194): Any amino acid
  MOD_RES (245)..(267): Any amino acid
  MOD_RES (285)..(286): Any amino acid
  MOD_RES (309)..(309): Any amino acid
  MOD_RES (332)..(333): Any amino acid
  MOD_RES (387)..(392): Any amino acid
  MOD_RES (416)..(431): Any amino acid
  MOD_RES (453)..(454): Any amino acid
  MOD_RES (469)..(471): Any amino acid
MNPSQKLFALSGVAIALSILNLLIGISNVVLNVSLHLXXXXXXXXXXXXXXXXXXXXXXXXKNTYVNNTTIIXXXXXXXXXGYLLLNKSLCNVEGWVVVEKDNAVRFGESEQVIVTREPYVSCDPSGCRMYALHQGTTIRNKHSNGTTHDRTAFRGXXXXXXXXXXXXSNSDFLCVGWSSTSCHDGVGRMTICXQGNNNNATATVYYDRRLTTTIRTWAKNILRTQDSECVSHNGTWAVVMTDGXXXXXXXXXXXXXXXXXXXXXXXLRGSARHIEECSCYGHDXXITCVCRDNWQGANRPIIEIDMTXMEHTSQYLCTGVLTDTSRPKDKXXGECFNPITGSPGSPGIKGFGFLNESNTWLGRTISPRLRSGFEMLKIHNAGTDPXXXXXXRQEIVGNDNWSGYSGSFIDYWDDXXXXXXXXXXXXXXXXRPEEAKYVWWASNSLIALCGSXXPVGPGSFPDGAQIQXXX

SEQ ID NO: 420007 - protein, 471 aa, Influenza virus
  MOD_RES (38)..(61): Any amino acid
  MOD_RES (73)..(81): Any amino acid
  MOD_RES (127)..(141): Any amino acid
  MOD_RES (161)..(168): Any amino acid
  MOD_RES (194)..(194): Any amino acid
  MOD_RES (245)..(267): Any amino acid
  MOD_RES (285)..(286): Any amino acid
  MOD_RES (309)..(309): Any amino acid
  MOD_RES (332)..(334): Any amino acid
  MOD_RES (387)..(392): Any amino acid
  MOD_RES (411)..(436): Any amino acid
  MOD_RES (454)..(454): Any amino acid
MNPNQKLFTLSGVAIALSVLNLLIGVSNVGLNMSLHLXXXXXXXXXXXXXXXXXXXXXXXXENKYVNNTTIIXXXXXXXXXNYLLLNKSLCSVEGWVVIEKDNAVRFGESEQIVVTREPYVSCDPIXXXXXXXXXXXXXXXKHSNGTIHDRAAFRGLISTXXXXXXXXSNSEFICVGWSSTSCHDGVNRMTICXQGNNENATATVYYNGRLTTTIKTWAGNILRTQESECVCHNSTCVVVMTDGXXXXXXXXXXXXXXXXXXXXXXXLKGSARHIEEWSCYGHSXXVSCVCRDNWQGANRPIIEIDMSXMDHTSQYLCTGVLTDTSRPGDKXXXDCSNPITGSPCAPGVKGFGFLSGNNTWLGRTISPRSRNGFEMLKIPNAGIDPXXXXXXRQEIVDNKNWSGYSGSFIXXXXXXXXXXXXXXXXXXXXXXXXXXKYVWWTSNSLVALCGSPXPIGSGFFPDGPQIQYFS

SEQ ID NO: 420008 - protein, 471 aa, Influenza virus
  MOD_RES (1)..(5): Any amino acid
  MOD_RES (38)..(61): Any amino acid
  MOD_RES (73)..(82): Any amino acid
  MOD_RES (127)..(142): Any amino acid
  MOD_RES (161)..(171): Any amino acid
  MOD_RES (194)..(197): Any amino acid
  MOD_RES (226)..(227): Any amino acid
  MOD_RES (245)..(286): Any amino acid
  MOD_RES (309)..(309): Any amino acid
  MOD_RES (328)..(346): Any amino acid
  MOD_RES (387)..(392): Any amino acid
  MOD_RES (411)..(471): Any amino acid
XXXXXKLFASSGIAIALGIINLLIGISNIGLNVSLHLXXXXXXXXXXXXXXXXXXXXXXXXGNTYVNNTTVIXXXXXXXXXXYLMLNKSLCKIEGWVVVAKDNAIRFGESEQVIVTREPYVSCDPKXXXXXXXXXXXXXXXXHSNGTIHDRTTFRGLLSTXXXXXXXXXXXDFICVGWSSTTCHDGVSRMTICXXXXNDNATATVYYDRRLTTTVKTWAGNILRTXXSECVCHNGTCVVIMTDGXXXXXXXXXXXXXXXXXXXXXXXXXXXXXXXXXXXXXXXXXXVTCGCRDNWQGANRPVIEIDMSXLEHTSKYVCTGVLTDTSRXXXXXXXXXXXXXXXXXXXPGTKGFGFLNEDSTWLGRTISPRSRSGFEMLRIPNAGIDPXXXXXXRQEIVDNSNWSGYSGSFIXXXXXXXXXXXXXXXXXXXXXXXXXXXXXXXXXXXXXXXXXXXXXXXXXXXXXXXXXXXXX

SEQ ID NO: 420009 - protein, 471 aa, Influenza virus
  MOD_RES (1)..(18): Any amino acid
  MOD_RES (31)..(92): Any amino acid
  MOD_RES (116)..(148): Any amino acid
  MOD_RES (161)..(197): Any amino acid
  MOD_RES (209)..(216): Any amino acid
  MOD_RES (231)..(232): Any amino acid
  MOD_RES (245)..(315): Any amino acid
  MOD_RES (332)..(369): Any amino acid
  MOD_RES (381)..(399): Any amino acid
  MOD_RES (413)..(471): Any amino acid
XXXXXXXXXXXXXXXXXXVLNLLIGISNIGXXXXXXXXXXXXXXXXXXXXXXXXXXXXXXXXXXXXXXXXXXXXXXXXXXXXXXXXXXXXXXVEGWVVIAQDNAIRFGESEQIVVXXXXXXXXXXXXXXXXXXXXXXXXXXXXXXXXXHDRTTFRGLISTXXXXXXXXXXXXXXXXXXXXXXXXXXXXXXXXXXXXXNNNATATVYYNXXXXXXXXTWARNILRTQDSECXXHNGTCVVVMTDGXXXXXXXXXXXXXXXXXXXXXXXXXXXXXXXXXXXXXXXXXXXXXXXXXXXXXXXXXXXXXXXXXXXXXXXYICTGILTDTSRPGDRXXXXXXXXXXXXXXXXXXXXXXXXXXXXXXXXXXXXXXSRSGFEMLKIHXXXXXXXXXXXXXXXXXXXSNRSGYSGSFIDYXXXXXXXXXXXXXXXXXXXXXXXXXXXXXXXXXXXXXXXXXXXXXXXXXXXXXXXXXXX

SEQ ID NO: 420010 - protein, 471 aa, Influenza virus
  MOD_RES (1)..(94): Any amino acid
  MOD_RES (110)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGWVVIAKDNAIRFGEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420011 - protein, 567 aa, Influenza virus
  MOD_RES (1)..(9): Any amino acid
  MOD_RES (180)..(183): Any amino acid
  MOD_RES (325)..(325): Any amino acid
  MOD_RES (417)..(418): Any amino acid
XXXXXXXXXLLASTNAYDRICIGYQSNNSTDTVNTLIEQNVPVTQTMELVETEKHPAYCNTDLGTPLELRDCKIEAVIYGNPKCDIHLKDQGWSYIVERPSAPEGMCYPGSVENLEELRFVFSNAASYKRIRLFDYSRWNVTSSGTSKACNASTGGQSFYRSINWLTKKKPDTYDFNEGXXXXNNEDGDIIFLWGIHHPPDTKEQTTLYKNANTLSSVTTNTINRSFQPNIGPRPLVRGQQGRMDYYWGILKRGETLKIRTNGNLIAPEFGYLLKGESHGRIIQNEDIPIGNCHTKCQTYAGAINSSKPFQNASRHYMGECPKYXKKASLRLAVGLRNTPSIEPKGLFGAIAGFIEGGWSGMIDGWYGFHHSNSEGTGMAADQKSTQEAIDKITNKVNNIVDKMNREFEVVNHEFSXXEKRINMINDKIDDQIEDLWAYNAELLVLLENQKTLDEHDSNVKNLFDEVKRRLSANAIDAGNGCFDILHKCNNECMETIKNGTYNHKEYEEEAKLERSKINGVKLEENTTYKILSIYSTVAASLCLAILIAGGLILGMQNGSCRCMFCI

SEQ ID NO: 420012 - protein, 567 aa, Influenza virus
  MOD_RES (1)..(9): Any amino acid
  MOD_RES (180)..(183): Any amino acid
  MOD_RES (246)..(264): Any amino acid
  MOD_RES (325)..(325): Any amino acid
  MOD_RES (417)..(418): Any amino acid
XXXXXXXXXLLVSTNAYDRICIGYQSNNSTNTVNTLIEQKVPVTQTMELVEAEKHSAYCNTDLGAPLELRDCKIEAVIYGNPKCDVHLKDQSWSYIVERPSAPEGMCYPGFVENLEELRFVFSSAASYKRIRLFDYSKWNVTRSGTSKACNASTGAQSFYRSINWLTKKEPDTYDFNEGXXXXNNEDGNIIFLWGIHHPPNTKEQTALYKNANTLSSVNTNTINRSFQPNIGPRALVRGQQGRMDXXXXXXXXXXXXXXXXXXXLIAPEFGYLLRGESHGRTIQNEDIPIGNCNTKCQTYAGAVNSSKPFQNASRYYMGECPKYXKKESLRLAVGLRNTPSVEPKGLFGAIAGFIEGGWCGMIDGWYGFHHSNAEGTGMAADQKSTQEAIEKITNKVNNIVDKMNREFGVVNHEFSXXEKRINMISDKIDDQIENLWAYNAELLVLLENQKILDEHDSNVKNLFDEVRRRLSANAIDTGNGCFDILHKCDNECMETIKNGTYDHKEYEEEAKLEKSRINGVKLEENTSYKILSIYSTVAASLCLAVLIAGGLILGMQNGSYRCMFCI

SEQ ID NO: 420013 - protein, 567 aa, Influenza virus
  MOD_RES (1)..(9): Any amino acid
  MOD_RES (23)..(23): Any amino acid
  MOD_RES (183)..(183): Any amino acid
  MOD_RES (250)..(268): Any amino acid
  MOD_RES (325)..(325): Any amino acid
  MOD_RES (354)..(380): Any amino acid
  MOD_RES (417)..(418): Any amino acid
  MOD_RES (559)..(567): Any amino acid
XXXXXXXXXLLMSTNAYDRICIXYQSNNSTDTVDTLIEQNIPVTQTMELVETKKHPAYCNTDLGAPLELRDCKVEAVIYGNPKCDTHLKDQDWSYIVERPSAPEGMCYPGSIENLEELRFVFSIAASYKRIRLFDYSGWNVTSSGTSKACSASTGGQSFYRSINWLTKKKNPEAYNFNEGSYXNNEEGDIIFLWGIHHPPDAKEQTTLYKNANTLTSVTTNTINRNFQPNIGPRPLVREQQGRMDYYWGXXXXXXXXXXXXXXXXXXXEFGYLLKGESYGRIIQNEDIPIENCHTKCQTYTGAINSSKPLQNASRHYMGECPNYXRKASLRLAVGLRNTPSIDPKGLFGAIAGXXXXXXXXXXXXXXXXXXXXXXXXXXXADQKSTQEAIGKITNKVNNIVDKMNREFEVMNHEFSXXEKRTNMINDKIDDQIEGLWAYNAELLVLLENQKTLDKHDSNVKNLFDEVKRRLSTNAMDAGNGCFDILHKCDNKCMETIKNGTYNRKEYEEEAKLERSKINEVKLEENTTYRILSIYSTVAASLCLAILVAGGLILGMQNXXXXXXXXX

SEQ ID NO: 420014 - protein, 567 aa, Influenza virus
  MOD_RES (1)..(9): Any amino acid
  MOD_RES (21)..(26): Any amino acid
  MOD_RES (67)..(78): Any amino acid
  MOD_RES (100)..(120): Any amino acid
  MOD_RES (180)..(183): Any amino acid
  MOD_RES (254)..(269): Any amino acid
  MOD_RES (325)..(325): Any amino acid
  MOD_RES (356)..(380): Any amino acid
  MOD_RES (417)..(418): Any amino acid
  MOD_RES (441)..(450): Any amino acid
  MOD_RES (491)..(495): Any amino acid
  MOD_RES (533)..(567): Any amino acid
XXXXXXXXXILVSTNAYDRIXXXXXXNNSTDTVNTLMEQNVPVTQAMELVEAEKHLAYCNTDLGTPXXXXXXXXXXXXYGNPKCDIHLRDQGWSYIVERXXXXXXXXXXXXXXXXXXXXXVFSSAASYKRVRLFDYSRWNVSSSGTSKACNALTGGQSFYRSINWLTKKKPDIYDFNEGXXXXNNENGDIIFLWGIHHPPDETEQTKLYKNTNTLSSVTTNTINRIFQPNIGPRPLVRGQQGTMDYYWGILKRXXXXXXXXXXXXXXXXFGYLLKGESHCRIIQNEDIPIGSCYTKCQTYAGAINSSRPFQNASRHHMGECPKYXKKESLRLALGLRNTPSIEPRGLFGAIAGFIXXXXXXXXXXXXXXXXXXXXXXXXXADQKSTQEAINKITNKVNNIVDKMNREFEVVDHEFSXXEKKINMINDKINDQIEDLWAYNXXXXXXXXXXKTLDEHDSNVENLFDEVRRRLSTNAIDTGKGCFDILHKCDXXXXXTIKNGTYDHKDYEEEAKLERSKINGVILEENTTYKILXXXXXXXXXXXXXXXXXXXXXXXXXXXXXXXXXXX

SEQ ID NO: 420015 - protein, 567 aa, Influenza virus
  MOD_RES (1)..(9): Any amino acid
  MOD_RES (76)..(86): Any amino acid
  MOD_RES (103)..(131): Any amino acid
  MOD_RES (169)..(171): Any amino acid
  MOD_RES (183)..(183): Any amino acid
  MOD_RES (197)..(201): Any amino acid
  MOD_RES (213)..(217): Any amino acid
  MOD_RES (254)..(270): Any amino acid
  MOD_RES (292)..(292): Any amino acid
  MOD_RES (325)..(325): Any amino acid
  MOD_RES (345)..(386): Any amino acid
  MOD_RES (408)..(418): Any amino acid
  MOD_RES (446)..(462): Any amino acid
  MOD_RES (487)..(495): Any amino acid
  MOD_RES (533)..(567): Any amino acid
XXXXXXXXXLLASTNAHDRICIGYQSNNSTDTVNTLTEQNVPVTQTMELVETEKNPAYCNTDLGSPLELRDCKIEXXXXXXXXXXXHLKDQAWSYIVERPSAXXXXXXXXXXXXXXXXXXXXXXXXXXXXXRLFDYSKWNVSRSGTSKACNALTGGQAFYRSINWLTKXXXPDTYDFNEGSYXNNKDGDIIFLWGIXXXXXAKEQTALYKNAXXXXXVTTNTINRSFRPNIGPRPLVRGQQGWMDYYWGILKRXXXXXXXXXXXXXXXXXGYLLKGESHGKIIQNEDIPIGXCKTKCQTYAGAINSSKPFQNTSRHYMGECPEYXKKESLRLAIGLRNTPSIEPXXXXXXXXXXXXXXXXXXXXXXXXXXXXXXXXXXXXXXXXXXQEAIDKITNKINNIVDKMNREXXXXXXXXXXXEKRINVINDKIDDQIEELWAYNAELLVXXXXXXXXXXXXXXXXXLFDEVRRRLSVNAVDTGNGCFDILXXXXXXXXXTIKNGTYNHKDYEEEAKLERSKINGVRLEENTTYKILXXXXXXXXXXXXXXXXXXXXXXXXXXXXXXXXXXX

SEQ ID NO: 420016 - protein, 567 aa, Influenza virus
  MOD_RES (1)..(147): Any amino acid
  MOD_RES (164)..(171): Any amino acid
  MOD_RES (183)..(297): Any amino acid
  MOD_RES (310)..(334): Any amino acid
  MOD_RES (353)..(567): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKACNASTGGQAFYRSIXXXXXXXXPDTYDFNEGTYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQTYTGAINSSRPXXXXXXXXXXXXXXXXXXXXXXXXXGLRNTPSVEPRGLFGAIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420017 - protein, 567 aa, Influenza virus; identical to SEQ ID NO: 419558
  MOD_RES (1)..(171): Any amino acid
  MOD_RES (183)..(567): Any amino acid

SEQ ID NO: 420018 - protein, 567 aa, Influenza virus; identical to SEQ ID NO: 419559
  MOD_RES (1)..(171): Any amino acid
  MOD_RES (183)..(567): Any amino acid

SEQ ID NO: 420019 - protein, 562 aa, Influenza virus
  MOD_RES (13)..(77): Any amino acid
  MOD_RES (89)..(246): Any amino acid
  MOD_RES (258)..(339): Any amino acid
  MOD_RES (372)..(425): Any amino acid
  MOD_RES (452)..(471): Any amino acid
  MOD_RES (485)..(521): Any amino acid
  MOD_RES (538)..(562): Any amino acid
RWKHVTNTILLVXXXXXXXXXXXXXXXXXXXXXXXXXXXXXXXXXXXXXXXXXXXXXXXXXXXXXXXXXXXXXXXXXEGLIYGNPSCDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKPGQTLRIRSXXXXXXXXXXXXXXXXXXXXXXXXXXXXXXXXXXXXXXXXXXXXXXXXXXXXXXXXXXXXXXXXXXXXXXXXXXXXXXXXXXRGLFGAIAGFIEGGWSGLVAGWYGFQHSNDQGXXXXXXXXXXXXXXXXXXXXXXXXXXXXXXXXXXXXXXXXXXXXXXXXXXXXXXDQIQDIWAYNAELLVLLENQKTLDEHXXXXXXXXXXXXXXXXXXXXEDGKGCFELYHKCXXXXXXXXXXXXXXXXXXXXXXXXXXXXXXXXXXXXXGTYKILTIYSTVASSLXXXXXXXXXXXXXXXXXXXXXXXXX

SEQ ID NO: 420020 - protein, 562 aa, Influenza virus
  MOD_RES (1)..(77): Any amino acid
  MOD_RES (89)..(246): Any amino acid
  MOD_RES (258)..(339): Any amino acid
  MOD_RES (372)..(425): Any amino acid
  MOD_RES (452)..(471): Any amino acid
  MOD_RES (485)..(521): Any amino acid
  MOD_RES (537)..(562): Any amino acid
XXXXXXXXXXXXXXXXXXXXXXXXXXXXXXXXXXXXXXXXXXXXXXXXXXXXXXXXXXXXXXXXXXXXXXXXXXXXXEGLVYGNPSCDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKPGQTLRVRSXXXXXXXXXXXXXXXXXXXXXXXXXXXXXXXXXXXXXXXXXXXXXXXXXXXXXXXXXXXXXXXXXXXXXXXXXXXXXXXXXXRGIFGAIAGFIEGGWPGLVAGWYGFQHTNDQGXXXXXXXXXXXXXXXXXXXXXXXXXXXXXXXXXXXXXXXXXXXXXXXXXXXXXXDQIQDVWAYNAELLVLIENQKTLDEHXXXXXXXXXXXXXXXXXXXXEDGNGCFELYHKCXXXXXXXXXXXXXXXXXXXXXXXXXXXXXXXXXXXXXGIYKILTIYSTVASPXXXXXXXXXXXXXXXXXXXXXXXXXX

SEQ ID NO: 420021 - protein, 562 aa, Influenza virus
  MOD_RES (1)..(77): Any amino acid
  MOD_RES (89)..(246): Any amino acid
  MOD_RES (258)..(345): Any amino acid
  MOD_RES (372)..(425): Any amino acid
  MOD_RES (452)..(471): Any amino acid
  MOD_RES (485)..(521): Any amino acid
  MOD_RES (538)..(562): Any amino acid
XXXXXXXXXXXXXXXXXXXXXXXXXXXXXXXXXXXXXXXXXXXXXXXXXXXXXXXXXXXXXXXXXXXXXXXXXXXXXEGLVYGNPACDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKPGQTLRVKSXXXXXXXXXXXXXXXXXXXXXXXXXXXXXXXXXXXXXXXXXXXXXXXXXXXXXXXXXXXXXXXXXXXXXXXXXXXXXXXXXXXXXXXXISGFIEGGWPGLIAGWYGFQHSNAQGXXXXXXXXXXXXXXXXXXXXXXXXXXXXXXXXXXXXXXXXXXXXXXXXXXXXXXDQIQNIWAYNAELLVLLGNQKTLDEHXXXXXXXXXXXXXXXXXXXXEDGKGCFDLYHKCXXXXXXXXXXXXXXXXXXXXXXXXXXXXXXXXXXXXXETYKILTIYSTAASSLXXXXXXXXXXXXXXXXXXXXXXXXX

SEQ ID NO: 420022 - protein, 562 aa, Influenza virus
  MOD_RES (1)..(77): Any amino acid
  MOD_RES (89)..(246): Any amino acid
  MOD_RES (258)..(347): Any amino acid
  MOD_RES (372)..(425): Any amino acid
  MOD_RES (452)..(471): Any amino acid
  MOD_RES (483)..(521): Any amino acid
  MOD_RES (538)..(562): Any amino acid
XXXXXXXXXXXXXXXXXXXXXXXXXXXXXXXXXXXXXXXXXXXXXXXXXXXXXXXXXXXXXXXXXXXXXXXXXXXXXEGLIYGNPSCNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLRPGQTLRVRSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGFIEGGWSGLIAGWYGFQHSNEQGXXXXXXXXXXXXXXXXXXXXXXXXXXXXXXXXXXXXXXXXXXXXXXXXXXXXXXDQIQDLWAYNAELLVLLENQKPLDEHXXXXXXXXXXXXXXXXXXXXENGNGCFELYHXXXXXXXXXXXXXXXXXXXXXXXXXXXXXXXXXXXXXXXGAYKILTIYSTVASSIXXXXXXXXXXXXXXXXXXXXXXXXX

SEQ ID NO: 420023 - protein, 562 aa, Influenza virus
  MOD_RES (1)..(77): Any amino acid
  MOD_RES (89)..(246): Any amino acid
  MOD_RES (258)..(348): Any amino acid
  MOD_RES (362)..(425): Any amino acid
  MOD_RES (452)..(471): Any amino acid
  MOD_RES (483)..(521): Any amino acid
  MOD_RES (538)..(562): Any amino acid
XXXXXXXXXXXXXXXXXXXXXXXXXXXXXXXXXXXXXXXXXXXXXXXXXXXXXXXXXXXXXXXXXXXXXXXXXXXXXEGLIYGNPFCDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKPGQTLRIISXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFIEGGWSGLVDGWXXXXXXXXXXXXXXXXXXXXXXXXXXXXXXXXXXXXXXXXXXXXXXXXXXXXXXXXXXXXXXXXDRIQDIWAYNAELLVLLENQKILDEHXXXXXXXXXXXXXXXXXXXXEDGKGWFELYHXXXXXXXXXXXXXXXXXXXXXXXXXXXXXXXXXXXXXXXGIYKILSIYSTVASSLXXXXXXXXXXXXXXXXXXXXXXXXX

SEQ ID NO: 420024 - protein, 562 aa, Influenza virus
  MOD_RES (1)..(473): Any amino acid
  MOD_RES (485)..(522): Any amino acid
  MOD_RES (538)..(562): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGKGCFELYHRCXXXXXXXXXXXXXXXXXXXXXXXXXXXXXXXXXXXXXXTHKILTIYSTVASSFXXXXXXXXXXXXXXXXXXXXXXXXX

SEQ ID NO: 420025 - protein, 562 aa, Influenza virus
  MOD_RES (1)..(473): Any amino acid
  MOD_RES (485)..(562): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGKGCFELYHECXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420026 - protein, 562 aa, Influenza virus; identical to SEQ ID NO: 420019
  MOD_RES (13)..(77): Any amino acid
  MOD_RES (89)..(246): Any amino acid
  MOD_RES (258)..(339): Any amino acid
  MOD_RES (372)..(425): Any amino acid
  MOD_RES (452)..(471): Any amino acid
  MOD_RES (485)..(521): Any amino acid
  MOD_RES (538)..(562): Any amino acid

SEQ ID NO: 420027 - protein, 562 aa, Influenza virus
  MOD_RES (1)..(77): Any amino acid
  MOD_RES (89)..(246): Any amino acid
  MOD_RES (258)..(340): Any amino acid
  MOD_RES (372)..(425): Any amino acid
  MOD_RES (452)..(471): Any amino acid
  MOD_RES (485)..(521): Any amino acid
  MOD_RES (537)..(562): Any amino acid
XXXXXXXXXXXXXXXXXXXXXXXXXXXXXXXXXXXXXXXXXXXXXXXXXXXXXXXXXXXXXXXXXXXXXXXXXXXXXEGLVYGNPSCDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKPGQTLRVRSXXXXXXXXXXXXXXXXXXXXXXXXXXXXXXXXXXXXXXXXXXXXXXXXXXXXXXXXXXXXXXXXXXXXXXXXXXXXXXXXXXXGIFGAIAGFIEGGWPGLVAGWYGFQHTNDQGXXXXXXXXXXXXXXXXXXXXXXXXXXXXXXXXXXXXXXXXXXXXXXXXXXXXXXDQIQDVWAYNAELLVLIENQKTLDEHXXXXXXXXXXXXXXXXXXXXEDGNGCFELYHKCXXXXXXXXXXXXXXXXXXXXXXXXXXXXXXXXXXXXXGIYKILTIYSTVASPXXXXXXXXXXXXXXXXXXXXXXXXXX

SEQ ID NO: 420028 - protein, 562 aa, Influenza virus; identical to SEQ ID NO: 420021
  MOD_RES (1)..(77): Any amino acid
  MOD_RES (89)..(246): Any amino acid
  MOD_RES (258)..(345): Any amino acid
  MOD_RES (372)..(425): Any amino acid
  MOD_RES (452)..(471): Any amino acid
  MOD_RES (485)..(521): Any amino acid
  MOD_RES (538)..(562): Any amino acid

SEQ ID NO: 420029 - protein, 562 aa, Influenza virus; identical to SEQ ID NO: 420022
  MOD_RES (1)..(77): Any amino acid
  MOD_RES (89)..(246): Any amino acid
  MOD_RES (258)..(347): Any amino acid
  MOD_RES (372)..(425): Any amino acid
  MOD_RES (452)..(471): Any amino acid
  MOD_RES (483)..(521): Any amino acid
  MOD_RES (538)..(562): Any amino acid

SEQ ID NO: 420030 - protein, 562 aa, Influenza virus
  MOD_RES (1)..(77): Any amino acid
  MOD_RES (89)..(246): Any amino acid
  MOD_RES (258)..(350): Any amino acid
  MOD_RES (362)..(425): Any amino acid
  MOD_RES (437)..(437): Any amino acid
  MOD_RES (449)..(471): Any amino acid
  MOD_RES (483)..(521): Any amino acid
  MOD_RES (538)..(562): Any amino acid
XXXXXXXXXXXXXXXXXXXXXXXXXXXXXXXXXXXXXXXXXXXXXXXXXXXXXXXXXXXXXXXXXXXXXXXXXXXXXEGLIYGNPFCDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKPGQTLRIISXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEGGWSGLVDGWXXXXXXXXXXXXXXXXXXXXXXXXXXXXXXXXXXXXXXXXXXXXXXXXXXXXXXXXXXXXXXXXDRIQDIWAYNAXLLVMLENQKTLXXXXXXXXXXXXXXXXXXXXXXXEDGKGWFELYHXXXXXXXXXXXXXXXXXXXXXXXXXXXXXXXXXXXXXXXGIYKILSIYSTVASSLXXXXXXXXXXXXXXXXXXXXXXXXX

SEQ ID NO: 420031 - protein, 562 aa, Influenza virus
  MOD_RES (1)..(438): Any amino acid
  MOD_RES (450)..(473): Any amino acid
  MOD_RES (485)..(522): Any amino acid
  MOD_RES (538)..(562): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLVLLETKKKLDXXXXXXXXXXXXXXXXXXXXXXXXGKGCFELYHRCXXXXXXXXXXXXXXXXXXXXXXXXXXXXXXXXXXXXXXTHKILTIYSTVASSFXXXXXXXXXXXXXXXXXXXXXXXXX

SEQ ID NO: 420032 - protein, 562 aa, Influenza virus
  MOD_RES (1)..(439): Any amino acid
  MOD_RES (451)..(473): Any amino acid
  MOD_RES (485)..(562): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLLENQKTLDDXXXXXXXXXXXXXXXXXXXXXXXGKGCFELYHECXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420033 - protein, 562 aa, Influenza virus
  MOD_RES (1)..(440): Any amino acid
  MOD_RES (452)..(562): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLENQKALDEHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420034 - protein, 473 aa, Influenza virus
  MOD_RES (1)..(8): Any amino acid
  MOD_RES (20)..(51): Any amino acid
  MOD_RES (65)..(132): Any amino acid
  MOD_RES (145)..(157): Any amino acid
  MOD_RES (173)..(176): Any amino acid
  MOD_RES (195)..(225): Any amino acid
  MOD_RES (237)..(273): Any amino acid
  MOD_RES (287)..(293): Any amino acid
  MOD_RES (306)..(319): Any amino acid
  MOD_RES (333)..(420): Any amino acid
  MOD_RES (436)..(456): Any amino acid
  MOD_RES (468)..(473): Any amino acid
XXXXXXXXIAIGSVSRTIAXXXXXXXXXXXXXXXXXXXXXXXXXXXXXXXXVPLVPCEPIIIERXXXXXXXXXXXXXXXXXXXXXXXXXXXXXXXXXXXXXXXXXXXXXXXXXXXXXXXXXXXXXXXXXXXXCYQFALGQGTTLXXXXXXXXXXXXXPHRTLLMNELGVPFHXXXXQVCIAWSSSSCHDGKAWLXXXXXXXXXXXXXXXXXXXXXXXXXXXXXXXILRTQESECVCXXXXXXXXXXXXXXXXXXXXXXXXXXXXXXXXXXXXXGSAQHVEECSCYPXXXXXXXVCRDNWKGSNRPXXXXXXXXXXXXXXYVCSGLVGDTPRNXXXXXXXXXXXXXXXXXXXXXXXXXXXXXXXXXXXXXXXXXXXXXXXXXXXXXXXXXXXXXXXXXXXXXXXXXXXXXXXXXXXXXXXXCINRCFYVELIRGRPXXXXXXXXXXXXXXXXXXXXXYGTGSWPDGANXXXXXX

SEQ ID NO: 420035 - protein, 473 aa, Influenza virus
  MOD_RES (1)..(132): Any amino acid
  MOD_RES (145)..(157): Any amino acid
  MOD_RES (173)..(176): Any amino acid
  MOD_RES (195)..(225): Any amino acid
  MOD_RES (237)..(273): Any amino acid
  MOD_RES (287)..(293): Any amino acid
  MOD_RES (306)..(319): Any amino acid
  MOD_RES (333)..(420): Any amino acid
  MOD_RES (436)..(456): Any amino acid
  MOD_RES (468)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCYQFALGHGTTLXXXXXXXXXXXXXPYRTLLMSELGVPFHXXXXQVCMAWSSSSCHDGRAWLXXXXXXXXXXXXXXXXXXXXXXXXXXXXXXXILRTQESECICXXXXXXXXXXXXXXXXXXXXXXXXXXXXXXXXXXXXXGSAQHIEECSCYPXXXXXXXVCRDNWRGSNRPXXXXXXXXXXXXXXYLCSGLVGDTPRSXXXXXXXXXXXXXXXXXXXXXXXXXXXXXXXXXXXXXXXXXXXXXXXXXXXXXXXXXXXXXXXXXXXXXXXXXXXXXXXXXXXXXXXXCVNRCFYVELIRGKPXXXXXXXXXXXXXXXXXXXXXYGTGSWPDGADXXXXXX

SEQ ID NO: 420036 - protein, 473 aa, Influenza virus
  MOD_RES (1)..(132): Any amino acid
  MOD_RES (145)..(157): Any amino acid
  MOD_RES (170)..(176): Any amino acid
  MOD_RES (195)..(225): Any amino acid
  MOD_RES (237)..(273): Any amino acid
  MOD_RES (286)..(293): Any amino acid
  MOD_RES (306)..(319): Any amino acid
  MOD_RES (331)..(420): Any amino acid
  MOD_RES (436)..(456): Any amino acid
  MOD_RES (468)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCYQFALGQGATLXXXXXXXXXXXXXPHRTLLMSELGVXXXXXXXQVCIAWSSASCHDGRAWLXXXXXXXXXXXXXXXXXXXXXXXXXXXXXXXILITQESECVCXXXXXXXXXXXXXXXXXXXXXXXXXXXXXXXXXXXXXGGAQHVEECSCYXXXXXXXXVYRDNWKGSNRPXXXXXXXXXXXXXXYLCSGLVADTPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCINRCFYVELVRGRPXXXXXXXXXXXXXXXXXXXXXYGAGSWPDGANXXXXXX

SEQ ID NO: 420037 - protein, 473 aa, Influenza virus
  MOD_RES (1)..(132): Any amino acid
  MOD_RES (145)..(157): Any amino acid
  MOD_RES (169)..(177): Any amino acid
  MOD_RES (195)..(225): Any amino acid
  MOD_RES (237)..(273): Any amino acid
  MOD_RES (286)..(293): Any amino acid
  MOD_RES (305)..(321): Any amino acid
  MOD_RES (333)..(421): Any amino acid
  MOD_RES (436)..(456): Any amino acid
  MOD_RES (468)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCNQFALGQGTTLXXXXXXXXXXXXXSYRTLLMSELGXXXXXXXXXVCIAWSSSSCYDGKAWLXXXXXXXXXXXXXXXXXXXXXXXXXXXXXXXILRTQESECVSXXXXXXXXXXXXXXXXXXXXXXXXXXXXXXXXXXXXXGNAQHVEECSCYXXXXXXXXVCRDNWRGFNRXXXXXXXXXXXXXXXXXCSGLVGDTPRDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXINRCFYVELTRGRPXXXXXXXXXXXXXXXXXXXXXHGTGSWPDGANXXXXXX

SEQ ID NO: 420038 - protein, 473 aa, Influenza virus
  MOD_RES (1)..(157): Any amino acid
  MOD_RES (170)..(183): Any amino acid
  MOD_RES (195)..(225): Any amino acid
  MOD_RES (237)..(273): Any amino acid
  MOD_RES (287)..(293): Any amino acid
  MOD_RES (305)..(321): Any amino acid
  MOD_RES (333)..(456): Any amino acid
  MOD_RES (468)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPHRTLLMNEIGVXXXXXXXXXXXXXXSSSCHDGKEWLXXXXXXXXXXXXXXXXXXXXXXXXXXXXXXXILRTQESDCVCXXXXXXXXXXXXXXXXXXXXXXXXXXXXXXXXXXXXXGSAKHVEECSCYPXXXXXXXVCWDNWRGSNRXXXXXXXXXXXXXXXXXCSGLVGDTPRTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYGTGSWADGANXXXXXX

SEQ ID NO: 420039 - protein, 473 aa, Influenza virus
  MOD_RES (1)..(158): Any amino acid
  MOD_RES (173)..(321): Any amino acid
  MOD_RES (333)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHRTLLMNELGIPFHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCSGLVGDTPRGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420040 - protein, 473 aa, Influenza virus
  MOD_RES (1)..(160): Any amino acid
  MOD_RES (173)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTLLMNELGVPLHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420041 - protein, 473 aa, Influenza virus
  MOD_RES (1)..(161): Any amino acid
  MOD_RES (173)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLMNELGGPFHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420042 - protein, 275 aa, Influenza virus
  MOD_RES (143)..(145): Any amino acid
  MOD_RES (169)..(169): Any amino acid
  MOD_RES (210)..(235): Any amino acid
  MOD_RES (266)..(275): Any amino acid
MLKMSLLTEVETYVLSIVPSGPLKAEIAQRLEDVFAGKNTDLEALMEWLKTRPILSPLTKGILGFVFTLTVPSERGLQRRRFVQNALNGNGDPNNMDRAVKLYRKLKREITFHGAKEVALSYSTGALASCMGLIYNRMGTVTXXXAFGLVCATCEQIADSQHRSHRQMXTTTNPLIRHENRMVLASTTAKAMEQMAGSSEQAAEAMEVAXXXXXXXXXXXXXXXXXXXXXXXXXXLLENLQAYQKRMGVQMQRFRRPDSSWLFGGXXXXXXXXXX

SEQ ID NO: 420043 - protein, 275 aa, Influenza virus
  MOD_RES (1)..(4): Any amino acid
  MOD_RES (51)..(51): Any amino acid
  MOD_RES (143)..(145): Any amino acid
  MOD_RES (169)..(169): Any amino acid
  MOD_RES (210)..(235): Any amino acid
  MOD_RES (254)..(256): Any amino acid
XXXXSQLTEVETYVLSVIPSGPLKAEIAQKLEDVFAGKNADLEALMEWLKXRPILSPLTKGMLGFVFTLTVPSERGLQRRRFIQNALNGNGDPSNMDRAVKLYKKLKREITFHGAKEIALSYSAGALASCMGLIYNRMGAVTXXXAFGLICATCEQIADSHHRSHRQMXATTNPLIKHENRMVLASTTAKAMEQVAGSSEQAAEAIEVAXXXXXXXXXXXXXXXXXXXXXXXXXXLLENLQTYQKRMGVQMHRXXXSSRHCSKYHWNLALDIVDS

SEQ ID NO: 420044 - protein, 275 aa, Influenza virus
  MOD_RES (1)..(7): Any amino acid
  MOD_RES (51)..(55): Any amino acid
  MOD_RES (70)..(77): Any amino acid
  MOD_RES (99)..(99): Any amino acid
  MOD_RES (130)..(130): Any amino acid
  MOD_RES (143)..(145): Any amino acid
  MOD_RES (169)..(169): Any amino acid
  MOD_RES (210)..(235): Any amino acid
  MOD_RES (254)..(275): Any amino acid
XXXXXXXTEVETYVLSIIPSGPLKAEIAQRLESVFAGKNSDLEALMEWLKXXXXXSSLTKGVLGFVFTLXXXXXXXXQRRRFVQNALSGNGDPNNMDRXVKLYKKLKREMTFHGAKEVSLSYSTGALASXMGLIYNRMGTITXXXALGLVCATCEQIADAQHRSHRQMXTITNPLIRHENRMVIASTTAKAMEQIAGSSEQAAEAMDIAXXXXXXXXXXXXXXXXXXXXXXXXXXLIENLQAYQKRMGLQMQRXXXXXXXXXXXXXXXXXXXXXX

SEQ ID NO: 420045 - protein, 275 aa, Influenza virus
  MOD_RES (1)..(22): Any amino acid
  MOD_RES (51)..(87): Any amino acid
  MOD_RES (115)..(118): Any amino acid
  MOD_RES (143)..(152): Any amino acid
  MOD_RES (169)..(169): Any amino acid
  MOD_RES (181)..(193): Any amino acid
  MOD_RES (210)..(235): Any amino acid
  MOD_RES (254)..(275): Any amino acid
XXXXXXXXXXXXXXXXXXXXXXLKAEIAQRLEGVFAGKNTDLEVLMEWLKXXXXXXXXXXXXXXXXXXXXXXXXXXXXXXXXXXXXXNGNGDPNNMDKAVKLYRKLKREMTFHGXXXXALGYSTGALASCMGLIYNRMGTVAXXXXXXXXXXTCEQIADSQHKSHRQMXATTNPLIRHENXXXXXXXXXXXXXQMAGSNEQAAEAMEVAXXXXXXXXXXXXXXXXXXXXXXXXXXLLDNLQAYQKRMGVQLQRXXXXXXXXXXXXXXXXXXXXXX

SEQ ID NO: 420046 - protein, 275 aa, Influenza virus
  MOD_RES (1)..(22): Any amino acid
  MOD_RES (60)..(90): Any amino acid
  MOD_RES (130)..(131): Any amino acid
  MOD_RES (143)..(198): Any amino acid
  MOD_RES (210)..(236): Any amino acid
  MOD_RES (249)..(275): Any amino acid
XXXXXXXXXXXXXXXXXXXXXXLKAEIAQRLENVFAGKNTDLEALMEWIKTRPILSPLTXXXXXXXXXXXXXXXXXXXXXXXXXXXXXXXGDPNNMARAVKLYKKLKREITFYGAKEISLSYSAGALASXXGLIYNRMGTVNXXXXXXXXXXXXXXXXXXXXXXXXXXXXXXXXXXXXXXXXXXXXXXXXXXXXXXXXSEQAAEAMEIAXXXXXXXXXXXXXXXXXXXXXXXXXXXLENLQAYQNRMGXXXXXXXXXXXXXXXXXXXXXXXXXXX

SEQ ID NO: 420047 - protein, 275 aa, Influenza virus
  MOD_RES (1)..(33): Any amino acid
  MOD_RES (47)..(91): Any amino acid
  MOD_RES (104)..(107): Any amino acid
  MOD_RES (119)..(240): Any amino acid
  MOD_RES (254)..(275): Any amino acid
XXXXXXXXXXXXXXXXXXXXXXXXXXXXXXXXXVFSGKNTDLEALMXXXXXXXXXXXXXXXXXXXXXXXXXXXXXXXXXXXXXXXXXXXXXDPNNIDRAVKLYXXXXREITFHRAKEVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQAYQKRMGVQIQRXXXXXXXXXXXXXXXXXXXXXX

SEQ ID NO: 420048 - protein, 275 aa, Influenza virus
  MOD_RES (1)..(94): Any amino acid
  MOD_RES (109)..(275): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNMDKAVKLYKKLKRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420049 - protein, 99 aa, Influenza virus
  MOD_RES (1)..(9): Any amino acid
  MOD_RES (21)..(88): Any amino acid
XXXXXXXXXRPTRNGWGCKCXXXXXXXXXXXXXXXXXXXXXXXXXXXXXXXXXXXXXXXXXXXXXXXXXXXXXXXXXXXXXXXXXXXXDDHFVSIELEG

SEQ ID NO: 420050 - protein, 99 aa, Influenza virus
  MOD_RES (1)..(88): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXDGHFVNIELED

SEQ ID NO: 420051 - protein, 527 aa, Influenza virus
  MOD_RES (33)..(50): Any amino acid
  MOD_RES (67)..(69): Any amino acid
  MOD_RES (116)..(146): Any amino acid
  MOD_RES (304)..(306): Any amino acid
  MOD_RES (328)..(338): Any amino acid
  MOD_RES (366)..(379): Any amino acid
  MOD_RES (393)..(399): Any amino acid
  MOD_RES (421)..(428): Any amino acid
  MOD_RES (445)..(455): Any amino acid
  MOD_RES (480)..(480): Any amino acid
  MOD_RES (497)..(507): Any amino acid
SKSRVDNHSMSDIEAMASQGTKRSYEQMETGGXXXXXXXXXXXXXXXXXXGIGRFYIQMCTELKLSXXXGRLIQNSITIERMVLSAFDERRNKYLEEHPSAGKDPKKTGGPIYRRXXXXXXXXXXXXXXXXXXXXXXXXXXXXXXXAGLTHIMIWHSNLNDATYQRTRALVRTGMDPRMCSLMQGSTLPRRSGAAGAAVKGVGTMVMELIRMIKRGINDRNFWRGENGRRTRIAYERMCNILKGKFQTAAQRRAMMDQVRESRNPGNAEIEDLIFLARSALILRGSVAVAHKSCLPACVYGLAXXXGYDFEREGYSLVGIDPFKLLQXXXXXXXXXXXRPNENPAHKSQLVWMACHSAAFEDLRVXXXXXXXXXXXXXXLSTRGVQIASNENXXXXXXXTLELRSRYWAIRTRSGGNTNQXXXXXXXXSVQPTFSVQRNLPFERXXXXXXXXXXXEGRTSDMRTEIIEIIIRMMENARPXDVSFQGRGVFELSDEKXXXXXXXXXXXMSNEGSYFFGDNAEEYRRLR

SEQ ID NO: 420052 - protein, 527 aa, Influenza virus
  MOD_RES (1)..(9): Any amino acid
  MOD_RES (33)..(50): Any amino acid
  MOD_RES (67)..(69): Any amino acid
  MOD_RES (116)..(146): Any amino acid
  MOD_RES (184)..(188): Any amino acid
  MOD_RES (304)..(306): Any amino acid
  MOD_RES (328)..(338): Any amino acid
  MOD_RES (366)..(379): Any amino acid
  MOD_RES (393)..(399): Any amino acid
  MOD_RES (421)..(428): Any amino acid
  MOD_RES (445)..(455): Any amino acid
  MOD_RES (468)..(480): Any amino acid
  MOD_RES (497)..(507): Any amino acid
  MOD_RES (524)..(527): Any amino acid
XXXXXXXXXMSDINIMASQGTKRSYEQMETDGXXXXXXXXXXXXXXXXXXGIGRFYVQMCTELKLNXXXGRLIQNSLTIEKMVLSAFDERRNRYLEEHPSAGRDPKKTGGPIYKRXXXXXXXXXXXXXXXXXXXXXXXXXXXXXXXAGLTHLMIWHSNLNDATYQRTRALVRSGMDPRMCSLMXXXXXPRRSGAAGAAIKGVGTMAMELIRMIKRGVNDRNFWRGENGRKTRVAYERMCNILKGKFQTAAQKRAMVDQVRESRNPGNAEIEDLTFLARSALILRGAVAVAHKSCLPACAYGPAXXXGHDFEREGYSLVGVDPFKLLQXXXXXXXXXXXRSNENPAHKSQLIWMACHSAAFEDLRLXXXXXXXXXXXXXXLSTRGVQVASNENXXXXXXXTLELRSGYWAIRTRSGGNTSQXXXXXXXXSTQPTFSVQRNLPFDKXXXXXXXXXXXEGRTSDMRAEIIXXXXXXXXXXXXXDLSFQGRGVFELSDERXXXXXXXXXXXMNNEGSYFFGDNAKEYXXXX

SEQ ID NO: 420053 - protein, 527 aa, Influenza virus
  MOD_RES (1)..(9): Any amino acid
  MOD_RES (37)..(50): Any amino acid
  MOD_RES (67)..(69): Any amino acid
  MOD_RES (81)..(89): Any amino acid
  MOD_RES (116)..(146): Any amino acid
  MOD_RES (173)..(191): Any amino acid
  MOD_RES (304)..(306): Any amino acid
  MOD_RES (328)..(338): Any amino acid
  MOD_RES (366)..(379): Any amino acid
  MOD_RES (393)..(399): Any amino acid
  MOD_RES (421)..(428): Any amino acid
  MOD_RES (445)..(455): Any amino acid
  MOD_RES (468)..(480): Any amino acid
  MOD_RES (496)..(507): Any amino acid
  MOD_RES (523)..(527): Any amino acid
XXXXXXXXXMSDIGAMASQGTKRSFSEQMETGGERQXXXXXXXXXXXXXXGIGKFYIQMCTELKLNXXXGRLIQNSMTIEXXXXXXXXXRRNKYLEEHPNAGKDPKKTGGPIYKKXXXXXXXXXXXXXXXXXXXXXXXXXXXXXXXAGLTHMMIWHSNLNDTTYQRTRALVRXXXXXXXXXXXXXXXXXXXSGAAGAAVKGIGTMVMELIRMVKRGINDRNFWRGDNGRRTRSAYERMCNILKKGKFQTAAQRAMMDQVRESRSPGNAEIEDLIFSARSALILRGSIAIAHKSCLPACVYGPAXXXGYDFEKEGYSLVGIDPFRLLQXXXXXXXXXXXRPKENPAHKSQLVWMACNSAAFEDLRVXXXXXXXXXXXXXXLSTRGIQIASNENXXXXXXXTLELRSKYWAIRTRSGGNNNQXXXXXXXXSIQPTFSVQRNLPFEKXXXXXXXXXXXEGRTSDMRTEVIXXXXXXXXXXXXXEVSFRGRGVFELSDEXXXXXXXXXXXXMSKEGSYFFGDNAEDXXXXX

SEQ ID NO: 420054 - protein, 527 aa, Influenza virus
  MOD_RES (1)..(9): Any amino acid
  MOD_RES (33)..(53): Any amino acid
  MOD_RES (67)..(69): Any amino acid
  MOD_RES (81)..(89): Any amino acid
  MOD_RES (109)..(146): Any amino acid
  MOD_RES (163)..(194): Any amino acid
  MOD_RES (218)..(230): Any amino acid
  MOD_RES (264)..(265): Any amino acid
  MOD_RES (304)..(306): Any amino acid
  MOD_RES (328)..(338): Any amino acid
  MOD_RES (366)..(379): Any amino acid
  MOD_RES (392)..(407): Any amino acid
  MOD_RES (421)..(428): Any amino acid
  MOD_RES (444)..(462): Any amino acid
  MOD_RES (474)..(480): Any amino acid
  MOD_RES (497)..(507): Any amino acid
  MOD_RES (524)..(527): Any amino acid
XXXXXXXXXMSDIEIMASQGTKRSHEQMETGGXXXXXXXXXXXXXXXXXXXXXRFYIQMCTELQLSXXXGRLVQNSITIEXXXXXXXXXRRNRYLEENPSAGKDPKKTXXXXXXXXXXXXXXXXXXXXXXXXXXXXXXXXXXXXXXSGLTHIMIWHSNLNDTXXXXXXXXXXXXXXXXXXXXXXXXXXXXXXXXAGAAVKGVGTIVLELIRMIKRGIXXXXXXXXXXXXXTRTAYERMCNILKKGKFQTAAQKAMMDQVRESRXXGNAEIEDLIFMARSALILRGSGSVAHKSCLPACIYGLVXXXGYNFEKEGYSLVGVDPFRLLQXXXXXXXXXXXRPNENPVHKSQLIWMACHSAAFEDLRIXXXXXXXXXXXXXXLATRGVQIASNEXXXXXXXXXXXXXXXXWAIRTKSGGNTNQXXXXXXXXSVQPAFSVQRNLPFDXXXXXXXXXXXXXXXXXXXRRAEIIKMESAXXXXXXXEVSFQGRGVFEFSDERXXXXXXXXXXXISNEGSYFFGDSAEEYXXXX

SEQ ID NO: 420055 - protein, 527 aa, Influenza virus
  MOD_RES (1)..(11): Any amino acid
  MOD_RES (33)..(55): Any amino acid
  MOD_RES (67)..(69): Any amino acid
  MOD_RES (90)..(90): Any amino acid
  MOD_RES (112)..(151): Any amino acid
  MOD_RES (163)..(194): Any amino acid
  MOD_RES (221)..(230): Any amino acid
  MOD_RES (244)..(245): Any amino acid
  MOD_RES (263)..(266): Any amino acid
  MOD_RES (304)..(320): Any amino acid
  MOD_RES (334)..(340): Any amino acid
  MOD_RES (356)..(379): Any amino acid
  MOD_RES (392)..(409): Any amino acid
  MOD_RES (421)..(428): Any amino acid
  MOD_RES (445)..(466): Any amino acid
  MOD_RES (478)..(480): Any amino acid
  MOD_RES (493)..(510): Any amino acid
  MOD_RES (524)..(527): Any amino acid
XXXXXXXXXXXDIEAMATQGTKRSYEQMETSGXXXXXXXXXXXXXXXXXXXXXXXYVQMCTELKLSXXXGRLIQNSITVERMVLSAFDEXRNKYLEEHPSTGKDPKKTGGPXXXXXXXXXXXXXXXXXXXXXXXXXXXXXXXXXXXXXXXXMMIWHSNLNDAXXXXXXXXXXXXXXXXXXXXXXXXXXXXXXXXAGAAIKGIGTMVMELVRMIKRGINDRXXXXXXXXXXTRGAYERMCNILKXXKFQTAAQRAMVDQVRESXXXXNAEIEDLIFLTRSASALILRGSVAHKSCLPACVYGLVXXXXXXXXXXXXXXXXXDPDPFRLLQNSQVXXXXXXXNENPVHKSQLVWMACXXXXXXXXXXXXXXXXXXXXXXXXLTTRGVQIASNEXXXXXXXXXXXXXXXXXXIRTRSGGNTNHXXXXXXXXSVQPTFSVQRSLPFERXXXXXXXXXXXXXXXXXXXXXXTEIIIRMMENAXXXEMSFQGRGVFELXXXXXXXXXXXXXXXXXXDGSYFFGDNAEEFXXXX

SEQ ID NO: 420056 - protein, 527 aa, Influenza virus
  MOD_RES (1)..(15): Any amino acid
  MOD_RES (33)..(242): Any amino acid
  MOD_RES (299)..(322): Any amino acid
  MOD_RES (334)..(486): Any amino acid
  MOD_RES (498)..(527): Any amino acid
XXXXXXXXXXXXXXXMALQGTKRSYEQMETGEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSKGSSKQQHKEAMMDQVREGRNPGNAEIEDLIFLARSALVLILRGSIAHKSCLPACXXXXXXXXXXXXXXXXXXXXXXXXDPFKLLQNSQVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRGQGHLDEKAXXXXXXXXXXXXXXXXXXXXXXXXXXXXXX

SEQ ID NO: 420057 - protein, 527 aa, Influenza virus
  MOD_RES (1)..(15): Any amino acid
  MOD_RES (29)..(251): Any amino acid
  MOD_RES (264)..(280): Any amino acid
  MOD_RES (293)..(322): Any amino acid
  MOD_RES (334)..(487): Any amino acid
  MOD_RES (500)..(527): Any amino acid
XXXXXXXXXXXXXXXMASQGTKRPYEQMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQRAMMDQVREGRXXXXXXXXXXXXXXXXXSALILRGSIAHKXXXXXXXXXXXXXXXXXXXXXXXXXXXXXXDPFKLLQNSQIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRGVFELSDEKATXXXXXXXXXXXXXXXXXXXXXXXXXXXX

SEQ ID NO: 420058 - protein, 527 aa, Influenza virus
  MOD_RES (1)..(280): Any amino acid
  MOD_RES (295)..(322): Any amino acid
  MOD_RES (334)..(487): Any amino acid
  MOD_RES (500)..(527): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSALILRGAVAHKSCXXXXXXXXXXXXXXXXXXXXXXXXXXXXDPFKLLQTSQVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRGVFELSDERATXXXXXXXXXXXXXXXXXXXXXXXXXXXX

SEQ ID NO: 420059 - protein, 527 aa, Influenza virus
  MOD_RES (1)..(322): Any amino acid
  MOD_RES (334)..(487): Any amino acid
  MOD_RES (500)..(527): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDPFRLLQSSQVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRGVFEFSDERAAXXXXXXXXXXXXXXXXXXXXXXXXXXXX

SEQ ID NO: 420060 - protein, 527 aa, Influenza virus
  MOD_RES (1)..(325): Any amino acid
  MOD_RES (337)..(488): Any amino acid
  MOD_RES (500)..(527): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPRLLQNSQVFSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGVFELSDEKAAXXXXXXXXXXXXXXXXXXXXXXXXXXXX

SEQ ID NO: 420061 - protein, 527 aa, Influenza virus
  MOD_RES (1)..(488): Any amino acid
  MOD_RES (500)..(527): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGVFELSDERAAXXXXXXXXXXXXXXXXXXXXXXXXXXXX

SEQ ID NO: 420062 - protein, 308 aa, Influenza virus
  MOD_RES (28)..(44): Any amino acid
  MOD_RES (58)..(74): Any amino acid
  MOD_RES (93)..(123): Any amino acid
  MOD_RES (139)..(183): Any amino acid
  MOD_RES (196)..(222): Any amino acid
  MOD_RES (234)..(262): Any amino acid
  MOD_RES (283)..(283): Any amino acid
MLFVQSYFQLFLVCVSLLQSAILSLQTXXXXXXXXXXXXXXXXXGDAPFLDRLRRDQXXXXXXXXXXXXXXXXXPMRTPIAFLTSSIVCPGKXXXXXXXXXXXXXXXXXXXXXXXXXXXXXXXIASVPASRYLIDMTLXXXXXXXXXXXXXXXXXXXXXXXXXXXXXXXXXXXXXXXXXXXXXAGVETMVILSASXXXXXXXXXXXXXXXXXXXXXXXXXXXNWPSSSGGLEWXXXXXXXXXXXXXXXXXXXXXXXXXXXXXSRNGKWREQLSQKFEEIRWLXSEVRRDQMAHCRMFEQITFMQALQL

SEQ ID NO: 420063 - protein, 308 aa, Influenza virus
  MOD_RES (1)..(25): Any amino acid
  MOD_RES (37)..(44): Any amino acid
  MOD_RES (68)..(123): Any amino acid
  MOD_RES (139)..(283): Any amino acid
  MOD_RES (307)..(308): Any amino acid
XXXXXXXXXXXXXXXXXXXXXXXXXFQVDCFLWHVRXXXXXXXXSDAPFLDRLRRANLCRFLETRTVXXXXXXXXXXXXXXXXXXXXXXXXXXXXXXXXXXXXXXXXXXXXXXXXXXXXXXXXIASVPASRYLTDMTLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSEVRGDQMAHCNSFEQITFMQALXX

SEQ ID NO: 420064 - protein, 308 aa, Influenza virus
  MOD_RES (1)..(25): Any amino acid
  MOD_RES (37)..(44): Any amino acid
  MOD_RES (58)..(124): Any amino acid
  MOD_RES (138)..(283): Any amino acid
  MOD_RES (305)..(308): Any amino acid
XXXXXXXXXXXXXXXXXXXXXXXXXFQVDCFLWHIRXXXXXXXXCDAPFDDRLRRDQXXXXXXXXXXXXXXXXXXXXXXXXXXXXXXXXXXXXXXXXXXXXXXXXXXXXXXXXXXXXXXXXXXXLKMPASRYLTDMTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEEVRHRLKITENSFEQITFMQXXXX

SEQ ID NO: 420065 - protein, 308 aa, Influenza virus
  MOD_RES (1)..(25): Any amino acid
  MOD_RES (37)..(44): Any amino acid
  MOD_RES (58)..(125): Any amino acid
  MOD_RES (139)..(308): Any amino acid
XXXXXXXXXXXXXXXXXXXXXXXXXFQVDCYLWHIRXXXXXXXXGDAPFLDRIRRDQXXXXXXXXXXXXXXXXXXXXXXXXXXXXXXXXXXXXXXXXXXXXXXXXXXXXXXXXXXXXXXXXXXXXSKITLKFAFNMMFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420066 - protein, 308 aa, Influenza virus
  MOD_RES (1)..(25): Any amino acid
  MOD_RES (37)..(44): Any amino acid
  MOD_RES (58)..(308): Any amino acid
XXXXXXXXXXXXXXXXXXXXXXXXXFQVDCFIWHIRXXXXXXXXGDAPFIDRLRRDQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420067 - protein, 308 aa, Influenza virus
  MOD_RES (1)..(25): Any amino acid
  MOD_RES (37)..(46): Any amino acid
  MOD_RES (58)..(308): Any amino acid
XXXXXXXXXXXXXXXXXXXXXXXXXFQVDCFLWYVRXXXXXXXXXXAPFLDRVRRDQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420068 - protein, 308 aa, Influenza virus
  MOD_RES (1)..(49): Any amino acid
  MOD_RES (66)..(308): Any amino acid
XXXXXXXXXXXXXXXXXXXXXXXXXXXXXXXXXXXXXXXXXXXXXXXXXSLLLLQANLCRFLETRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420069 - protein, 308 aa, Influenza virus
  MOD_RES (1)..(49): Any amino acid
  MOD_RES (62)..(308): Any amino acid
XXXXXXXXXXXXXXXXXXXXXXXXXXXXXXXXXXXXXXXXXXXXXXXXXSSLLLQANLCRFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420070 - protein, 205 aa, Influenza virus
  MOD_RES (98)..(100): Any amino acid
  MOD_RES (112)..(168): Any amino acid
  MOD_RES (203)..(205): Any amino acid
TAFSGMSANGDILMRYLLFQDILMRMSKDQELGDAPFLDRLRRDQKSLRGRGSTLGLDIRTATREGKHIVERILEEESDEALKMTIASDILTRMSKMXXXRPHPEDLNGMIXXXXXXXXXXXXXXXXXXXXXXXXXXXXXXXXXXXXXXXXXXXXXXXXXXXXXXXXXTENSFEQITFMQALQLLLEVEQEIRTFSFQLILLXXX

SEQ ID NO: 420071 - protein, 205 aa, Influenza virus
  MOD_RES (1)..(13): Any amino acid
  MOD_RES (39)..(81): Any amino acid
  MOD_RES (98)..(168): Any amino acid
XXXXXXXXXXXXXFQYLLFQDILMRRFADQELGDAPFLXXXXXXXXXXXXXXXXXXXXXXXXXXXXXXXXXXXXXXXXXXXLKMTIASDILKRMSKMXXXXXXXXXXXXXXXXXXXXXXXXXXXXXXXXXXXXXXXXXXXXXXXXXXXXXXXXXXXXXXXXXXXXXXXTENSFEQITFLQALQLLLEVESEIRTFSFQLINNKKP

SEQ ID NO: 420072 - protein, 205 aa, Influenza virus
  MOD_RES (1)..(13): Any amino acid
  MOD_RES (36)..(168): Any amino acid
  MOD_RES (203)..(205): Any amino acid
XXXXXXXXXXXXXFQVDCFLWHVRKRFADQELGDAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTESSFEQITFMQALQLLFEVEQEIRTFSFQLILIXXX

SEQ ID NO: 420073 - protein, 205 aa, Influenza virus
  MOD_RES (1)..(168): Any amino acid
  MOD_RES (192)..(205): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTENSFEQITFIQALQLLLEVENEXXXXXXXXXXXXXX

SEQ ID NO: 420074 - protein, 205 aa, Influenza virus
  MOD_RES (1)..(180): Any amino acid
  MOD_RES (192)..(205): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXALHLLLEVEQEXXXXXXXXXXXXXX

SEQ ID NO: 420075 - protein, 734 aa, Influenza virus
  MOD_RES (27)..(30): Any amino acid
  MOD_RES (58)..(66): Any amino acid
  MOD_RES (86)..(101): Any amino acid
  MOD_RES (141)..(142): Any amino acid
  MOD_RES (159)..(159): Any amino acid
  MOD_RES (209)..(215): Any amino acid
  MOD_RES (227)..(230): Any amino acid
  MOD_RES (254)..(277): Any amino acid
  MOD_RES (315)..(352): Any amino acid
  MOD_RES (364)..(370): Any amino acid
  MOD_RES (387)..(410): Any amino acid
  MOD_RES (428)..(430): Any amino acid
  MOD_RES (451)..(451): Any amino acid
  MOD_RES (468)..(468): Any amino acid
  MOD_RES (535)..(569): Any amino acid
  MOD_RES (619)..(636): Any amino acid
  MOD_RES (728)..(734): Any amino acid
MEDFVRQCFNPMIVELAEKAMKEYGEXXXXETNKFAAICTHLEVCFMYSDFHFIDERXXXXXXXXXDPNALLKHRFEIIEGRDRTXXXXXXXXXXXXXXXXKPKFLPDLYDYKENRFIEIGVTRREVHIYYLEKANKIKSXXTHIHIFSFTGEEMATKXDYTLDEESRARIKTTRLFTIRQEMASRGLWDSFRQSERGEETIEERFEIXXXXXXXLADQSLPPNFSXXXXFRAYVDGFEPNGCIEGKLSQMSKXXXXXXXXXXXXXXXXXXXXXXXXCSQRSKFLLMDALKLSIEDPSHEGEGEGIPLYDAIKCXXXXXXXXXXXXXXXXXXXXXXXXXXXXXXXXXXXXXXLKDEEKIPKTKXXXXXXXLKWALGENMAPEKVDFXXXXXXXXXXXXXXXXXXXXXXXXWIQSEFNKACELTDSSWXXXELDEIGEDVAPIEHIASMRRXYFTAEVSHCRATEYIMXKGVYINTALLNASCAAMDDFQLIPMISKCRTKEGRRKTNLYGFIIKGRSHLRNDTDVVNFVSMEFSXXXXXXXXXXXXXXXXXXXXXXXXXXXXXXXXXXXMFLYVRTNGTSKIKMKWGMEMRRCLLQSLQQIESMIEAESSVKEKDMTKXXXXXXXXXXXXXXXXXXVEEGSIGKVCRTLLAKSVFNSLYASPQLEGFSAESRKLLLIVQALRDNLEPGTFDLGGLYEAIEECLINDPWVLLNASWFNSFLTHALRFLXXXXXXX

SEQ ID NO: 420076 - protein, 734 aa, Influenza virus
  MOD_RES (27)..(30): Any amino acid
  MOD_RES (58)..(66): Any amino acid
  MOD_RES (86)..(101): Any amino acid
  MOD_RES (141)..(142): Any amino acid
  MOD_RES (159)..(159): Any amino acid
  MOD_RES (209)..(215): Any amino acid
  MOD_RES (227)..(230): Any amino acid
  MOD_RES (254)..(277): Any amino acid
  MOD_RES (315)..(370): Any amino acid
  MOD_RES (387)..(410): Any amino acid
  MOD_RES (428)..(430): Any amino acid
  MOD_RES (451)..(451): Any amino acid
  MOD_RES (468)..(468): Any amino acid
  MOD_RES (535)..(569): Any amino acid
  MOD_RES (619)..(636): Any amino acid
  MOD_RES (709)..(710): Any amino acid
  MOD_RES (732)..(734): Any amino acid
MENFVRQCFNPMIIELAEKTMKEYGEXXXXETNKLAAICTHLEICFMYSDFHFINEQXXXXXXXXXDSNALLKHRFEIIEGRDRIXXXXXXXXXXXXXXXXKPRFLPDLYDYKEDRFVEIGVTRREVHTYYLEKANKIKTXXTHIHIFSFNGEEMATKXDYTIDEESRARIKTTRLFTIRQELASRSLWDSFRQSERGEDTIEERFEIXXXXXXXLANQSLPPNFSXXXXFRAYVDGFKPNGCIEGKLSQMPKXXXXXXXXXXXXXXXXXXXXXXXXCHQRSKFLLMDSLKLSIEDPNHEGEGEGIPLYDAVRCXXXXXXXXXXXXXXXXXXXXXXXXXXXXXXXXXXXXXXXXXXXXXXXXXXXXXXXXLRWALGENMAPEKMDFXXXXXXXXXXXXXXXXXXXXXXXXWIQNEFNKACELTDSIWXXXELDEIGEDIAPIEHVASMRRXYFTAEISHCRATEYIMXKGVYVNTALLNASCAAMEDFQLIPMISKSRTKEGRRKTNLYGFIVKGRSHLRNDTDVVNYVSMEFSXXXXXXXXXXXXXXXXXXXXXXXXXXXXXXXXXXXMFLYIRTNGTSKIKMKWGMELRRCLLQSLQQIESIIEAESSVKEKDLTKXXXXXXXXXXXXXXXXXXVEESSIGKVCRTLLAKSVFNCLYASPQLEGFSAESRKMLLIVQALRDSLEPGTFDLEGLYESIEECLINDPWXXLNASWFNSFLAHALKLVVAMLXXX

SEQ ID NO: 420077 - protein, 734 aa, Influenza virus
  MOD_RES (27)..(30): Any amino acid
  MOD_RES (58)..(66): Any amino acid
  MOD_RES (86)..(101): Any amino acid
  MOD_RES (141)..(146): Any amino acid
  MOD_RES (159)..(159): Any amino acid
  MOD_RES (209)..(215): Any amino acid
  MOD_RES (227)..(230): Any amino acid
  MOD_RES (254)..(277): Any amino acid
  MOD_RES (315)..(370): Any amino acid
  MOD_RES (387)..(410): Any amino acid
  MOD_RES (428)..(430): Any amino acid
  MOD_RES (451)..(451): Any amino acid
  MOD_RES (468)..(468): Any amino acid
  MOD_RES (514)..(518): Any amino acid
  MOD_RES (535)..(569): Any amino acid
  MOD_RES (593)..(594): Any amino acid
  MOD_RES (619)..(636): Any amino acid
  MOD_RES (708)..(710): Any amino acid
  MOD_RES (727)..(734): Any amino acid
MEGFVRQCFNPMVVELAEKAMKEHGEXXXXETNKFASICTHLEVCFMYSDFHFINERXXXXXXXXXDPNVLLKHRFEIIEGRDRNXXXXXXXXXXXXXXXXKPRYLPDLYDYKESRFLEIGVTRREVHVYYLEKASKIKSXXXXXXIFSFTGEEMASKXEYTLDEESRARRIKTRLFTIRQEMANKGLWDSFRQSERGEETVEERFEIXXXXXXXLANYSLPPNFSXXXXFRVYVDGFEPNGYIEGKLSQMSKXXXXXXXXXXXXXXXXXXXXXXXXCYQRSKFLLMDALKLSIENPSHEGEGEGIPLHDAIKCXXXXXXXXXXXXXXXXXXXXXXXXXXXXXXXXXXXXXXXXXXXXXXXXXXXXXXXXLKWVLGENMAPEKIDFXXXXXXXXXXXXXXXXXXXXXXXXWVQNEFNKACELTDSVWXXXELDEIGEDLAPIEYIASMRRXYFTAEVSYCRATEYIMXKGVYMNTALLNASCAAMDEFQLIPMISKCKTKEGRRKTNLYGFLIXXXXXLRNDTDVVNFLSMEFSXXXXXXXXXXXXXXXXXXXXXXXXXXXXXXXXXXXIFLYVRTNGTSKVKMKWGMEMRRXXLQSLQQIESMVEAESSVKEKDMTRXXXXXXXXXXXXXXXXXXVEDGSIGKVCRTLLAKSVFNNLYASSQLEGFSAESRKLLLVVQAFRDNLEPGTFDIGGLYDAIEECLINDPXXXLNASWFNSFLVHALKSXXXXXXXX

SEQ ID NO: 420078 - protein, 734 aa, Influenza virus
  MOD_RES (27)..(30): Any amino acid
  MOD_RES (58)..(66): Any amino acid
  MOD_RES (86)..(101): Any amino acid
  MOD_RES (135)..(146): Any amino acid
  MOD_RES (159)..(159): Any amino acid
  MOD_RES (183)..(185): Any amino acid
  MOD_RES (209)..(215): Any amino acid
  MOD_RES (227)..(230): Any amino acid
  MOD_RES (249)..(277): Any amino acid
  MOD_RES (289)..(290): Any amino acid
  MOD_RES (315)..(370): Any amino acid
  MOD_RES (384)..(410): Any amino acid
  MOD_RES (428)..(430): Any amino acid
  MOD_RES (451)..(451): Any amino acid
  MOD_RES (468)..(468): Any amino acid
  MOD_RES (511)..(524): Any amino acid
  MOD_RES (543)..(569): Any amino acid
  MOD_RES (581)..(596): Any amino acid
  MOD_RES (619)..(636): Any amino acid
  MOD_RES (693)..(693): Any amino acid
  MOD_RES (708)..(710): Any amino acid
MEEFVRQCFNPMTVELAERAMKEYGEXXXXETNKFAAVCTHLEVCFMYSDFHFIDEQXXXXXXXXXDPNTLLKHRFEIIEGRDRAXXXXXXXXXXXXXXXXKPKYLPDLYDYKKNRFTEIGVTRREIHIYYLEKXXXXXXXXXXXXIFSFIGEEMATKXDYILDEESRARIIKTRLYTIRQEXXXRGLWDPFRQSERGEETIEEKFEIXXXXXXXLADQSLPPNFPXXXXFRTYVDGFEPNGSIEGKLXXXXXXXXXXXXXXXXXXXXXXXXXXXXXCFQRSKFLLMDXXKLSIEDPDHEGEGEGIPLYDAVKCXXXXXXXXXXXXXXXXXXXXXXXXXXXXXXXXXXXXXXXXXXXXXXXXXXXXXXXXLKWTLGENMAPEKXXXXXXXXXXXXXXXXXXXXXXXXXXXWVQSEFNKACELTGSSWXXXEFDEIGEDVAPIEYVASMRRXYFTTEVSHCRATEYMMXKGVYINTAMLNASCAAMDDYQLIPMISKCRTREGRRKTNLYGXXXXXXXXXXXXXXGSLNFVSMEFSLTDPRLEXXXXXXXXXXXXXXXXXXXXXXXXXXXLFLYVRTNGTSXXXXXXXXXXXXXXXXSLQQVESMIEAESSVREKDMTKXXXXXXXXXXXXXXXXXXMEEGSIGKVCRALLAKSVFNSLYSSPQLEGFSAESRKLLLIAQALKDNLEPGTFDLXGLYGAIEECLINDPXXXLNASWFNSFLIHALRELWQCYYLL

SEQ ID NO: 420079 - protein, 734 aa, Influenza virus
  MOD_RES (19)..(31): Any amino acid
  MOD_RES (58)..(67): Any amino acid
  MOD_RES (79)..(101): Any amino acid
  MOD_RES (114)..(119): Any amino acid
  MOD_RES (135)..(147): Any amino acid
  MOD_RES (159)..(163): Any amino acid
  MOD_RES (184)..(196): Any amino acid
  MOD_RES (209)..(230): Any amino acid
  MOD_RES (254)..(290): Any amino acid
  MOD_RES (303)..(370): Any amino acid
  MOD_RES (383)..(415): Any amino acid
  MOD_RES (428)..(433): Any amino acid
  MOD_RES (445)..(451): Any amino acid
  MOD_RES (468)..(469): Any amino acid
  MOD_RES (516)..(525): Any amino acid
  MOD_RES (543)..(569): Any amino acid
  MOD_RES (581)..(600): Any amino acid
  MOD_RES (619)..(636): Any amino acid
  MOD_RES (668)..(668): Any amino acid
  MOD_RES (710)..(710): Any amino acid
  MOD_RES (723)..(734): Any amino acid
MGDFVRQCFNPMIAELAEXXXXXXXXXXXXXTNKFAAICTHMEVCFMYSDFHFINELXXXXXXXXXXQNALLKHRFEIXXXXXXXXXXXXXXXXXXXXXXXKPKSLPDLYDYKXXXXXXIGVTRREVHMYYLEKXXXXXXXXXXXXXFSFTGEEMATRXXXXXASSKSRARIKTRLFTIRQELXXXXXXXXXXXXXRGEETIEERFAIXXXXXXXXXXXXXXXXXXXXXXFRTYVDGFKPNGCIESKLSQMSKXXXXXXXXXXXXXXXXXXXXXXXXXXXXXXXXXXXXXKLSIEEPSHEGEXXXXXXXXXXXXXXXXXXXXXXXXXXXXXXXXXXXXXXXXXXXXXXXXXXXXXXXXXXXXXXXXXXXXLMWALGENMAPEXXXXXXXXXXXXXXXXXXXXXXXXXXXXXXXXXFNKACELTDSTWXXXXXXEIGEDIAPIEYXXXXXXXYFTEEVSHCRATEYIIXXGVYINTALLNSSCAAMDDFQLIPIISKCRTKEGRRRTNLYGFIIKGXXXXXXXXXXVVNFVSMEFSLTDPKLEXXXXXXXXXXXXXXXXXXXXXXXXXXXMFLYMRTNGTSXXXXXXXXXXXXXXXXXXXXIESMIEAESSIKEKDMTKXXXXXXXXXXXXXXXXXXIEEGSIGKVCRTLLAKSVFNSIYASPQLEGFXAESRKLLLITQALRDDLEPGTFDIEGLYEAVEECLINDPWVXLNASWFNSFLKHXXXXXXXXXXXX

SEQ ID NO: 420080 - protein, 734 aa, Influenza virus
  MOD_RES (1)..(129): Any amino acid
  MOD_RES (141)..(164): Any amino acid
  MOD_RES (186)..(200): Any amino acid
  MOD_RES (212)..(234): Any amino acid
  MOD_RES (249)..(292): Any amino acid
  MOD_RES (312)..(374): Any amino acid
  MOD_RES (387)..(418): Any amino acid
  MOD_RES (431)..(439): Any amino acid
  MOD_RES (451)..(457): Any amino acid
  MOD_RES (473)..(482): Any amino acid
  MOD_RES (504)..(525): Any amino acid
  MOD_RES (543)..(637): Any amino acid
  MOD_RES (649)..(654): Any amino acid
  MOD_RES (668)..(715): Any amino acid
  MOD_RES (732)..(734): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYYMEKANKIKSXXXXXXXXXXXXXXXXXXXXXXXXDEESRARIKTRLFTIRQEMAIXXXXXXXXXXXXXXXRSIEEKFEITGXXXXXXXXXXXXXXXXXXXXXXXIDGFEPNGCIESKLXXXXXXXXXXXXXXXXXXXXXXXXXXXXXXXXXXXXXXXXXXXXKASKEPEVHEGEGIPLYDAXXXXXXXXXXXXXXXXXXXXXXXXXXXXXXXXXXXXXXXXXXXXXXXXXXXXXXXXXXXXXXXLGENIAPEKVDFXXXXXXXXXXXXXXXXXXXXXXXXXXXXXXXXKTAYELTDSSWIXXXXXXXXXAPIEHIASIRRXXXXXXXISKSRATEYIMKGVYXXXXXXXXXXTAMDDFQLIPMISNCRTKEGRXXXXXXXXXXXXXXXXXXXXXXVVNYVSMEFSLTDPRFEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEEGSIGKLCRTXXXXXXFNSLYASSQLEGFXXXXXXXXXXXXXXXXXXXXXXXXXXXXXXXXXXXXXXXXXXXXXXXXFNSSLTHALRELWQCYXXX

SEQ ID NO: 420081 - protein, 734 aa, Influenza virus
  MOD_RES (1)..(174): Any amino acid
  MOD_RES (186)..(242): Any amino acid
  MOD_RES (254)..(294): Any amino acid
  MOD_RES (311)..(458): Any amino acid
  MOD_RES (472)..(525): Any amino acid
  MOD_RES (541)..(734): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLFTIRQEMAGXXXXXXXXXXXXXXXXXXXXXXXXXXXXXXXXXXXXXXXXXXXXXXXXXXXXXXXXXYIEGKLSQMSRXXXXXXXXXXXXXXXXXXXXXXXXXXXXXXXXXXXXXXXXXSIEDPSHEGEGIPLYDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSHCRATEYIMKGVXXXXXXXXXXXXXXXXXXXXXXXXXXXXXXXXXXXXXXXXXXXXXXXXXXXXXXVVNFLSMEFSLTDPRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420082 - protein, 734 aa, Influenza virus
  MOD_RES (1)..(294): Any amino acid
  MOD_RES (311)..(458): Any amino acid
  MOD_RES (471)..(531): Any amino acid
  MOD_RES (543)..(734): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIEDPNHEGEGIPLYDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSYCRATEYIMKGXXXXXXXXXXXXXXXXXXXXXXXXXXXXXXXXXXXXXXXXXXXXXXXXXXXXXXXXXXXXXMEFSLVDPRLEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420083 - protein, 734 aa, Influenza virus
  MOD_RES (1)..(294): Any amino acid
  MOD_RES (311)..(458): Any amino acid
  MOD_RES (473)..(734): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIEDPDHEGEGIPLYDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSHCRATEYMMKGVYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420084 - protein, 734 aa, Influenza virus
  MOD_RES (1)..(294): Any amino acid
  MOD_RES (312)..(458): Any amino acid
  MOD_RES (473)..(734): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIENPSHEGEGIPLHDAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSHCRATEYIIKGVYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420085 - protein, 734 aa, Influenza virus
  MOD_RES (1)..(294): Any amino acid
  MOD_RES (311)..(734): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIEEPSHEGEGIPLCDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420086 - protein, 829 aa, Influenza virus
  MOD_RES (12)..(14): Any amino acid
  MOD_RES (58)..(61): Any amino acid
  MOD_RES (78)..(78): Any amino acid
  MOD_RES (112)..(115): Any amino acid
  MOD_RES (156)..(159): Any amino acid
  MOD_RES (174)..(184): Any amino acid
  MOD_RES (197)..(217): Any amino acid
  MOD_RES (324)..(335): Any amino acid
  MOD_RES (365)..(391): Any amino acid
  MOD_RES (405)..(405): Any amino acid
  MOD_RES (437)..(440): Any amino acid
  MOD_RES (462)..(464): Any amino acid
  MOD_RES (575)..(594): Any amino acid
  MOD_RES (625)..(626): Any amino acid
  MOD_RES (668)..(684): Any amino acid
  MOD_RES (792)..(792): Any amino acid
  MOD_RES (804)..(806): Any amino acid
MDVNPTLLFLKXXXPAQNAISTTFPYTGDPPYSHGTGTGYTMDTVNRTHQYSEKGKWXXXXETGAPQLNPIDGPLPEXNEPSGYAQTDCVLEAMAFLEESHPGIFENSCLEXXXXVQQTRVDKLTQGRQTYDWTLNRNQPAATALANTIEVFRSNXXXXNESGRLIDFLKDVMXXXXXXXXXXXTHFQRKRRVRDNXXXXXXXXXXXXXXXXXXXXXSYLIRALTLNTMTKDAERGKLKRRAIATPGMQIRGFVYFVETLARSICEKLEQSGLPVGGNEKKAKLANVVRKMMTNSQDTELSFTITGDNTKWNENQNPRMFLAMXXXXXXXXXXXXWFRNVLSIAPIMFSNKMARLGKGYMFESKXXXXXXXXXXXXXXXXXXXXXXXXXXXKIEKIEKIRPLLIXGTASLSPGMMMGMFNMLSTVLGVSILNLGQKXXXXTTYWWDGLQSSDDFALIVNAPXXXGIQAGVDRFYRTCKLVGINMSKKKSYINRTGTFEFTSFFYRYGFVANFSMELPSFGVSGINESADMSIGVTVIKNNMINNDLGPATAQMALQLFIKDYRYTYRCHRGDTQXXXXXXXXXXXXXXXXXXXXGLLVSDGGPNLYNIRNLHIPEVCLKWELMDXXYQGRLCNPLNPFVSHVGTRWMKIIRVGCVILLNPFVSHKEIXXXXXXXXXXXXXXXXXMEYDAVATTHSWIPKRNRSILNTSQRGILGQNHGICAVATTHSWVPILNTSQRGILEDEQMYQKCCNLFEKFFPSSSYRRPVGISSMVEAMVSRARIDARIDFESGRXGKKEEFSEIMKXXXTIEELRRQKWWVWLWLVLREKMP

SEQ ID NO: 420087 - protein, 829 aa, Influenza virus
  MOD_RES (12)..(14): Any amino acid
  MOD_RES (27)..(35): Any amino acid
  MOD_RES (57)..(61): Any amino acid
  MOD_RES (78)..(78): Any amino acid
  MOD_RES (112)..(115): Any amino acid
  MOD_RES (156)..(159): Any amino acid
  MOD_RES (174)..(184): Any amino acid
  MOD_RES (197)..(217): Any amino acid
  MOD_RES (229)..(244): Any amino acid
  MOD_RES (274)..(283): Any amino acid
  MOD_RES (324)..(335): Any amino acid
  MOD_RES (357)..(405): Any amino acid
  MOD_RES (418)..(419): Any amino acid
  MOD_RES (437)..(440): Any amino acid
  MOD_RES (462)..(464): Any amino acid
  MOD_RES (504)..(513): Any amino acid
  MOD_RES (546)..(559): Any amino acid
  MOD_RES (575)..(594): Any amino acid
  MOD_RES (625)..(626): Any amino acid
  MOD_RES (642)..(684): Any amino acid
  MOD_RES (714)..(730): Any amino acid
  MOD_RES (787)..(792): Any amino acid
  MOD_RES (804)..(806): Any amino acid
  MOD_RES (828)..(829): Any amino acid
MDVNPTLLFLEXXXPVQNAISTTFPYXXXXXXXXXTGTGYTMDTVSRTHQYSEKGKXXXXXEIGAPQLNPIDGPLPKXNEPTGYAQTDCVLEAMALLEESHPGIFENSCIEXXXXIQQTRVDKLTQGRQTFDWTLNRNQPAATALANTIEIFRSNXXXXSESGRLIDFLKDVIXXXXXXXXXXXTHFQRKRRIRDNXXXXXXXXXXXXXXXXXXXXXGYLIRALTLNTXXXXXXXXXXXXXXXXTPGMQIRGFVHFVEALARRICEKLEQSGLXXXXXXXXXXLANVVRKMMTSSQDTEISFTITGDNTKWNENQNPRVFLAMXXXXXXXXXXXXWFRNILSMAPIMFSNKMAKLGXXXXXXXXXXXXXXXXXXXXXXXXXXXXXXXXXXXXXXXXXXXXXXXXXGAASLSPGMMMGXXNMLSTVLGVSVLNLGQKXXXXTIYWWDGLQSSDDFALILNAPXXXGIQAGVNRFYRTCKLVGINMSKRKSYINKTGTFEFTSFFXXXXXXXXXXMELPSFGVSGVNESADMSIGVAVIKNNMINNDXXXXXXXXXXXXXXKDYRYTYRCHKGDTQXXXXXXXXXXXXXXXXXXXXGLLISDGGPNLYNIRNLHIPEAGLKWELMDXXYRGRLCNPLNPFVNHXXXXXXXXXXXXXXXXXXXXXXXXXXXXXXXXXXXXXXXXXXXIEYDAVATTHSWVPKRNRSILNTSQRGVLXXXXXXXXXXXXXXXXXILNTSQRGVLEDEQMYQKCCSLFEKFFPSSSYRRPIGISSMVEAMISRARIDARIDXXXXXXGKKEEFSEIMRXXXTIEELRRQKSLIWLWLVLREKXX

SEQ ID NO: 420088 - protein, 829 aa, Influenza virus
  MOD_RES (1)..(3): Any amino acid
  MOD_RES (27)..(43): Any amino acid
  MOD_RES (58)..(61): Any amino acid
  MOD_RES (78)..(78): Any amino acid
  MOD_RES (112)..(115): Any amino acid
  MOD_RES (134)..(143): Any amino acid
  MOD_RES (156)..(159): Any amino acid
  MOD_RES (174)..(184): Any amino acid
  MOD_RES (197)..(217): Any amino acid
  MOD_RES (229)..(248): Any amino acid
  MOD_RES (274)..(285): Any amino acid
  MOD_RES (324)..(335): Any amino acid
  MOD_RES (363)..(405): Any amino acid
  MOD_RES (419)..(425): Any amino acid
  MOD_RES (437)..(440): Any amino acid
  MOD_RES (462)..(464): Any amino acid
  MOD_RES (498)..(523): Any amino acid
  MOD_RES (544)..(562): Any amino acid
  MOD_RES (575)..(594): Any amino acid
  MOD_RES (610)..(610): Any amino acid
  MOD_RES (625)..(626): Any amino acid
  MOD_RES (642)..(684): Any amino acid
  MOD_RES (724)..(733): Any amino acid
  MOD_RES (759)..(761): Any amino acid
  MOD_RES (792)..(792): Any amino acid
  MOD_RES (804)..(829): Any amino acid
XXXINPTLLFLKVPPAQNAISITFPYXXXXXXXXXXXXXXXXXTVNRTHQYSERGRWXXXXETKAPQLNPIDGPLPDXNDPSGYAQTDCVLEAMAFLEKSHPGLFENSCLEXXXXVQQTRVDRLTQGRQTYDWXXXXXXXXXXALANTIEVFRLNXXXXNESGRLMDFLKDVMXXXXXXXXXXXTHFHRKRRVRDNXXXXXXXXXXXXXXXXXXXXXNYLIRALTLNTXXXXXXXXXXXXXXXXXXXXQIRGFVYFVEALARCICEKLEQSGLXXXXXXXXXXXXNVVRKMMTNSHDTELSFTVTGDNTKWNENQNPRIFLAMXXXXXXXXXXXXWFRNILSIAPIMFSNKVARLGKGYMFEXXXXXXXXXXXXXXXXXXXXXXXXXXXXXXXXXXXXXXXXXXXGTVSLSPGMMMGMXXXXXXXLGVSILNLGQRXXXXTSYWWDGLQSSDDFALIVNASXXXGVQAGVDRFYRTCKLLGINMSKKKSYINKTGTFXXXXXXXXXXXXXXXXXXXXXXXXXXINESADMSIGITVIKNNMINXXXXXXXXXXXXXXXXXXXRYTYRCHRGDMQXXXXXXXXXXXXXXXXXXXXGLLVADGGPNLYNIRXLHIPEVCLKWDLMDXXYKGRLCNPLNPFVTHXXXXXXXXXXXXXXXXXXXXXXXXXXXXXXXXXXXXXXXXXXXVEYDAVATTHSWTPKRNRSILNTNAITRSGQNHGICAVAXXXXXXXXXXTNQRGILEDEQMYQRCCNLFEKFFPXXXYRRPVGISSMGEAMVSRARIDARVDFESGRXGKKEFSEIMKIXXXXXXXXXXXXXXXXXXXXXXXXXX

SEQ ID NO: 420089 - protein, 829 aa, Influenza virus
  MOD_RES (1)..(8): Any amino acid
  MOD_RES (20)..(45): Any amino acid
  MOD_RES (58)..(61): Any amino acid
  MOD_RES (78)..(78): Any amino acid
  MOD_RES (112)..(115): Any amino acid
  MOD_RES (127)..(143): Any amino acid
  MOD_RES (156)..(162): Any amino acid
  MOD_RES (174)..(217): Any amino acid
  MOD_RES (234)..(248): Any amino acid
  MOD_RES (274)..(286): Any amino acid
  MOD_RES (300)..(311): Any amino acid
  MOD_RES (324)..(335): Any amino acid
  MOD_RES (365)..(405): Any amino acid
  MOD_RES (417)..(440): Any amino acid
  MOD_RES (462)..(465): Any amino acid
  MOD_RES (487)..(523): Any amino acid
  MOD_RES (549)..(563): Any amino acid
  MOD_RES (575)..(602): Any amino acid
  MOD_RES (624)..(626): Any amino acid
  MOD_RES (642)..(703): Any amino acid
  MOD_RES (718)..(733): Any amino acid
  MOD_RES (787)..(829): Any amino acid
XXXXXXXXYFFLKVPVQNAXXXXXXXXXXXXXXXXXXXXXXXXXXNRTHQYSERGKWXXXXETGALQLNPIDGPLPVXNEPNGYAQTDCVLEAMAFLENSHPGIFGNSCLEXXXXVQQTRMDKLTQXXXXXXXXXXXXXXXXXALANTIEVFKSNXXXXXXXGRLIDFLKDVVXXXXXXXXXXXXXXXXXXXXXXXXXXXXXXXXXXXXXXXXXXXXSYLIRTLTLNTMTKDAXXXXXXXXXXXXXXXQIRGFVYFVEILARNICEKLEQSGLXXXXXXXXXXXXXVVRKMMTNSRDTEXXXXXXXXXXXXNENQNPRVFLTMXXXXXXXXXXXXWFRNVLSVAPIMFSNKMARLGRGYMFESKXXXXXXXXXXXXXXXXXXXXXXXXXXXXXXXXXXXXXXXXXGTAALSPGMMMXXXXXXXXXXXXXXXXXXXXXXXXTVYWWDGLQSSDDFALIVNALXXXXIQAGVDRFYRICKLVGINMSKXXXXXXXXXXXXXXXXXXXXXXXXXXXXXXXXXXXXXVNESADMSIGITVIRNNMINNDLGPXXXXXXXXXXXXXXXYTYRCHRGDTHXXXXXXXXXXXXXXXXXXXXXXXXXXXXSNLYNIRNLHIPEVCLKWGLMXXXYQGRLCNPMNPFVSHXXXXXXXXXXXXXXXXXXXXXXXXXXXXXXXXXXXXXXXXXXXXXXXXXXXXXXXXXXXXXXICNSNAITRSGQNHXXXXXXXXXXXXXXXXTSQKGILEDEQMYQKCCTLFEKFFPSSSYRRPVGISSMMEAMVSRARIDARTDXXXXXXXXXXXXXXXXXXXXXXXXXXXXXXXXXXXXXXXXXXX

SEQ ID NO: 420090 - protein, 829 aa, Influenza virus
  MOD_RES (1)..(45): Any amino acid
  MOD_RES (58)..(61): Any amino acid
  MOD_RES (75)..(88): Any amino acid
  MOD_RES (112)..(143): Any amino acid
  MOD_RES (155)..(162): Any amino acid
  MOD_RES (174)..(217): Any amino acid
  MOD_RES (231)..(248): Any amino acid
  MOD_RES (262)..(294): Any amino acid
  MOD_RES (307)..(311): Any amino acid
  MOD_RES (324)..(335): Any amino acid
  MOD_RES (351)..(440): Any amino acid
  MOD_RES (453)..(470): Any amino acid
  MOD_RES (482)..(527): Any amino acid
  MOD_RES (544)..(563): Any amino acid
  MOD_RES (575)..(629): Any amino acid
  MOD_RES (642)..(737): Any amino acid
  MOD_RES (756)..(766): Any amino acid
  MOD_RES (787)..(829): Any amino acid
XXXXXXXXXXXXXXXXXXXXXXXXXXXXXXXXXXXXXXXXXXXXXNRTHQYSEKGRWXXXXETGAPQLNPVDGPXXXXXXXXXXXXXXCVLEAMAFLEDSHPGIFESSCLEXXXXXXXXXXXXXXXXXXXXXXXXXXXXXXXXALANTIEVFRAXXXXXXXXGRLIDFLKDVTXXXXXXXXXXXXXXXXXXXXXXXXXXXXXXXXXXXXXXXXXXXXSYIIRALTLNTMTXXXXXXXXXXXXXXXXXXQIRGVVYFVETLAXXXXXXXXXXXXXXXXXXXXXXXXXXXXXXXXXSQDTELSFTVTGXXXXXNENQSPRMFLAMXXXXXXXXXXXXWFRNALSIAPIMFSNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTAYWWDGLQSSDXXXXXXXXXXXXXXXXXXNRFYRTCKLLGXXXXXXXXXXXXXXXXXXXXXXXXXXXXXXXXXXXXXXXXXXXXXXADMSIGVTVIRNNMINXXXXXXXXXXXXXXXXXXXXYTYRCHRGDAQXXXXXXXXXXXXXXXXXXXXXXXXXXXXXXXXXXXXXXXXXXXXXXXXXXXXXXXRLCNPLNPFVGHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGILEDERMYQKCCNLFERXXXXXXXXXXXGISSMVEAMMSRARIDARIDXXXXXXXXXXXXXXXXXXXXXXXXXXXXXXXXXXXXXXXXXXX

SEQ ID NO: 420091 - protein, 829 aa, Influenza virus
  MOD_RES (1)..(144): Any amino acid
  MOD_RES (156)..(294): Any amino acid
  MOD_RES (307)..(313): Any amino acid
  MOD_RES (331)..(529): Any amino acid
  MOD_RES (550)..(634): Any amino acid
  MOD_RES (652)..(776): Any amino acid
  MOD_RES (791)..(829): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLANTIEVFRMNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSQDTEVSFTITGXXXXXXXNQNQNPRMFLAMITYITXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMSVGVTVIKNNMVNNDLGPAXXXXXXXXXXXXXXXXXXXXXXXXXXXXXXXXXXXXXXXXXXXXXXXXXXXXXXXXXXXXXXXXXXXXXXXXXXXXXXXXXXXXXHPRGLLEVGTRWMKIIRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSRARIDARVDSESGXXXXXXXXXXXXXXXXXXXXXXXXXXXXXXXXXXXXXXX

SEQ ID NO: 420092 - protein, 829 aa, Influenza virus
  MOD_RES (1)..(315): Any amino acid
  MOD_RES (331)..(531): Any amino acid
  MOD_RES (543)..(829): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNQNPRIFLAMITYITXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIGVTVIKNNMVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420093 - protein, 829 aa, Influenza virus
  MOD_RES (1)..(315): Any amino acid
  MOD_RES (331)..(829): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNQNPRVFLAMITYITXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420094 - protein, 829 aa, Influenza virus
  MOD_RES (1)..(315): Any amino acid
  MOD_RES (331)..(829): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNQNPRVFLTMITYITXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420095 - protein, 829 aa, Influenza virus
  MOD_RES (1)..(315): Any amino acid
  MOD_RES (329)..(829): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNQSPRMFLAMITYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420096 - protein, 829 aa, Influenza virus
  MOD_RES (1)..(318): Any amino acid
  MOD_RES (331)..(829): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPRTFLAMITYITXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 420097 - protein, 780 aa, Influenza virus
  MOD_RES (73)..(101): Any amino acid
  MOD_RES (117)..(139): Any amino acid
  MOD_RES (165)..(168): Any amino acid
  MOD_RES (197)..(210): Any amino acid
  MOD_RES (264)..(264): Any amino acid
  MOD_RES (305)..(308): Any amino acid
  MOD_RES (349)..(353): Any amino acid
  MOD_RES (367)..(411): Any amino acid
  MOD_RES (459)..(508): Any amino acid
  MOD_RES (572)..(583): Any amino acid
  MOD_RES (601)..(603): Any amino acid
  MOD_RES (626)..(626): Any amino acid
  MOD_RES (674)..(675): Any amino acid
  MOD_RES (697)..(698): Any amino acid
  MOD_RES (731)..(731): Any amino acid
  MOD_RES (778)..(780): Any amino acid
SESRSNIFNMERIKELRDLMSQSRTREILTKTTVDHMAIIKKYTSGRQEKQEKNPALRMKWMMAMKYPITADXXXXXXXXXXXXXXXXXXXXXXXXXXXXXMVSPLAVTWWNRNGPXXXXXXXXXXXXXXXXXXXXXXXGTFGPVHFRNQVKIRRRVDINPGHAXXXXAKEAQDVIMEVVFPNEVGARILTSESQLXXXXXXXXXXXXXXIAPLMVAYMLERELVRKTRFLPVAGGTSSVYIEVLHLTQGTCWEQMYTPGGEVXNDDVDQSLIIAARNIVRRAAVSADPLASLLEMCHSTQIGGXXXXDILRQNPTEEQAVDICKAAMGLRISSSFSFGGFTFKRTSGXXXXXEEEVLTGNLQTLKXXXXXXXXXXXXXXXXXXXXXXXXXXXXXXXXXXXXXXXXXXXXXIVAMVFSQEDCMIKAVRGDLNFVNRANQRLNPMHQLLRHFQKDAKVLXXXXXXXXXXXXXXXXXXXXXXXXXXXXXXXXXXXXXXXXXXXXXXXXXXVSIDRFLRVRDQRGNVLLSPEEVSETQGTEKLTITYSSSMMWEINGPESVLVNTYQWIIRNWEXXXXXXXXXXXXLYNKMEFEPFQSLVPKAXXXQYSGFVRTLFQQMRDVLGTFDTXQIIKLLPFAAAPPEQSRMQFSSLTVNVRGSGMRILVRGNSPVFNYNKXXKRLTVLGKDAGAGALAEDPDEXXAGVESAVLRGFLILGKEDKKRYGPALSINELSXLAKGEKANVLIGQGDVVLVMKRKRDSSILTDSQTATKRIRMAINQCXXX

SEQ ID NO: 420098 - protein, 780 aa, Influenza virus
  MOD_RES (73)..(101): Any amino acid
  MOD_RES (117)..(139): Any amino acid
  MOD_RES (165)..(168): Any amino acid
  MOD_RES (197)..(210): Any amino acid
  MOD_RES (223)..(223): Any amino acid
  MOD_RES (264)..(264): Any amino acid
  MOD_RES (305)..(308): Any amino acid
  MOD_RES (349)..(353): Any amino acid
  MOD_RES (367)..(411): Any amino acid
  MOD_RES (459)..(508): Any amino acid
  MOD_RES (572)..(583): Any amino acid
  MOD_RES (601)..(603): Any amino acid
  MOD_RES (626)..(626): Any amino acid
  MOD_RES (674)..(675): Any amino acid
  MOD_RES (687)..(698): Any amino acid
  MOD_RES (731)..(731): Any amino acid
  MOD_RES (758)..(759): Any amino acid
  MOD_RES (775)..(780): Any amino acid
SKSRSNIFNMERIKELRYLMLQSRTREILTRTTVDHMAIIKRYTSGRSGRQEKNPALRMKWMMAMRYPITADXXXXXXXXXXXXXXXXXXXXXXXXXXXXXMISPLAVTWWNRKGPXXXXXXXXXXXXXXXXXXXXXXXGTFGPVHFQNQVKIRRRVDTNPGHAXXXXSKEAQDVIMEVVFPNEVGAKILTSESQLXXXXXXXXXXXXXXISPLMVAYMLERXLVRKTRFLPVSGGTSSIYIEVLHLTQGACWEQLYTPGGEVXNDDIDQSLIIAARNIVRRATVSADPLASLLEMCHGTQIGGXXXXDILKQNPTEEQAVGICKAAMGLKISSSFSFGGFTFKRTKGXXXXXEEEMLTGNLQTLKXXXXXXXXXXXXXXXXXXXXXXXXXXXXXXXXXXXXXXXXXXXXXVVAMVFSQEDCVVKAVRGDLNFVNRANQRLNTMHQLLRHFQKNAKVLXXXXXXXXXXXXXXXXXXXXXXXXXXXXXXXXXXXXXXXXXXXXXXXXXXVNIDRFLRVRDQQGNILLSPEEVSETQGIERLTITYSSSMMWEVNGPESVLVNTYQWVIRNWEXXXXXXXXXXXXLYNKIEFEPFQSLVPRAXXXRYSGFVRTLFQQMRDILGTFDTXQVIKLLPFAAAPPKQSRMQFSSLAVNVRGSGMRVLIRGNSPVFNYNRXXKRLTILGKDAGXXXXXXXXXXXXSGVESAVLRGFLIIGKEDRRRYGPALSINELGXLTKGEKANVLIGQGDIVLVMKRKRDSXXLTDSQTATKRLRMAIXXXXXX

SEQ ID NO: 420099 - protein, 780 aa, Influenza virus
  MOD_RES (17)..(18): Any amino acid
  MOD_RES (73)..(101): Any amino acid
  MOD_RES (117)..(139): Any amino acid
  MOD_RES (165)..(168): Any amino acid
  MOD_RES (197)..(210): Any amino acid
  MOD_RES (262)..(264): Any amino acid
  MOD_RES (305)..(308): Any amino acid
  MOD_RES (349)..(353): Any amino acid
  MOD_RES (367)..(411): Any amino acid
  MOD_RES (434)..(445): Any amino acid
  MOD_RES (459)..(508): Any amino acid
  MOD_RES (523)..(523): Any amino acid
  MOD_RES (571)..(583): Any amino acid
  MOD_RES (599)..(603): Any amino acid
  MOD_RES (626)..(626): Any amino acid
  MOD_RES (674)..(675): Any amino acid
  MOD_RES (687)..(698): Any amino acid
  MOD_RES (730)..(731): Any amino acid
  MOD_RES (745)..(745): Any amino acid
  MOD_RES (775)..(780): Any amino acid
SKSRSIIFNMERIKELXXLMSQSRTRGILTKTTVDHMAVIKKYTSARQEKQEKNPSLRMKWMMAMKYPITAEXXXXXXXXXXXXXXXXXXXXXXXXXXXXXIVSPLAVTWWNRSGPXXXXXXXXXXXXXXXXXXXXXXXGIFGPVHFRNQIKIRRRVDINPGHSXXXXAKEAQDVIMEIVFPNEVGARIITSESQLXXXXXXXXXXXXXXIAPLMMAYMLERELVRKTRFLPVTGGTSSVYVEVLHLTQGTCWEQLYTPGGXXXNDDVDQSLVIAARNIVRRAIVSADPLASLLEMCHSTRIGGXXXXDILKHNPTEEQAVNICKAAMGMRISSSFSFGGFTFKRTNGXXXXXEEEVLTGNLQALKXXXXXXXXXXXXXXXXXXXXXXXXXXXXXXXXXXXXXXXXXXXXXIVAMVFSQEECMVKAVRGDLNFXXXXXXXXXXXXQLLRHFQKDARVLXXXXXXXXXXXXXXXXXXXXXXXXXXXXXXXXXXXXXXXXXXXXXXXXXXVSIDRFLRVKDQQGXVLLSPEEVSEAQGTEKLTITYSSSLMWEINGPESVLINTYQWIIRNWXXXXXXXXXXXXXLYNKVEFEPFQSLVPXXXXXLYSGFVRTLFQQMRDVIGTFDTXQIIKLLPFASAPPEQSKMQFSSLTVNVRGTGMRILVRGNSPAFNYNKXXKRLTIIGKDAGXXXXXXXXXXXXTGVESAVLRGFLILGREDKKKYGPALSINELXXLARGEKANVLIGQXDVVLVMKRKRNSSILTDSQTATKRIRLAIXXXXXX

SEQ ID NO: 420100 - protein, 780 aa, Influenza virus
  MOD_RES (1)..(18): Any amino acid
  MOD_RES (61)..(61): Any amino acid
  MOD_RES (73)..(101): Any amino acid
  MOD_RES (116)..(139): Any amino acid
  MOD_RES (165)..(168): Any amino acid
  MOD_RES (180)..(180): Any amino acid
  MOD_RES (197)..(223): Any amino acid
  MOD_RES (249)..(251): Any amino acid
  MOD_RES (264)..(264): Any amino acid
  MOD_RES (305)..(308): Any amino acid
  MOD_RES (348)..(353): Any amino acid
  MOD_RES (367)..(411): Any amino acid
  MOD_RES (435)..(446): Any amino acid
  MOD_RES (459)..(511): Any amino acid
  MOD_RES (523)..(524): Any amino acid
  MOD_RES (572)..(583): Any amino acid
  MOD_RES (599)..(626): Any amino acid
  MOD_RES (672)..(675): Any amino acid
  MOD_RES (687)..(698): Any amino acid
  MOD_RES (731)..(731): Any amino acid
  MOD_RES (743)..(763): Any amino acid
XXXXXXXXXXXXXXXXXXLMSLSRTREILTKITVDHMAIIKKYTSARQERQEKNPSLRMKXMMAMKYPITANXXXXXXXXXXXXXXXXXXXXXXXXXXXXXMVSPLAITWWNRNGXXXXXXXXXXXXXXXXXXXXXXXXGTFGPVHFRSQVKIRRRVDVNPGHAXXXXTKEAQDVIMEVXFPNEVGARILASESQLXXXXXXXXXXXXXXXXXXXXXXXXXXXLVRKTRFLPVVGGTSSMYIEVLHLTXXXCWEQMYTPGGGVXNDEVDQSLIIAARSIVRRATVSADPLLSLLEMCHSTQVGGXXXXDILRQNPSEEQAVDICKAAIGLRISSSFSFGSFTFKRTSXXXXXXEEELLTGNLQTLKXXXXXXXXXXXXXXXXXXXXXXXXXXXXXXXXXXXXXXXXXXXXXIVAIVFSQEDCMMKAVRGDLNFVXXXXXXXXXXXXLLRHFQKDAKILXXXXXXXXXXXXXXXXXXXXXXXXXXXXXXXXXXXXXXXXXXXXXXXXXXXXXDRFLRVRDQLGXXLLSPEEISETQGTEKLTIIYSSSMMWEINGPDSVLVNTYQWIIKNWEXXXXXXXXXXXXLYNKLEFEPFQSLVPXXXXXXXXXXXXXXXXXXXXXXXXXXXXQIIKMLPFAAAPPVQSRMQFSSFTVNVRGSGLRILVRGNSPVFNHXXXXRRLTVLGKDAGXXXXXXXXXXXXGGVESAVLRGFLILGKENKKRYGPALSISELSXIAKGEKANVLIXXXXXXXXXXXXXXXXXXXXXQTATKRIRMATNECRII

SEQ ID NO: 420101 - protein, 780 aa, Influenza virus
  MOD_RES (1)..(19): Any amino acid
  MOD_RES (58)..(139): Any amino acid
  MOD_RES (165)..(168): Any amino acid
  MOD_RES (180)..(185): Any amino acid
  MOD_RES (197)..(227): Any amino acid
  MOD_RES (249)..(251): Any amino acid
  MOD_RES (264)..(267): Any amino acid
  MOD_RES (279)..(280): Any amino acid
  MOD_RES (302)..(308): Any amino acid
  MOD_RES (339)..(355): Any amino acid
  MOD_RES (367)..(411): Any amino acid
  MOD_RES (433)..(446): Any amino acid
  MOD_RES (459)..(511): Any amino acid
  MOD_RES (523)..(526): Any amino acid
  MOD_RES (558)..(586): Any amino acid
  MOD_RES (601)..(629): Any amino acid
  MOD_RES (674)..(675): Any amino acid
  MOD_RES (687)..(698): Any amino acid
  MOD_RES (729)..(732): Any amino acid
  MOD_RES (744)..(766): Any amino acid
  MOD_RES (778)..(780): Any amino acid
XXXXXXXXXXXXXXXXXXXMSQPRTREILTKTTVDHMAIIRHNQEYTSGRQEKNPALXXXXXXXXXXXXXXXXXXXXXXXXXXXXXXXXXXXXXXXXXXXXXXXXXXXXXXXXXXXXXXXXXXXXXXXXXXXXXXXXXXGAFGPVHFRNQVKIRRRVDMNPGHAXXXXVKEAQDVIMEVXXXXXXGARILTSESQMXXXXXXXXXXXXXXXXXXXXXXXXXXXXXXXTRFLPVAGGTGSVYIEVLHLTXXXCWEQMYTPGGKVXXXXIDQSLIIAARSXXRRATVSADPLVSLLEMCHSTQXXXXXXXDILRQNSTEEQAVEICKAALGLRISSSFSFXXXXXXXXXXXXXXXXXEVLTGNLQTLRXXXXXXXXXXXXXXXXXXXXXXXXXXXXXXXXXXXXXXXXXXXXXIVAMVFSQEDRMIKAVRGDLNXXXXXXXXXXXXXXLLRHFQKDAKMLXXXXXXXXXXXXXXXXXXXXXXXXXXXXXXXXXXXXXXXXXXXXXXXXXXXXXDRFLRVRDQMGXXXXSPEEVSETQGMEKLTITYSSPMMWEINGPESXXXXXXXXXXXXXXXXXXXXXXXXXXXXXKMEFEPFQSLIPKAXXXXXXXXXXXXXXXXXXXXXXXXXXXXXKLLPFAAAPPVQSKMQFSSLTVSVRGSGMRILIRGNSPIFNYNKXXKRLAVLGKDAGXXXXXXXXXXXXAGVEFAVLRGFLILGKEDRRRYGPALSISEXXXXAKGEKTNVLIGXXXXXXXXXXXXXXXXXXXXXXXIKRIRMATNECXXX

SEQ ID NO: 420102 - protein, 780 aa, Influenza virus
  MOD_RES (1)..(40): Any amino acid
  MOD_RES (60)..(234): Any amino acid
  MOD_RES (247)..(251): Any amino acid
  MOD_RES (264)..(276): Any amino acid
  MOD_RES (289)..(312): Any amino acid
  MOD_RES (324)..(421): Any amino acid
  MOD_RES (433)..(640): Any amino acid
  MOD_RES (674)..(713): Any amino acid
  MOD_RES (725)..(766): Any amino acid
  MOD_RES (778)..(780): Any amino acid
XXXXXXXXXXXXXXXXXXXXXXXXXXXXXXXXXXXXXXXXGHNQEYTSGRQEKNPSLRMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGGTGSIYIEVLHXXXXXCWEQMYNPGGEVXXXXXXXXXXXXXRNIVRRATVSTDXXXXXXXXXXXXXXXXXXXXXXXXQNPTEEQAVNIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCMIKAIRGDLNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQNRMQFSSLTVSVRGSGLRILIRGNSPVFNYSKXXXXXXXXXXXXXXXXXXXXXXXXXXXXXXXXXXXXXXXXQKKDKRYGPALXXXXXXXXXXXXXXXXXXXXXXXXXXXXXXXXXXXXXXXXXXTKRIRMAINLVXXX

SEQ ID NO: 420103 - protein, 780 aa, Influenza virus
  MOD_RES (1)..(43): Any amino acid
  MOD_RES (56)..(312): Any amino acid
  MOD_RES (326)..(647): Any amino acid
  MOD_RES (660)..(661): Any amino acid
  MOD_RES (673)..(715): Any amino acid
  MOD_RES (727)..(766): Any amino acid
XXXXXXXXXXXXXXXXXXXXXXXXXXXXXXXXXXXXXXXXXXXKKYTSGRQEKNPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQNPTEEQAVEICKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSLTVNVRGSGLRXXVRGNSPVFNYSXXXXXXXXXXXXXXXXXXXXXXXXXXXXXXXXXXXXXXXXXXXEDKRYGPALSIXXXXXXXXXXXXXXXXXXXXXXXXXXXXXXXXXXXXXXXXTKRIRMAINWGRIV

SEQ ID NO: 420104 - protein, 780 aa, Influenza virus
  MOD_RES (1)..(43): Any amino acid
  MOD_RES (60)..(317): Any amino acid
  MOD_RES (330)..(649): Any amino acid
  MOD_RES (661)..(715): Any amino acid
  MOD_RES (727)..(766): Any amino acid
  MOD_RES (778)..(780): Any amino acid
XXXXXXXXXXXXXXXXXXXXXXXXXXXXXXXXXXXXXXXXXXXKKYTSARQEKNPALRMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEQAVDICKAALGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTVNVRGSGMRVXXXXXXXXXXXXXXXXXXXXXXXXXXXXXXXXXXXXXXXXXXXXXXXXXXXXXXXEDRRYGPALSIXXXXXXXXXXXXXXXXXXXXXXXXXXXXXXXXXXXXXXXXTKRIRMAINYSXXX

SEQ ID NO: 420105 - protein, 780 aa, Influenza virus
  MOD_RES (1)..(715): Any amino acid
  MOD_RES (727)..(780): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXENKRYGPALSIXXXXXXXXXXXXXXXXXXXXXXXXXXXXXXXXXXXXXXXXXXXXXXXXXXXXXX

SEQ ID NO: 420106 - protein, 780 aa, Influenza virus
  MOD_RES (1)..(715): Any amino acid
  MOD_RES (727)..(780): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXENKKYGPALSIXXXXXXXXXXXXXXXXXXXXXXXXXXXXXXXXXXXXXXXXXXXXXXXXXXXXXX

SEQ ID NO: 420107 - protein, 742 aa, Influenza virus; identical to SEQ ID NO: 418289
  MOD_RES (11)..(14): Any amino acid
  MOD_RES (24)..(31): Any amino acid
  MOD_RES (46)..(74): Any amino acid
  MOD_RES (94)..(154): Any amino acid
  MOD_RES (164)..(223): Any amino acid
  MOD_RES (232)..(233): Any amino acid
  MOD_RES (242)..(280): Any amino acid
  MOD_RES (289)..(298): Any amino acid
  MOD_RES (311)..(341): Any amino acid
  MOD_RES (357)..(358): Any amino acid
  MOD_RES (367)..(369): Any amino acid
  MOD_RES (387)..(393): Any amino acid
  MOD_RES (402)..(422): Any amino acid
  MOD_RES (439)..(440): Any amino acid
  MOD_RES (458)..(459): Any amino acid
  MOD_RES (491)..(496): Any amino acid
  MOD_RES (506)..(641): Any amino acid
  MOD_RES (658)..(681): Any amino acid
  MOD_RES (703)..(718): Any amino acid
  MOD_RES (732)..(732): Any amino acid
  MOD_RES (741)..(742): Any amino acid

SEQ ID NO: 420108 - protein, 742 aa, Influenza virus; identical to SEQ ID NO: 418290
  MOD_RES (1)..(2): Any amino acid
  MOD_RES (11)..(14): Any amino acid
  MOD_RES (24)..(40): Any amino acid
  MOD_RES (49)..(223): Any amino acid
  MOD_RES (232)..(341): Any amino acid
  MOD_RES (354)..(358): Any amino acid
  MOD_RES (367)..(378): Any amino acid
  MOD_RES (387)..(422): Any amino acid
  MOD_RES (449)..(459): Any amino acid
  MOD_RES (477)..(477): Any amino acid
  MOD_RES (491)..(688): Any amino acid
  MOD_RES (702)..(732): Any amino acid
  MOD_RES (741)..(742): Any amino acid

SEQ ID NO: 420109 - protein, 742 aa, Influenza virus; identical to SEQ ID NO: 418291
  MOD_RES (1)..(2): Any amino acid
  MOD_RES (11)..(14): Any amino acid
  MOD_RES (24)..(43): Any amino acid
  MOD_RES (52)..(223): Any amino acid
  MOD_RES (232)..(341): Any amino acid
  MOD_RES (350)..(358): Any amino acid
  MOD_RES (367)..(383): Any amino acid
  MOD_RES (394)..(424): Any amino acid
  MOD_RES (439)..(440): Any amino acid
  MOD_RES (449)..(459): Any amino acid
  MOD_RES (478)..(732): Any amino acid
  MOD_RES (742)..(742): Any amino acid

SEQ ID NO: 420110 - protein, 742 aa, Influenza virus; identical to SEQ ID NO: 418292
  MOD_RES (1)..(17): Any amino acid
  MOD_RES (26)..(43): Any amino acid
  MOD_RES (52)..(430): Any amino acid
  MOD_RES (439)..(459): Any amino acid
  MOD_RES (476)..(732): Any amino acid

SEQ ID NO: 420111 - protein, 742 aa, Influenza virus; identical to SEQ ID NO: 418293
  MOD_RES (1)..(17): Any amino acid
  MOD_RES (26)..(430): Any amino acid
  MOD_RES (439)..(461): Any amino acid
  MOD_RES (470)..(732): Any amino acid

SEQ ID NO: 420112 - protein, 694 aa, Influenza virus; identical to SEQ ID NO: 418302
  MOD_RES (26)..(76): Any amino acid
  MOD_RES (87)..(385): Any amino acid
  MOD_RES (397)..(410): Any amino acid
  MOD_RES (420)..(425): Any amino acid
  MOD_RES (434)..(441): Any amino acid
  MOD_RES (453)..(453): Any amino acid
  MOD_RES (462)..(473): Any amino acid
  MOD_RES (482)..(546): Any amino acid
  MOD_RES (556)..(659): Any amino acid
  MOD_RES (676)..(677): Any amino acid

SEQ ID NO: 420113 - protein, 694 aa, Influenza virus; identical to SEQ ID NO: 418303
  MOD_RES (19)..(19): Any amino acid
  MOD_RES (30)..(385): Any amino acid
  MOD_RES (397)..(410): Any amino acid
  MOD_RES (420)..(425): Any amino acid
  MOD_RES (434)..(441): Any amino acid
  MOD_RES (450)..(453): Any amino acid
  MOD_RES (462)..(546): Any amino acid
  MOD_RES (555)..(694): Any amino acid

SEQ ID NO: 420114 - protein, 694 aa, Influenza virus; identical to SEQ ID NO: 418304
  MOD_RES (1)..(1): Any amino acid
  MOD_RES (13)..(385): Any amino acid
  MOD_RES (397)..(411): Any amino acid
  MOD_RES (434)..(441): Any amino acid
  MOD_RES (450)..(694): Any amino acid

SEQ ID NO: 420115 - protein, 694 aa, Influenza virus; identical to SEQ ID NO: 418305
  MOD_RES (1)..(5): Any amino acid
  MOD_RES (18)..(387): Any amino acid
  MOD_RES (397)..(441): Any amino acid
  MOD_RES (450)..(694): Any amino acid

SEQ ID NO: 420116 - protein, 694 aa, Influenza virus; identical to SEQ ID NO: 418306
  MOD_RES (1)..(5): Any amino acid
  MOD_RES (18)..(387): Any amino acid
  MOD_RES (397)..(443): Any amino acid
  MOD_RES (453)..(694): Any amino acid

SEQ ID NO: 420117 - protein, 502 aa, Influenza virus; identical to SEQ ID NO: 418311
  MOD_RES (29)..(43): Any amino acid
  MOD_RES (52)..(110): Any amino acid
  MOD_RES (165)..(165): Any amino acid
  MOD_RES (235)..(237): Any amino acid
  MOD_RES (285)..(289): Any amino acid
  MOD_RES (305)..(307): Any amino acid
  MOD_RES (328)..(330): Any amino acid
  MOD_RES (348)..(364): Any amino acid
  MOD_RES (385)..(389): Any amino acid
  MOD_RES (402)..(416): Any amino acid
  MOD_RES (452)..(454): Any amino acid
  MOD_RES (471)..(472): Any amino acid
  MOD_RES (496)..(502): Any amino acid

SEQ ID NO: 420118 - protein, 502 aa, Influenza virus; identical to SEQ ID NO: 418312
  MOD_RES (19)..(43): Any amino acid
  MOD_RES (52)..(110): Any amino acid
  MOD_RES (165)..(165): Any amino acid
  MOD_RES (189)..(195): Any amino acid
  MOD_RES (235)..(237): Any amino acid
  MOD_RES (263)..(276): Any amino acid
  MOD_RES (285)..(289): Any amino acid
  MOD_RES (305)..(307): Any amino acid
  MOD_RES (328)..(330): Any amino acid
  MOD_RES (348)..(364): Any amino acid
  MOD_RES (383)..(389): Any amino acid
  MOD_RES (402)..(416): Any amino acid
  MOD_RES (452)..(454): Any amino acid
  MOD_RES (471)..(483): Any amino acid
  MOD_RES (496)..(502): Any amino acid

SEQ ID NO: 420119 - protein, 502 aa, Influenza virus; identical to SEQ ID NO: 418313
  MOD_RES (1)..(1): Any amino acid
  MOD_RES (13)..(110): Any amino acid
  MOD_RES (150)..(156): Any amino acid
  MOD_RES (165)..(165): Any amino acid
  MOD_RES (235)..(247): Any amino acid
  MOD_RES (263)..(276): Any amino acid
  MOD_RES (285)..(289): Any amino acid
  MOD_RES (305)..(307): Any amino acid
  MOD_RES (328)..(330): Any amino acid
  MOD_RES (341)..(364): Any amino acid
  MOD_RES (385)..(390): Any amino acid
  MOD_RES (402)..(416): Any amino acid
  MOD_RES (425)..(428): Any amino acid
  MOD_RES (452)..(455): Any amino acid
  MOD_RES (471)..(483): Any amino acid
  MOD_RES (496)..(502): Any amino acid

SEQ ID NO: 420120 - protein, 502 aa, Influenza virus; identical to SEQ ID NO: 418314
  MOD_RES (1)..(5): Any amino acid
  MOD_RES (18)..(110): Any amino acid
  MOD_RES (137)..(156): Any amino acid
  MOD_RES (165)..(165): Any amino acid
  MOD_RES (186)..(195): Any amino acid
  MOD_RES (235)..(247): Any amino acid
  MOD_RES (260)..(289): Any amino acid
  MOD_RES (305)..(307): Any amino acid
  MOD_RES (316)..(316): Any amino acid
  MOD_RES (328)..(330): Any amino acid
  MOD_RES (348)..(364): Any amino acid
  MOD_RES (382)..(393): Any amino acid
  MOD_RES (402)..(416): Any amino acid
  MOD_RES (425)..(428): Any amino acid
  MOD_RES (452)..(455): Any amino acid
  MOD_RES (471)..(483): Any amino acid
  MOD_RES (496)..(502): Any amino acid

SEQ ID NO: 420121 - protein, 502 aa, Influenza virus; identical to SEQ ID NO: 418315
  MOD_RES (1)..(110): Any amino acid
  MOD_RES (140)..(165): Any amino acid
  MOD_RES (186)..(195): Any amino acid
  MOD_RES (204)..(213): Any amino acid
  MOD_RES (229)..(249): Any amino acid
  MOD_RES (263)..(289): Any amino acid
  MOD_RES (301)..(319): Any amino acid
  MOD_RES (328)..(330): Any amino acid
  MOD_RES (347)..(364): Any amino acid
  MOD_RES (383)..(393): Any amino acid
  MOD_RES (402)..(435): Any amino acid
  MOD_RES (447)..(484): Any amino acid
  MOD_RES (496)..(502): Any amino acid

SEQ ID NO: 420122 - protein, 494 aa, Influenza virus; identical to SEQ ID NO: 418318
  MOD_RES (21)..(53): Any amino acid
  MOD_RES (62)..(71): Any amino acid
  MOD_RES (80)..(85): Any amino acid
  MOD_RES (95)..(109): Any amino acid
  MOD_RES (127)..(127): Any amino acid
  MOD_RES (140)..(141): Any amino acid
  MOD_RES (155)..(167): Any amino acid
  MOD_RES (211)..(213): Any amino acid
  MOD_RES (222)..(234): Any amino acid
  MOD_RES (250)..(250): Any amino acid
  MOD_RES (263)..(285): Any amino acid
  MOD_RES (301)..(303): Any amino acid
  MOD_RES (328)..(333): Any amino acid
  MOD_RES (347)..(364): Any amino acid
  MOD_RES (375)..(376): Any amino acid
  MOD_RES (385)..(388): Any amino acid
  MOD_RES (399)..(421): Any amino acid
  MOD_RES (432)..(434): Any amino acid
  MOD_RES (449)..(453): Any amino acid

SEQ ID NO: 420123 - protein, 494 aa, Influenza virus; identical to SEQ ID NO: 418319
  MOD_RES (1)..(58): Any amino acid
  MOD_RES (69)..(109): Any amino acid
  MOD_RES (126)..(127): Any amino acid
  MOD_RES (140)..(141): Any amino acid
  MOD_RES (150)..(167): Any amino acid
  MOD_RES (211)..(213): Any amino acid
  MOD_RES (222)..(234): Any amino acid
  MOD_RES (250)..(250): Any amino acid
  MOD_RES (263)..(285): Any amino acid
  MOD_RES (301)..(303): Any amino acid
  MOD_RES (320)..(333): Any amino acid
  MOD_RES (347)..(364): Any amino acid
  MOD_RES (375)..(376): Any amino acid
  MOD_RES (385)..(388): Any amino acid
  MOD_RES (399)..(421): Any amino acid
  MOD_RES (432)..(434): Any amino acid
  MOD_RES (449)..(453): Any amino acid
  MOD_RES (493)..(494): Any amino acid

SEQ ID NO: 420124 - protein, 494 aa, Influenza virus; identical to SEQ ID NO: 418320
  MOD_RES (1)..(109): Any amino acid
  MOD_RES (127)..(127): Any amino acid
  MOD_RES (140)..(167): Any amino acid
  MOD_RES (211)..(213): Any amino acid
  MOD_RES (222)..(234): Any amino acid
  MOD_RES (250)..(251): Any amino acid
  MOD_RES (263)..(285): Any amino acid
  MOD_RES (301)..(303): Any amino acid
  MOD_RES (320)..(333): Any amino acid
  MOD_RES (347)..(364): Any amino acid
  MOD_RES (375)..(376): Any amino acid
  MOD_RES (385)..(388): Any amino acid
  MOD_RES (399)..(422): Any amino acid
  MOD_RES (432)..(440): Any amino acid
  MOD_RES (449)..(454): Any amino acid
  MOD_RES (492)..(494): Any amino acid

SEQ ID NO: 420125 - protein, 494 aa, Influenza virus; identical to SEQ ID NO: 418321
  MOD_RES (1)..(109): Any amino acid
  MOD_RES (127)..(127): Any amino acid
  MOD_RES (140)..(167): Any amino acid
  MOD_RES (177)..(178): Any amino acid
  MOD_RES (194)..(194): Any amino acid
  MOD_RES (208)..(213): Any amino acid
  MOD_RES (222)..(234): Any amino acid
  MOD_RES (250)..(254): Any amino acid
  MOD_RES (263)..(292): Any amino acid
  MOD_RES (301)..(311): Any amino acid
  MOD_RES (320)..(338): Any amino acid
  MOD_RES (347)..(366): Any amino acid
  MOD_RES (375)..(388): Any amino acid
  MOD_RES (399)..(454): Any amino acid
  MOD_RES (466)..(472): Any amino acid
  MOD_RES (493)..(494): Any amino acid

SEQ ID NO: 420126 - protein, 494 aa, Influenza virus; identical to SEQ ID NO: 418322
  MOD_RES (1)..(112): Any amino acid
  MOD_RES (122)..(131): Any amino acid
  MOD_RES (140)..(167): Any amino acid
  MOD_RES (176)..(178): Any amino acid
  MOD_RES (187)..(234): Any amino acid
  MOD_RES (250)..(260): Any amino acid
  MOD_RES (270)..(292): Any amino acid
  MOD_RES (301)..(338): Any amino acid
  MOD_RES (347)..(366): Any amino acid
  MOD_RES (375)..(388): Any amino acid
  MOD_RES (398)..(455): Any amino acid
  MOD_RES (470)..(474): Any amino acid
  MOD_RES (491)..(494): Any amino acid

SEQ ID NO: 420127 - protein, 515 aa, Influenza virus; identical to SEQ ID NO: 418329
  MOD_RES (1)..(20): Any amino acid
  MOD_RES (39)..(88): Any amino acid
  MOD_RES (112)..(113): Any amino acid
  MOD_RES (127)..(127): Any amino acid
  MOD_RES (195)..(266): Any amino acid
  MOD_RES (281)..(287): Any amino acid
  MOD_RES (306)..(318): Any amino acid
  MOD_RES (332)..(332): Any amino acid
  MOD_RES (379)..(390): Any amino acid
  MOD_RES (401)..(401): Any amino acid
  MOD_RES (413)..(414): Any amino acid
  MOD_RES (430)..(438): Any amino acid
  MOD_RES (458)..(460): Any amino acid
  MOD_RES (478)..(481): Any amino acid

SEQ ID NO: 420128 - protein, 515 aa, Influenza virus; identical to SEQ ID NO: 418330
  MOD_RES (1)..(20): Any amino acid
  MOD_RES (39)..(88): Any amino acid
  MOD_RES (112)..(113): Any amino acid
  MOD_RES (127)..(127): Any amino acid
  MOD_RES (195)..(266): Any amino acid
  MOD_RES (281)..(287): Any amino acid
  MOD_RES (306)..(318): Any amino acid
  MOD_RES (332)..(332): Any amino acid
  MOD_RES (379)..(390): Any amino acid
  MOD_RES (401)..(401): Any amino acid
  MOD_RES (413)..(414): Any amino acid
  MOD_RES (430)..(438): Any amino acid
  MOD_RES (458)..(460): Any amino acid
  MOD_RES (478)..(481): Any amino acid

SEQ ID NO: 420129 - protein, 515 aa, Influenza virus; identical to SEQ ID NO: 418331
  MOD_RES (1)..(20): Any amino acid
  MOD_RES (39)..(88): Any amino acid
  MOD_RES (112)..(113): Any amino acid
  MOD_RES (123)..(127): Any amino acid
  MOD_RES (195)..(266): Any amino acid
  MOD_RES (276)..(287): Any amino acid
  MOD_RES (306)..(318): Any amino acid
  MOD_RES (327)..(332): Any amino acid
  MOD_RES (342)..(342): Any amino acid
  MOD_RES (366)..(367): Any amino acid
  MOD_RES (379)..(390): Any amino acid
  MOD_RES (400)..(401): Any amino acid
  MOD_RES (413)..(414): Any amino acid
  MOD_RES (430)..(438): Any amino acid
  MOD_RES (447)..(449): Any amino acid
  MOD_RES (458)..(460): Any amino acid
  MOD_RES (478)..(481): Any amino acid
  MOD_RES (503)..(503): Any amino acid

SEQ ID NO: 420130 - protein, 515 aa, Influenza virus; identical to SEQ ID NO: 418332
  MOD_RES (1)..(20): Any amino acid
  MOD_RES (39)..(103): Any amino acid
  MOD_RES (112)..(113): Any amino acid
  MOD_RES (127)..(127): Any amino acid
  MOD_RES (163)..(164): Any amino acid
  MOD_RES (173)..(173): Any amino acid
  MOD_RES (182)..(185): Any amino acid
  MOD_RES (195)..(266): Any amino acid
  MOD_RES (275)..(287): Any amino acid
  MOD_RES (306)..(318): Any amino acid
  MOD_RES (328)..(332): Any amino acid
  MOD_RES (342)..(344): Any amino acid
  MOD_RES (366)..(367): Any amino acid
  MOD_RES (379)..(390): Any amino acid
  MOD_RES (399)..(401): Any amino acid
  MOD_RES (411)..(414): Any amino acid
  MOD_RES (425)..(438): Any amino acid
  MOD_RES (449)..(449): Any amino acid
  MOD_RES (458)..(467): Any amino acid
  MOD_RES (478)..(482): Any amino acid
  MOD_RES (491)..(496): Any amino acid
  MOD_RES (515)..(515): Any amino acid

SEQ ID NO: 420131 - protein, 515 aa, Influenza virus; identical to SEQ ID NO: 418333
  MOD_RES (1)..(20): Any amino acid
  MOD_RES (39)..(113): Any amino acid
  MOD_RES (127)..(127): Any amino acid
  MOD_RES (136)..(145): Any amino acid
  MOD_RES (165)..(165): Any amino acid
  MOD_RES (182)..(266): Any amino acid
  MOD_RES (275)..(287): Any amino acid
  MOD_RES (306)..(318): Any amino acid
  MOD_RES (329)..(345): Any amino acid
  MOD_RES (367)..(367): Any amino acid
  MOD_RES (379)..(390): Any amino acid
  MOD_RES (399)..(401): Any amino acid
  MOD_RES (410)..(421): Any amino acid
  MOD_RES (430)..(469): Any amino acid
  MOD_RES (478)..(496): Any amino acid
  MOD_RES (512)..(515): Any amino acid

SEQ ID NO: 420132 - protein, 470 aa, Influenza virus; identical to SEQ ID NO: 418337
  MOD_RES (15)..(16): Any amino acid
  MOD_RES (44)..(47): Any amino acid
  MOD_RES (74)..(89): Any amino acid
  MOD_RES (264)..(266): Any amino acid
  MOD_RES (335)..(335): Any amino acid

SEQ ID NO: 420133 - protein, 470 aa, Influenza virus; identical to SEQ ID NO: 418338
  MOD_RES (15)..(16): Any amino acid
  MOD_RES (28)..(32): Any amino acid
  MOD_RES (44)..(47): Any amino acid
  MOD_RES (74)..(89): Any amino acid
  MOD_RES (102)..(112): Any amino acid
  MOD_RES (134)..(154): Any amino acid
  MOD_RES (170)..(179): Any amino acid
  MOD_RES (223)..(233): Any amino acid
  MOD_RES (264)..(266): Any amino acid
  MOD_RES (295)..(295): Any amino acid
  MOD_RES (335)..(335): Any amino acid
  MOD_RES (346)..(362): Any amino acid
  MOD_RES (468)..(470): Any amino acid

SEQ ID NO: 420134 - protein, 470 aa, Influenza virus; identical to SEQ ID NO: 418339
  MOD_RES (13)..(18): Any amino acid
  MOD_RES (44)..(57): Any amino acid
  MOD_RES (74)..(89): Any amino acid
  MOD_RES (101)..(113): Any amino acid
  MOD_RES (134)..(154): Any amino acid
  MOD_RES (170)..(184): Any amino acid
  MOD_RES (218)..(233): Any amino acid
  MOD_RES (249)..(250): Any amino acid
  MOD_RES (264)..(266): Any amino acid
  MOD_RES (294)..(301): Any amino acid
  MOD_RES (335)..(335): Any amino acid
  MOD_RES (344)..(363): Any amino acid
  MOD_RES (395)..(428): Any amino acid
  MOD_RES (444)..(444): Any amino acid
  MOD_RES (465)..(470): Any amino acid

SEQ ID NO: 420135 - protein, 470 aa, Influenza virus; identical to SEQ ID NO: 418340
  MOD_RES (1)..(1): Any amino acid
  MOD_RES (15)..(19): Any amino acid
  MOD_RES (30)..(33): Any amino acid
  MOD_RES (44)..(57): Any amino acid
  MOD_RES (71)..(117): Any amino acid
  MOD_RES (133)..(157): Any amino acid
  MOD_RES (168)..(191): Any amino acid
  MOD_RES (213)..(239): Any amino acid
  MOD_RES (255)..(255): Any amino acid
  MOD_RES (264)..(266): Any amino acid
  MOD_RES (294)..(302): Any amino acid
  MOD_RES (311)..(319): Any amino acid
  MOD_RES (335)..(381): Any amino acid
  MOD_RES (391)..(429): Any amino acid
  MOD_RES (441)..(445): Any amino acid
  MOD_RES (459)..(462): Any amino acid

SEQ ID NO: 420136 - protein, 470 aa, Influenza virus; identical to SEQ ID NO: 418341
  MOD_RES (1)..(3): Any amino acid
  MOD_RES (13)..(19): Any amino acid
  MOD_RES (28)..(35): Any amino acid
  MOD_RES (44)..(61): Any amino acid
  MOD_RES (71)..(120): Any amino acid
  MOD_RES (134)..(160): Any amino acid
  MOD_RES (169)..(246): Any amino acid
  MOD_RES (255)..(266): Any amino acid
  MOD_RES (278)..(285): Any amino acid
  MOD_RES (294)..(302): Any amino acid
  MOD_RES (317)..(320): Any amino acid
  MOD_RES (334)..(447): Any amino acid
  MOD_RES (459)..(470): Any amino acid

SEQ ID NO: 420137 - protein, 473 aa, Influenza virus; identical to SEQ ID NO: 418344
  MOD_RES (19)..(20): Any amino acid
  MOD_RES (30)..(47): Any amino acid
  MOD_RES (71)..(79): Any amino acid
  MOD_RES (234)..(234): Any amino acid
  MOD_RES (257)..(264): Any amino acid
  MOD_RES (302)..(308): Any amino acid
  MOD_RES (329)..(335): Any amino acid
  MOD_RES (383)..(393): Any amino acid
  MOD_RES (416)..(418): Any amino acid

SEQ ID NO: 420138 - protein, 473 aa, Influenza virus; identical to SEQ ID NO: 418345
  MOD_RES (1)..(5): Any amino acid
  MOD_RES (19)..(20): Any amino acid
  MOD_RES (30)..(47): Any amino acid
  MOD_RES (71)..(79): Any amino acid
  MOD_RES (132)..(132): Any amino acid
  MOD_RES (148)..(152): Any amino acid
  MOD_RES (200)..(200): Any amino acid
  MOD_RES (234)..(237): Any amino acid
  MOD_RES (257)..(264): Any amino acid
  MOD_RES (274)..(274): Any amino acid
  MOD_RES (290)..(292): Any amino acid
  MOD_RES (302)..(308): Any amino acid
  MOD_RES (329)..(335): Any amino acid
  MOD_RES (346)..(349): Any amino acid
  MOD_RES (383)..(393): Any amino acid
  MOD_RES (416)..(418): Any amino acid
  MOD_RES (445)..(445): Any amino acid
  MOD_RES (472)..(473): Any amino acid

SEQ ID NO: 420139 - protein, 473 aa, Influenza virus; identical to SEQ ID NO: 418346
  MOD_RES (1)..(5): Any amino acid
  MOD_RES (19)..(20): Any amino acid
  MOD_RES (30)..(47): Any amino acid
  MOD_RES (71)..(79): Any amino acid
  MOD_RES (130)..(133): Any amino acid
  MOD_RES (143)..(154): Any amino acid
  MOD_RES (234)..(238): Any amino acid
  MOD_RES (257)..(264): Any amino acid
  MOD_RES (290)..(308): Any amino acid
  MOD_RES (318)..(320): Any amino acid
  MOD_RES (329)..(335): Any amino acid
  MOD_RES (383)..(393): Any amino acid
  MOD_RES (416)..(426): Any amino acid
  MOD_RES (442)..(449): Any amino acid
  MOD_RES (473)..(473): Any amino acid

SEQ ID NO: 420140 - protein, 473 aa, Influenza virus; identical to SEQ ID NO: 418347
  MOD_RES (1)..(5): Any amino acid
  MOD_RES (18)..(47): Any amino acid
  MOD_RES (70)..(79): Any amino acid
  MOD_RES (103)..(116): Any amino acid
  MOD_RES (128)..(156): Any amino acid
  MOD_RES (175)..(180): Any amino acid
  MOD_RES (200)..(205): Any amino acid
  MOD_RES (221)..(224): Any amino acid
  MOD_RES (234)..(238): Any amino acid
  MOD_RES (257)..(264): Any amino acid
  MOD_RES (276)..(276): Any amino acid
  MOD_RES (292)..(308): Any amino acid
  MOD_RES (318)..(320): Any amino acid
  MOD_RES (329)..(335): Any amino acid
  MOD_RES (346)..(353): Any amino acid
  MOD_RES (362)..(365): Any amino acid
  MOD_RES (383)..(393): Any amino acid
  MOD_RES (416)..(428): Any amino acid
  MOD_RES (444)..(450): Any amino acid
  MOD_RES (462)..(473): Any amino acid

SEQ ID NO: 420141 - protein, 473 aa, Influenza virus; identical to SEQ ID NO: 418348
  MOD_RES (1)..(7): Any amino acid
  MOD_RES (19)..(47): Any amino acid
  MOD_RES (70)..(88): Any amino acid
  MOD_RES (103)..(116): Any amino acid
  MOD_RES (132)..(180): Any amino acid
  MOD_RES (189)..(190): Any amino acid
  MOD_RES (203)..(205): Any amino acid
  MOD_RES (227)..(243): Any amino acid
  MOD_RES (257)..(265): Any amino acid
  MOD_RES (289)..(320): Any amino acid
  MOD_RES (329)..(335): Any amino acid
  MOD_RES (344)..(365): Any amino acid
  MOD_RES (382)..(393): Any amino acid
  MOD_RES (416)..(432): Any amino acid
  MOD_RES (444)..(451): Any amino acid
  MOD_RES (465)..(473): Any amino acid

SEQ ID NO: 420142 - protein, 471 aa, Influenza virus; identical to SEQ ID NO: 418351
  MOD_RES (37)..(55): Any amino acid
  MOD_RES (64)..(87): Any amino acid
  MOD_RES (128)..(128): Any amino acid
  MOD_RES (173)..(174): Any amino acid
  MOD_RES (210)..(214): Any amino acid
  MOD_RES (253)..(271): Any amino acid
  MOD_RES (286)..(288): Any amino acid
  MOD_RES (309)..(311): Any amino acid
  MOD_RES (334)..(343): Any amino acid
  MOD_RES (387)..(397): Any amino acid
  MOD_RES (416)..(417): Any amino acid

SEQ ID NO: 420143 - protein, 471 aa, Influenza virus; identical to SEQ ID NO: 418352
  MOD_RES (37)..(87): Any amino acid
  MOD_RES (104)..(104): Any amino acid
  MOD_RES (128)..(128): Any amino acid
  MOD_RES (173)..(174): Any amino acid
  MOD_RES (210)..(214): Any amino acid
  MOD_RES (226)..(228): Any amino acid
  MOD_RES (253)..(271): Any amino acid
  MOD_RES (286)..(288): Any amino acid
  MOD_RES (309)..(311): Any amino acid
  MOD_RES (334)..(343): Any amino acid
  MOD_RES (387)..(397): Any amino acid
  MOD_RES (416)..(417): Any amino acid

SEQ ID NO: 420144 - protein, 471 aa, Influenza virus; identical to SEQ ID NO: 418353
  MOD_RES (24)..(24): Any amino acid
  MOD_RES (34)..(87): Any amino acid
  MOD_RES (102)..(104): Any amino acid
  MOD_RES (120)..(128): Any amino acid
  MOD_RES (171)..(174): Any amino acid
  MOD_RES (202)..(214): Any amino acid
  MOD_RES (229)..(230): Any amino acid
  MOD_RES (251)..(271): Any amino acid
  MOD_RES (280)..(288): Any amino acid
  MOD_RES (309)..(311): Any amino acid
  MOD_RES (334)..(343): Any amino acid
  MOD_RES (387)..(397): Any amino acid
  MOD_RES (416)..(427): Any amino acid
  MOD_RES (463)..(463): Any amino acid

SEQ ID NO: 420145 - protein, 471 aa, Influenza virus; identical to SEQ ID NO: 418354
  MOD_RES (1)..(4): Any amino acid
  MOD_RES (35)..(87): Any amino acid
  MOD_RES (120)..(143): Any amino acid
  MOD_RES (159)..(159): Any amino acid
  MOD_RES (173)..(174): Any amino acid
  MOD_RES (209)..(214): Any amino acid
  MOD_RES (225)..(230): Any amino acid
  MOD_RES (253)..(271): Any amino acid
  MOD_RES (281)..(300): Any amino acid
  MOD_RES (309)..(311): Any amino acid
  MOD_RES (330)..(343): Any amino acid
  MOD_RES (387)..(397): Any amino acid
  MOD_RES (416)..(429): Any amino acid
  MOD_RES (447)..(449): Any amino acid
  MOD_RES (462)..(471): Any amino acid

SEQ ID NO: 420146 - protein, 471 aa, Influenza virus; identical to SEQ ID NO: 418355
  MOD_RES (1)..(6): Any amino acid
  MOD_RES (24)..(25): Any amino acid
  MOD_RES (37)..(87): Any amino acid
  MOD_RES (96)..(105): Any amino acid
  MOD_RES (123)..(148): Any amino acid
  MOD_RES (164)..(181): Any amino acid
  MOD_RES (194)..(217): Any amino acid
  MOD_RES (226)..(234): Any amino acid
  MOD_RES (253)..(272): Any amino acid
  MOD_RES (281)..(300): Any amino acid
  MOD_RES (309)..(311): Any amino acid
  MOD_RES (331)..(350): Any amino acid
  MOD_RES (359)..(359): Any amino acid
  MOD_RES (368)..(370): Any amino acid
  MOD_RES (386)..(398): Any amino acid
  MOD_RES (408)..(429): Any amino acid
  MOD_RES (448)..(471): Any amino acid

SEQ ID NO: 420147 - protein, 471 aa, Influenza virus; identical to SEQ ID NO: 418357
  MOD_RES (16)..(19): Any amino acid
  MOD_RES (39)..(61): Any amino acid
  MOD_RES (73)..(82): Any amino acid
  MOD_RES (167)..(168): Any amino acid
  MOD_RES (254)..(267): Any amino acid
  MOD_RES (285)..(285): Any amino acid
  MOD_RES (308)..(311): Any amino acid
  MOD_RES (332)..(333): Any amino acid
  MOD_RES (387)..(391): Any amino acid
  MOD_RES (400)..(400): Any amino acid
  MOD_RES (416)..(416): Any amino acid

SEQ ID NO: 420148 - protein, 471 aa, Influenza virus; identical to SEQ ID NO: 418358
  MOD_RES (13)..(19): Any amino acid
  MOD_RES (37)..(61): Any amino acid
  MOD_RES (73)..(82): Any amino acid
  MOD_RES (167)..(168): Any amino acid
  MOD_RES (254)..(267): Any amino acid
  MOD_RES (285)..(285): Any amino acid
  MOD_RES (294)..(294): Any amino acid
  MOD_RES (308)..(311): Any amino acid
  MOD_RES (332)..(333): Any amino acid
  MOD_RES (384)..(391): Any amino acid
  MOD_RES (400)..(400): Any amino acid
  MOD_RES (416)..(416): Any amino acid
  MOD_RES (425)..(430): Any amino acid
  MOD_RES (470)..(471): Any amino acid

SEQ ID NO: 420149 - protein, 471 aa, Influenza virus; identical to SEQ ID NO: 418359
  MOD_RES (16)..(19): Any amino acid
  MOD_RES (39)..(61): Any amino acid
  MOD_RES (72)..(82): Any amino acid
  MOD_RES (106)..(106): Any amino acid
  MOD_RES (118)..(118): Any amino acid
  MOD_RES (135)..(138): Any amino acid
  MOD_RES (167)..(168): Any amino acid
  MOD_RES (225)..(227): Any amino acid
  MOD_RES (254)..(267): Any amino acid
  MOD_RES (282)..(285): Any amino acid
  MOD_RES (295)..(296): Any amino acid
  MOD_RES (308)..(311): Any amino acid
  MOD_RES (321)..(321): Any amino acid
  MOD_RES (332)..(333): Any amino acid
  MOD_RES (387)..(391): Any amino acid
  MOD_RES (400)..(400): Any amino acid
  MOD_RES (416)..(416): Any amino acid
  MOD_RES (426)..(432): Any amino acid

SEQ ID NO: 420150 - protein, 471 aa, Influenza virus; identical to SEQ ID NO: 418360
  MOD_RES (1)..(1): Any amino acid
  MOD_RES (16)..(19): Any amino acid
  MOD_RES (39)..(61): Any amino acid
  MOD_RES (70)..(82): Any amino acid
  MOD_RES (107)..(118): Any amino acid
  MOD_RES (135)..(140): Any amino acid
  MOD_RES (167)..(168): Any amino acid
  MOD_RES (199)..(201): Any amino acid
  MOD_RES (224)..(227): Any amino acid
  MOD_RES (254)..(267): Any amino acid
  MOD_RES (283)..(285): Any amino acid
  MOD_RES (295)..(298): Any amino acid
  MOD_RES (308)..(311): Any amino acid
  MOD_RES (321)..(323): Any amino acid
  MOD_RES (332)..(338): Any amino acid
  MOD_RES (347)..(349): Any amino acid
  MOD_RES (387)..(391): Any amino acid
  MOD_RES (400)..(416): Any amino acid
  MOD_RES (425)..(434): Any amino acid
  MOD_RES (455)..(455): Any amino acid
  MOD_RES (469)..(471): Any amino acid

SEQ ID NO: 420151 - protein, 471 aa, Influenza virus; identical to SEQ ID NO: 418361
  MOD_RES (1)..(2): Any amino acid
  MOD_RES (13)..(19): Any amino acid
  MOD_RES (39)..(62): Any amino acid
  MOD_RES (73)..(84): Any amino acid
  MOD_RES (107)..(144): Any amino acid
  MOD_RES (156)..(158): Any amino acid
  MOD_RES (167)..(168): Any amino acid
  MOD_RES (180)..(182): Any amino acid
  MOD_RES (205)..(207): Any amino acid
  MOD_RES (228)..(228): Any amino acid
  MOD_RES (238)..(238): Any amino acid
  MOD_RES (254)..(270): Any amino acid
  MOD_RES (285)..(285): Any amino acid
  MOD_RES (296)..(323): Any amino acid
  MOD_RES (332)..(339): Any amino acid
  MOD_RES (349)..(349): Any amino acid
  MOD_RES (358)..(360): Any amino acid
  MOD_RES (387)..(416): Any amino acid
  MOD_RES (426)..(446): Any amino acid
  MOD_RES (455)..(458): Any amino acid
  MOD_RES (468)..(471): Any amino acid

SEQ ID NO: 420152 - protein, 548 aa, Influenza virus; identical to SEQ ID NO: 418365
  MOD_RES (1)..(50): Any amino acid
  MOD_RES (61)..(168): Any amino acid
  MOD_RES (201)..(201): Any amino acid
  MOD_RES (274)..(291): Any amino acid
  MOD_RES (326)..(344): Any amino acid
  MOD_RES (408)..(417): Any amino acid
  MOD_RES (450)..(470): Any amino acid
  MOD_RES (489)..(491): Any amino acid
  MOD_RES (510)..(510): Any amino acid
  MOD_RES (527)..(528): Any amino acid

SEQ ID NO: 420153 - protein, 548 aa, Influenza virus; identical to SEQ ID NO: 418366
  MOD_RES (1)..(50): Any amino acid
  MOD_RES (61)..(168): Any amino acid
  MOD_RES (177)..(177): Any amino acid
  MOD_RES (193)..(201): Any amino acid
  MOD_RES (274)..(291): Any amino acid
  MOD_RES (326)..(344): Any amino acid
  MOD_RES (367)..(369): Any amino acid
  MOD_RES (408)..(417): Any amino acid
  MOD_RES (450)..(470): Any amino acid
  MOD_RES (489)..(491): Any amino acid
  MOD_RES (510)..(510): Any amino acid
  MOD_RES (527)..(528): Any amino acid
  MOD_RES (545)..(548): Any amino acid

SEQ ID NO: 420154 - protein, 548 aa, Influenza virus; identical to SEQ ID NO: 418367
  MOD_RES (1)..(50): Any amino acid
  MOD_RES (61)..(168): Any amino acid
  MOD_RES (177)..(180): Any amino acid
  MOD_RES (196)..(201): Any amino acid
  MOD_RES (254)..(258): Any amino acid
  MOD_RES (274)..(291): Any amino acid
  MOD_RES (326)..(344): Any amino acid
  MOD_RES (354)..(354): Any amino acid
  MOD_RES (408)..(417): Any amino acid
  MOD_RES (449)..(470): Any amino acid
  MOD_RES (489)..(491): Any amino acid
  MOD_RES (510)..(510): Any amino acid
  MOD_RES (520)..(528): Any amino acid
  MOD_RES (545)..(548): Any amino acid

SEQ ID NO: 420155 - protein, 548 aa, Influenza virus; identical to SEQ ID NO: 418368
  MOD_RES (1)..(50): Any amino acid
  MOD_RES (61)..(168): Any amino acid
  MOD_RES (177)..(188): Any amino acid
  MOD_RES (198)..(207): Any amino acid
  MOD_RES (255)..(258): Any amino acid
  MOD_RES (274)..(291): Any amino acid
  MOD_RES (326)..(344): Any amino acid
  MOD_RES (355)..(357): Any amino acid
  MOD_RES (367)..(372): Any amino acid
  MOD_RES (395)..(397): Any amino acid
  MOD_RES (408)..(425): Any amino acid
  MOD_RES (449)..(470): Any amino acid
  MOD_RES (480)..(480): Any amino acid
  MOD_RES (489)..(491): Any amino acid
  MOD_RES (500)..(517): Any amino acid
  MOD_RES (527)..(528): Any amino acid
  MOD_RES (545)..(548): Any amino acid

SEQ ID NO: 420156 - protein, 548 aa, Influenza virus; identical to SEQ ID NO: 418369
  MOD_RES (1)..(212): Any amino acid
  MOD_RES (227)..(229): Any amino acid
  MOD_RES (241)..(242): Any amino acid
  MOD_RES (255)..(262): Any amino acid
  MOD_RES (274)..(292): Any amino acid
  MOD_RES (301)..(344): Any amino acid
  MOD_RES (354)..(377): Any amino acid
  MOD_RES (395)..(431): Any amino acid
  MOD_RES (450)..(491): Any amino acid
  MOD_RES (500)..(518): Any amino acid
  MOD_RES (527)..(534): Any amino acid
  MOD_RES (543)..(548): Any amino acid

SEQ ID NO: 420157 - protein, 470 aa, Influenza virus; identical to SEQ ID NO: 418372
  MOD_RES (16)..(24): Any amino acid
  MOD_RES (40)..(53): Any amino acid
  MOD_RES (76)..(84): Any amino acid
  MOD_RES (286)..(288): Any amino acid
  MOD_RES (310)..(310): Any amino acid

SEQ ID NO: 420158 - protein, 470 aa, Influenza virus; identical to SEQ ID NO: 418373
  MOD_RES (16)..(24): Any amino acid
  MOD_RES (40)..(53): Any amino acid
  MOD_RES (65)..(66): Any amino acid
  MOD_RES (75)..(84): Any amino acid
  MOD_RES (134)..(136): Any amino acid
  MOD_RES (223)..(228): Any amino acid
  MOD_RES (283)..(288): Any amino acid
  MOD_RES (298)..(298): Any amino acid
  MOD_RES (310)..(310): Any amino acid
  MOD_RES (319)..(326): Any amino acid
  MOD_RES (378)..(378): Any amino acid
  MOD_RES (424)..(428): Any amino acid
  MOD_RES (470)..(470): Any amino acid

SEQ ID NO: 420159 - protein, 470 aa, Influenza virus; identical to SEQ ID NO: 418374
  MOD_RES (1)..(1): Any amino acid
  MOD_RES (16)..(24): Any amino acid
  MOD_RES (40)..(53): Any amino acid
  MOD_RES (75)..(84): Any amino acid
  MOD_RES (98)..(99): Any amino acid
  MOD_RES (119)..(120): Any amino acid
  MOD_RES (136)..(152): Any amino acid
  MOD_RES (175)..(182): Any amino acid
  MOD_RES (222)..(230): Any amino acid
  MOD_RES (244)..(248): Any amino acid
  MOD_RES (260)..(260): Any amino acid
  MOD_RES (286)..(288): Any amino acid
  MOD_RES (297)..(300): Any amino acid
  MOD_RES (310)..(310): Any amino acid
  MOD_RES (319)..(326): Any amino acid
  MOD_RES (426)..(429): Any amino acid
  MOD_RES (445)..(457): Any amino acid

SEQ ID NO: 420160 - protein, 470 aa, Influenza virus; identical to SEQ ID NO: 418375
  MOD_RES (1)..(1): Any amino acid
  MOD_RES (11)..(24): Any amino acid
  MOD_RES (33)..(54): Any amino acid
  MOD_RES (76)..(84): Any amino acid
  MOD_RES (99)..(99): Any amino acid
  MOD_RES (137)..(156): Any amino acid
  MOD_RES (182)..(182): Any amino acid
  MOD_RES (194)..(199): Any amino acid
  MOD_RES (210)..(210): Any amino acid
  MOD_RES (219)..(230): Any amino acid
  MOD_RES (242)..(248): Any amino acid
  MOD_RES (271)..(277): Any amino acid
  MOD_RES (286)..(310): Any amino acid
  MOD_RES (319)..(326): Any amino acid
  MOD_RES (335)..(340): Any amino acid
  MOD_RES (354)..(358): Any amino acid
  MOD_RES (377)..(380): Any amino acid
  MOD_RES (405)..(408): Any amino acid
  MOD_RES (418)..(430): Any amino acid
  MOD_RES (445)..(461): Any amino acid
  MOD_RES (470)..(470): Any amino acid

SEQ ID NO: 420161 - protein, 470 aa, Influenza virus; identical to SEQ ID NO: 418376
  MOD_RES (1)..(2): Any amino acid
  MOD_RES (16)..(24): Any amino acid
  MOD_RES (33)..(57): Any amino acid
  MOD_RES (76)..(86): Any amino acid
  MOD_RES (102)..(104): Any amino acid
  MOD_RES (113)..(166): Any amino acid
  MOD_RES (175)..(182): Any amino acid
  MOD_RES (191)..(200): Any amino acid
  MOD_RES (209)..(210): Any amino acid
  MOD_RES (222)..(231): Any amino acid
  MOD_RES (243)..(253): Any amino acid
  MOD_RES (275)..(310): Any amino acid
  MOD_RES (321)..(326): Any amino acid
  MOD_RES (335)..(340): Any amino acid
  MOD_RES (350)..(358): Any amino acid
  MOD_RES (375)..(380): Any amino acid
  MOD_RES (404)..(409): Any amino acid
  MOD_RES (425)..(462): Any amino acid

SEQ ID NO: 420162 - protein, 568 aa, Influenza virus; identical to SEQ ID NO: 418380
  MOD_RES (1)..(15): Any amino acid
  MOD_RES (38)..(39): Any amino acid
  MOD_RES (53)..(65): Any amino acid
  MOD_RES (77)..(85): Any amino acid
  MOD_RES (99)..(101): Any amino acid
  MOD_RES (128)..(153): Any amino acid
  MOD_RES (166)..(166): Any amino acid
  MOD_RES (184)..(188): Any amino acid
  MOD_RES (199)..(199): Any amino acid
  MOD_RES (246)..(247): Any amino acid
  MOD_RES (271)..(271): Any amino acid
  MOD_RES (280)..(285): Any amino acid
  MOD_RES (337)..(337): Any amino acid
  MOD_RES (486)..(486): Any amino acid
  MOD_RES (542)..(546): Any amino acid

SEQ ID NO: 420163 - protein, 568 aa, Influenza virus; identical to SEQ ID NO: 418381
  MOD_RES (1)..(15): Any amino acid
  MOD_RES (38)..(39): Any amino acid
  MOD_RES (53)..(65): Any amino acid
  MOD_RES (77)..(85): Any amino acid
  MOD_RES (98)..(101): Any amino acid
  MOD_RES (128)..(153): Any amino acid
  MOD_RES (166)..(166): Any amino acid
  MOD_RES (184)..(188): Any amino acid
  MOD_RES (199)..(199): Any amino acid
  MOD_RES (246)..(247): Any amino acid
  MOD_RES (271)..(271): Any amino acid
  MOD_RES (280)..(285): Any amino acid
  MOD_RES (309)..(312): Any amino acid
  MOD_RES (337)..(337): Any amino acid
  MOD_RES (347)..(351): Any amino acid
  MOD_RES (394)..(403): Any amino acid
  MOD_RES (419)..(427): Any amino acid
  MOD_RES (442)..(443): Any amino acid
  MOD_RES (486)..(486): Any amino acid
  MOD_RES (542)..(546): Any amino acid
  MOD_RES (557)..(568): Any amino acid

SEQ ID NO: 420164 - protein, 568 aa, Influenza virus; identical to SEQ ID NO: 418382
  MOD_RES (1)..(15): Any amino acid
  MOD_RES (38)..(39): Any amino acid
  MOD_RES (48)..(65): Any amino acid
  MOD_RES (77)..(85): Any amino acid
  MOD_RES (99)..(101): Any amino acid
  MOD_RES (128)..(153): Any amino acid
  MOD_RES (166)..(166): Any amino acid
  MOD_RES (184)..(188): Any amino acid
  MOD_RES (199)..(199): Any amino acid
  MOD_RES (246)..(247): Any amino acid
  MOD_RES (271)..(271): Any amino acid
  MOD_RES (280)..(285): Any amino acid
  MOD_RES (309)..(312): Any amino acid
  MOD_RES (337)..(338): Any amino acid
  MOD_RES (354)..(367): Any amino acid
  MOD_RES (394)..(405): Any amino acid
  MOD_RES (421)..(432): Any amino acid
  MOD_RES (441)..(444): Any amino acid
  MOD_RES (457)..(475): Any amino acid
  MOD_RES (486)..(486): Any amino acid
  MOD_RES (525)..(529): Any amino acid
  MOD_RES (542)..(546): Any amino acid
  MOD_RES (557)..(568): Any amino acid

SEQ ID NO: 420165 - protein, 568 aa, Influenza virus; identical to SEQ ID NO: 418383
  MOD_RES (1)..(15): Any amino acid
  MOD_RES (38)..(39): Any amino acid
  MOD_RES (48)..(65): Any amino acid
  MOD_RES (77)..(85): Any amino acid
  MOD_RES (99)..(101): Any amino acid
  MOD_RES (118)..(119): Any amino acid
  MOD_RES (128)..(153): Any amino acid
  MOD_RES (166)..(166): Any amino acid
  MOD_RES (183)..(188): Any amino acid
  MOD_RES (199)..(199): Any amino acid
  MOD_RES (246)..(247): Any amino acid
  MOD_RES (271)..(271): Any amino acid
  MOD_RES (280)..(285): Any amino acid
  MOD_RES (301)..(313): Any amino acid
  MOD_RES (330)..(368): Any amino acid
  MOD_RES (396)..(407): Any amino acid
  MOD_RES (423)..(434): Any amino acid
  MOD_RES (443)..(445): Any amino acid
  MOD_RES (456)..(475): Any amino acid
  MOD_RES (486)..(486): Any amino acid
  MOD_RES (502)..(503): Any amino acid
  MOD_RES (526)..(533): Any amino acid
  MOD_RES (542)..(546): Any amino acid
  MOD_RES (557)..(568): Any amino acid

SEQ ID NO: 420166 - protein, 568 aa, Influenza virus; identical to SEQ ID NO: 418384
  MOD_RES (1)..(39): Any amino acid
  MOD_RES (48)..(68): Any amino acid
  MOD_RES (77)..(85): Any amino acid
  MOD_RES (99)..(101): Any amino acid
  MOD_RES (118)..(119): Any amino acid
  MOD_RES (128)..(153): Any amino acid
  MOD_RES (162)..(166): Any amino acid
  MOD_RES (176)..(188): Any amino acid
  MOD_RES (197)..(199): Any amino acid
  MOD_RES (208)..(213): Any amino acid
  MOD_RES (246)..(247): Any amino acid
  MOD_RES (259)..(261): Any amino acid
  MOD_RES (270)..(271): Any amino acid
  MOD_RES (280)..(287): Any amino acid
  MOD_RES (307)..(313): Any amino acid
  MOD_RES (330)..(377): Any amino acid
  MOD_RES (393)..(410): Any amino acid
  MOD_RES (420)..(449): Any amino acid
  MOD_RES (459)..(475): Any amino acid
  MOD_RES (484)..(486): Any amino acid
  MOD_RES (513)..(513): Any amino acid
  MOD_RES (527)..(533): Any amino acid
  MOD_RES (542)..(547): Any amino acid
  MOD_RES (556)..(568): Any amino acid

SEQ ID NO: 420167 - protein, 561 aa, Influenza virus; identical to SEQ ID NO: 418389
  MOD_RES (1)..(15): Any amino acid
  MOD_RES (54)..(64): Any amino acid
  MOD_RES (131)..(131): Any amino acid
  MOD_RES (145)..(150): Any amino acid
  MOD_RES (184)..(184): Any amino acid
  MOD_RES (282)..(283): Any amino acid
  MOD_RES (337)..(337): Any amino acid

SEQ ID NO: 420168 - protein, 561 aa, Influenza virus; identical to SEQ ID NO: 418390
  MOD_RES (1)..(15): Any amino acid
  MOD_RES (54)..(64): Any amino acid
  MOD_RES (116)..(118): Any amino acid
  MOD_RES (131)..(131): Any amino acid
  MOD_RES (142)..(150): Any amino acid
  MOD_RES (184)..(184): Any amino acid
  MOD_RES (223)..(233): Any amino acid
  MOD_RES (281)..(283): Any amino acid
  MOD_RES (302)..(312): Any amino acid
  MOD_RES (337)..(337): Any amino acid
  MOD_RES (354)..(371): Any amino acid
  MOD_RES (396)..(403): Any amino acid
  MOD_RES (419)..(432): Any amino acid
  MOD_RES (443)..(446): Any amino acid
  MOD_RES (559)..(561): Any amino acid

SEQ ID NO: 420169 - protein, 561 aa, Influenza virus; identical to SEQ ID NO: 418391
  MOD_RES (1)..(15): Any amino acid
  MOD_RES (54)..(64): Any amino acid
  MOD_RES (116)..(120): Any amino acid
  MOD_RES (131)..(131): Any amino acid
  MOD_RES (145)..(150): Any amino acid
  MOD_RES (184)..(184): Any amino acid
  MOD_RES (230)..(237): Any amino acid
  MOD_RES (269)..(271): Any amino acid
  MOD_RES (282)..(283): Any amino acid
  MOD_RES (307)..(313): Any amino acid
  MOD_RES (337)..(342): Any amino acid
  MOD_RES (353)..(375): Any amino acid
  MOD_RES (392)..(405): Any amino acid
  MOD_RES (421)..(433): Any amino acid
  MOD_RES (442)..(447): Any amino acid
  MOD_RES (462)..(475): Any amino acid
  MOD_RES (523)..(533): Any amino acid
  MOD_RES (554)..(561): Any amino acid

SEQ ID NO: 420170 - protein, 561 aa, Influenza virus; identical to SEQ ID NO: 418392
  MOD_RES (1)..(15): Any amino acid
  MOD_RES (54)..(64): Any amino acid
  MOD_RES (118)..(120): Any amino acid
  MOD_RES (131)..(131): Any amino acid
  MOD_RES (145)..(150): Any amino acid
  MOD_RES (178)..(184): Any amino acid
  MOD_RES (226)..(245): Any amino acid
  MOD_RES (282)..(293): Any amino acid
  MOD_RES (309)..(313): Any amino acid
  MOD_RES (330)..(377): Any amino acid
  MOD_RES (393)..(407): Any amino acid
  MOD_RES (423)..(453): Any amino acid
  MOD_RES (462)..(475): Any amino acid
  MOD_RES (502)..(509): Any amino acid
  MOD_RES (525)..(533): Any amino acid
  MOD_RES (550)..(561): Any amino acid

SEQ ID NO: 420171 - protein, 561 aa, Influenza virus; identical to SEQ ID NO: 418393
  MOD_RES (1)..(21): Any amino acid
  MOD_RES (48)..(64): Any amino acid
  MOD_RES (121)..(121): Any amino acid
  MOD_RES (131)..(131): Any amino acid
  MOD_RES (145)..(151): Any amino acid
  MOD_RES (177)..(184): Any amino acid
  MOD_RES (194)..(195): Any amino acid
  MOD_RES (209)..(213): Any amino acid
  MOD_RES (228)..(245): Any amino acid
  MOD_RES (256)..(263): Any amino acid
  MOD_RES (282)..(321): Any amino acid
  MOD_RES (330)..(380): Any amino acid
  MOD_RES (392)..(477): Any amino acid
  MOD_RES (493)..(516): Any amino acid
  MOD_RES (525)..(534): Any amino acid
  MOD_RES (546)..(561): Any amino acid

SEQ ID NO: 420172 - protein, 471 aa, Influenza virus; identical to SEQ ID NO: 418397
  MOD_RES (19)..(19): Any amino acid
  MOD_RES (47)..(53): Any amino acid
  MOD_RES (75)..(82): Any amino acid
  MOD_RES (308)..(308): Any amino acid
  MOD_RES (332)..(333): Any amino acid
  MOD_RES (389)..(389): Any amino acid
  MOD_RES (416)..(416): Any amino acid

SEQ ID NO: 420173 - protein, 471 aa, Influenza virus; identical to SEQ ID NO: 418398
  MOD_RES (17)..(19): Any amino acid
  MOD_RES (47)..(53): Any amino acid
  MOD_RES (75)..(82): Any amino acid
  MOD_RES (134)..(134): Any amino acid
  MOD_RES (150)..(150): Any amino acid
  MOD_RES (228)..(230): Any amino acid
  MOD_RES (308)..(308): Any amino acid
  MOD_RES (332)..(333): Any amino acid
  MOD_RES (387)..(389): Any amino acid
  MOD_RES (416)..(416): Any amino acid
  MOD_RES (425)..(428): Any amino acid

SEQ ID NO: 420174 - protein, 471 aa, Influenza virus; identical to SEQ ID NO: 418399
  MOD_RES (1)..(1): Any amino acid
  MOD_RES (19)..(19): Any amino acid
  MOD_RES (47)..(53): Any amino acid
  MOD_RES (75)..(82): Any amino acid
  MOD_RES (93)..(97): Any amino acid
  MOD_RES (118)..(118): Any amino acid
  MOD_RES (134)..(156): Any amino acid
  MOD_RES (225)..(232): Any amino acid
  MOD_RES (295)..(296): Any amino acid
  MOD_RES (308)..(308): Any amino acid
  MOD_RES (319)..(323): Any amino acid
  MOD_RES (332)..(349): Any amino acid
  MOD_RES (374)..(375): Any amino acid
  MOD_RES (389)..(389): Any amino acid
  MOD_RES (416)..(416): Any amino acid
  MOD_RES (426)..(446): Any amino acid
  MOD_RES (470)..(471): Any amino acid

SEQ ID NO: 420175 - protein, 471 aa, Influenza virus; identical to SEQ ID NO: 418400
  MOD_RES (1)..(1): Any amino acid
  MOD_RES (19)..(19): Any amino acid
  MOD_RES (28)..(38): Any amino acid
  MOD_RES (47)..(53): Any amino acid
  MOD_RES (75)..(82): Any amino acid
  MOD_RES (95)..(121): Any amino acid
  MOD_RES (137)..(159): Any amino acid
  MOD_RES (174)..(186): Any amino acid
  MOD_RES (229)..(237): Any amino acid
  MOD_RES (293)..(298): Any amino acid
  MOD_RES (308)..(308): Any amino acid
  MOD_RES (332)..(349): Any amino acid
  MOD_RES (358)..(358): Any amino acid
  MOD_RES (372)..(376): Any amino acid
  MOD_RES (389)..(389): Any amino acid
  MOD_RES (409)..(416): Any amino acid
  MOD_RES (426)..(447): Any amino acid
  MOD_RES (471)..(471): Any amino acid

SEQ ID NO: 420176 - protein, 471 aa, Influenza virus; identical to SEQ ID NO: 418401
  MOD_RES (1)..(7): Any amino acid
  MOD_RES (17)..(65): Any amino acid
  MOD_RES (74)..(84): Any amino acid
  MOD_RES (100)..(122): Any amino acid
  MOD_RES (133)..(164): Any amino acid
  MOD_RES (180)..(189): Any amino acid
  MOD_RES (199)..(203): Any amino acid
  MOD_RES (216)..(239): Any amino acid
  MOD_RES (248)..(248): Any amino acid
  MOD_RES (263)..(263): Any amino acid
  MOD_RES (275)..(277): Any amino acid
  MOD_RES (290)..(298): Any amino acid
  MOD_RES (307)..(309): Any amino acid
  MOD_RES (319)..(379): Any amino acid
  MOD_RES (389)..(389): Any amino acid
  MOD_RES (409)..(416): Any amino acid
  MOD_RES (426)..(471): Any amino acid

SEQ ID NO: 420177 - protein, 565 aa, Influenza virus; identical to SEQ ID NO: 418405
  MOD_RES (1)..(14): Any amino acid
  MOD_RES (113)..(113): Any amino acid
  MOD_RES (122)..(157): Any amino acid
  MOD_RES (177)..(177): Any amino acid
  MOD_RES (190)..(204): Any amino acid
  MOD_RES (215)..(234): Any amino acid
  MOD_RES (250)..(254): Any amino acid
  MOD_RES (275)..(275): Any amino acid
  MOD_RES (286)..(289): Any amino acid
  MOD_RES (387)..(394): Any amino acid
  MOD_RES (403)..(414): Any amino acid
  MOD_RES (424)..(430): Any amino acid
  MOD_RES (522)..(523): Any amino acid
  MOD_RES (550)..(551): Any amino acid

SEQ ID NO: 420178 - protein, 565 aa, Influenza virus; identical to SEQ ID NO: 418406
  MOD_RES (1)..(14): Any amino acid
  MOD_RES (113)..(113): Any amino acid
  MOD_RES (122)..(157): Any amino acid
  MOD_RES (177)..(177): Any amino acid
  MOD_RES (190)..(204): Any amino acid
  MOD_RES (215)..(234): Any amino acid
  MOD_RES (250)..(254): Any amino acid
  MOD_RES (275)..(275): Any amino acid
  MOD_RES (286)..(289): Any amino acid
  MOD_RES (349)..(363): Any amino acid
  MOD_RES (387)..(394): Any amino acid
  MOD_RES (403)..(414): Any amino acid
  MOD_RES (424)..(430): Any amino acid
  MOD_RES (446)..(450): Any amino acid
  MOD_RES (477)..(477): Any amino acid
  MOD_RES (522)..(523): Any amino acid
  MOD_RES (550)..(551): Any amino acid
  MOD_RES (561)..(565): Any amino acid

SEQ ID NO: 420179 - protein, 565 aa, Influenza virus; identical to SEQ ID NO: 418407
  MOD_RES (1)..(14): Any amino acid
  MOD_RES (48)..(51): Any amino acid
  MOD_RES (113)..(113): Any amino acid
  MOD_RES (122)..(157): Any amino acid
  MOD_RES (177)..(177): Any amino acid
  MOD_RES (189)..(204): Any amino acid
  MOD_RES (215)..(239): Any amino acid
  MOD_RES (250)..(254): Any amino acid
  MOD_RES (275)..(275): Any amino acid
  MOD_RES (286)..(289): Any amino acid
  MOD_RES (303)..(305): Any amino acid
  MOD_RES (349)..(366): Any amino acid
  MOD_RES (387)..(394): Any amino acid
  MOD_RES (403)..(414): Any amino acid
  MOD_RES (423)..(430): Any amino acid
  MOD_RES (451)..(451): Any amino acid
  MOD_RES (478)..(478): Any amino acid
  MOD_RES (497)..(498): Any amino acid
  MOD_RES (522)..(523): Any amino acid
  MOD_RES (550)..(551): Any amino acid
  MOD_RES (563)..(565): Any amino acid

SEQ ID NO: 420180 - protein, 565 aa, Influenza virus; identical to SEQ ID NO: 418408
  MOD_RES (1)..(15): Any amino acid
  MOD_RES (41)..(43): Any amino acid
  MOD_RES (69)..(69): Any amino acid
  MOD_RES (113)..(113): Any amino acid
  MOD_RES (122)..(157): Any amino acid
  MOD_RES (177)..(177): Any amino acid
  MOD_RES (189)..(204): Any amino acid
  MOD_RES (215)..(240): Any amino acid
  MOD_RES (250)..(254): Any amino acid
  MOD_RES (275)..(275): Any amino acid
  MOD_RES (286)..(289): Any amino acid
  MOD_RES (356)..(368): Any amino acid
  MOD_RES (377)..(377): Any amino acid
  MOD_RES (387)..(394): Any amino acid
  MOD_RES (403)..(414): Any amino acid
  MOD_RES (424)..(430): Any amino acid
  MOD_RES (447)..(451): Any amino acid
  MOD_RES (477)..(479): Any amino acid
  MOD_RES (510)..(510): Any amino acid
  MOD_RES (521)..(537): Any amino acid
  MOD_RES (549)..(551): Any amino acid
  MOD_RES (561)..(565): Any amino acid

SEQ ID NO: 420181 - protein, 565 aa, Influenza virus; identical to SEQ ID NO: 418409
  MOD_RES (1)..(23): Any amino acid
  MOD_RES (39)..(51): Any amino acid
  MOD_RES (71)..(77): Any amino acid
  MOD_RES (101)..(162): Any amino acid
  MOD_RES (175)..(177): Any amino acid
  MOD_RES (190)..(204): Any amino acid
  MOD_RES (213)..(241): Any amino acid
  MOD_RES (250)..(254): Any amino acid
  MOD_RES (275)..(275): Any amino acid
  MOD_RES (286)..(289): Any amino acid
  MOD_RES (322)..(323): Any amino acid
  MOD_RES (341)..(378): Any amino acid
  MOD_RES (387)..(394): Any amino acid
  MOD_RES (403)..(414): Any amino acid
  MOD_RES (424)..(430): Any amino acid
  MOD_RES (441)..(455): Any amino acid
  MOD_RES (464)..(467): Any amino acid
  MOD_RES (478)..(480): Any amino acid
  MOD_RES (496)..(501): Any amino acid
  MOD_RES (522)..(537): Any amino acid
  MOD_RES (550)..(551): Any amino acid
  MOD_RES (563)..(565): Any amino acid

SEQ ID NO: 420182 - protein, 564 aa, Influenza virus; identical to SEQ ID NO: 418412
  MOD_RES (10)..(14): Any amino acid
  MOD_RES (57)..(60): Any amino acid
  MOD_RES (189)..(189): Any amino acid
  MOD_RES (205)..(219): Any amino acid
  MOD_RES (289)..(291): Any amino acid
  MOD_RES (406)..(410): Any amino acid
  MOD_RES (489)..(492): Any amino acid

SEQ ID NO: 420183 - protein, 564 aa, Influenza virus; identical to SEQ ID NO: 418413
  MOD_RES (10)..(14): Any amino acid
  MOD_RES (23)..(23): Any amino acid
  MOD_RES (57)..(60): Any amino acid
  MOD_RES (128)..(129): Any amino acid
  MOD_RES (172)..(176): Any amino acid
  MOD_RES (189)..(189): Any amino acid
  MOD_RES (205)..(219): Any amino acid
  MOD_RES (289)..(291): Any amino acid
  MOD_RES (363)..(363): Any amino acid
  MOD_RES (406)..(410): Any amino acid
  MOD_RES (449)..(454): Any amino acid
  MOD_RES (489)..(492): Any amino acid
  MOD_RES (524)..(535): Any amino acid

SEQ ID NO: 420184 - protein, 564 aa, Influenza virus; identical to SEQ ID NO: 418414
  MOD_RES (10)..(14): Any amino acid
  MOD_RES (23)..(29): Any amino acid
  MOD_RES (45)..(45): Any amino acid
  MOD_RES (57)..(60): Any amino acid
  MOD_RES (178)..(179): Any amino acid
  MOD_RES (189)..(189): Any amino acid
  MOD_RES (205)..(219): Any amino acid
  MOD_RES (243)..(252): Any amino acid
  MOD_RES (289)..(291): Any amino acid
  MOD_RES (328)..(331): Any amino acid
  MOD_RES (356)..(366): Any amino acid
  MOD_RES (406)..(410): Any amino acid
  MOD_RES (438)..(456): Any amino acid
  MOD_RES (489)..(492): Any amino acid
  MOD_RES (516)..(564): Any amino acid

SEQ ID NO: 420185 - protein, 564 aa, Influenza virus; identical to SEQ ID NO: 418415
  MOD_RES (10)..(29): Any amino acid
  MOD_RES (45)..(46): Any amino acid
  MOD_RES (57)..(70): Any amino acid
  MOD_RES (86)..(98): Any amino acid
  MOD_RES (127)..(135): Any amino acid
  MOD_RES (179)..(193): Any amino acid
  MOD_RES (205)..(219): Any amino acid
  MOD_RES (244)..(264): Any amino acid
  MOD_RES (280)..(280): Any amino acid
  MOD_RES (289)..(292): Any amino acid
  MOD_RES (347)..(368): Any amino acid
  MOD_RES (393)..(397): Any amino acid
  MOD_RES (406)..(410): Any amino acid
  MOD_RES (435)..(456): Any amino acid
  MOD_RES (489)..(494): Any amino acid
  MOD_RES (503)..(503): Any amino acid
  MOD_RES (522)..(564): Any amino acid

SEQ ID NO: 420186 - protein, 564 aa, Influenza virus; identical to SEQ ID NO: 418416
  MOD_RES (1)..(1): Any amino acid
  MOD_RES (10)..(29): Any amino acid
  MOD_RES (39)..(47): Any amino acid
  MOD_RES (57)..(72): Any amino acid
  MOD_RES (88)..(105): Any amino acid
  MOD_RES (114)..(146): Any amino acid
  MOD_RES (171)..(196): Any amino acid
  MOD_RES (205)..(219): Any amino acid
  MOD_RES (245)..(280): Any amino acid
  MOD_RES (289)..(317): Any amino acid
  MOD_RES (349)..(369): Any amino acid
  MOD_RES (385)..(410): Any amino acid
  MOD_RES (435)..(457): Any amino acid
  MOD_RES (489)..(494): Any amino acid
  MOD_RES (506)..(506): Any amino acid
  MOD_RES (516)..(564): Any amino acid

SEQ ID NO: 420187 - protein, 567 aa, Influenza virus; identical to SEQ ID NO: 418418
  MOD_RES (1)..(17): Any amino acid
  MOD_RES (86)..(89): Any amino acid
  MOD_RES (147)..(154): Any amino acid
  MOD_RES (169)..(172): Any amino acid
  MOD_RES (202)..(212): Any amino acid
  MOD_RES (225)..(231): Any amino acid
  MOD_RES (251)..(256): Any amino acid
  MOD_RES (289)..(290): Any amino acid
  MOD_RES (341)..(343): Any amino acid
  MOD_RES (469)..(472): Any amino acid
  MOD_RES (565)..(567): Any amino acid

SEQ ID NO: 420188 - protein, 567 aa, Influenza virus; identical to SEQ ID NO: 418419
  MOD_RES (1)..(17): Any amino acid
  MOD_RES (86)..(89): Any amino acid
  MOD_RES (147)..(154): Any amino acid
  MOD_RES (169)..(179): Any amino acid
  MOD_RES (202)..(212): Any amino acid
  MOD_RES (225)..(231): Any amino acid
  MOD_RES (251)..(256): Any amino acid
  MOD_RES (289)..(290): Any amino acid
  MOD_RES (341)..(343): Any amino acid
  MOD_RES (355)..(368): Any amino acid
  MOD_RES (427)..(427): Any amino acid
  MOD_RES (443)..(445): Any amino acid
  MOD_RES (469)..(472): Any amino acid
  MOD_RES (565)..(567): Any amino acid

SEQ ID NO: 420189 - protein, 567 aa, Influenza virus; identical to SEQ ID NO: 418420
  MOD_RES (1)..(17): Any amino acid
  MOD_RES (65)..(66): Any amino acid
  MOD_RES (82)..(89): Any amino acid
  MOD_RES (110)..(125): Any amino acid
  MOD_RES (147)..(154): Any amino acid
  MOD_RES (169)..(179): Any amino acid
  MOD_RES (202)..(212): Any amino acid
  MOD_RES (225)..(231): Any amino acid
  MOD_RES (251)..(256): Any amino acid
  MOD_RES (273)..(278): Any amino acid
  MOD_RES (289)..(290): Any amino acid
  MOD_RES (327)..(330): Any amino acid
  MOD_RES (341)..(343): Any amino acid
  MOD_RES (357)..(368): Any amino acid
  MOD_RES (384)..(411): Any amino acid
  MOD_RES (427)..(433): Any amino acid
  MOD_RES (469)..(472): Any amino acid
  MOD_RES (533)..(536): Any amino acid
  MOD_RES (565)..(567): Any amino acid

SEQ ID NO: 420190 - protein, 567 aa, Influenza virus; identical to SEQ ID NO: 418421
  MOD_RES (1)..(25): Any amino acid
  MOD_RES (65)..(72): Any amino acid
  MOD_RES (86)..(94): Any amino acid
  MOD_RES (110)..(133): Any amino acid
  MOD_RES (147)..(154): Any amino acid
  MOD_RES (169)..(179): Any amino acid
  MOD_RES (202)..(213): Any amino acid
  MOD_RES (225)..(231): Any amino acid
  MOD_RES (251)..(257): Any amino acid
  MOD_RES (266)..(278): Any amino acid
  MOD_RES (289)..(306): Any amino acid
  MOD_RES (321)..(332): Any amino acid
  MOD_RES (341)..(343): Any amino acid
  MOD_RES (354)..(370): Any amino acid
  MOD_RES (384)..(411): Any amino acid
  MOD_RES (427)..(452): Any amino acid
  MOD_RES (469)..(486): Any amino acid
  MOD_RES (505)..(513): Any amino acid
  MOD_RES (535)..(539): Any amino acid
  MOD_RES (565)..(567): Any amino acid

SEQ ID NO: 420191 - protein, 567 aa, Influenza virus; identical to SEQ ID NO: 418422
  MOD_RES (1)..(27): Any amino acid
  MOD_RES (54)..(98): Any amino acid
  MOD_RES (114)..(133): Any amino acid
  MOD_RES (147)..(154): Any amino acid
  MOD_RES (169)..(179): Any amino acid
  MOD_RES (189)..(213): Any amino acid
  MOD_RES (225)..(241): Any amino acid
  MOD_RES (251)..(311): Any amino acid
  MOD_RES (327)..(332): Any amino acid
  MOD_RES (341)..(373): Any amino acid
  MOD_RES (389)..(411): Any amino acid
  MOD_RES (423)..(458): Any amino acid
  MOD_RES (469)..(496): Any amino acid
  MOD_RES (505)..(515): Any amino acid
  MOD_RES (538)..(542): Any amino acid
  MOD_RES (563)..(567): Any amino acid

SEQ ID NO: 420192 - protein, 568 aa, Influenza virus; identical to SEQ ID NO: 418424

SEQ ID NO: 420193 - protein, 568 aa, Influenza virus; identical to SEQ ID NO: 418425
  MOD_RES (1)..(9): Any amino acid
  MOD_RES (20)..(165): Any amino acid
  MOD_RES (181)..(568): Any amino acid

SEQ ID NO: 420194 - protein, 570 aa, Influenza virus; identical to SEQ ID NO: 418426

SEQ ID NO: 420195 - protein, 570 aa, Influenza virus; identical to SEQ ID NO: 418427
  MOD_RES (1)..(9): Any amino acid
  MOD_RES (48)..(49): Any amino acid
  MOD_RES (65)..(78): Any amino acid
  MOD_RES (97)..(101): Any amino acid
  MOD_RES (117)..(122): Any amino acid
  MOD_RES (147)..(154): Any amino acid
  MOD_RES (188)..(198): Any amino acid
  MOD_RES (236)..(269): Any amino acid
  MOD_RES (285)..(311): Any amino acid
  MOD_RES (331)..(339): Any amino acid
  MOD_RES (363)..(402): Any amino acid
  MOD_RES (418)..(521): Any amino acid
  MOD_RES (537)..(570): Any amino acid

SEQ ID NO: 420196 - protein, 570 aa, Influenza virus; identical to SEQ ID NO: 418428
  MOD_RES (1)..(157): Any amino acid
  MOD_RES (173)..(340): Any amino acid
  MOD_RES (361)..(570): Any amino acid

SEQ ID NO: 420197 - protein, 570 aa, Influenza virus; identical to SEQ ID NO: 418429
  MOD_RES (1)..(158): Any amino acid
  MOD_RES (174)..(570): Any amino acid

SEQ ID NO: 420198 - protein, 569 aa, Influenza virus; identical to SEQ ID NO: 418430
  MOD_RES (10)..(15): Any amino acid
  MOD_RES (172)..(173): Any amino acid
  MOD_RES (343)..(343): Any amino acid
  MOD_RES (471)..(471): Any amino acid

SEQ ID NO: 420199 - protein, 569 aa, Influenza virus; identical to SEQ ID NO: 418431
  MOD_RES (1)..(15): Any amino acid
  MOD_RES (59)..(60): Any amino acid
  MOD_RES (76)..(82): Any amino acid
  MOD_RES (98)..(100): Any amino acid
  MOD_RES (124)..(131): Any amino acid
  MOD_RES (172)..(173): Any amino acid
  MOD_RES (188)..(195): Any amino acid
  MOD_RES (217)..(219): Any amino acid
  MOD_RES (326)..(333): Any amino acid
  MOD_RES (349)..(377): Any amino acid
  MOD_RES (400)..(418): Any amino acid
  MOD_RES (471)..(471): Any amino acid
  MOD_RES (517)..(518): Any amino acid

SEQ ID NO: 420200 - protein, 569 aa, Influenza virus; identical to SEQ ID NO: 418432
  MOD_RES (1)..(15): Any amino acid
  MOD_RES (44)..(63): Any amino acid
  MOD_RES (79)..(102): Any amino acid
  MOD_RES (120)..(131): Any amino acid
  MOD_RES (172)..(179): Any amino acid
  MOD_RES (191)..(197): Any amino acid
  MOD_RES (216)..(231): Any amino acid
  MOD_RES (240)..(245): Any amino acid
  MOD_RES (266)..(279): Any amino acid
  MOD_RES (305)..(307): Any amino acid
  MOD_RES (323)..(334): Any amino acid
  MOD_RES (343)..(343): Any amino acid
  MOD_RES (352)..(377): Any amino acid
  MOD_RES (393)..(421): Any amino acid
  MOD_RES (437)..(443): Any amino acid
  MOD_RES (456)..(458): Any amino acid
  MOD_RES (471)..(471): Any amino acid
  MOD_RES (493)..(508): Any amino acid
  MOD_RES (552)..(552): Any amino acid

SEQ ID NO: 420201 - protein, 569 aa, Influenza virus; identical to SEQ ID NO: 418433
  MOD_RES (1)..(15): Any amino acid
  MOD_RES (25)..(28): Any amino acid
  MOD_RES (41)..(63): Any amino acid
  MOD_RES (76)..(104): Any amino acid
  MOD_RES (118)..(133): Any amino acid
  MOD_RES (149)..(149): Any amino acid
  MOD_RES (172)..(179): Any amino acid
  MOD_RES (189)..(197): Any amino acid
  MOD_RES (217)..(245): Any amino acid
  MOD_RES (271)..(282): Any amino acid
  MOD_RES (312)..(343): Any amino acid
  MOD_RES (352)..(383): Any amino acid
  MOD_RES (399)..(447): Any amino acid
  MOD_RES (471)..(471): Any amino acid
  MOD_RES (495)..(525): Any amino acid
  MOD_RES (538)..(538): Any amino acid
  MOD_RES (554)..(554): Any amino acid
  MOD_RES (568)..(569): Any amino acid

SEQ ID NO: 420202 - protein, 569 aa, Influenza virus; identical to SEQ ID NO: 418434
  MOD_RES (1)..(15): Any amino acid
  MOD_RES (24)..(29): Any amino acid
  MOD_RES (45)..(104): Any amino acid
  MOD_RES (120)..(133): Any amino acid
  MOD_RES (172)..(198): Any amino acid
  MOD_RES (221)..(250): Any amino acid
  MOD_RES (259)..(282): Any amino acid
  MOD_RES (305)..(343): Any amino acid
  MOD_RES (352)..(384): Any amino acid
  MOD_RES (393)..(458): Any amino acid
  MOD_RES (470)..(538): Any amino acid
  MOD_RES (552)..(569): Any amino acid

SEQ ID NO: 420203 - protein, 627 aa, Influenza virus; identical to SEQ ID NO: 418436
  MOD_RES (16)..(26): Any amino acid
  MOD_RES (45)..(304): Any amino acid
  MOD_RES (322)..(342): Any amino acid
  MOD_RES (353)..(385): Any amino acid
  MOD_RES (415)..(415): Any amino acid
  MOD_RES (424)..(477): Any amino acid
  MOD_RES (496)..(519): Any amino acid
  MOD_RES (529)..(573): Any amino acid
  MOD_RES (584)..(603): Any amino acid
  MOD_RES (625)..(627): Any amino acid

SEQ ID NO: 420204 - protein, 627 aa, Influenza virus; identical to SEQ ID NO: 418437
  MOD_RES (1)..(3): Any amino acid
  MOD_RES (16)..(304): Any amino acid
  MOD_RES (319)..(390): Any amino acid
  MOD_RES (415)..(415): Any amino acid
  MOD_RES (424)..(477): Any amino acid
  MOD_RES (496)..(519): Any amino acid
  MOD_RES (529)..(573): Any amino acid
  MOD_RES (584)..(612): Any amino acid
  MOD_RES (622)..(627): Any amino acid

SEQ ID NO: 420205 - protein, 627 aa, Influenza virus; identical to SEQ ID NO: 418438
  MOD_RES (1)..(6): Any amino acid
  MOD_RES (16)..(393): Any amino acid
  MOD_RES (415)..(415): Any amino acid
  MOD_RES (424)..(477): Any amino acid
  MOD_RES (496)..(519): Any amino acid
  MOD_RES (529)..(573): Any amino acid
  MOD_RES (584)..(612): Any amino acid

SEQ ID NO: 420206 - protein, 627 aa, Influenza virus; identical to SEQ ID NO: 418439
  MOD_RES (1)..(6): Any amino acid
  MOD_RES (16)..(396): Any amino acid
  MOD_RES (412)..(415): Any amino acid
  MOD_RES (424)..(477): Any amino acid
  MOD_RES (496)..(519): Any amino acid
  MOD_RES (529)..(573): Any amino acid
  MOD_RES (584)..(612): Any amino acid
  MOD_RES (622)..(627): Any amino acid

SEQ ID NO: 420207 - protein, 627 aa, Influenza virus; identical to SEQ ID NO: 418440
  MOD_RES (1)..(396): Any amino acid
  MOD_RES (415)..(415): Any amino acid
  MOD_RES (424)..(477): Any amino acid
  MOD_RES (496)..(519): Any amino acid
  MOD_RES (529)..(573): Any amino acid
  MOD_RES (584)..(612): Any amino acid

SEQ ID NO: 420208 - protein, 599 aa, Influenza virus; identical to SEQ ID NO: 418441
  MOD_RES (17)..(26): Any amino acid
  MOD_RES (62)..(83): Any amino acid
  MOD_RES (97)..(101): Any amino acid
  MOD_RES (110)..(123): Any amino acid
  MOD_RES (147)..(169): Any amino acid
  MOD_RES (179)..(180): Any amino acid
  MOD_RES (190)..(201): Any amino acid
  MOD_RES (212)..(253): Any amino acid
  MOD_RES (263)..(264): Any amino acid
  MOD_RES (281)..(312): Any amino acid
  MOD_RES (324)..(325): Any amino acid
  MOD_RES (431)..(431): Any amino acid
  MOD_RES (473)..(483): Any amino acid
  MOD_RES (506)..(506): Any amino acid
  MOD_RES (528)..(531): Any amino acid
  MOD_RES (540)..(541): Any amino acid

SEQ ID NO: 420209 - protein, 599 aa, Influenza virus; identical to SEQ ID NO: 418442
  MOD_RES (1)..(3): Any amino acid
  MOD_RES (17)..(26): Any amino acid
  MOD_RES (38)..(38): Any amino acid
  MOD_RES (60)..(83): Any amino acid
  MOD_RES (97)..(101): Any amino acid
  MOD_RES (110)..(123): Any amino acid
  MOD_RES (147)..(169): Any amino acid
  MOD_RES (179)..(181): Any amino acid
  MOD_RES (190)..(201): Any amino acid
  MOD_RES (212)..(253): Any amino acid
  MOD_RES (263)..(264): Any amino acid
  MOD_RES (281)..(312): Any amino acid
  MOD_RES (324)..(325): Any amino acid
  MOD_RES (361)..(369): Any amino acid
  MOD_RES (431)..(431): Any amino acid
  MOD_RES (473)..(483): Any amino acid
  MOD_RES (506)..(506): Any amino acid
  MOD_RES (528)..(531): Any amino acid
  MOD_RES (540)..(541): Any amino acid
  MOD_RES (580)..(581): Any amino acid
  MOD_RES (594)..(599): Any amino acid

SEQ ID NO: 420210 - protein, 599 aa, Influenza virus; identical to SEQ ID NO: 418443
  MOD_RES (1)..(6): Any amino acid
  MOD_RES (17)..(26): Any amino acid
  MOD_RES (62)..(83): Any amino acid
  MOD_RES (97)..(101): Any amino acid
  MOD_RES (110)..(123): Any amino acid
  MOD_RES (147)..(169): Any amino acid
  MOD_RES (179)..(201): Any amino acid
  MOD_RES (212)..(253): Any amino acid
  MOD_RES (263)..(264): Any amino acid
  MOD_RES (281)..(312): Any amino acid
  MOD_RES (342)..(342): Any amino acid
  MOD_RES (364)..(385): Any amino acid
  MOD_RES (428)..(431): Any amino acid
  MOD_RES (455)..(464): Any amino acid
  MOD_RES (473)..(483): Any amino acid
  MOD_RES (506)..(506): Any amino acid
  MOD_RES (528)..(531): Any amino acid
  MOD_RES (540)..(541): Any amino acid
  MOD_RES (580)..(581): Any amino acid

SEQ ID NO: 420211 - protein, 599 aa, Influenza virus; identical to SEQ ID NO: 418444
  MOD_RES (1)..(8): Any amino acid
  MOD_RES (17)..(40): Any amino acid
  MOD_RES (57)..(83): Any amino acid
  MOD_RES (97)..(101): Any amino acid
  MOD_RES (110)..(123): Any amino acid
  MOD_RES (143)..(169): Any amino acid
  MOD_RES (179)..(201): Any amino acid
  MOD_RES (212)..(253): Any amino acid
  MOD_RES (263)..(264): Any amino acid
  MOD_RES (281)..(312): Any amino acid
  MOD_RES (324)..(325): Any amino acid
  MOD_RES (354)..(397): Any amino acid
  MOD_RES (428)..(431): Any amino acid
  MOD_RES (449)..(464): Any amino acid
  MOD_RES (473)..(497): Any amino acid
  MOD_RES (506)..(509): Any amino acid
  MOD_RES (528)..(531): Any amino acid
  MOD_RES (540)..(541): Any amino acid
  MOD_RES (550)..(550): Any amino acid
  MOD_RES (567)..(571): Any amino acid
  MOD_RES (596)..(599): Any amino acid

SEQ ID NO: 420212 - protein, 599 aa, Influenza virus; identical to SEQ ID NO: 418445
  MOD_RES (1)..(12): Any amino acid
  MOD_RES (21)..(41): Any amino acid
  MOD_RES (55)..(88): Any amino acid
  MOD_RES (97)..(101): Any amino acid
  MOD_RES (110)..(132): Any amino acid
  MOD_RES (142)..(169): Any amino acid
  MOD_RES (178)..(201): Any amino acid
  MOD_RES (212)..(254): Any amino acid
  MOD_RES (263)..(264): Any amino acid
  MOD_RES (276)..(312): Any amino acid
  MOD_RES (351)..(397): Any amino acid
  MOD_RES (416)..(416): Any amino acid
  MOD_RES (431)..(431): Any amino acid
  MOD_RES (456)..(464): Any amino acid
  MOD_RES (473)..(519): Any amino acid
  MOD_RES (528)..(531): Any amino acid
  MOD_RES (540)..(552): Any amino acid
  MOD_RES (565)..(571): Any amino acid
  MOD_RES (580)..(581): Any amino acid
  MOD_RES (595)..(599): Any amino acid

SEQ ID NO: 420213 - protein, 484 aa, Influenza virus; identical to SEQ ID NO: 418450
  MOD_RES (19)..(106): Any amino acid
  MOD_RES (231)..(232): Any amino acid
  MOD_RES (267)..(282): Any amino acid
  MOD_RES (298)..(299): Any amino acid
  MOD_RES (323)..(323): Any amino acid
  MOD_RES (343)..(354): Any amino acid
  MOD_RES (379)..(382): Any amino acid
  MOD_RES (395)..(409): Any amino acid
  MOD_RES (445)..(447): Any amino acid
  MOD_RES (465)..(467): Any amino acid
  MOD_RES (482)..(484): Any amino acid

SEQ ID NO: 420214 - protein, 484 aa, Influenza virus; identical to SEQ ID NO: 418451
  MOD_RES (1)..(106): Any amino acid
  MOD_RES (145)..(146): Any amino acid
  MOD_RES (231)..(232): Any amino acid
  MOD_RES (259)..(282): Any amino acid
  MOD_RES (298)..(299): Any amino acid
  MOD_RES (323)..(323): Any amino acid
  MOD_RES (334)..(334): Any amino acid
  MOD_RES (343)..(354): Any amino acid
  MOD_RES (379)..(383): Any amino acid
  MOD_RES (395)..(409): Any amino acid
  MOD_RES (419)..(420): Any amino acid
  MOD_RES (445)..(447): Any amino acid
  MOD_RES (465)..(467): Any amino acid
  MOD_RES (482)..(484): Any amino acid

SEQ ID NO: 420215 - protein, 484 aa, Influenza virus; identical to SEQ ID NO: 418452
  MOD_RES (1)..(106): Any amino acid
  MOD_RES (119)..(120): Any amino acid
  MOD_RES (145)..(152): Any amino acid
  MOD_RES (185)..(191): Any amino acid
  MOD_RES (208)..(217): Any amino acid
  MOD_RES (227)..(232): Any amino acid
  MOD_RES (259)..(282): Any amino acid
  MOD_RES (298)..(299): Any amino acid
  MOD_RES (309)..(309): Any amino acid
  MOD_RES (323)..(323): Any amino acid
  MOD_RES (343)..(354): Any amino acid
  MOD_RES (379)..(383): Any amino acid
  MOD_RES (392)..(409): Any amino acid
  MOD_RES (418)..(421): Any amino acid
  MOD_RES (445)..(448): Any amino acid
  MOD_RES (465)..(467): Any amino acid
  MOD_RES (482)..(484): Any amino acid

SEQ ID NO: 420216 - protein, 484 aa, Influenza virus; identical to SEQ ID NO: 418453
  MOD_RES (1)..(108): Any amino acid
  MOD_RES (130)..(131): Any amino acid
  MOD_RES (145)..(152): Any amino acid
  MOD_RES (182)..(191): Any amino acid
  MOD_RES (210)..(217): Any amino acid
  MOD_RES (231)..(232): Any amino acid
  MOD_RES (259)..(282): Any amino acid
  MOD_RES (298)..(299): Any amino acid
  MOD_RES (308)..(313): Any amino acid
  MOD_RES (323)..(323): Any amino acid
  MOD_RES (343)..(354): Any amino acid
  MOD_RES (379)..(409): Any amino acid
  MOD_RES (418)..(421): Any amino acid
  MOD_RES (432)..(448): Any amino acid
  MOD_RES (465)..(467): Any amino acid
  MOD_RES (482)..(484): Any amino acid

SEQ ID NO: 420217 - protein, 484 aa, Influenza virus; identical to SEQ ID NO: 418454
  MOD_RES (1)..(110): Any amino acid
  MOD_RES (125)..(133): Any amino acid
  MOD_RES (149)..(153): Any amino acid
  MOD_RES (170)..(191): Any amino acid
  MOD_RES (200)..(217): Any amino acid
  MOD_RES (229)..(237): Any amino acid
  MOD_RES (250)..(282): Any amino acid
  MOD_RES (294)..(313): Any amino acid
  MOD_RES (323)..(325): Any amino acid
  MOD_RES (334)..(359): Any amino acid
  MOD_RES (375)..(423): Any amino acid
  MOD_RES (439)..(472): Any amino acid
  MOD_RES (482)..(484): Any amino acid

SEQ ID NO: 420218 - protein, 566 aa, Influenza virus; identical to SEQ ID NO: 418456
  MOD_RES (1)..(17): Any amino acid
  MOD_RES (36)..(37): Any amino acid
  MOD_RES (52)..(53): Any amino acid
  MOD_RES (62)..(73): Any amino acid
  MOD_RES (85)..(113): Any amino acid
  MOD_RES (124)..(241): Any amino acid
  MOD_RES (250)..(306): Any amino acid
  MOD_RES (327)..(328): Any amino acid
  MOD_RES (369)..(371): Any amino acid
  MOD_RES (382)..(392): Any amino acid
  MOD_RES (401)..(421): Any amino acid
  MOD_RES (460)..(468): Any amino acid
  MOD_RES (491)..(491): Any amino acid
  MOD_RES (504)..(527): Any amino acid
  MOD_RES (538)..(550): Any amino acid

SEQ ID NO: 420219 - protein, 566 aa, Influenza virus; identical to SEQ ID NO: 418457
  MOD_RES (1)..(17): Any amino acid
  MOD_RES (36)..(37): Any amino acid
  MOD_RES (52)..(53): Any amino acid
  MOD_RES (62)..(73): Any amino acid
  MOD_RES (85)..(113): Any amino acid
  MOD_RES (124)..(241): Any amino acid
  MOD_RES (250)..(306): Any amino acid
  MOD_RES (327)..(328): Any amino acid
  MOD_RES (350)..(354): Any amino acid
  MOD_RES (369)..(371): Any amino acid
  MOD_RES (382)..(392): Any amino acid
  MOD_RES (401)..(421): Any amino acid
  MOD_RES (460)..(468): Any amino acid
  MOD_RES (491)..(491): Any amino acid
  MOD_RES (504)..(527): Any amino acid
  MOD_RES (538)..(550): Any amino acid

SEQ ID NO: 420220 - protein, 566 aa, Influenza virus; identical to SEQ ID NO: 418458
  MOD_RES (1)..(17): Any amino acid
  MOD_RES (36)..(37): Any amino acid
  MOD_RES (49)..(53): Any amino acid
  MOD_RES (62)..(73): Any amino acid
  MOD_RES (85)..(113): Any amino acid
  MOD_RES (124)..(241): Any amino acid
  MOD_RES (250)..(306): Any amino acid
  MOD_RES (327)..(328): Any amino acid
  MOD_RES (351)..(355): Any amino acid
  MOD_RES (369)..(371): Any amino acid
  MOD_RES (381)..(392): Any amino acid
  MOD_RES (401)..(421): Any amino acid
  MOD_RES (443)..(446): Any amino acid
  MOD_RES (460)..(468): Any amino acid
  MOD_RES (477)..(481): Any amino acid
  MOD_RES (491)..(491): Any amino acid
  MOD_RES (504)..(527): Any amino acid
  MOD_RES (537)..(550): Any amino acid

SEQ ID NO: 420221 - protein, 566 aa, Influenza virus; identical to SEQ ID NO: 418459
  MOD_RES (1)..(17): Any amino acid
  MOD_RES (26)..(37): Any amino acid
  MOD_RES (46)..(53): Any amino acid
  MOD_RES (62)..(73): Any amino acid
  MOD_RES (85)..(113): Any amino acid
  MOD_RES (124)..(241): Any amino acid
  MOD_RES (250)..(307): Any amino acid
  MOD_RES (319)..(328): Any amino acid
  MOD_RES (349)..(373): Any amino acid
  MOD_RES (382)..(392): Any amino acid
  MOD_RES (401)..(421): Any amino acid
  MOD_RES (433)..(449): Any amino acid
  MOD_RES (460)..(468): Any amino acid
  MOD_RES (481)..(482): Any amino acid
  MOD_RES (491)..(491): Any amino acid
  MOD_RES (504)..(527): Any amino acid
  MOD_RES (538)..(550): Any amino acid

SEQ ID NO: 420222 - protein, 566 aa, Influenza virus; identical to SEQ ID NO: 418460
  MOD_RES (1)..(18): Any amino acid
  MOD_RES (27)..(37): Any amino acid
  MOD_RES (47)..(53): Any amino acid
  MOD_RES (62)..(73): Any amino acid
  MOD_RES (85)..(115): Any amino acid
  MOD_RES (124)..(241): Any amino acid
  MOD_RES (250)..(307): Any amino acid
  MOD_RES (323)..(328): Any amino acid
  MOD_RES (351)..(392): Any amino acid
  MOD_RES (401)..(421): Any amino acid
  MOD_RES (435)..(471): Any amino acid
  MOD_RES (482)..(482): Any amino acid
  MOD_RES (491)..(494): Any amino acid
  MOD_RES (504)..(527): Any amino acid
  MOD_RES (538)..(555): Any amino acid

SEQ ID NO: 420223 - protein, 475 aa, Influenza virus; identical to SEQ ID NO: 418464
  MOD_RES (1)..(46): Any amino acid
  MOD_RES (55)..(84): Any amino acid
  MOD_RES (94)..(94): Any amino acid
  MOD_RES (127)..(128): Any amino acid
  MOD_RES (144)..(151): Any amino acid
  MOD_RES (198)..(200): Any amino acid
  MOD_RES (209)..(221): Any amino acid
  MOD_RES (236)..(236): Any amino acid
  MOD_RES (250)..(270): Any amino acid
  MOD_RES (287)..(287): Any amino acid
  MOD_RES (307)..(314): Any amino acid
  MOD_RES (329)..(345): Any amino acid
  MOD_RES (358)..(359): Any amino acid
  MOD_RES (368)..(370): Any amino acid
  MOD_RES (382)..(403): Any amino acid
  MOD_RES (415)..(416): Any amino acid
  MOD_RES (433)..(436): Any amino acid

SEQ ID NO: 420224 - protein, 475 aa, Influenza virus; identical to SEQ ID NO: 418465
  MOD_RES (1)..(84): Any amino acid
  MOD_RES (94)..(94): Any amino acid
  MOD_RES (104)..(104): Any amino acid
  MOD_RES (127)..(128): Any amino acid
  MOD_RES (144)..(151): Any amino acid
  MOD_RES (197)..(200): Any amino acid
  MOD_RES (209)..(221): Any amino acid
  MOD_RES (236)..(236): Any amino acid
  MOD_RES (250)..(270): Any amino acid
  MOD_RES (287)..(287): Any amino acid
  MOD_RES (307)..(314): Any amino acid
  MOD_RES (326)..(345): Any amino acid
  MOD_RES (358)..(359): Any amino acid
  MOD_RES (368)..(370): Any amino acid
  MOD_RES (382)..(403): Any amino acid
  MOD_RES (415)..(416): Any amino acid
  MOD_RES (433)..(436): Any amino acid
  MOD_RES (466)..(475): Any amino acid

SEQ ID NO: 420225 - protein, 475 aa, Influenza virus; identical to SEQ ID NO: 418466
  MOD_RES (1)..(84): Any amino acid
  MOD_RES (94)..(94): Any amino acid
  MOD_RES (103)..(106): Any amino acid
  MOD_RES (127)..(134): Any amino acid
  MOD_RES (144)..(151): Any amino acid
  MOD_RES (177)..(180): Any amino acid
  MOD_RES (198)..(200): Any amino acid
  MOD_RES (209)..(221): Any amino acid
  MOD_RES (236)..(236): Any amino acid
  MOD_RES (249)..(270): Any amino acid
  MOD_RES (287)..(289): Any amino acid
  MOD_RES (305)..(314): Any amino acid
  MOD_RES (326)..(345): Any amino acid
  MOD_RES (358)..(359): Any amino acid
  MOD_RES (368)..(370): Any amino acid
  MOD_RES (382)..(403): Any amino acid
  MOD_RES (415)..(416): Any amino acid
  MOD_RES (433)..(436): Any amino acid
  MOD_RES (466)..(475): Any amino acid

SEQ ID NO: 420226 - protein, 475 aa, Influenza virus; identical to SEQ ID NO: 418467
  MOD_RES (1)..(84): Any amino acid
  MOD_RES (94)..(94): Any amino acid
  MOD_RES (103)..(108): Any amino acid
  MOD_RES (127)..(134): Any amino acid
  MOD_RES (144)..(151): Any amino acid
  MOD_RES (181)..(181): Any amino acid
  MOD_RES (197)..(200): Any amino acid
  MOD_RES (209)..(221): Any amino acid
  MOD_RES (236)..(236): Any amino acid
  MOD_RES (250)..(270): Any amino acid
  MOD_RES (287)..(296): Any amino acid
  MOD_RES (307)..(345): Any amino acid
  MOD_RES (358)..(370): Any amino acid
  MOD_RES (382)..(403): Any amino acid
  MOD_RES (412)..(416): Any amino acid
  MOD_RES (433)..(440): Any amino acid
  MOD_RES (461)..(462): Any amino acid
  MOD_RES (473)..(475): Any amino acid

SEQ ID NO: 420227 - protein, 475 aa, Influenza virus; identical to SEQ ID NO: 418468
  MOD_RES (1)..(84): Any amino acid
  MOD_RES (94)..(95): Any amino acid
  MOD_RES (104)..(109): Any amino acid
  MOD_RES (127)..(151): Any amino acid
  MOD_RES (162)..(165): Any amino acid
  MOD_RES (181)..(200): Any amino acid
  MOD_RES (209)..(227): Any amino acid
  MOD_RES (236)..(236): Any amino acid
  MOD_RES (245)..(296): Any amino acid
  MOD_RES (307)..(345): Any amino acid
  MOD_RES (358)..(403): Any amino acid
  MOD_RES (412)..(424): Any amino acid
  MOD_RES (433)..(441): Any amino acid
  MOD_RES (465)..(475): Any amino acid

SEQ ID NO: 420228 - protein, 569 aa, Influenza virus; identical to SEQ ID NO: 418472
  MOD_RES (15)..(21): Any amino acid
  MOD_RES (94)..(94): Any amino acid
  MOD_RES (106)..(110): Any amino acid
  MOD_RES (126)..(131): Any amino acid
  MOD_RES (140)..(161): Any amino acid
  MOD_RES (173)..(182): Any amino acid
  MOD_RES (195)..(222): Any amino acid
  MOD_RES (231)..(241): Any amino acid
  MOD_RES (255)..(259): Any amino acid
  MOD_RES (289)..(294): Any amino acid
  MOD_RES (330)..(331): Any amino acid
  MOD_RES (341)..(341): Any amino acid
  MOD_RES (392)..(399): Any amino acid
  MOD_RES (412)..(412): Any amino acid
  MOD_RES (437)..(437): Any amino acid
  MOD_RES (527)..(527): Any amino acid

SEQ ID NO: 420229 - protein, 569 aa, Influenza virus; identical to SEQ ID NO: 418473
  MOD_RES (15)..(21): Any amino acid
  MOD_RES (94)..(94): Any amino acid
  MOD_RES (106)..(110): Any amino acid
  MOD_RES (126)..(131): Any amino acid
  MOD_RES (140)..(161): Any amino acid
  MOD_RES (170)..(182): Any amino acid
  MOD_RES (195)..(222): Any amino acid
  MOD_RES (231)..(241): Any amino acid
  MOD_RES (255)..(259): Any amino acid
  MOD_RES (289)..(294): Any amino acid
  MOD_RES (330)..(331): Any amino acid
  MOD_RES (341)..(341): Any amino acid
  MOD_RES (352)..(357): Any amino acid
  MOD_RES (392)..(399): Any amino acid
  MOD_RES (411)..(412): Any amino acid
  MOD_RES (437)..(437): Any amino acid
  MOD_RES (527)..(527): Any amino acid
  MOD_RES (538)..(542): Any amino acid
  MOD_RES (563)..(569): Any amino acid

SEQ ID NO: 420230 - protein, 569 aa, Influenza virus; identical to SEQ ID NO: 418474
  MOD_RES (12)..(21): Any amino acid
  MOD_RES (75)..(83): Any amino acid
  MOD_RES (94)..(94): Any amino acid
  MOD_RES (106)..(110): Any amino acid
  MOD_RES (125)..(131): Any amino acid
  MOD_RES (140)..(161): Any amino acid
  MOD_RES (173)..(182): Any amino acid
  MOD_RES (195)..(222): Any amino acid
  MOD_RES (231)..(241): Any amino acid
  MOD_RES (253)..(259): Any amino acid
  MOD_RES (289)..(294): Any amino acid
  MOD_RES (306)..(311): Any amino acid
  MOD_RES (330)..(331): Any amino acid
  MOD_RES (341)..(341): Any amino acid
  MOD_RES (354)..(378): Any amino acid
  MOD_RES (392)..(399): Any amino acid
  MOD_RES (412)..(412): Any amino acid
  MOD_RES (437)..(437): Any amino acid
  MOD_RES (526)..(527): Any amino acid
  MOD_RES (536)..(542): Any amino acid
  MOD_RES (563)..(569): Any amino acid

SEQ ID NO: 420231 - protein, 569 aa, Influenza virus; identical to SEQ ID NO: 418475
  MOD_RES (11)..(23): Any amino acid
  MOD_RES (81)..(83): Any amino acid
  MOD_RES (94)..(96): Any amino acid
  MOD_RES (106)..(116): Any amino acid
  MOD_RES (126)..(131): Any amino acid
  MOD_RES (140)..(185): Any amino acid
  MOD_RES (195)..(222): Any amino acid
  MOD_RES (231)..(241): Any amino acid
  MOD_RES (255)..(274): Any amino acid
  MOD_RES (289)..(294): Any amino acid
  MOD_RES (309)..(331): Any amino acid
  MOD_RES (341)..(341): Any amino acid
  MOD_RES (354)..(399): Any amino acid
  MOD_RES (412)..(412): Any amino acid
  MOD_RES (437)..(437): Any amino acid
  MOD_RES (446)..(449): Any amino acid
  MOD_RES (485)..(489): Any amino acid
  MOD_RES (527)..(528): Any amino acid
  MOD_RES (538)..(546): Any amino acid
  MOD_RES (562)..(569): Any amino acid

SEQ ID NO: 420232 - protein, 569 aa, Influenza virus; identical to SEQ ID NO: 418476
  MOD_RES (1)..(23): Any amino acid
  MOD_RES (41)..(49): Any amino acid
  MOD_RES (77)..(84): Any amino acid
  MOD_RES (94)..(97): Any amino acid
  MOD_RES (106)..(116): Any amino acid
  MOD_RES (126)..(131): Any amino acid
  MOD_RES (140)..(185): Any amino acid
  MOD_RES (195)..(222): Any amino acid
  MOD_RES (231)..(241): Any amino acid
  MOD_RES (253)..(278): Any amino acid
  MOD_RES (289)..(294): Any amino acid
  MOD_RES (304)..(331): Any amino acid
  MOD_RES (341)..(341): Any amino acid
  MOD_RES (352)..(400): Any amino acid
  MOD_RES (412)..(423): Any amino acid
  MOD_RES (437)..(449): Any amino acid
  MOD_RES (488)..(489): Any amino acid
  MOD_RES (527)..(546): Any amino acid
  MOD_RES (562)..(569): Any amino acid

SEQ ID NO: 420233 - protein, 562 aa, Influenza virus; identical to SEQ ID NO: 418480
  MOD_RES (1)..(12): Any amino acid
  MOD_RES (101)..(101): Any amino acid
  MOD_RES (121)..(121): Any amino acid
  MOD_RES (136)..(154): Any amino acid
  MOD_RES (166)..(172): Any amino acid
  MOD_RES (199)..(203): Any amino acid
  MOD_RES (214)..(215): Any amino acid
  MOD_RES (224)..(234): Any amino acid
  MOD_RES (248)..(249): Any amino acid
  MOD_RES (386)..(391): Any amino acid

SEQ ID NO: 420234 - protein, 562 aa, Influenza virus; identical to SEQ ID NO: 418481
  MOD_RES (1)..(12): Any amino acid
  MOD_RES (76)..(79): Any amino acid
  MOD_RES (101)..(101): Any amino acid
  MOD_RES (121)..(121): Any amino acid
  MOD_RES (136)..(154): Any amino acid
  MOD_RES (163)..(172): Any amino acid
  MOD_RES (199)..(203): Any amino acid
  MOD_RES (214)..(215): Any amino acid
  MOD_RES (224)..(234): Any amino acid
  MOD_RES (248)..(249): Any amino acid
  MOD_RES (347)..(350): Any amino acid
  MOD_RES (386)..(391): Any amino acid
  MOD_RES (437)..(438): Any amino acid
  MOD_RES (534)..(535): Any amino acid

SEQ ID NO: 420235 - protein, 562 aa, Influenza virus; identical to SEQ ID NO: 418482
  MOD_RES (1)..(12): Any amino acid
  MOD_RES (63)..(66): Any amino acid
  MOD_RES (77)..(79): Any amino acid
  MOD_RES (101)..(101): Any amino acid
  MOD_RES (121)..(121): Any amino acid
  MOD_RES (136)..(154): Any amino acid
  MOD_RES (166)..(172): Any amino acid
  MOD_RES (199)..(203): Any amino acid
  MOD_RES (214)..(215): Any amino acid
  MOD_RES (224)..(234): Any amino acid
  MOD_RES (248)..(249): Any amino acid
  MOD_RES (302)..(305): Any amino acid
  MOD_RES (342)..(371): Any amino acid
  MOD_RES (386)..(391): Any amino acid
  MOD_RES (436)..(441): Any amino acid
  MOD_RES (475)..(478): Any amino acid
  MOD_RES (528)..(535): Any amino acid
  MOD_RES (548)..(553): Any amino acid
  MOD_RES (562)..(562): Any amino acid

SEQ ID NO: 420236 - protein, 562 aa, Influenza virus; identical to SEQ ID NO: 418483
  MOD_RES (1)..(12): Any amino acid
  MOD_RES (38)..(42): Any amino acid
  MOD_RES (68)..(79): Any amino acid
  MOD_RES (101)..(101): Any amino acid
  MOD_RES (120)..(121): Any amino acid
  MOD_RES (136)..(172): Any amino acid
  MOD_RES (199)..(203): Any amino acid
  MOD_RES (214)..(234): Any amino acid
  MOD_RES (248)..(249): Any amino acid
  MOD_RES (258)..(262): Any amino acid
  MOD_RES (297)..(306): Any amino acid
  MOD_RES (345)..(377): Any amino acid
  MOD_RES (386)..(391): Any amino acid
  MOD_RES (432)..(442): Any amino acid
  MOD_RES (464)..(465): Any amino acid
  MOD_RES (478)..(487): Any amino acid
  MOD_RES (524)..(524): Any amino acid
  MOD_RES (533)..(539): Any amino acid
  MOD_RES (555)..(562): Any amino acid

SEQ ID NO: 420237 - protein, 562 aa, Influenza virus; identical to SEQ ID NO: 418484
  MOD_RES (1)..(24): Any amino acid
  MOD_RES (38)..(43): Any amino acid
  MOD_RES (57)..(79): Any amino acid
  MOD_RES (101)..(101): Any amino acid
  MOD_RES (110)..(111): Any amino acid
  MOD_RES (121)..(121): Any amino acid
  MOD_RES (136)..(172): Any amino acid
  MOD_RES (199)..(234): Any amino acid
  MOD_RES (243)..(249): Any amino acid
  MOD_RES (260)..(274): Any amino acid
  MOD_RES (283)..(285): Any amino acid
  MOD_RES (298)..(315): Any amino acid
  MOD_RES (344)..(377): Any amino acid
  MOD_RES (386)..(391): Any amino acid
  MOD_RES (403)..(404): Any amino acid
  MOD_RES (438)..(452): Any amino acid
  MOD_RES (468)..(487): Any amino acid
  MOD_RES (499)..(502): Any amino acid
  MOD_RES (531)..(539): Any amino acid
  MOD_RES (555)..(562): Any amino acid

SEQ ID NO: 420238 - protein, 469 aa, Influenza virus; identical to SEQ ID NO: 418487
  MOD_RES (17)..(24): Any amino acid
  MOD_RES (44)..(51): Any amino acid
  MOD_RES (62)..(62): Any amino acid
  MOD_RES (75)..(83): Any amino acid
  MOD_RES (210)..(212): Any amino acid
  MOD_RES (387)..(387): Any amino acid

SEQ ID NO: 420239 - protein, 469 aa, Influenza virus; identical to SEQ ID NO: 418488
  MOD_RES (17)..(24): Any amino acid
  MOD_RES (44)..(51): Any amino acid
  MOD_RES (62)..(62): Any amino acid
  MOD_RES (75)..(83): Any amino acid
  MOD_RES (101)..(103): Any amino acid
  MOD_RES (157)..(158): Any amino acid
  MOD_RES (210)..(212): Any amino acid
  MOD_RES (387)..(387): Any amino acid
  MOD_RES (452)..(455): Any amino acid

SEQ ID NO: 420240 - protein, 469 aa, Influenza virus; identical to SEQ ID NO: 418489
  MOD_RES (1)..(2): Any amino acid
  MOD_RES (17)..(24): Any amino acid
  MOD_RES (44)..(51): Any amino acid
  MOD_RES (60)..(62): Any amino acid
  MOD_RES (75)..(83): Any amino acid
  MOD_RES (99)..(103): Any amino acid
  MOD_RES (126)..(126): Any amino acid
  MOD_RES (157)..(164): Any amino acid
  MOD_RES (180)..(184): Any amino acid
  MOD_RES (210)..(212): Any amino acid
  MOD_RES (221)..(224): Any amino acid
  MOD_RES (244)..(245): Any amino acid
  MOD_RES (274)..(275): Any amino acid
  MOD_RES (376)..(376): Any amino acid
  MOD_RES (387)..(387): Any amino acid
  MOD_RES (439)..(439): Any amino acid
  MOD_RES (449)..(457): Any amino acid

SEQ ID NO: 420241 - protein, 469 aa, Influenza virus; identical to SEQ ID NO: 418490
  MOD_RES (1)..(3): Any amino acid
  MOD_RES (17)..(24): Any amino acid
  MOD_RES (41)..(52): Any amino acid
  MOD_RES (62)..(62): Any amino acid
  MOD_RES (75)..(87): Any amino acid
  MOD_RES (101)..(104): Any amino acid
  MOD_RES (118)..(118): Any amino acid
  MOD_RES (135)..(139): Any amino acid
  MOD_RES (161)..(168): Any amino acid
  MOD_RES (180)..(186): Any amino acid
  MOD_RES (210)..(212): Any amino acid
  MOD_RES (228)..(228): Any amino acid
  MOD_RES (239)..(250): Any amino acid
  MOD_RES (277)..(278): Any amino acid
  MOD_RES (294)..(296): Any amino acid
  MOD_RES (386)..(387): Any amino acid
  MOD_RES (409)..(414): Any amino acid
  MOD_RES (439)..(457): Any amino acid
  MOD_RES (469)..(469): Any amino acid

SEQ ID NO: 420242 - protein, 469 aa, Influenza virus; identical to SEQ ID NO: 418491
  MOD_RES (1)..(4): Any amino acid
  MOD_RES (15)..(33): Any amino acid
  MOD_RES (44)..(52): Any amino acid
  MOD_RES (62)..(62): Any amino acid
  MOD_RES (75)..(87): Any amino acid
  MOD_RES (97)..(108): Any amino acid
  MOD_RES (135)..(141): Any amino acid
  MOD_RES (161)..(168): Any amino acid
  MOD_RES (184)..(192): Any amino acid
  MOD_RES (207)..(213): Any amino acid
  MOD_RES (223)..(228): Any amino acid
  MOD_RES (244)..(250): Any amino acid
  MOD_RES (273)..(278): Any amino acid
  MOD_RES (295)..(296): Any amino acid
  MOD_RES (315)..(323): Any amino acid
  MOD_RES (353)..(356): Any amino acid
  MOD_RES (369)..(376): Any amino acid
  MOD_RES (387)..(387): Any amino acid
  MOD_RES (402)..(414): Any amino acid
  MOD_RES (442)..(458): Any amino acid

SEQ ID NO: 420243 - protein, 580 aa, Influenza virus; identical to SEQ ID NO: 418495
  MOD_RES (13)..(13): Any amino acid
  MOD_RES (22)..(29): Any amino acid
  MOD_RES (51)..(57): Any amino acid
  MOD_RES (72)..(86): Any amino acid
  MOD_RES (105)..(110): Any amino acid
  MOD_RES (119)..(121): Any amino acid
  MOD_RES (132)..(133): Any amino acid
  MOD_RES (148)..(172): Any amino acid
  MOD_RES (183)..(200): Any amino acid
  MOD_RES (213)..(257): Any amino acid
  MOD_RES (269)..(273): Any amino acid
  MOD_RES (288)..(291): Any amino acid
  MOD_RES (300)..(306): Any amino acid
  MOD_RES (337)..(338): Any amino acid
  MOD_RES (385)..(385): Any amino acid
  MOD_RES (414)..(414): Any amino acid
  MOD_RES (508)..(508): Any amino acid
  MOD_RES (519)..(520): Any amino acid
  MOD_RES (532)..(539): Any amino acid
  MOD_RES (559)..(561): Any amino acid

SEQ ID NO: 420244 - protein, 580 aa, Influenza virus; identical to SEQ ID NO: 418496
  MOD_RES (1)..(3): Any amino acid
  MOD_RES (13)..(13): Any amino acid
  MOD_RES (22)..(32): Any amino acid
  MOD_RES (51)..(57): Any amino acid
  MOD_RES (72)..(90): Any amino acid
  MOD_RES (105)..(110): Any amino acid
  MOD_RES (119)..(121): Any amino acid
  MOD_RES (132)..(133): Any amino acid
  MOD_RES (147)..(172): Any amino acid
  MOD_RES (183)..(200): Any amino acid
  MOD_RES (213)..(257): Any amino acid
  MOD_RES (269)..(273): Any amino acid
  MOD_RES (287)..(306): Any amino acid
  MOD_RES (337)..(338): Any amino acid
  MOD_RES (367)..(367): Any amino acid
  MOD_RES (385)..(385): Any amino acid
  MOD_RES (414)..(414): Any amino acid
  MOD_RES (424)..(424): Any amino acid
  MOD_RES (508)..(508): Any amino acid
  MOD_RES (519)..(520): Any amino acid
  MOD_RES (532)..(539): Any amino acid
  MOD_RES (559)..(561): Any amino acid
  MOD_RES (579)..(580): Any amino acid

SEQ ID NO: 420245 - protein, 580 aa, Influenza virus; identical to SEQ ID NO: 418497
  MOD_RES (1)..(10): Any amino acid
  MOD_RES (20)..(35): Any amino acid
  MOD_RES (51)..(57): Any amino acid
  MOD_RES (72)..(90): Any amino acid
  MOD_RES (105)..(110): Any amino acid
  MOD_RES (119)..(121): Any amino acid
  MOD_RES (132)..(133): Any amino acid
  MOD_RES (146)..(172): Any amino acid
  MOD_RES (183)..(200): Any amino acid
  MOD_RES (213)..(257): Any amino acid
  MOD_RES (266)..(273): Any amino acid
  MOD_RES (288)..(306): Any amino acid
  MOD_RES (337)..(338): Any amino acid
  MOD_RES (364)..(367): Any amino acid
  MOD_RES (414)..(414): Any amino acid
  MOD_RES (425)..(440): Any amino acid
  MOD_RES (476)..(480): Any amino acid
  MOD_RES (506)..(508): Any amino acid
  MOD_RES (517)..(520): Any amino acid
  MOD_RES (532)..(539): Any amino acid
  MOD_RES (559)..(561): Any amino acid

SEQ ID NO: 420246 - protein, 580 aa, Influenza virus; identical to SEQ ID NO: 418498
  MOD_RES (1)..(10): Any amino acid
  MOD_RES (20)..(35): Any amino acid
  MOD_RES (49)..(57): Any amino acid
  MOD_RES (72)..(90): Any amino acid
  MOD_RES (102)..(110): Any amino acid
  MOD_RES (119)..(121): Any amino acid
  MOD_RES (132)..(133): Any amino acid
  MOD_RES (148)..(172): Any amino acid
  MOD_RES (182)..(257): Any amino acid
  MOD_RES (269)..(273): Any amino acid
  MOD_RES (288)..(306): Any amino acid
  MOD_RES (327)..(328): Any amino acid
  MOD_RES (337)..(338): Any amino acid
  MOD_RES (365)..(370): Any amino acid
  MOD_RES (384)..(385): Any amino acid
  MOD_RES (394)..(396): Any amino acid
  MOD_RES (414)..(414): Any amino acid
  MOD_RES (424)..(453): Any amino acid
  MOD_RES (478)..(486): Any amino acid
  MOD_RES (508)..(508): Any amino acid
  MOD_RES (519)..(520): Any amino acid
  MOD_RES (532)..(539): Any amino acid
  MOD_RES (559)..(563): Any amino acid

SEQ ID NO: 420247 - protein, 580 aa, Influenza virus; identical to SEQ ID NO: 418499
  MOD_RES (1)..(10): Any amino acid
  MOD_RES (20)..(110): Any amino acid
  MOD_RES (119)..(121): Any amino acid
  MOD_RES (132)..(137): Any amino acid
  MOD_RES (148)..(174): Any amino acid
  MOD_RES (183)..(257): Any amino acid
  MOD_RES (268)..(279): Any amino acid
  MOD_RES (288)..(311): Any amino acid
  MOD_RES (327)..(338): Any amino acid
  MOD_RES (363)..(377): Any amino acid
  MOD_RES (399)..(405): Any amino acid
  MOD_RES (414)..(414): Any amino acid
  MOD_RES (423)..(464): Any amino acid
  MOD_RES (482)..(489): Any amino acid
  MOD_RES (508)..(508): Any amino acid
  MOD_RES (519)..(522): Any amino acid
  MOD_RES (532)..(539): Any amino acid
  MOD_RES (553)..(567): Any amino acid
  MOD_RES (576)..(580): Any amino acid

SEQ ID NO: 420248 - protein, 574 aa, Influenza virus; identical to SEQ ID NO: 418504
  MOD_RES (10)..(23): Any amino acid
  MOD_RES (51)..(51): Any amino acid
  MOD_RES (66)..(82): Any amino acid
  MOD_RES (99)..(104): Any amino acid
  MOD_RES (113)..(115): Any amino acid
  MOD_RES (127)..(127): Any amino acid
  MOD_RES (143)..(166): Any amino acid
  MOD_RES (177)..(194): Any amino acid
  MOD_RES (209)..(250): Any amino acid
  MOD_RES (263)..(267): Any amino acid
  MOD_RES (282)..(283): Any amino acid
  MOD_RES (293)..(300): Any amino acid
  MOD_RES (408)..(408): Any amino acid
  MOD_RES (514)..(514): Any amino acid
  MOD_RES (530)..(530): Any amino acid
  MOD_RES (553)..(555): Any amino acid

SEQ ID NO: 420249 - protein, 574 aa, Influenza virus; identical to SEQ ID NO: 418505
  MOD_RES (1)..(1): Any amino acid
  MOD_RES (10)..(26): Any amino acid
  MOD_RES (51)..(51): Any amino acid
  MOD_RES (66)..(84): Any amino acid
  MOD_RES (99)..(104): Any amino acid
  MOD_RES (113)..(115): Any amino acid
  MOD_RES (127)..(127): Any amino acid
  MOD_RES (143)..(166): Any amino acid
  MOD_RES (177)..(194): Any amino acid
  MOD_RES (209)..(250): Any amino acid
  MOD_RES (259)..(267): Any amino acid
  MOD_RES (282)..(283): Any amino acid
  MOD_RES (293)..(300): Any amino acid
  MOD_RES (361)..(361): Any amino acid
  MOD_RES (408)..(408): Any amino acid
  MOD_RES (418)..(422): Any amino acid
  MOD_RES (514)..(514): Any amino acid
  MOD_RES (530)..(530): Any amino acid
  MOD_RES (553)..(555): Any amino acid
  MOD_RES (573)..(574): Any amino acid

SEQ ID NO: 420250 - protein, 574 aa, Influenza virus; identical to SEQ ID NO: 418506
  MOD_RES (1)..(29): Any amino acid
  MOD_RES (51)..(51): Any amino acid
  MOD_RES (66)..(84): Any amino acid
  MOD_RES (96)..(104): Any amino acid
  MOD_RES (113)..(115): Any amino acid
  MOD_RES (127)..(127): Any amino acid
  MOD_RES (143)..(166): Any amino acid
  MOD_RES (177)..(194): Any amino acid
  MOD_RES (209)..(250): Any amino acid
  MOD_RES (263)..(267): Any amino acid
  MOD_RES (281)..(283): Any amino acid
  MOD_RES (293)..(300): Any amino acid
  MOD_RES (356)..(361): Any amino acid
  MOD_RES (386)..(390): Any amino acid
  MOD_RES (408)..(408): Any amino acid
  MOD_RES (418)..(434): Any amino acid
  MOD_RES (455)..(458): Any amino acid
  MOD_RES (514)..(514): Any amino acid
  MOD_RES (530)..(530): Any amino acid
  MOD_RES (547)..(555): Any amino acid

SEQ ID NO: 420251 - protein, 574 aa, Influenza virus; identical to SEQ ID NO: 418507
  MOD_RES (1)..(29): Any amino acid
  MOD_RES (38)..(39): Any amino acid
  MOD_RES (51)..(104): Any amino acid
  MOD_RES (113)..(115): Any amino acid
  MOD_RES (127)..(132): Any amino acid
  MOD_RES (143)..(168): Any amino acid
  MOD_RES (177)..(200): Any amino acid
  MOD_RES (209)..(250): Any amino acid
  MOD_RES (262)..(273): Any amino acid
  MOD_RES (282)..(283): Any amino acid
  MOD_RES (293)..(300): Any amino acid
  MOD_RES (339)..(340): Any amino acid
  MOD_RES (356)..(362): Any amino acid
  MOD_RES (386)..(391): Any amino acid
  MOD_RES (408)..(408): Any amino acid
  MOD_RES (417)..(447): Any amino acid
  MOD_RES (459)..(462): Any amino acid
  MOD_RES (471)..(483): Any amino acid
  MOD_RES (514)..(516): Any amino acid
  MOD_RES (530)..(530): Any amino acid
  MOD_RES (553)..(557): Any amino acid

SEQ ID NO: 420252 - protein, 574 aa, Influenza virus; identical to SEQ ID NO: 418508
  MOD_RES (1)..(39): Any amino acid
  MOD_RES (49)..(118): Any amino acid
  MOD_RES (127)..(134): Any amino acid
  MOD_RES (143)..(200): Any amino acid
  MOD_RES (209)..(250): Any amino acid
  MOD_RES (261)..(273): Any amino acid
  MOD_RES (282)..(283): Any amino acid
  MOD_RES (292)..(305): Any amino acid
  MOD_RES (321)..(323): Any amino acid
  MOD_RES (332)..(340): Any amino acid
  MOD_RES (356)..(371): Any amino acid
  MOD_RES (393)..(398): Any amino acid
  MOD_RES (407)..(447): Any amino acid
  MOD_RES (458)..(466): Any amino acid
  MOD_RES (476)..(484): Any amino acid
  MOD_RES (501)..(517): Any amino acid
  MOD_RES (529)..(530): Any amino acid
  MOD_RES (539)..(561): Any amino acid
  MOD_RES (570)..(574): Any amino acid

SEQ ID NO: 420253 - protein, 486 aa, Influenza virus; identical to SEQ ID NO: 418516
  MOD_RES (20)..(36): Any amino acid
  MOD_RES (46)..(79): Any amino acid
  MOD_RES (89)..(91): Any amino acid
  MOD_RES (101)..(101): Any amino acid
  MOD_RES (134)..(134): Any amino acid
  MOD_RES (151)..(159): Any amino acid
  MOD_RES (205)..(205): Any amino acid
  MOD_RES (218)..(218): Any amino acid
  MOD_RES (228)..(228): Any amino acid
  MOD_RES (257)..(262): Any amino acid
  MOD_RES (271)..(278): Any amino acid
  MOD_RES (318)..(324): Any amino acid
  MOD_RES (340)..(357): Any amino acid
  MOD_RES (380)..(380): Any amino acid
  MOD_RES (392)..(401): Any amino acid
  MOD_RES (410)..(413): Any amino acid
  MOD_RES (442)..(445): Any amino acid

SEQ ID NO: 420254 - protein, 486 aa, Influenza virus; identical to SEQ ID NO: 418517
  MOD_RES (1)..(6): Any amino acid
  MOD_RES (20)..(36): Any amino acid
  MOD_RES (45)..(91): Any amino acid
  MOD_RES (101)..(109): Any amino acid
  MOD_RES (134)..(134): Any amino acid
  MOD_RES (151)..(159): Any amino acid
  MOD_RES (171)..(172): Any amino acid
  MOD_RES (188)..(194): Any amino acid
  MOD_RES (205)..(205): Any amino acid
  MOD_RES (218)..(218): Any amino acid
  MOD_RES (228)..(228): Any amino acid
  MOD_RES (257)..(262): Any amino acid
  MOD_RES (271)..(278): Any amino acid
  MOD_RES (318)..(324): Any amino acid
  MOD_RES (340)..(357): Any amino acid
  MOD_RES (380)..(380): Any amino acid
  MOD_RES (392)..(401): Any amino acid
  MOD_RES (410)..(413): Any amino acid
  MOD_RES (442)..(445): Any amino acid
  MOD_RES (456)..(458): Any amino acid
  MOD_RES (484)..(486): Any amino acid

SEQ ID NO: 420255 - protein, 486 aa, Influenza virus; identical to SEQ ID NO: 418518
  MOD_RES (1)..(6): Any amino acid
  MOD_RES (20)..(36): Any amino acid
  MOD_RES (46)..(91): Any amino acid
  MOD_RES (101)..(113): Any amino acid
  MOD_RES (134)..(134): Any amino acid
  MOD_RES (150)..(159): Any amino acid
  MOD_RES (192)..(205): Any amino acid
  MOD_RES (218)..(218): Any amino acid
  MOD_RES (228)..(228): Any amino acid
  MOD_RES (237)..(238): Any amino acid
  MOD_RES (257)..(262): Any amino acid
  MOD_RES (271)..(278): Any amino acid
  MOD_RES (288)..(288): Any amino acid
  MOD_RES (315)..(324): Any amino acid
  MOD_RES (336)..(357): Any amino acid
  MOD_RES (380)..(380): Any amino acid
  MOD_RES (392)..(401): Any amino acid
  MOD_RES (410)..(413): Any amino acid
  MOD_RES (429)..(445): Any amino acid
  MOD_RES (454)..(467): Any amino acid
  MOD_RES (485)..(486): Any amino acid

SEQ ID NO: 420256 - protein, 486 aa, Influenza virus; identical to SEQ ID NO: 418519
  MOD_RES (1)..(6): Any amino acid
  MOD_RES (16)..(36): Any amino acid
  MOD_RES (46)..(91): Any amino acid
  MOD_RES (101)..(125): Any amino acid
  MOD_RES (134)..(134): Any amino acid
  MOD_RES (143)..(172): Any amino acid
  MOD_RES (181)..(205): Any amino acid
  MOD_RES (218)..(218): Any amino acid
  MOD_RES (228)..(228): Any amino acid
  MOD_RES (237)..(238): Any amino acid
  MOD_RES (256)..(262): Any amino acid
  MOD_RES (271)..(278): Any amino acid
  MOD_RES (288)..(289): Any amino acid
  MOD_RES (305)..(306): Any amino acid
  MOD_RES (318)..(324): Any amino acid
  MOD_RES (336)..(360): Any amino acid
  MOD_RES (380)..(380): Any amino acid
  MOD_RES (389)..(401): Any amino acid
  MOD_RES (410)..(413): Any amino acid
  MOD_RES (435)..(445): Any amino acid
  MOD_RES (454)..(467): Any amino acid
  MOD_RES (483)..(486): Any amino acid

SEQ ID NO: 420257 - protein, 486 aa, Influenza virus; identical to SEQ ID NO: 418520
  MOD_RES (1)..(7): Any amino acid
  MOD_RES (20)..(36): Any amino acid
  MOD_RES (46)..(91): Any amino acid
  MOD_RES (101)..(205): Any amino acid
  MOD_RES (215)..(218): Any amino acid
  MOD_RES (228)..(245): Any amino acid
  MOD_RES (254)..(262): Any amino acid
  MOD_RES (271)..(289): Any amino acid
  MOD_RES (305)..(306): Any amino acid
  MOD_RES (318)..(367): Any amino acid
  MOD_RES (376)..(380): Any amino acid
  MOD_RES (389)..(401): Any amino acid
  MOD_RES (410)..(445): Any amino acid
  MOD_RES (454)..(473): Any amino acid
  MOD_RES (482)..(486): Any amino acid

SEQ ID NO: 420258 - protein, 571 aa, Influenza virus; identical to SEQ ID NO: 418524
  MOD_RES (1)..(18): Any amino acid
  MOD_RES (32)..(32): Any amino acid
  MOD_RES (60)..(61): Any amino acid
  MOD_RES (76)..(76): Any amino acid
  MOD_RES (93)..(95): Any amino acid
  MOD_RES (105)..(107): Any amino acid
  MOD_RES (141)..(141): Any amino acid
  MOD_RES (172)..(173): Any amino acid
  MOD_RES (206)..(207): Any amino acid
  MOD_RES (222)..(223): Any amino acid
  MOD_RES (275)..(288): Any amino acid
  MOD_RES (303)..(306): Any amino acid
  MOD_RES (317)..(317): Any amino acid
  MOD_RES (342)..(343): Any amino acid

SEQ ID NO: 420259 - protein, 571 aa, Influenza virus; identical to SEQ ID NO: 418525
  MOD_RES (1)..(18): Any amino acid
  MOD_RES (32)..(32): Any amino acid
  MOD_RES (60)..(61): Any amino acid
  MOD_RES (76)..(76): Any amino acid
  MOD_RES (93)..(95): Any amino acid
  MOD_RES (105)..(109): Any amino acid
  MOD_RES (141)..(141): Any amino acid
  MOD_RES (172)..(173): Any amino acid
  MOD_RES (206)..(207): Any amino acid
  MOD_RES (222)..(223): Any amino acid
  MOD_RES (274)..(288): Any amino acid
  MOD_RES (303)..(306): Any amino acid
  MOD_RES (317)..(317): Any amino acid
  MOD_RES (332)..(333): Any amino acid
  MOD_RES (342)..(343): Any amino acid
  MOD_RES (352)..(365): Any amino acid
  MOD_RES (377)..(379): Any amino acid
  MOD_RES (441)..(446): Any amino acid
  MOD_RES (524)..(525): Any amino acid
  MOD_RES (549)..(549): Any amino acid

SEQ ID NO: 420260 - protein, 571 aa, Influenza virus; identical to SEQ ID NO: 418526
  MOD_RES (1)..(18): Any amino acid
  MOD_RES (32)..(32): Any amino acid
  MOD_RES (60)..(61): Any amino acid
  MOD_RES (76)..(76): Any amino acid
  MOD_RES (90)..(95): Any amino acid
  MOD_RES (105)..(109): Any amino acid
  MOD_RES (125)..(127): Any amino acid
  MOD_RES (141)..(141): Any amino acid
  MOD_RES (172)..(173): Any amino acid
  MOD_RES (193)..(195): Any amino acid
  MOD_RES (206)..(207): Any amino acid
  MOD_RES (222)..(223): Any amino acid
  MOD_RES (247)..(247): Any amino acid
  MOD_RES (262)..(265): Any amino acid
  MOD_RES (275)..(288): Any amino acid
  MOD_RES (303)..(306): Any amino acid
  MOD_RES (317)..(317): Any amino acid
  MOD_RES (335)..(384): Any amino acid
  MOD_RES (397)..(397): Any amino acid
  MOD_RES (413)..(413): Any amino acid
  MOD_RES (434)..(449): Any amino acid
  MOD_RES (469)..(479): Any amino acid
  MOD_RES (535)..(535): Any amino acid
  MOD_RES (548)..(549): Any amino acid
  MOD_RES (569)..(571): Any amino acid

SEQ ID NO: 420261 - protein, 571 aa, Influenza virus; identical to SEQ ID NO: 418527
  MOD_RES (1)..(24): Any amino acid
  MOD_RES (55)..(61): Any amino acid
  MOD_RES (76)..(76): Any amino acid
  MOD_RES (87)..(95): Any amino acid
  MOD_RES (104)..(110): Any amino acid
  MOD_RES (125)..(127): Any amino acid
  MOD_RES (139)..(141): Any amino acid
  MOD_RES (172)..(175): Any amino acid
  MOD_RES (189)..(207): Any amino acid
  MOD_RES (219)..(223): Any amino acid
  MOD_RES (249)..(252): Any amino acid
  MOD_RES (266)..(288): Any amino acid
  MOD_RES (303)..(307): Any amino acid
  MOD_RES (317)..(317): Any amino acid
  MOD_RES (330)..(385): Any amino acid
  MOD_RES (400)..(415): Any amino acid
  MOD_RES (433)..(450): Any amino acid
  MOD_RES (476)..(482): Any amino acid
  MOD_RES (531)..(541): Any amino acid
  MOD_RES (571)..(571): Any amino acid

SEQ ID NO: 420262 - protein, 571 aa, Influenza virus; identical to SEQ ID NO: 418528
  MOD_RES (1)..(25): Any amino acid
  MOD_RES (45)..(46): Any amino acid
  MOD_RES (56)..(61): Any amino acid
  MOD_RES (75)..(113): Any amino acid
  MOD_RES (126)..(129): Any amino acid
  MOD_RES (141)..(153): Any amino acid
  MOD_RES (162)..(163): Any amino acid
  MOD_RES (172)..(179): Any amino acid
  MOD_RES (195)..(209): Any amino acid
  MOD_RES (222)..(224): Any amino acid
  MOD_RES (234)..(236): Any amino acid
  MOD_RES (248)..(252): Any amino acid
  MOD_RES (263)..(288): Any amino acid
  MOD_RES (303)..(308): Any amino acid
  MOD_RES (317)..(317): Any amino acid
  MOD_RES (326)..(385): Any amino acid
  MOD_RES (399)..(421): Any amino acid
  MOD_RES (431)..(453): Any amino acid
  MOD_RES (463)..(487): Any amino acid
  MOD_RES (496)..(499): Any amino acid
  MOD_RES (513)..(515): Any amino acid
  MOD_RES (531)..(541): Any amino acid
  MOD_RES (570)..(571): Any amino acid

SEQ ID NO: 420263 - protein, 608 aa, Influenza virus; identical to SEQ ID NO: 418532
  MOD_RES (11)..(18): Any amino acid
  MOD_RES (57)..(66): Any amino acid
  MOD_RES (92)..(92): Any amino acid
  MOD_RES (104)..(120): Any amino acid
  MOD_RES (129)..(138): Any amino acid
  MOD_RES (147)..(163): Any amino acid
  MOD_RES (177)..(197): Any amino acid
  MOD_RES (207)..(222): Any amino acid
  MOD_RES (236)..(266): Any amino acid
  MOD_RES (283)..(302): Any amino acid
  MOD_RES (339)..(340): Any amino acid
  MOD_RES (350)..(352): Any amino acid
  MOD_RES (433)..(441): Any amino acid
  MOD_RES (516)..(516): Any amino acid
  MOD_RES (527)..(551): Any amino acid
  MOD_RES (579)..(580): Any amino acid

SEQ ID NO: 420264 - protein, 608 aa, Influenza virus; identical to SEQ ID NO: 418533
  MOD_RES (11)..(18): Any amino acid
  MOD_RES (27)..(27): Any amino acid
  MOD_RES (57)..(66): Any amino acid
  MOD_RES (92)..(92): Any amino acid
  MOD_RES (103)..(120): Any amino acid
  MOD_RES (129)..(163): Any amino acid
  MOD_RES (177)..(197): Any amino acid
  MOD_RES (207)..(222): Any amino acid
  MOD_RES (236)..(266): Any amino acid
  MOD_RES (283)..(304): Any amino acid
  MOD_RES (314)..(315): Any amino acid
  MOD_RES (339)..(340): Any amino acid
  MOD_RES (350)..(358): Any amino acid
  MOD_RES (375)..(379): Any amino acid
  MOD_RES (433)..(441): Any amino acid
  MOD_RES (504)..(504): Any amino acid
  MOD_RES (516)..(516): Any amino acid
  MOD_RES (527)..(551): Any amino acid
  MOD_RES (571)..(571): Any amino acid
  MOD_RES (594)..(597): Any amino acid
  MOD_RES (608)..(608): Any amino acid

SEQ ID NO: 420265 - protein, 608 aa, Influenza virus; identical to SEQ ID NO: 418534
  MOD_RES (1)..(18): Any amino acid
  MOD_RES (27)..(27): Any amino acid
  MOD_RES (54)..(66): Any amino acid
  MOD_RES (92)..(92): Any amino acid
  MOD_RES (101)..(120): Any amino acid
  MOD_RES (129)..(163): Any amino acid
  MOD_RES (176)..(197): Any amino acid
  MOD_RES (207)..(222): Any amino acid
  MOD_RES (236)..(266): Any amino acid
  MOD_RES (283)..(304): Any amino acid
  MOD_RES (314)..(315): Any amino acid
  MOD_RES (335)..(340): Any amino acid
  MOD_RES (350)..(358): Any amino acid
  MOD_RES (367)..(367): Any amino acid
  MOD_RES (382)..(385): Any amino acid
  MOD_RES (433)..(441): Any amino acid
  MOD_RES (464)..(477): Any amino acid
  MOD_RES (501)..(506): Any amino acid
  MOD_RES (516)..(516): Any amino acid
  MOD_RES (527)..(551): Any amino acid
  MOD_RES (571)..(571): Any amino acid
  MOD_RES (606)..(608): Any amino acid

SEQ ID NO: 420266 - protein, 608 aa, Influenza virus; identical to SEQ ID NO: 418535
  MOD_RES (1)..(18): Any amino acid
  MOD_RES (27)..(28): Any amino acid
  MOD_RES (44)..(44): Any amino acid
  MOD_RES (57)..(66): Any amino acid
  MOD_RES (77)..(83): Any amino acid
  MOD_RES (92)..(92): Any amino acid
  MOD_RES (101)..(120): Any amino acid
  MOD_RES (129)..(167): Any amino acid
  MOD_RES (177)..(197): Any amino acid
  MOD_RES (207)..(222): Any amino acid
  MOD_RES (236)..(269): Any amino acid
  MOD_RES (283)..(304): Any amino acid
  MOD_RES (314)..(315): Any amino acid
  MOD_RES (339)..(358): Any amino acid
  MOD_RES (367)..(389): Any amino acid
  MOD_RES (398)..(400): Any amino acid
  MOD_RES (433)..(441): Any amino acid
  MOD_RES (466)..(481): Any amino acid
  MOD_RES (516)..(516): Any amino acid
  MOD_RES (526)..(551): Any amino acid
  MOD_RES (571)..(571): Any amino acid
  MOD_RES (606)..(608): Any amino acid

SEQ ID NO: 420267 - protein, 608 aa, Influenza virus; identical to SEQ ID NO: 418536
  MOD_RES (1)..(18): Any amino acid
  MOD_RES (27)..(28): Any amino acid
  MOD_RES (43)..(48): Any amino acid
  MOD_RES (57)..(66): Any amino acid
  MOD_RES (82)..(92): Any amino acid
  MOD_RES (101)..(120): Any amino acid
  MOD_RES (129)..(167): Any amino acid
  MOD_RES (177)..(197): Any amino acid
  MOD_RES (207)..(222): Any amino acid
  MOD_RES (236)..(304): Any amino acid
  MOD_RES (314)..(315): Any amino acid
  MOD_RES (332)..(358): Any amino acid
  MOD_RES (367)..(404): Any amino acid
  MOD_RES (417)..(418): Any amino acid
  MOD_RES (433)..(447): Any amino acid
  MOD_RES (462)..(482): Any amino acid
  MOD_RES (498)..(517): Any amino acid
  MOD_RES (526)..(553): Any amino acid
  MOD_RES (562)..(562): Any amino acid
  MOD_RES (571)..(571): Any amino acid
  MOD_RES (584)..(586): Any amino acid
  MOD_RES (599)..(599): Any amino acid
  MOD_RES (608)..(608): Any amino acid

SEQ ID NO: 420268 - protein, 599 aa, Influenza virus; identical to SEQ ID NO: 418544
  MOD_RES (11)..(18): Any amino acid
  MOD_RES (92)..(92): Any amino acid
  MOD_RES (105)..(115): Any amino acid
  MOD_RES (131)..(135): Any amino acid
  MOD_RES (144)..(163): Any amino acid
  MOD_RES (173)..(191): Any amino acid
  MOD_RES (206)..(217): Any amino acid
  MOD_RES (232)..(239): Any amino acid
  MOD_RES (248)..(260): Any amino acid
  MOD_RES (285)..(295): Any amino acid
  MOD_RES (347)..(348): Any amino acid
  MOD_RES (507)..(507): Any amino acid
  MOD_RES (523)..(541): Any amino acid
  MOD_RES (570)..(571): Any amino acid

SEQ ID NO: 420269 - protein, 599 aa, Influenza virus; identical to SEQ ID NO: 418545
  MOD_RES (11)..(18): Any amino acid
  MOD_RES (27)..(27): Any amino acid
  MOD_RES (92)..(92): Any amino acid
  MOD_RES (105)..(115): Any amino acid
  MOD_RES (131)..(163): Any amino acid
  MOD_RES (173)..(191): Any amino acid
  MOD_RES (206)..(217): Any amino acid
  MOD_RES (232)..(239): Any amino acid
  MOD_RES (248)..(260): Any amino acid
  MOD_RES (285)..(295): Any amino acid
  MOD_RES (347)..(355): Any amino acid
  MOD_RES (443)..(468): Any amino acid
  MOD_RES (495)..(495): Any amino acid
  MOD_RES (507)..(507): Any amino acid
  MOD_RES (523)..(541): Any amino acid
  MOD_RES (569)..(571): Any amino acid
  MOD_RES (585)..(588): Any amino acid
  MOD_RES (599)..(599): Any amino acid

SEQ ID NO: 420270 - protein, 599 aa, Influenza virus; identical to SEQ ID NO: 418546
  MOD_RES (1)..(18): Any amino acid
  MOD_RES (27)..(27): Any amino acid
  MOD_RES (43)..(44): Any amino acid
  MOD_RES (77)..(92): Any amino acid
  MOD_RES (105)..(115): Any amino acid
  MOD_RES (131)..(163): Any amino acid
  MOD_RES (173)..(191): Any amino acid
  MOD_RES (206)..(217): Any amino acid
  MOD_RES (232)..(239): Any amino acid
  MOD_RES (248)..(260): Any amino acid
  MOD_RES (282)..(295): Any amino acid
  MOD_RES (313)..(319): Any amino acid
  MOD_RES (347)..(355): Any amino acid
  MOD_RES (372)..(376): Any amino acid
  MOD_RES (427)..(428): Any amino acid
  MOD_RES (447)..(472): Any amino acid
  MOD_RES (488)..(497): Any amino acid
  MOD_RES (507)..(507): Any amino acid
  MOD_RES (523)..(541): Any amino acid
  MOD_RES (562)..(562): Any amino acid
  MOD_RES (597)..(599): Any amino acid

SEQ ID NO: 420271 - protein, 599 aa, Influenza virus; identical to SEQ ID NO: 418547
  MOD_RES (1)..(18): Any amino acid
  MOD_RES (27)..(28): Any amino acid
  MOD_RES (40)..(48): Any amino acid
  MOD_RES (57)..(57): Any amino acid
  MOD_RES (77)..(96): Any amino acid
  MOD_RES (105)..(115): Any amino acid
  MOD_RES (131)..(164): Any amino acid
  MOD_RES (173)..(191): Any amino acid
  MOD_RES (205)..(217): Any amino acid
  MOD_RES (228)..(239): Any amino acid
  MOD_RES (248)..(260): Any amino acid
  MOD_RES (284)..(295): Any amino acid
  MOD_RES (313)..(327): Any amino acid
  MOD_RES (347)..(357): Any amino acid
  MOD_RES (371)..(381): Any amino acid
  MOD_RES (411)..(417): Any amino acid
  MOD_RES (450)..(473): Any amino acid
  MOD_RES (489)..(498): Any amino acid
  MOD_RES (507)..(507): Any amino acid
  MOD_RES (520)..(541): Any amino acid
  MOD_RES (599)..(599): Any amino acid

SEQ ID NO: 420272 - protein, 599 aa, Influenza virus; identical to SEQ ID NO: 418548
  MOD_RES (1)..(21): Any amino acid
  MOD_RES (44)..(51): Any amino acid
  MOD_RES (60)..(64): Any amino acid
  MOD_RES (76)..(96): Any amino acid
  MOD_RES (105)..(121): Any amino acid
  MOD_RES (131)..(191): Any amino acid
  MOD_RES (206)..(239): Any amino acid
  MOD_RES (248)..(271): Any amino acid
  MOD_RES (281)..(298): Any amino acid
  MOD_RES (313)..(338): Any amino acid
  MOD_RES (347)..(357): Any amino acid
  MOD_RES (366)..(381): Any amino acid
  MOD_RES (393)..(397): Any amino acid
  MOD_RES (407)..(420): Any amino acid
  MOD_RES (437)..(508): Any amino acid
  MOD_RES (523)..(550): Any amino acid
  MOD_RES (562)..(562): Any amino acid
  MOD_RES (575)..(577): Any amino acid
  MOD_RES (590)..(599): Any amino acid

SEQ ID NO: 420273 - protein, 500 aa, Influenza virus; identical to SEQ ID NO: 418558
  MOD_RES (29)..(41): Any amino acid
  MOD_RES (53)..(72): Any amino acid
  MOD_RES (87)..(105): Any amino acid
  MOD_RES (114)..(114): Any amino acid
  MOD_RES (240)..(240): Any amino acid
  MOD_RES (267)..(268): Any amino acid
  MOD_RES (277)..(279): Any amino acid
  MOD_RES (288)..(292): Any amino acid
  MOD_RES (310)..(310): Any amino acid
  MOD_RES (331)..(333): Any amino acid
  MOD_RES (360)..(363): Any amino acid
  MOD_RES (403)..(417): Any amino acid
  MOD_RES (456)..(456): Any amino acid

SEQ ID NO: 420274 - protein, 500 aa, Influenza virus; identical to SEQ ID NO: 418559
  MOD_RES (1)..(1): Any amino acid
  MOD_RES (29)..(51): Any amino acid
  MOD_RES (60)..(72): Any amino acid
  MOD_RES (86)..(105): Any amino acid
  MOD_RES (114)..(114): Any amino acid
  MOD_RES (198)..(199): Any amino acid
  MOD_RES (240)..(240): Any amino acid
  MOD_RES (267)..(268): Any amino acid
  MOD_RES (277)..(279): Any amino acid
  MOD_RES (288)..(292): Any amino acid
  MOD_RES (310)..(310): Any amino acid
  MOD_RES (331)..(333): Any amino acid
  MOD_RES (360)..(363): Any amino acid
  MOD_RES (403)..(417): Any amino acid
  MOD_RES (456)..(456): Any amino acid
  MOD_RES (473)..(481): Any amino acid
  MOD_RES (496)..(500): Any amino acid

SEQ ID NO: 420275 - protein, 500 aa, Influenza virus; identical to SEQ ID NO: 418560
  MOD_RES (1)..(1): Any amino acid
  MOD_RES (13)..(72): Any amino acid
  MOD_RES (87)..(105): Any amino acid
  MOD_RES (114)..(114): Any amino acid
  MOD_RES (192)..(199): Any amino acid
  MOD_RES (240)..(240): Any amino acid
  MOD_RES (267)..(268): Any amino acid
  MOD_RES (277)..(292): Any amino acid
  MOD_RES (310)..(310): Any amino acid
  MOD_RES (331)..(333): Any amino acid
  MOD_RES (360)..(363): Any amino acid
  MOD_RES (403)..(417): Any amino acid
  MOD_RES (426)..(426): Any amino acid
  MOD_RES (456)..(456): Any amino acid
  MOD_RES (473)..(481): Any amino acid
  MOD_RES (499)..(500): Any amino acid

SEQ ID NO: 420276 - protein, 500 aa, Influenza virus; identical to SEQ ID NO: 418561
  MOD_RES (1)..(5): Any amino acid
  MOD_RES (18)..(72): Any amino acid
  MOD_RES (87)..(105): Any amino acid
  MOD_RES (114)..(114): Any amino acid
  MOD_RES (153)..(160): Any amino acid
  MOD_RES (190)..(200): Any amino acid
  MOD_RES (240)..(240): Any amino acid
  MOD_RES (249)..(254): Any amino acid
  MOD_RES (264)..(271): Any amino acid
  MOD_RES (281)..(300): Any amino acid
  MOD_RES (310)..(321): Any amino acid
  MOD_RES (331)..(333): Any amino acid
  MOD_RES (360)..(363): Any amino acid
  MOD_RES (396)..(417): Any amino acid
  MOD_RES (427)..(430): Any amino acid
  MOD_RES (456)..(456): Any amino acid
  MOD_RES (473)..(481): Any amino acid

SEQ ID NO: 420277 - protein, 500 aa, Influenza virus; identical to SEQ ID NO: 418562
  MOD_RES (1)..(72): Any amino acid
  MOD_RES (87)..(118): Any amino acid
  MOD_RES (127)..(127): Any amino acid
  MOD_RES (149)..(161): Any amino acid
  MOD_RES (177)..(180): Any amino acid
  MOD_RES (193)..(200): Any amino acid
  MOD_RES (213)..(225): Any amino acid
  MOD_RES (238)..(240): Any amino acid
  MOD_RES (249)..(301): Any amino acid
  MOD_RES (310)..(322): Any amino acid
  MOD_RES (331)..(334): Any amino acid
  MOD_RES (360)..(364): Any amino acid
  MOD_RES (379)..(387): Any amino acid
  MOD_RES (397)..(417): Any amino acid
  MOD_RES (426)..(434): Any amino acid
  MOD_RES (446)..(456): Any amino acid
  MOD_RES (473)..(481): Any amino acid
  MOD_RES (499)..(500): Any amino acid

SEQ ID NO: 420278 - protein, 573 aa, Influenza virus; identical to SEQ ID NO: 418565
  MOD_RES (1)..(15): Any amino acid
  MOD_RES (48)..(52): Any amino acid
  MOD_RES (61)..(69): Any amino acid
  MOD_RES (84)..(88): Any amino acid
  MOD_RES (102)..(143): Any amino acid
  MOD_RES (171)..(215): Any amino acid
  MOD_RES (227)..(229): Any amino acid
  MOD_RES (244)..(257): Any amino acid
  MOD_RES (276)..(287): Any amino acid
  MOD_RES (302)..(305): Any amino acid
  MOD_RES (316)..(339): Any amino acid
  MOD_RES (402)..(403): Any amino acid
  MOD_RES (412)..(440): Any amino acid
  MOD_RES (511)..(534): Any amino acid

SEQ ID NO: 420279 - protein, 573 aa, Influenza virus; identical to SEQ ID NO: 418566
  MOD_RES (1)..(15): Any amino acid
  MOD_RES (45)..(52): Any amino acid
  MOD_RES (61)..(69): Any amino acid
  MOD_RES (84)..(88): Any amino acid
  MOD_RES (102)..(143): Any amino acid
  MOD_RES (169)..(215): Any amino acid
  MOD_RES (227)..(229): Any amino acid
  MOD_RES (244)..(257): Any amino acid
  MOD_RES (276)..(287): Any amino acid
  MOD_RES (302)..(305): Any amino acid
  MOD_RES (316)..(344): Any amino acid
  MOD_RES (358)..(360): Any amino acid
  MOD_RES (402)..(403): Any amino acid
  MOD_RES (412)..(440): Any amino acid
  MOD_RES (511)..(534): Any amino acid
  MOD_RES (562)..(563): Any amino acid

SEQ ID NO: 420280 - protein, 573 aa, Influenza virus; identical to SEQ ID NO: 418567
  MOD_RES (1)..(15): Any amino acid
  MOD_RES (47)..(52): Any amino acid
  MOD_RES (61)..(69): Any amino acid
  MOD_RES (84)..(88): Any amino acid
  MOD_RES (102)..(143): Any amino acid
  MOD_RES (152)..(157): Any amino acid
  MOD_RES (171)..(215): Any amino acid
  MOD_RES (227)..(229): Any amino acid
  MOD_RES (244)..(264): Any amino acid
  MOD_RES (276)..(287): Any amino acid
  MOD_RES (302)..(305): Any amino acid
  MOD_RES (316)..(344): Any amino acid
  MOD_RES (354)..(361): Any amino acid
  MOD_RES (402)..(403): Any amino acid
  MOD_RES (412)..(440): Any amino acid
  MOD_RES (497)..(497): Any amino acid
  MOD_RES (511)..(534): Any amino acid
  MOD_RES (562)..(563): Any amino acid

SEQ ID NO: 420281 - protein, 573 aa, Influenza virus; identical to SEQ ID NO: 418568
  MOD_RES (1)..(15): Any amino acid
  MOD_RES (47)..(52): Any amino acid
  MOD_RES (61)..(69): Any amino acid
  MOD_RES (78)..(92): Any amino acid
  MOD_RES (102)..(143): Any amino acid
  MOD_RES (153)..(157): Any amino acid
  MOD_RES (168)..(215): Any amino acid
  MOD_RES (224)..(229): Any amino acid
  MOD_RES (244)..(266): Any amino acid
  MOD_RES (276)..(287): Any amino acid
  MOD_RES (302)..(305): Any amino acid
  MOD_RES (314)..(348): Any amino acid
  MOD_RES (358)..(371): Any amino acid
  MOD_RES (402)..(403): Any amino acid
  MOD_RES (412)..(440): Any amino acid
  MOD_RES (449)..(459): Any amino acid
  MOD_RES (511)..(534): Any amino acid
  MOD_RES (567)..(573): Any amino acid

SEQ ID NO: 420282 - protein, 573 aa, Influenza virus; identical to SEQ ID NO: 418569
  MOD_RES (1)..(15): Any amino acid
  MOD_RES (48)..(52): Any amino acid
  MOD_RES (61)..(69): Any amino acid
  MOD_RES (84)..(92): Any amino acid
  MOD_RES (102)..(143): Any amino acid
  MOD_RES (152)..(160): Any amino acid
  MOD_RES (171)..(215): Any amino acid
  MOD_RES (227)..(229): Any amino acid
  MOD_RES (240)..(266): Any amino acid
  MOD_RES (276)..(293): Any amino acid
  MOD_RES (302)..(305): Any amino acid
  MOD_RES (316)..(348): Any amino acid
  MOD_RES (357)..(380): Any amino acid
  MOD_RES (398)..(403): Any amino acid
  MOD_RES (412)..(440): Any amino acid
  MOD_RES (455)..(467): Any amino acid
  MOD_RES (508)..(534): Any amino acid
  MOD_RES (566)..(573): Any amino acid

SEQ ID NO: 420283 - protein, 471 aa, Influenza virus; identical to SEQ ID NO: 418575
  MOD_RES (1)..(4): Any amino acid
  MOD_RES (16)..(83): Any amino acid
  MOD_RES (126)..(127): Any amino acid
  MOD_RES (208)..(216): Any amino acid
  MOD_RES (235)..(236): Any amino acid
  MOD_RES (251)..(265): Any amino acid
  MOD_RES (312)..(315): Any amino acid
  MOD_RES (334)..(334): Any amino acid
  MOD_RES (359)..(359): Any amino acid
  MOD_RES (383)..(402): Any amino acid
  MOD_RES (416)..(417): Any amino acid
  MOD_RES (436)..(436): Any amino acid
  MOD_RES (471)..(471): Any amino acid

SEQ ID NO: 420284 - protein, 471 aa, Influenza virus; identical to SEQ ID NO: 418576
  MOD_RES (1)..(4): Any amino acid
  MOD_RES (16)..(83): Any amino acid
  MOD_RES (126)..(127): Any amino acid
  MOD_RES (208)..(216): Any amino acid
  MOD_RES (233)..(236): Any amino acid
  MOD_RES (250)..(265): Any amino acid
  MOD_RES (304)..(315): Any amino acid
  MOD_RES (334)..(334): Any amino acid
  MOD_RES (359)..(359): Any amino acid
  MOD_RES (383)..(402): Any amino acid
  MOD_RES (416)..(417): Any amino acid
  MOD_RES (434)..(436): Any amino acid
  MOD_RES (450)..(457): Any amino acid
  MOD_RES (471)..(471): Any amino acid

SEQ ID NO: 420285 - protein, 471 aa, Influenza virus; identical to SEQ ID NO: 418577
  MOD_RES (1)..(4): Any amino acid
  MOD_RES (16)..(83): Any amino acid
  MOD_RES (101)..(106): Any amino acid
  MOD_RES (116)..(117): Any amino acid
  MOD_RES (126)..(134): Any amino acid
  MOD_RES (208)..(216): Any amino acid
  MOD_RES (225)..(225): Any amino acid
  MOD_RES (235)..(236): Any amino acid
  MOD_RES (251)..(265): Any amino acid
  MOD_RES (284)..(287): Any amino acid
  MOD_RES (304)..(315): Any amino acid
  MOD_RES (325)..(325): Any amino acid
  MOD_RES (334)..(334): Any amino acid
  MOD_RES (359)..(359): Any amino acid
  MOD_RES (382)..(402): Any amino acid
  MOD_RES (416)..(417): Any amino acid
  MOD_RES (436)..(438): Any amino acid
  MOD_RES (455)..(460): Any amino acid
  MOD_RES (471)..(471): Any amino acid

SEQ ID NO: 420286 - protein, 471 aa, Influenza virus; identical to SEQ ID NO: 418578
  MOD_RES (1)..(4): Any amino acid
  MOD_RES (16)..(83): Any amino acid
  MOD_RES (101)..(106): Any amino acid
  MOD_RES (116)..(134): Any amino acid
  MOD_RES (151)..(153): Any amino acid
  MOD_RES (162)..(168): Any amino acid
  MOD_RES (208)..(216): Any amino acid
  MOD_RES (225)..(226): Any amino acid
  MOD_RES (235)..(237): Any amino acid
  MOD_RES (251)..(265): Any amino acid
  MOD_RES (284)..(287): Any amino acid
  MOD_RES (299)..(315): Any amino acid
  MOD_RES (325)..(325): Any amino acid
  MOD_RES (334)..(334): Any amino acid
  MOD_RES (344)..(346): Any amino acid
  MOD_RES (359)..(359): Any amino acid
  MOD_RES (383)..(402): Any amino acid
  MOD_RES (411)..(417): Any amino acid
  MOD_RES (426)..(439): Any amino acid
  MOD_RES (454)..(462): Any amino acid
  MOD_RES (471)..(471): Any amino acid

SEQ ID NO: 420287 - protein, 471 aa, Influenza virus; identical to SEQ ID NO: 418579
  MOD_RES (1)..(4): Any amino acid
  MOD_RES (16)..(83): Any amino acid
  MOD_RES (103)..(106): Any amino acid
  MOD_RES (116)..(141): Any amino acid
  MOD_RES (150)..(153): Any amino acid
  MOD_RES (162)..(178): Any amino acid
  MOD_RES (193)..(194): Any amino acid
  MOD_RES (205)..(226): Any amino acid
  MOD_RES (235)..(241): Any amino acid
  MOD_RES (250)..(265): Any amino acid
  MOD_RES (274)..(287): Any amino acid
  MOD_RES (304)..(334): Any amino acid
  MOD_RES (359)..(359): Any amino acid
  MOD_RES (383)..(402): Any amino acid
  MOD_RES (411)..(417): Any amino acid
  MOD_RES (426)..(462): Any amino acid
  MOD_RES (471)..(471): Any amino acid

SEQ ID NO: 420288 - protein, 570 aa, Influenza virus; identical to SEQ ID NO: 418583
  MOD_RES (1)..(13): Any amino acid
  MOD_RES (52)..(73): Any amino acid
  MOD_RES (85)..(89): Any amino acid
  MOD_RES (100)..(100): Any amino acid
  MOD_RES (112)..(126): Any amino acid
  MOD_RES (136)..(157): Any amino acid
  MOD_RES (168)..(188): Any amino acid
  MOD_RES (200)..(213): Any amino acid
  MOD_RES (223)..(238): Any amino acid
  MOD_RES (274)..(277): Any amino acid
  MOD_RES (286)..(305): Any amino acid
  MOD_RES (329)..(329): Any amino acid
  MOD_RES (343)..(344): Any amino acid
  MOD_RES (393)..(393): Any amino acid
  MOD_RES (413)..(413): Any amino acid
  MOD_RES (424)..(424): Any amino acid
  MOD_RES (465)..(467): Any amino acid
  MOD_RES (495)..(496): Any amino acid
  MOD_RES (510)..(526): Any amino acid
  MOD_RES (550)..(554): Any amino acid

SEQ ID NO: 420289 - protein, 570 aa, Influenza virus; identical to SEQ ID NO: 418584
  MOD_RES (1)..(13): Any amino acid
  MOD_RES (23)..(23): Any amino acid
  MOD_RES (52)..(73): Any amino acid
  MOD_RES (85)..(89): Any amino acid
  MOD_RES (100)..(100): Any amino acid
  MOD_RES (112)..(126): Any amino acid
  MOD_RES (136)..(157): Any amino acid
  MOD_RES (166)..(188): Any amino acid
  MOD_RES (198)..(213): Any amino acid
  MOD_RES (223)..(238): Any amino acid
  MOD_RES (274)..(305): Any amino acid
  MOD_RES (329)..(329): Any amino acid
  MOD_RES (343)..(344): Any amino acid
  MOD_RES (371)..(376): Any amino acid
  MOD_RES (393)..(393): Any amino acid
  MOD_RES (413)..(413): Any amino acid
  MOD_RES (424)..(424): Any amino acid
  MOD_RES (465)..(467): Any amino acid
  MOD_RES (495)..(496): Any amino acid
  MOD_RES (510)..(526): Any amino acid
  MOD_RES (550)..(554): Any amino acid
  MOD_RES (568)..(570): Any amino acid

SEQ ID NO: 420290 - protein, 570 aa, Influenza virus; identical to SEQ ID NO: 418585
  MOD_RES (1)..(13): Any amino acid
  MOD_RES (52)..(73): Any amino acid
  MOD_RES (85)..(89): Any amino acid
  MOD_RES (100)..(100): Any amino acid
  MOD_RES (112)..(126): Any amino acid
  MOD_RES (135)..(157): Any amino acid
  MOD_RES (168)..(188): Any amino acid
  MOD_RES (200)..(213): Any amino acid
  MOD_RES (223)..(238): Any amino acid
  MOD_RES (274)..(305): Any amino acid
  MOD_RES (329)..(329): Any amino acid
  MOD_RES (343)..(344): Any amino acid
  MOD_RES (353)..(356): Any amino acid
  MOD_RES (372)..(381): Any amino acid
  MOD_RES (393)..(393): Any amino acid
  MOD_RES (411)..(413): Any amino acid
  MOD_RES (424)..(424): Any amino acid
  MOD_RES (442)..(443): Any amino acid
  MOD_RES (465)..(467): Any amino acid
  MOD_RES (481)..(484): Any amino acid
  MOD_RES (495)..(496): Any amino acid
  MOD_RES (508)..(526): Any amino acid
  MOD_RES (536)..(538): Any amino acid
  MOD_RES (547)..(554): Any amino acid
  MOD_RES (569)..(570): Any amino acid

SEQ ID NO: 420291 - protein, 570 aa, Influenza virus; identical to SEQ ID NO: 418586
  MOD_RES (1)..(13): Any amino acid
  MOD_RES (22)..(25): Any amino acid
  MOD_RES (41)..(43): Any amino acid
  MOD_RES (52)..(76): Any amino acid
  MOD_RES (85)..(89): Any amino acid
  MOD_RES (99)..(100): Any amino acid
  MOD_RES (112)..(126): Any amino acid
  MOD_RES (136)..(159): Any amino acid
  MOD_RES (168)..(188): Any amino acid
  MOD_RES (197)..(214): Any amino acid
  MOD_RES (223)..(238): Any amino acid
  MOD_RES (260)..(265): Any amino acid
  MOD_RES (274)..(305): Any amino acid
  MOD_RES (315)..(317): Any amino acid
  MOD_RES (329)..(344): Any amino acid
  MOD_RES (353)..(381): Any amino acid
  MOD_RES (393)..(393): Any amino acid
  MOD_RES (413)..(424): Any amino acid
  MOD_RES (443)..(444): Any amino acid
  MOD_RES (463)..(467): Any amino acid
  MOD_RES (479)..(485): Any amino acid
  MOD_RES (495)..(496): Any amino acid
  MOD_RES (505)..(526): Any amino acid
  MOD_RES (535)..(538): Any amino acid
  MOD_RES (547)..(555): Any amino acid
  MOD_RES (569)..(570): Any amino acid

SEQ ID NO: 420292 - protein, 570 aa, Influenza virus; identical to SEQ ID NO: 418587
  MOD_RES (1)..(13): Any amino acid
  MOD_RES (22)..(27): Any amino acid
  MOD_RES (43)..(43): Any amino acid
  MOD_RES (52)..(89): Any amino acid
  MOD_RES (99)..(100): Any amino acid
  MOD_RES (112)..(127): Any amino acid
  MOD_RES (136)..(188): Any amino acid
  MOD_RES (197)..(214): Any amino acid
  MOD_RES (223)..(238): Any amino acid
  MOD_RES (258)..(265): Any amino acid
  MOD_RES (274)..(309): Any amino acid
  MOD_RES (321)..(384): Any amino acid
  MOD_RES (393)..(399): Any amino acid
  MOD_RES (412)..(424): Any amino acid
  MOD_RES (440)..(448): Any amino acid
  MOD_RES (465)..(469): Any amino acid
  MOD_RES (481)..(496): Any amino acid
  MOD_RES (507)..(526): Any amino acid
  MOD_RES (537)..(541): Any amino acid
  MOD_RES (550)..(557): Any amino acid
  MOD_RES (566)..(570): Any amino acid

SEQ ID NO: 420293 - protein, 619 aa, Influenza virus; identical to SEQ ID NO: 418590
  MOD_RES (14)..(23): Any amino acid
  MOD_RES (42)..(42): Any amino acid
  MOD_RES (67)..(93): Any amino acid
  MOD_RES (105)..(118): Any amino acid
  MOD_RES (127)..(169): Any amino acid
  MOD_RES (178)..(204): Any amino acid
  MOD_RES (214)..(251): Any amino acid
  MOD_RES (265)..(272): Any amino acid
  MOD_RES (289)..(320): Any amino acid
  MOD_RES (329)..(330): Any amino acid
  MOD_RES (341)..(341): Any amino acid
  MOD_RES (355)..(356): Any amino acid
  MOD_RES (374)..(375): Any amino acid
  MOD_RES (459)..(463): Any amino acid
  MOD_RES (480)..(480): Any amino acid
  MOD_RES (539)..(539): Any amino acid
  MOD_RES (552)..(553): Any amino acid
  MOD_RES (563)..(567): Any amino acid
  MOD_RES (593)..(598): Any amino acid
  MOD_RES (614)..(619): Any amino acid

SEQ ID NO: 420294 - protein, 619 aa, Influenza virus; identical to SEQ ID NO: 418591
  MOD_RES (14)..(30): Any amino acid
  MOD_RES (39)..(42): Any amino acid
  MOD_RES (67)..(93): Any amino acid
  MOD_RES (105)..(118): Any amino acid
  MOD_RES (127)..(169): Any amino acid
  MOD_RES (178)..(204): Any amino acid
  MOD_RES (214)..(251): Any amino acid
  MOD_RES (265)..(272): Any amino acid
  MOD_RES (289)..(320): Any amino acid
  MOD_RES (329)..(330): Any amino acid
  MOD_RES (341)..(341): Any amino acid
  MOD_RES (355)..(356): Any amino acid
  MOD_RES (365)..(375): Any amino acid
  MOD_RES (393)..(402): Any amino acid
  MOD_RES (429)..(429): Any amino acid
  MOD_RES (459)..(463): Any amino acid
  MOD_RES (480)..(480): Any amino acid
  MOD_RES (539)..(539): Any amino acid
  MOD_RES (552)..(553): Any amino acid
  MOD_RES (563)..(567): Any amino acid
  MOD_RES (580)..(581): Any amino acid
  MOD_RES (593)..(598): Any amino acid
  MOD_RES (614)..(619): Any amino acid

SEQ ID NO: 420295 - protein, 619 aa, Influenza virus; identical to SEQ ID NO: 418592
  MOD_RES (1)..(2): Any amino acid
  MOD_RES (14)..(42): Any amino acid
  MOD_RES (67)..(93): Any amino acid
  MOD_RES (105)..(118): Any amino acid
  MOD_RES (127)..(169): Any amino acid
  MOD_RES (178)..(204): Any amino acid
  MOD_RES (214)..(251): Any amino acid
  MOD_RES (265)..(272): Any amino acid
  MOD_RES (289)..(320): Any amino acid
  MOD_RES (329)..(330): Any amino acid
  MOD_RES (341)..(342): Any amino acid
  MOD_RES (352)..(356): Any amino acid
  MOD_RES (365)..(375): Any amino acid
  MOD_RES (385)..(403): Any amino acid
  MOD_RES (459)..(463): Any amino acid
  MOD_RES (480)..(480): Any amino acid
  MOD_RES (500)..(503): Any amino acid
  MOD_RES (524)..(530): Any amino acid
  MOD_RES (539)..(539): Any amino acid
  MOD_RES (552)..(553): Any amino acid
  MOD_RES (563)..(567): Any amino acid
  MOD_RES (593)..(598): Any amino acid

SEQ ID NO: 420296 - protein, 619 aa, Influenza virus; identical to SEQ ID NO: 418593
  MOD_RES (1)..(3): Any amino acid
  MOD_RES (14)..(42): Any amino acid
  MOD_RES (67)..(93): Any amino acid
  MOD_RES (105)..(118): Any amino acid
  MOD_RES (127)..(169): Any amino acid
  MOD_RES (178)..(204): Any amino acid
  MOD_RES (214)..(251): Any amino acid
  MOD_RES (264)..(272): Any amino acid
  MOD_RES (289)..(320): Any amino acid
  MOD_RES (329)..(330): Any amino acid
  MOD_RES (341)..(344): Any amino acid
  MOD_RES (355)..(375): Any amino acid
  MOD_RES (392)..(408): Any amino acid
  MOD_RES (424)..(432): Any amino acid
  MOD_RES (459)..(463): Any amino acid
  MOD_RES (472)..(480): Any amino acid
  MOD_RES (502)..(503): Any amino acid
  MOD_RES (523)..(553): Any amino acid
  MOD_RES (563)..(567): Any amino acid
  MOD_RES (593)..(598): Any amino acid
  MOD_RES (611)..(619): Any amino acid

SEQ ID NO: 420297 - protein, 619 aa, Influenza virus; identical to SEQ ID NO: 418594
  MOD_RES (1)..(3): Any amino acid
  MOD_RES (14)..(48): Any amino acid
  MOD_RES (63)..(118): Any amino acid
  MOD_RES (127)..(169): Any amino acid
  MOD_RES (178)..(204): Any amino acid
  MOD_RES (214)..(252): Any amino acid
  MOD_RES (265)..(272): Any amino acid
  MOD_RES (289)..(320): Any amino acid
  MOD_RES (329)..(330): Any amino acid
  MOD_RES (339)..(377): Any amino acid
  MOD_RES (386)..(409): Any amino acid
  MOD_RES (425)..(447): Any amino acid
  MOD_RES (458)..(463): Any amino acid
  MOD_RES (475)..(480): Any amino acid
  MOD_RES (497)..(497): Any amino acid
  MOD_RES (525)..(553): Any amino acid
  MOD_RES (563)..(568): Any amino acid
  MOD_RES (579)..(583): Any amino acid
  MOD_RES (593)..(600): Any amino acid
  MOD_RES (609)..(619): Any amino acid

SEQ ID NO: 420298 - protein, 573 aa, Influenza virus; identical to SEQ ID NO: 418598
  MOD_RES (15)..(21): Any amino acid
  MOD_RES (62)..(74): Any amino acid
  MOD_RES (137)..(138): Any amino acid
  MOD_RES (153)..(155): Any amino acid
  MOD_RES (175)..(191): Any amino acid
  MOD_RES (202)..(204): Any amino acid
  MOD_RES (219)..(221): Any amino acid
  MOD_RES (230)..(232): Any amino acid
  MOD_RES (254)..(255): Any amino acid
  MOD_RES (280)..(296): Any amino acid
  MOD_RES (568)..(573): Any amino acid

SEQ ID NO: 420299 - protein, 573 aa, Influenza virus; identical to SEQ ID NO: 418599
  MOD_RES (1)..(21): Any amino acid
  MOD_RES (62)..(74): Any amino acid
  MOD_RES (137)..(138): Any amino acid
  MOD_RES (153)..(155): Any amino acid
  MOD_RES (175)..(191): Any amino acid
  MOD_RES (202)..(204): Any amino acid
  MOD_RES (219)..(221): Any amino acid
  MOD_RES (230)..(232): Any amino acid
  MOD_RES (254)..(255): Any amino acid
  MOD_RES (280)..(296): Any amino acid
  MOD_RES (353)..(356): Any amino acid
  MOD_RES (383)..(395): Any amino acid
  MOD_RES (477)..(484): Any amino acid
  MOD_RES (568)..(573): Any amino acid

SEQ ID NO: 420300 - protein, 573 aa, Influenza virus; identical to SEQ ID NO: 418600
  MOD_RES (1)..(21): Any amino acid
  MOD_RES (33)..(34): Any amino acid
  MOD_RES (62)..(76): Any amino acid
  MOD_RES (137)..(138): Any amino acid
  MOD_RES (153)..(155): Any amino acid
  MOD_RES (175)..(191): Any amino acid
  MOD_RES (202)..(204): Any amino acid
  MOD_RES (219)..(221): Any amino acid
  MOD_RES (230)..(232): Any amino acid
  MOD_RES (254)..(255): Any amino acid
  MOD_RES (280)..(296): Any amino acid
  MOD_RES (353)..(357): Any amino acid
  MOD_RES (372)..(395): Any amino acid
  MOD_RES (441)..(445): Any amino acid
  MOD_RES (478)..(485): Any amino acid
  MOD_RES (529)..(539): Any amino acid
  MOD_RES (562)..(562): Any amino acid

SEQ ID NO: 420301 - protein, 573 aa, Influenza virus; identical to SEQ ID NO: 418601
  MOD_RES (1)..(21): Any amino acid
  MOD_RES (31)..(53): Any amino acid
  MOD_RES (62)..(77): Any amino acid
  MOD_RES (99)..(101): Any amino acid
  MOD_RES (137)..(138): Any amino acid
  MOD_RES (152)..(155): Any amino acid
  MOD_RES (175)..(191): Any amino acid
  MOD_RES (202)..(204): Any amino acid
  MOD_RES (219)..(221): Any amino acid
  MOD_RES (230)..(232): Any amino acid
  MOD_RES (244)..(244): Any amino acid
  MOD_RES (254)..(255): Any amino acid
  MOD_RES (264)..(269): Any amino acid
  MOD_RES (280)..(296): Any amino acid
  MOD_RES (333)..(334): Any amino acid
  MOD_RES (353)..(395): Any amino acid
  MOD_RES (425)..(426): Any amino acid
  MOD_RES (442)..(454): Any amino acid
  MOD_RES (470)..(485): Any amino acid
  MOD_RES (515)..(518): Any amino acid
  MOD_RES (534)..(540): Any amino acid
  MOD_RES (562)..(573): Any amino acid

SEQ ID NO: 420302 - protein, 573 aa, Influenza virus; identical to SEQ ID NO: 418602
  MOD_RES (1)..(21): Any amino acid
  MOD_RES (32)..(77): Any amino acid
  MOD_RES (99)..(101): Any amino acid
  MOD_RES (137)..(142): Any amino acid
  MOD_RES (153)..(193): Any amino acid
  MOD_RES (202)..(210): Any amino acid
  MOD_RES (219)..(221): Any amino acid
  MOD_RES (230)..(236): Any amino acid
  MOD_RES (254)..(256): Any amino acid
  MOD_RES (266)..(271): Any amino acid
  MOD_RES (280)..(296): Any amino acid
  MOD_RES (313)..(315): Any amino acid
  MOD_RES (339)..(399): Any amino acid
  MOD_RES (418)..(429): Any amino acid
  MOD_RES (439)..(454): Any amino acid
  MOD_RES (477)..(499): Any amino acid
  MOD_RES (518)..(540): Any amino acid
  MOD_RES (557)..(573): Any amino acid

SEQ ID NO: 420303 - protein, 469 aa, Influenza virus; identical to SEQ ID NO: 418606
  MOD_RES (30)..(58): Any amino acid
  MOD_RES (72)..(83): Any amino acid
  MOD_RES (210)..(210): Any amino acid
  MOD_RES (308)..(308): Any amino acid
  MOD_RES (393)..(393): Any amino acid
  MOD_RES (469)..(469): Any amino acid

SEQ ID NO: 420304 - protein, 469 aa, Influenza virus; identical to SEQ ID NO: 418607
  MOD_RES (1)..(5): Any amino acid
  MOD_RES (30)..(58): Any amino acid
  MOD_RES (72)..(83): Any amino acid
  MOD_RES (162)..(164): Any amino acid
  MOD_RES (180)..(184): Any amino acid
  MOD_RES (209)..(210): Any amino acid
  MOD_RES (224)..(228): Any amino acid
  MOD_RES (271)..(275): Any amino acid
  MOD_RES (291)..(294): Any amino acid
  MOD_RES (308)..(308): Any amino acid
  MOD_RES (393)..(393): Any amino acid
  MOD_RES (410)..(414): Any amino acid
  MOD_RES (452)..(457): Any amino acid
  MOD_RES (469)..(469): Any amino acid

SEQ ID NO: 420305 - protein, 469 aa, Influenza virus; identical to SEQ ID NO: 418608
  MOD_RES (1)..(8): Any amino acid
  MOD_RES (30)..(58): Any amino acid
  MOD_RES (72)..(83): Any amino acid
  MOD_RES (161)..(169): Any amino acid
  MOD_RES (184)..(186): Any amino acid
  MOD_RES (210)..(210): Any amino acid
  MOD_RES (220)..(230): Any amino acid
  MOD_RES (271)..(278): Any amino acid
  MOD_RES (294)..(295): Any amino acid
  MOD_RES (306)..(308): Any amino acid
  MOD_RES (321)..(323): Any amino acid
  MOD_RES (393)..(393): Any amino acid
  MOD_RES (424)..(424): Any amino acid
  MOD_RES (453)..(457): Any amino acid
  MOD_RES (469)..(469): Any amino acid

SEQ ID NO: 420306 - protein, 469 aa, Influenza virus; identical to SEQ ID NO: 418609
  MOD_RES (1)..(10): Any amino acid
  MOD_RES (30)..(58): Any amino acid
  MOD_RES (72)..(83): Any amino acid
  MOD_RES (100)..(104): Any amino acid
  MOD_RES (161)..(191): Any amino acid
  MOD_RES (210)..(230): Any amino acid
  MOD_RES (271)..(297): Any amino acid
  MOD_RES (308)..(308): Any amino acid
  MOD_RES (321)..(326): Any amino acid
  MOD_RES (364)..(373): Any amino acid
  MOD_RES (393)..(394): Any amino acid
  MOD_RES (407)..(407): Any amino acid
  MOD_RES (416)..(426): Any amino acid
  MOD_RES (442)..(458): Any amino acid
  MOD_RES (469)..(469): Any amino acid

SEQ ID NO: 420307 - protein, 469 aa, Influenza virus; identical to SEQ ID NO: 418610
  MOD_RES (1)..(11): Any amino acid
  MOD_RES (30)..(58): Any amino acid
  MOD_RES (72)..(87): Any amino acid
  MOD_RES (96)..(105): Any amino acid
  MOD_RES (151)..(191): Any amino acid
  MOD_RES (200)..(201): Any amino acid
  MOD_RES (210)..(230): Any amino acid
  MOD_RES (241)..(243): Any amino acid
  MOD_RES (270)..(308): Any amino acid
  MOD_RES (320)..(326): Any amino acid
  MOD_RES (350)..(350): Any amino acid
  MOD_RES (364)..(376): Any amino acid
  MOD_RES (393)..(395): Any amino acid
  MOD_RES (404)..(407): Any amino acid
  MOD_RES (416)..(426): Any amino acid
  MOD_RES (435)..(460): Any amino acid
  MOD_RES (469)..(469): Any amino acid

SEQ ID NO: 420308 - protein, 597 aa, Influenza virus; identical to SEQ ID NO: 418613
  MOD_RES (15)..(24): Any amino acid
  MOD_RES (61)..(74): Any amino acid
  MOD_RES (99)..(99): Any amino acid
  MOD_RES (117)..(123): Any amino acid
  MOD_RES (137)..(137): Any amino acid
  MOD_RES (151)..(163): Any amino acid
  MOD_RES (182)..(183): Any amino acid
  MOD_RES (192)..(197): Any amino acid
  MOD_RES (211)..(212): Any amino acid
  MOD_RES (244)..(244): Any amino acid
  MOD_RES (284)..(303): Any amino acid
  MOD_RES (335)..(335): Any amino acid
  MOD_RES (352)..(352): Any amino acid
  MOD_RES (578)..(582): Any amino acid

SEQ ID NO: 420309 - protein, 597 aa, Influenza virus; identical to SEQ ID NO: 418614
  MOD_RES (1)..(2): Any amino acid
  MOD_RES (15)..(24): Any amino acid
  MOD_RES (61)..(74): Any amino acid
  MOD_RES (95)..(99): Any amino acid
  MOD_RES (108)..(108): Any amino acid
  MOD_RES (117)..(123): Any amino acid
  MOD_RES (137)..(137): Any amino acid
  MOD_RES (151)..(163): Any amino acid
  MOD_RES (182)..(183): Any amino acid
  MOD_RES (192)..(197): Any amino acid
  MOD_RES (211)..(212): Any amino acid
  MOD_RES (244)..(244): Any amino acid
  MOD_RES (284)..(303): Any amino acid
  MOD_RES (335)..(335): Any amino acid
  MOD_RES (352)..(352): Any amino acid
  MOD_RES (370)..(386): Any amino acid
  MOD_RES (402)..(402): Any amino acid
  MOD_RES (479)..(484): Any amino acid
  MOD_RES (508)..(514): Any amino acid
  MOD_RES (578)..(582): Any amino acid
  MOD_RES (594)..(597): Any amino acid

SEQ ID NO: 420310 - protein, 597 aa, Influenza virus; identical to SEQ ID NO: 418615
  MOD_RES (1)..(3): Any amino acid
  MOD_RES (15)..(28): Any amino acid
  MOD_RES (61)..(74): Any amino acid
  MOD_RES (99)..(99): Any amino acid
  MOD_RES (117)..(123): Any amino acid
  MOD_RES (137)..(137): Any amino acid
  MOD_RES (151)..(163): Any amino acid
  MOD_RES (182)..(183): Any amino acid
  MOD_RES (192)..(197): Any amino acid
  MOD_RES (211)..(212): Any amino acid
  MOD_RES (244)..(244): Any amino acid
  MOD_RES (284)..(303): Any amino acid
  MOD_RES (335)..(336): Any amino acid
  MOD_RES (352)..(353): Any amino acid
  MOD_RES (377)..(387): Any amino acid
  MOD_RES (403)..(413): Any amino acid
  MOD_RES (455)..(456): Any amino acid
  MOD_RES (472)..(484): Any amino acid
  MOD_RES (501)..(522): Any amino acid
  MOD_RES (564)..(566): Any amino acid
  MOD_RES (578)..(582): Any amino acid
  MOD_RES (592)..(597): Any amino acid

SEQ ID NO: 420311 - protein, 597 aa, Influenza virus; identical to SEQ ID NO: 418616
  MOD_RES (1)..(6): Any amino acid
  MOD_RES (15)..(28): Any amino acid
  MOD_RES (61)..(74): Any amino acid
  MOD_RES (99)..(99): Any amino acid
  MOD_RES (117)..(123): Any amino acid
  MOD_RES (137)..(137): Any amino acid
  MOD_RES (151)..(163): Any amino acid
  MOD_RES (182)..(183): Any amino acid
  MOD_RES (192)..(197): Any amino acid
  MOD_RES (209)..(213): Any amino acid
  MOD_RES (231)..(234): Any amino acid
  MOD_RES (244)..(244): Any amino acid
  MOD_RES (284)..(303): Any amino acid
  MOD_RES (333)..(341): Any amino acid
  MOD_RES (352)..(353): Any amino acid
  MOD_RES (370)..(393): Any amino acid
  MOD_RES (409)..(414): Any amino acid
  MOD_RES (439)..(440): Any amino acid
  MOD_RES (454)..(456): Any amino acid
  MOD_RES (475)..(485): Any amino acid
  MOD_RES (501)..(522): Any amino acid
  MOD_RES (578)..(584): Any amino acid
  MOD_RES (596)..(597): Any amino acid

SEQ ID NO: 420312 - protein, 597 aa, Influenza virus; identical to SEQ ID NO: 418617
  MOD_RES (1)..(32): Any amino acid
  MOD_RES (61)..(74): Any amino acid
  MOD_RES (94)..(99): Any amino acid
  MOD_RES (108)..(108): Any amino acid
  MOD_RES (117)..(128): Any amino acid
  MOD_RES (137)..(137): Any amino acid
  MOD_RES (151)..(163): Any amino acid
  MOD_RES (182)..(202): Any amino acid
  MOD_RES (211)..(215): Any amino acid
  MOD_RES (228)..(228): Any amino acid
  MOD_RES (244)..(244): Any amino acid
  MOD_RES (273)..(275): Any amino acid
  MOD_RES (284)..(303): Any amino acid
  MOD_RES (325)..(343): Any amino acid
  MOD_RES (352)..(353): Any amino acid
  MOD_RES (362)..(362): Any amino acid
  MOD_RES (376)..(426): Any amino acid
  MOD_RES (455)..(459): Any amino acid
  MOD_RES (471)..(485): Any amino acid
  MOD_RES (507)..(522): Any amino acid
  MOD_RES (531)..(531): Any amino acid
  MOD_RES (561)..(569): Any amino acid
  MOD_RES (578)..(597): Any amino acid

SEQ ID NO: 420313 - protein, 515 aa, Influenza virus; identical to SEQ ID NO: 418623
  MOD_RES (1)..(10): Any amino acid
  MOD_RES (39)..(62): Any amino acid
  MOD_RES (80)..(84): Any amino acid
  MOD_RES (127)..(127): Any amino acid
  MOD_RES (200)..(255): Any amino acid
  MOD_RES (309)..(318): Any amino acid
  MOD_RES (458)..(459): Any amino acid
  MOD_RES (478)..(478): Any amino acid

SEQ ID NO: 420314 - protein, 515 aa, Influenza virus; identical to SEQ ID NO: 418624
  MOD_RES (1)..(10): Any amino acid
  MOD_RES (39)..(62): Any amino acid
  MOD_RES (80)..(84): Any amino acid
  MOD_RES (96)..(98): Any amino acid
  MOD_RES (127)..(127): Any amino acid
  MOD_RES (198)..(255): Any amino acid
  MOD_RES (309)..(318): Any amino acid
  MOD_RES (366)..(367): Any amino acid
  MOD_RES (457)..(459): Any amino acid
  MOD_RES (478)..(478): Any amino acid
  MOD_RES (514)..(515): Any amino acid

SEQ ID NO: 420315 - protein, 515 aa, Influenza virus; identical to SEQ ID NO: 418625
  MOD_RES (1)..(10): Any amino acid
  MOD_RES (38)..(62): Any amino acid
  MOD_RES (80)..(84): Any amino acid
  MOD_RES (112)..(112): Any amino acid
  MOD_RES (123)..(127): Any amino acid
  MOD_RES (183)..(186): Any amino acid
  MOD_RES (200)..(255): Any amino acid
  MOD_RES (267)..(272): Any amino acid
  MOD_RES (306)..(318): Any amino acid
  MOD_RES (340)..(342): Any amino acid
  MOD_RES (458)..(459): Any amino acid
  MOD_RES (478)..(478): Any amino acid
  MOD_RES (489)..(495): Any amino acid

SEQ ID NO: 420316 - protein, 515 aa, Influenza virus; identical to SEQ ID NO: 418626
  MOD_RES (1)..(10): Any amino acid
  MOD_RES (38)..(62): Any amino acid
  MOD_RES (78)..(84): Any amino acid
  MOD_RES (127)..(127): Any amino acid
  MOD_RES (183)..(186): Any amino acid
  MOD_RES (200)..(255): Any amino acid
  MOD_RES (267)..(272): Any amino acid
  MOD_RES (309)..(318): Any amino acid
  MOD_RES (340)..(345): Any amino acid
  MOD_RES (403)..(406): Any amino acid
  MOD_RES (445)..(449): Any amino acid
  MOD_RES (458)..(459): Any amino acid
  MOD_RES (468)..(468): Any amino acid
  MOD_RES (478)..(478): Any amino acid
  MOD_RES (493)..(496): Any amino acid
  MOD_RES (511)..(515): Any amino acid

SEQ ID NO: 420317 - protein, 515 aa, Influenza virus; identical to SEQ ID NO: 418627
  MOD_RES (1)..(10): Any amino acid
  MOD_RES (39)..(62): Any amino acid
  MOD_RES (80)..(86): Any amino acid
  MOD_RES (95)..(104): Any amino acid
  MOD_RES (113)..(114): Any amino acid
  MOD_RES (123)..(135): Any amino acid
  MOD_RES (184)..(187): Any amino acid
  MOD_RES (198)..(255): Any amino acid
  MOD_RES (266)..(273): Any amino acid
  MOD_RES (283)..(293): Any amino acid
  MOD_RES (309)..(322): Any amino acid
  MOD_RES (342)..(345): Any amino acid
  MOD_RES (360)..(375): Any amino acid
  MOD_RES (392)..(393): Any amino acid
  MOD_RES (403)..(409): Any amino acid
  MOD_RES (430)..(434): Any amino acid
  MOD_RES (446)..(459): Any amino acid
  MOD_RES (473)..(478): Any amino acid
  MOD_RES (487)..(515): Any amino acid

SEQ ID NO: 420318 - protein, 585 aa, Influenza virus; identical to SEQ ID NO: 418630
  MOD_RES (15)..(23): Any amino acid
  MOD_RES (42)..(42): Any amino acid
  MOD_RES (67)..(80): Any amino acid
  MOD_RES (104)..(105): Any amino acid
  MOD_RES (115)..(115): Any amino acid
  MOD_RES (124)..(125): Any amino acid
  MOD_RES (140)..(143): Any amino acid
  MOD_RES (156)..(161): Any amino acid
  MOD_RES (178)..(182): Any amino acid
  MOD_RES (195)..(196): Any amino acid
  MOD_RES (210)..(211): Any amino acid
  MOD_RES (236)..(241): Any amino acid
  MOD_RES (258)..(261): Any amino acid
  MOD_RES (282)..(302): Any amino acid
  MOD_RES (311)..(311): Any amino acid
  MOD_RES (334)..(334): Any amino acid
  MOD_RES (348)..(349): Any amino acid
  MOD_RES (528)..(529): Any amino acid
  MOD_RES (566)..(568): Any amino acid

SEQ ID NO: 420319 - protein, 585 aa, Influenza virus; identical to SEQ ID NO: 418631
  MOD_RES (15)..(29): Any amino acid
  MOD_RES (42)..(42): Any amino acid
  MOD_RES (67)..(80): Any amino acid
  MOD_RES (100)..(105): Any amino acid
  MOD_RES (114)..(115): Any amino acid
  MOD_RES (124)..(125): Any amino acid
  MOD_RES (140)..(143): Any amino acid
  MOD_RES (156)..(161): Any amino acid
  MOD_RES (178)..(182): Any amino acid
  MOD_RES (195)..(196): Any amino acid
  MOD_RES (210)..(211): Any amino acid
  MOD_RES (236)..(241): Any amino acid
  MOD_RES (258)..(261): Any amino acid
  MOD_RES (282)..(302): Any amino acid
  MOD_RES (311)..(311): Any amino acid
  MOD_RES (332)..(334): Any amino acid
  MOD_RES (345)..(349): Any amino acid
  MOD_RES (358)..(358): Any amino acid
  MOD_RES (374)..(374): Any amino acid
  MOD_RES (401)..(401): Any amino acid
  MOD_RES (528)..(529): Any amino acid
  MOD_RES (566)..(568): Any amino acid

SEQ ID NO: 420320 - protein, 585 aa, Influenza virus; identical to SEQ ID NO: 418632
  MOD_RES (1)..(3): Any amino acid
  MOD_RES (15)..(29): Any amino acid
  MOD_RES (42)..(42): Any amino acid
  MOD_RES (67)..(80): Any amino acid
  MOD_RES (104)..(105): Any amino acid
  MOD_RES (115)..(115): Any amino acid
  MOD_RES (124)..(125): Any amino acid
  MOD_RES (140)..(143): Any amino acid
  MOD_RES (156)..(161): Any amino acid
  MOD_RES (178)..(182): Any amino acid
  MOD_RES (195)..(196): Any amino acid
  MOD_RES (210)..(211): Any amino acid
  MOD_RES (236)..(241): Any amino acid
  MOD_RES (258)..(261): Any amino acid
  MOD_RES (282)..(302): Any amino acid
  MOD_RES (311)..(311): Any amino acid
  MOD_RES (334)..(335): Any amino acid
  MOD_RES (348)..(349): Any amino acid
  MOD_RES (360)..(361): Any amino acid
  MOD_RES (370)..(380): Any amino acid
  MOD_RES (400)..(402): Any amino acid
  MOD_RES (435)..(435): Any amino acid
  MOD_RES (528)..(529): Any amino acid
  MOD_RES (566)..(568): Any amino acid

SEQ ID NO: 420321 - protein, 585 aa, Influenza virus; identical to SEQ ID NO: 418633
  MOD_RES (1)..(6): Any amino acid
  MOD_RES (15)..(29): Any amino acid
  MOD_RES (42)..(42): Any amino acid
  MOD_RES (56)..(80): Any amino acid
  MOD_RES (99)..(105): Any amino acid
  MOD_RES (115)..(125): Any amino acid
  MOD_RES (139)..(143): Any amino acid
  MOD_RES (153)..(161): Any amino acid
  MOD_RES (178)..(183): Any amino acid
  MOD_RES (195)..(196): Any amino acid
  MOD_RES (207)..(211): Any amino acid
  MOD_RES (235)..(241): Any amino acid
  MOD_RES (252)..(261): Any amino acid
  MOD_RES (281)..(302): Any amino acid
  MOD_RES (311)..(311): Any amino acid
  MOD_RES (334)..(349): Any amino acid
  MOD_RES (358)..(358): Any amino acid
  MOD_RES (370)..(381): Any amino acid
  MOD_RES (397)..(402): Any amino acid
  MOD_RES (422)..(427): Any amino acid
  MOD_RES (479)..(480): Any amino acid
  MOD_RES (496)..(496): Any amino acid
  MOD_RES (528)..(529): Any amino acid
  MOD_RES (566)..(568): Any amino acid

SEQ ID NO: 420322 - protein, 585 aa, Influenza virus; identical to SEQ ID NO: 418634
  MOD_RES (1)..(29): Any amino acid
  MOD_RES (38)..(46): Any amino acid
  MOD_RES (62)..(81): Any amino acid
  MOD_RES (90)..(90): Any amino acid
  MOD_RES (99)..(105): Any amino acid
  MOD_RES (115)..(125): Any amino acid
  MOD_RES (140)..(143): Any amino acid
  MOD_RES (152)..(161): Any amino acid
  MOD_RES (171)..(186): Any amino acid
  MOD_RES (195)..(215): Any amino acid
  MOD_RES (236)..(261): Any amino acid
  MOD_RES (276)..(311): Any amino acid
  MOD_RES (320)..(323): Any amino acid
  MOD_RES (334)..(350): Any amino acid
  MOD_RES (360)..(361): Any amino acid
  MOD_RES (370)..(384): Any amino acid
  MOD_RES (395)..(410): Any amino acid
  MOD_RES (421)..(427): Any amino acid
  MOD_RES (449)..(452): Any amino acid
  MOD_RES (461)..(468): Any amino acid
  MOD_RES (482)..(503): Any amino acid
  MOD_RES (527)..(529): Any amino acid
  MOD_RES (566)..(568): Any amino acid
  MOD_RES (582)..(585): Any amino acid

SEQ ID NO: 420323 - protein, 471 aa, Influenza virus; identical to SEQ ID NO: 418638
  MOD_RES (39)..(61): Any amino acid
  MOD_RES (73)..(81): Any amino acid
  MOD_RES (164)..(168): Any amino acid
  MOD_RES (254)..(267): Any amino acid
  MOD_RES (285)..(286): Any amino acid
  MOD_RES (309)..(309): Any amino acid
  MOD_RES (332)..(333): Any amino acid
  MOD_RES (389)..(391): Any amino acid
  MOD_RES (416)..(416): Any amino acid
  MOD_RES (454)..(454): Any amino acid

SEQ ID NO: 420324 - protein, 471 aa, Influenza virus; identical to SEQ ID NO: 418639
  MOD_RES (39)..(61): Any amino acid
  MOD_RES (73)..(81): Any amino acid
  MOD_RES (135)..(138): Any amino acid
  MOD_RES (164)..(168): Any amino acid
  MOD_RES (254)..(267): Any amino acid
  MOD_RES (285)..(286): Any amino acid
  MOD_RES (309)..(309): Any amino acid
  MOD_RES (332)..(333): Any amino acid
  MOD_RES (389)..(391): Any amino acid
  MOD_RES (416)..(416): Any amino acid
  MOD_RES (425)..(432): Any amino acid
  MOD_RES (448)..(454): Any amino acid

SEQ ID NO: 420325 - protein, 471 aa, Influenza virus; identical to SEQ ID NO: 418640
  MOD_RES (1)..(1): Any amino acid
  MOD_RES (39)..(61): Any amino acid
  MOD_RES (72)..(81): Any amino acid
  MOD_RES (137)..(140): Any amino acid
  MOD_RES (164)..(168): Any amino acid
  MOD_RES (254)..(267): Any amino acid
  MOD_RES (285)..(286): Any amino acid
  MOD_RES (295)..(300): Any amino acid
  MOD_RES (309)..(309): Any amino acid
  MOD_RES (332)..(333): Any amino acid
  MOD_RES (389)..(391): Any amino acid
  MOD_RES (406)..(407): Any amino acid
  MOD_RES (416)..(434): Any amino acid
  MOD_RES (450)..(454): Any amino acid
  MOD_RES (466)..(471): Any amino acid

SEQ ID NO: 420326 - protein, 471 aa, Influenza virus; identical to SEQ ID NO: 418641
  MOD_RES (1)..(2): Any amino acid
  MOD_RES (18)..(18): Any amino acid
  MOD_RES (39)..(61): Any amino acid
  MOD_RES (70)..(81): Any amino acid
  MOD_RES (109)..(118): Any amino acid
  MOD_RES (127)..(144): Any amino acid
  MOD_RES (164)..(168): Any amino acid
  MOD_RES (199)..(201): Any amino acid
  MOD_RES (254)..(276): Any amino acid
  MOD_RES (285)..(286): Any amino acid
  MOD_RES (296)..(300): Any amino acid
  MOD_RES (309)..(309): Any amino acid
  MOD_RES (332)..(338): Any amino acid
  MOD_RES (389)..(391): Any amino acid
  MOD_RES (408)..(439): Any amino acid
  MOD_RES (454)..(454): Any amino acid

SEQ ID NO: 420327 - protein, 471 aa, Influenza virus; identical to SEQ ID NO: 418642
  MOD_RES (1)..(8): Any amino acid
  MOD_RES (38)..(62): Any amino acid
  MOD_RES (73)..(91): Any amino acid
  MOD_RES (100)..(118): Any amino acid
  MOD_RES (127)..(145): Any amino acid
  MOD_RES (164)..(182): Any amino acid
  MOD_RES (205)..(207): Any amino acid
  MOD_RES (223)..(230): Any amino acid
  MOD_RES (254)..(286): Any amino acid
  MOD_RES (298)..(300): Any amino acid
  MOD_RES (309)..(309): Any amino acid
  MOD_RES (319)..(345): Any amino acid
  MOD_RES (357)..(357): Any amino acid
  MOD_RES (367)..(376): Any amino acid
  MOD_RES (386)..(392): Any amino acid
  MOD_RES (408)..(471): Any amino acid

SEQ ID NO: 420328 - protein, 567 aa, Influenza virus; identical to SEQ ID NO: 418645
  MOD_RES (1)..(8): Any amino acid

SEQ ID NO: 420329 - protein, 567 aa, Influenza virus; identical to SEQ ID NO: 418646
  MOD_RES (1)..(8): Any amino acid
  MOD_RES (20)..(23): Any amino acid
  MOD_RES (100)..(103): Any amino acid
  MOD_RES (159)..(162): Any amino acid
  MOD_RES (251)..(267): Any amino acid
  MOD_RES (350)..(352): Any amino acid
  MOD_RES (382)..(383): Any amino acid
  MOD_RES (399)..(401): Any amino acid
  MOD_RES (443)..(444): Any amino acid
  MOD_RES (536)..(538): Any amino acid

SEQ ID NO: 420330 - protein, 567 aa, Influenza virus; identical to SEQ ID NO: 418647
  MOD_RES (1)..(8): Any amino acid
  MOD_RES (20)..(26): Any amino acid
  MOD_RES (73)..(78): Any amino acid
  MOD_RES (100)..(104): Any amino acid
  MOD_RES (143)..(145): Any amino acid
  MOD_RES (161)..(163): Any amino acid
  MOD_RES (194)..(194): Any amino acid
  MOD_RES (247)..(271): Any amino acid
  MOD_RES (351)..(383): Any amino acid
  MOD_RES (399)..(403): Any amino acid
  MOD_RES (438)..(447): Any amino acid
  MOD_RES (484)..(484): Any amino acid
  MOD_RES (512)..(512): Any amino acid
  MOD_RES (538)..(540): Any amino acid
  MOD_RES (556)..(567): Any amino acid

SEQ ID NO: 420331 - protein, 567 aa, Influenza virus; identical to SEQ ID NO: 418648
  MOD_RES (1)..(8): Any amino acid
  MOD_RES (25)..(29): Any amino acid
  MOD_RES (63)..(81): Any amino acid
  MOD_RES (97)..(123): Any amino acid
  MOD_RES (164)..(165): Any amino acid
  MOD_RES (251)..(272): Any amino acid
  MOD_RES (288)..(291): Any amino acid
  MOD_RES (353)..(383): Any amino acid
  MOD_RES (399)..(404): Any amino acid
  MOD_RES (443)..(465): Any amino acid
  MOD_RES (484)..(498): Any amino acid
  MOD_RES (514)..(514): Any amino acid
  MOD_RES (530)..(567): Any amino acid

SEQ ID NO: 420332 - protein, 567 aa, Influenza virus; identical to SEQ ID NO: 418649
  MOD_RES (1)..(8): Any amino acid
  MOD_RES (18)..(29): Any amino acid
  MOD_RES (45)..(47): Any amino acid
  MOD_RES (64)..(86): Any amino acid
  MOD_RES (100)..(134): Any amino acid
  MOD_RES (143)..(150): Any amino acid
  MOD_RES (166)..(171): Any amino acid
  MOD_RES (195)..(201): Any amino acid
  MOD_RES (210)..(211): Any amino acid
  MOD_RES (220)..(273): Any amino acid
  MOD_RES (289)..(291): Any amino acid
  MOD_RES (302)..(309): Any amino acid
  MOD_RES (334)..(337): Any amino acid
  MOD_RES (350)..(389): Any amino acid
  MOD_RES (405)..(409): Any amino acid
  MOD_RES (443)..(465): Any amino acid
  MOD_RES (488)..(498): Any amino acid
  MOD_RES (511)..(514): Any amino acid
  MOD_RES (530)..(567): Any amino acid

SEQ ID NO: 420333 - protein, 562 aa, Influenza virus; identical to SEQ ID NO: 418654
  MOD_RES (10)..(25): Any amino acid
  MOD_RES (39)..(55): Any amino acid
  MOD_RES (65)..(76): Any amino acid
  MOD_RES (89)..(94): Any amino acid
  MOD_RES (106)..(155): Any amino acid
  MOD_RES (166)..(237): Any amino acid
  MOD_RES (269)..(296): Any amino acid
  MOD_RES (320)..(322): Any amino acid
  MOD_RES (334)..(339): Any amino acid
  MOD_RES (378)..(421): Any amino acid
  MOD_RES (464)..(471): Any amino acid
  MOD_RES (487)..(487): Any amino acid
  MOD_RES (499)..(520): Any amino acid
  MOD_RES (539)..(543): Any amino acid
  MOD_RES (553)..(562): Any amino acid

SEQ ID NO: 420334 - protein, 562 aa, Influenza virus; identical to SEQ ID NO: 418655
  MOD_RES (1)..(25): Any amino acid
  MOD_RES (39)..(55): Any amino acid
  MOD_RES (65)..(76): Any amino acid
  MOD_RES (89)..(94): Any amino acid
  MOD_RES (106)..(155): Any amino acid
  MOD_RES (166)..(237): Any amino acid
  MOD_RES (269)..(296): Any amino acid
  MOD_RES (320)..(322): Any amino acid
  MOD_RES (334)..(339): Any amino acid
  MOD_RES (378)..(421): Any amino acid
  MOD_RES (464)..(471): Any amino acid
  MOD_RES (487)..(487): Any amino acid
  MOD_RES (499)..(520): Any amino acid
  MOD_RES (539)..(543): Any amino acid
  MOD_RES (553)..(562): Any amino acid

SEQ ID NO: 420335 - protein, 562 aa, Influenza virus; identical to SEQ ID NO: 418656
  MOD_RES (1)..(25): Any amino acid
  MOD_RES (39)..(55): Any amino acid
  MOD_RES (65)..(76): Any amino acid
  MOD_RES (89)..(94): Any amino acid
  MOD_RES (106)..(155): Any amino acid
  MOD_RES (164)..(237): Any amino acid
  MOD_RES (269)..(296): Any amino acid
  MOD_RES (316)..(322): Any amino acid
  MOD_RES (334)..(350): Any amino acid
  MOD_RES (378)..(421): Any amino acid
  MOD_RES (464)..(471): Any amino acid
  MOD_RES (487)..(487): Any amino acid
  MOD_RES (499)..(520): Any amino acid
  MOD_RES (539)..(543): Any amino acid
  MOD_RES (553)..(562): Any amino acid

SEQ ID NO: 420336 - protein, 562 aa, Influenza virus; identical to SEQ ID NO: 418657
  MOD_RES (1)..(25): Any amino acid
  MOD_RES (39)..(55): Any amino acid
  MOD_RES (64)..(76): Any amino acid
  MOD_RES (89)..(94): Any amino acid
  MOD_RES (103)..(155): Any amino acid
  MOD_RES (166)..(237): Any amino acid
  MOD_RES (269)..(296): Any amino acid
  MOD_RES (320)..(322): Any amino acid
  MOD_RES (331)..(361): Any amino acid
  MOD_RES (378)..(421): Any amino acid
  MOD_RES (439)..(439): Any amino acid
  MOD_RES (464)..(472): Any amino acid
  MOD_RES (487)..(487): Any amino acid
  MOD_RES (497)..(520): Any amino acid
  MOD_RES (539)..(543): Any amino acid
  MOD_RES (553)..(562): Any amino acid

SEQ ID NO: 420337 - protein, 562 aa, Influenza virus; identical to SEQ ID NO: 418658
  MOD_RES (1)..(30): Any amino acid
  MOD_RES (39)..(55): Any amino acid
  MOD_RES (64)..(97): Any amino acid
  MOD_RES (106)..(155): Any amino acid
  MOD_RES (166)..(244): Any amino acid
  MOD_RES (253)..(254): Any amino acid
  MOD_RES (263)..(296): Any amino acid
  MOD_RES (320)..(322): Any amino acid
  MOD_RES (334)..(369): Any amino acid
  MOD_RES (378)..(421): Any amino acid
  MOD_RES (431)..(443): Any amino acid
  MOD_RES (464)..(478): Any amino acid
  MOD_RES (487)..(489): Any amino acid
  MOD_RES (499)..(520): Any amino acid
  MOD_RES (529)..(530): Any amino acid
  MOD_RES (539)..(543): Any amino acid
  MOD_RES (552)..(562): Any amino acid

SEQ ID NO: 420338 - protein, 562 aa, Influenza virus; identical to SEQ ID NO: 418661
  MOD_RES (10)..(25): Any amino acid
  MOD_RES (39)..(50): Any amino acid
  MOD_RES (65)..(76): Any amino acid
  MOD_RES (89)..(94): Any amino acid
  MOD_RES (106)..(155): Any amino acid
  MOD_RES (166)..(237): Any amino acid
  MOD_RES (269)..(296): Any amino acid
  MOD_RES (320)..(322): Any amino acid
  MOD_RES (335)..(339): Any amino acid
  MOD_RES (378)..(390): Any amino acid
  MOD_RES (399)..(421): Any amino acid
  MOD_RES (464)..(471): Any amino acid
  MOD_RES (487)..(487): Any amino acid
  MOD_RES (499)..(519): Any amino acid
  MOD_RES (539)..(543): Any amino acid
  MOD_RES (553)..(562): Any amino acid

SEQ ID NO: 420339 - protein, 562 aa, Influenza virus; identical to SEQ ID NO: 418662
  MOD_RES (1)..(25): Any amino acid
  MOD_RES (39)..(50): Any amino acid
  MOD_RES (65)..(76): Any amino acid
  MOD_RES (89)..(94): Any amino acid
  MOD_RES (106)..(155): Any amino acid
  MOD_RES (166)..(237): Any amino acid
  MOD_RES (269)..(296): Any amino acid
  MOD_RES (320)..(322): Any amino acid
  MOD_RES (335)..(347): Any amino acid
  MOD_RES (378)..(390): Any amino acid
  MOD_RES (399)..(421): Any amino acid
  MOD_RES (464)..(471): Any amino acid
  MOD_RES (487)..(487): Any amino acid
  MOD_RES (499)..(519): Any amino acid
  MOD_RES (539)..(543): Any amino acid
  MOD_RES (553)..(562): Any amino acid

SEQ ID NO: 420340 - protein, 562 aa, Influenza virus; identical to SEQ ID NO: 418663
  MOD_RES (1)..(25): Any amino acid
  MOD_RES (39)..(50): Any amino acid
  MOD_RES (65)..(76): Any amino acid
  MOD_RES (89)..(94): Any amino acid
  MOD_RES (106)..(155): Any amino acid
  MOD_RES (164)..(237): Any amino acid
  MOD_RES (269)..(296): Any amino acid
  MOD_RES (316)..(322): Any amino acid
  MOD_RES (335)..(350): Any amino acid
  MOD_RES (378)..(390): Any amino acid
  MOD_RES (399)..(421): Any amino acid
  MOD_RES (439)..(439): Any amino acid
  MOD_RES (464)..(471): Any amino acid
  MOD_RES (487)..(487): Any amino acid
  MOD_RES (499)..(519): Any amino acid
  MOD_RES (539)..(543): Any amino acid
  MOD_RES (553)..(562): Any amino acid

SEQ ID NO: 420341 - protein, 562 aa, Influenza virus; identical to SEQ ID NO: 418664
  MOD_RES (1)..(25): Any amino acid
  MOD_RES (39)..(50): Any amino acid
  MOD_RES (64)..(76): Any amino acid
  MOD_RES (89)..(94): Any amino acid
  MOD_RES (103)..(155): Any amino acid
  MOD_RES (166)..(237): Any amino acid
  MOD_RES (269)..(296): Any amino acid
  MOD_RES (320)..(322): Any amino acid
  MOD_RES (331)..(361): Any amino acid
  MOD_RES (378)..(390): Any amino acid
  MOD_RES (399)..(421): Any amino acid
  MOD_RES (439)..(445): Any amino acid
  MOD_RES (464)..(472): Any amino acid
  MOD_RES (487)..(487): Any amino acid
  MOD_RES (497)..(519): Any amino acid
  MOD_RES (539)..(543): Any amino acid
  MOD_RES (553)..(562): Any amino acid

SEQ ID NO: 420342 - protein, 562 aa, Influenza virus; identical to SEQ ID NO: 418665
  MOD_RES (1)..(30): Any amino acid
  MOD_RES (39)..(50): Any amino acid
  MOD_RES (59)..(97): Any amino acid
  MOD_RES (106)..(155): Any amino acid
  MOD_RES (166)..(241): Any amino acid
  MOD_RES (263)..(296): Any amino acid
  MOD_RES (319)..(322): Any amino acid
  MOD_RES (335)..(369): Any amino acid
  MOD_RES (378)..(390): Any amino acid
  MOD_RES (399)..(421): Any amino acid
  MOD_RES (431)..(445): Any amino acid
  MOD_RES (464)..(478): Any amino acid
  MOD_RES (487)..(489): Any amino acid
  MOD_RES (499)..(519): Any amino acid
  MOD_RES (539)..(543): Any amino acid
  MOD_RES (552)..(562): Any amino acid

SEQ ID NO: 420343 - protein, 473 aa, Influenza virus; identical to SEQ ID NO: 418669
  MOD_RES (1)..(8): Any amino acid
  MOD_RES (17)..(51): Any amino acid
  MOD_RES (62)..(90): Any amino acid
  MOD_RES (108)..(108): Any amino acid
  MOD_RES (130)..(131): Any amino acid
  MOD_RES (145)..(157): Any amino acid
  MOD_RES (174)..(174): Any amino acid
  MOD_RES (203)..(224): Any amino acid
  MOD_RES (252)..(273): Any amino acid
  MOD_RES (289)..(292): Any amino acid
  MOD_RES (307)..(319): Any amino acid
  MOD_RES (333)..(350): Any amino acid
  MOD_RES (360)..(362): Any amino acid
  MOD_RES (371)..(420): Any amino acid
  MOD_RES (436)..(438): Any amino acid
  MOD_RES (448)..(449): Any amino acid
  MOD_RES (469)..(473): Any amino acid

SEQ ID NO: 420344 - protein, 473 aa, Influenza virus; identical to SEQ ID NO: 418670
  MOD_RES (1)..(90): Any amino acid
  MOD_RES (108)..(108): Any amino acid
  MOD_RES (130)..(131): Any amino acid
  MOD_RES (145)..(157): Any amino acid
  MOD_RES (173)..(174): Any amino acid
  MOD_RES (203)..(224): Any amino acid
  MOD_RES (252)..(273): Any amino acid
  MOD_RES (289)..(292): Any amino acid
  MOD_RES (307)..(319): Any amino acid
  MOD_RES (333)..(350): Any amino acid
  MOD_RES (359)..(362): Any amino acid
  MOD_RES (371)..(420): Any amino acid
  MOD_RES (436)..(438): Any amino acid
  MOD_RES (448)..(449): Any amino acid
  MOD_RES (466)..(473): Any amino acid

SEQ ID NO: 420345 - protein, 473 aa, Influenza virus; identical to SEQ ID NO: 418671
  MOD_RES (1)..(90): Any amino acid
  MOD_RES (108)..(108): Any amino acid
  MOD_RES (130)..(131): Any amino acid
  MOD_RES (144)..(157): Any amino acid
  MOD_RES (174)..(174): Any amino acid
  MOD_RES (203)..(224): Any amino acid
  MOD_RES (249)..(273): Any amino acid
  MOD_RES (289)..(292): Any amino acid
  MOD_RES (307)..(319): Any amino acid
  MOD_RES (333)..(351): Any amino acid
  MOD_RES (360)..(362): Any amino acid
  MOD_RES (371)..(426): Any amino acid
  MOD_RES (436)..(438): Any amino acid
  MOD_RES (448)..(449): Any amino acid
  MOD_RES (469)..(473): Any amino acid

SEQ ID NO: 420346 - protein, 473 aa, Influenza virus; identical to SEQ ID NO: 418672
  MOD_RES (1)..(91): Any amino acid
  MOD_RES (108)..(108): Any amino acid
  MOD_RES (130)..(131): Any amino acid
  MOD_RES (140)..(157): Any amino acid
  MOD_RES (174)..(174): Any amino acid
  MOD_RES (203)..(224): Any amino acid
  MOD_RES (252)..(273): Any amino acid
  MOD_RES (289)..(292): Any amino acid
  MOD_RES (301)..(324): Any amino acid
  MOD_RES (333)..(362): Any amino acid
  MOD_RES (371)..(438): Any amino acid
  MOD_RES (447)..(449): Any amino acid
  MOD_RES (466)..(473): Any amino acid

SEQ ID NO: 420347 - protein, 473 aa, Influenza virus; identical to SEQ ID NO: 418673
  MOD_RES (1)..(94): Any amino acid
  MOD_RES (108)..(110): Any amino acid
  MOD_RES (128)..(163): Any amino acid
  MOD_RES (173)..(174): Any amino acid
  MOD_RES (183)..(186): Any amino acid
  MOD_RES (203)..(229): Any amino acid
  MOD_RES (252)..(273): Any amino acid
  MOD_RES (289)..(298): Any amino acid
  MOD_RES (307)..(438): Any amino acid
  MOD_RES (448)..(449): Any amino acid
  MOD_RES (469)..(473): Any amino acid

SEQ ID NO: 420348 - protein, 275 aa, Influenza virus; identical to SEQ ID NO: 418679
  MOD_RES (143)..(145): Any amino acid
  MOD_RES (210)..(211): Any amino acid
  MOD_RES (227)..(233): Any amino acid

SEQ ID NO: 420349 - protein, 275 aa, Influenza virus; identical to SEQ ID NO: 418680
  MOD_RES (1)..(10): Any amino acid
  MOD_RES (70)..(75): Any amino acid
  MOD_RES (132)..(132): Any amino acid
  MOD_RES (143)..(145): Any amino acid
  MOD_RES (185)..(187): Any amino acid
  MOD_RES (210)..(211): Any amino acid
  MOD_RES (227)..(233): Any amino acid
  MOD_RES (256)..(256): Any amino acid
  MOD_RES (273)..(275): Any amino acid

SEQ ID NO: 420350 - protein, 275 aa, Influenza virus; identical to SEQ ID NO: 418681
  MOD_RES (1)..(10): Any amino acid
  MOD_RES (19)..(25): Any amino acid
  MOD_RES (48)..(58): Any amino acid
  MOD_RES (67)..(80): Any amino acid
  MOD_RES (127)..(133): Any amino acid
  MOD_RES (143)..(145): Any amino acid
  MOD_RES (169)..(169): Any amino acid
  MOD_RES (192)..(199): Any amino acid
  MOD_RES (208)..(211): Any amino acid
  MOD_RES (227)..(233): Any amino acid
  MOD_RES (256)..(275): Any amino acid

SEQ ID NO: 420351 - protein, 275 aa, Influenza virus; identical to SEQ ID NO: 418682
  MOD_RES (1)..(25): Any amino acid
  MOD_RES (47)..(91): Any amino acid
  MOD_RES (122)..(134): Any amino acid
  MOD_RES (143)..(155): Any amino acid
  MOD_RES (178)..(200): Any amino acid
  MOD_RES (210)..(211): Any amino acid
  MOD_RES (227)..(233): Any amino acid
  MOD_RES (256)..(275): Any amino acid

SEQ ID NO: 420352 - protein, 275 aa, Influenza virus; identical to SEQ ID NO: 418683
  MOD_RES (1)..(25): Any amino acid
  MOD_RES (40)..(96): Any amino acid
  MOD_RES (106)..(113): Any amino acid
  MOD_RES (129)..(211): Any amino acid
  MOD_RES (227)..(233): Any amino acid
  MOD_RES (256)..(275): Any amino acid

SEQ ID NO: 420353 - protein, 99 aa, Influenza virus; identical to SEQ ID NO: 418685
  MOD_RES (12)..(34): Any amino acid
  MOD_RES (44)..(67): Any amino acid
  MOD_RES (82)..(91): Any amino acid

SEQ ID NO: 420354 - protein, 99 aa, Influenza virus; identical to SEQ ID NO: 418686
  MOD_RES (1)..(2): Any amino acid
  MOD_RES (12)..(34): Any amino acid
  MOD_RES (44)..(67): Any amino acid
  MOD_RES (82)..(91): Any amino acid

SEQ ID NO: 420355 - protein, 99 aa, Influenza virus; identical to SEQ ID NO: 418687
  MOD_RES (1)..(2): Any amino acid
  MOD_RES (12)..(34): Any amino acid
  MOD_RES (44)..(67): Any amino acid
  MOD_RES (82)..(99): Any amino acid

SEQ ID NO: 420356 - protein, 99 aa, Influenza virus; identical to SEQ ID NO: 418688
  MOD_RES (1)..(2): Any amino acid
  MOD_RES (12)..(35): Any amino acid
  MOD_RES (44)..(67): Any amino acid
  MOD_RES (82)..(99): Any amino acid

SEQ ID NO: 420357 - protein, 99 aa, Influenza virus; identical to SEQ ID NO: 418689
  MOD_RES (1)..(9): Any amino acid
  MOD_RES (18)..(72): Any amino acid
  MOD_RES (82)..(99): Any amino acid

SEQ ID NO: 420358 - protein, 527 aa, Influenza virus; identical to SEQ ID NO: 418690
  MOD_RES (33)..(34): Any amino acid
  MOD_RES (116)..(121): Any amino acid
  MOD_RES (146)..(146): Any amino acid
  MOD_RES (305)..(305): Any amino acid
  MOD_RES (328)..(335): Any amino acid
  MOD_RES (367)..(375): Any amino acid
  MOD_RES (394)..(397): Any amino acid
  MOD_RES (445)..(452): Any amino acid
  MOD_RES (477)..(480): Any amino acid

SEQ ID NO: 420359 - protein, 527 aa, Influenza virus; identical to SEQ ID NO: 418691
  MOD_RES (1)..(9): Any amino acid
  MOD_RES (33)..(34): Any amino acid
  MOD_RES (116)..(121): Any amino acid
  MOD_RES (146)..(146): Any amino acid
  MOD_RES (181)..(191): Any amino acid
  MOD_RES (241)..(242): Any amino acid
  MOD_RES (305)..(305): Any amino acid
  MOD_RES (328)..(335): Any amino acid
  MOD_RES (367)..(375): Any amino acid
  MOD_RES (394)..(397): Any amino acid
  MOD_RES (445)..(452): Any amino acid
  MOD_RES (469)..(480): Any amino acid
  MOD_RES (523)..(527): Any amino acid

SEQ ID NO: 420360 - protein, 527 aa, Influenza virus; identical to SEQ ID NO: 418692
  MOD_RES (1)..(9): Any amino acid
  MOD_RES (33)..(34): Any amino acid
  MOD_RES (58)..(58): Any amino acid
  MOD_RES (83)..(92): Any amino acid
  MOD_RES (116)..(121): Any amino acid
  MOD_RES (146)..(146): Any amino acid
  MOD_RES (160)..(194): Any amino acid
  MOD_RES (221)..(222): Any amino acid
  MOD_RES (241)..(243): Any amino acid
  MOD_RES (305)..(305): Any amino acid
  MOD_RES (328)..(335): Any amino acid
  MOD_RES (367)..(375): Any amino acid
  MOD_RES (394)..(397): Any amino acid
  MOD_RES (445)..(452): Any amino acid
  MOD_RES (469)..(480): Any amino acid
  MOD_RES (493)..(493): Any amino acid
  MOD_RES (524)..(527): Any amino acid

SEQ ID NO: 420361 - protein, 527 aa, Influenza virus; identical to SEQ ID NO: 418693
  MOD_RES (1)..(10): Any amino acid
  MOD_RES (20)..(23): Any amino acid
  MOD_RES (32)..(34): Any amino acid
  MOD_RES (83)..(92): Any amino acid
  MOD_RES (106)..(121): Any amino acid
  MOD_RES (146)..(146): Any amino acid
  MOD_RES (155)..(197): Any amino acid
  MOD_RES (215)..(230): Any amino acid
  MOD_RES (241)..(245): Any amino acid
  MOD_RES (261)..(268): Any amino acid
  MOD_RES (292)..(294): Any amino acid
  MOD_RES (305)..(305): Any amino acid
  MOD_RES (317)..(318): Any amino acid
  MOD_RES (328)..(335): Any amino acid
  MOD_RES (348)..(348): Any amino acid
  MOD_RES (367)..(375): Any amino acid
  MOD_RES (394)..(397): Any amino acid
  MOD_RES (406)..(410): Any amino acid
  MOD_RES (431)..(436): Any amino acid
  MOD_RES (445)..(452): Any amino acid
  MOD_RES (469)..(480): Any amino acid
  MOD_RES (515)..(515): Any amino acid
  MOD_RES (524)..(527): Any amino acid

SEQ ID NO: 420362 - protein, 527 aa, Influenza virus; identical to SEQ ID NO: 418694
  MOD_RES (1)..(11): Any amino acid
  MOD_RES (22)..(23): Any amino acid
  MOD_RES (33)..(34): Any amino acid
  MOD_RES (43)..(49): Any amino acid
  MOD_RES (62)..(67): Any amino acid
  MOD_RES (76)..(77): Any amino acid
  MOD_RES (87)..(95): Any amino acid
  MOD_RES (108)..(122): Any amino acid
  MOD_RES (137)..(205): Any amino acid
  MOD_RES (218)..(230): Any amino acid
  MOD_RES (241)..(248): Any amino acid
  MOD_RES (258)..(269): Any amino acid
  MOD_RES (278)..(278): Any amino acid
  MOD_RES (290)..(295): Any amino acid
  MOD_RES (305)..(305): Any amino acid
  MOD_RES (314)..(320): Any amino acid
  MOD_RES (333)..(375): Any amino acid
  MOD_RES (394)..(412): Any amino acid
  MOD_RES (421)..(421): Any amino acid
  MOD_RES (433)..(452): Any amino acid
  MOD_RES (469)..(480): Any amino acid
  MOD_RES (500)..(504): Any amino acid
  MOD_RES (515)..(527): Any amino acid

SEQ ID NO: 420363 - protein, 308 aa, Influenza virus; identical to SEQ ID NO: 418703
  MOD_RES (37)..(44): Any amino acid
  MOD_RES (65)..(74): Any amino acid
  MOD_RES (90)..(123): Any amino acid
  MOD_RES (136)..(183): Any amino acid
  MOD_RES (193)..(222): Any amino acid
  MOD_RES (231)..(262): Any amino acid
  MOD_RES (280)..(286): Any amino acid

SEQ ID NO: 420364 - protein, 308 aa, Influenza virus; identical to SEQ ID NO: 418704
  MOD_RES (1)..(23): Any amino acid
  MOD_RES (37)..(44): Any amino acid
  MOD_RES (57)..(57): Any amino acid
  MOD_RES (72)..(124): Any amino acid
  MOD_RES (136)..(286): Any amino acid
  MOD_RES (304)..(308): Any amino acid

SEQ ID NO: 420365 - protein, 308 aa, Influenza virus; identical to SEQ ID NO: 418705
  MOD_RES (1)..(23): Any amino acid
  MOD_RES (37)..(44): Any amino acid
  MOD_RES (57)..(57): Any amino acid
  MOD_RES (72)..(125): Any amino acid
  MOD_RES (136)..(286): Any amino acid
  MOD_RES (295)..(308): Any amino acid

SEQ ID NO: 420366 - protein, 308 aa, Influenza virus; identical to SEQ ID NO: 418706
  MOD_RES (1)..(27): Any amino acid
  MOD_RES (37)..(49): Any amino acid
  MOD_RES (72)..(126): Any amino acid
  MOD_RES (135)..(308): Any amino acid

SEQ ID NO: 420367 - protein, 308 aa, Influenza virus; identical to SEQ ID NO: 418707
  MOD_RES (1)..(49): Any amino acid
  MOD_RES (71)..(308): Any amino acid

SEQ ID NO: 420368 - protein, 205 aa, Influenza virus; identical to SEQ ID NO: 418710
  MOD_RES (13)..(13): Any amino acid
  MOD_RES (95)..(100): Any amino acid
  MOD_RES (109)..(146): Any amino acid
  MOD_RES (160)..(168): Any amino acid

SEQ ID NO: 420369 - protein, 205 aa, Influenza virus; identical to SEQ ID NO: 418711
  MOD_RES (1)..(13): Any amino acid
  MOD_RES (33)..(84): Any amino acid
  MOD_RES (95)..(146): Any amino acid
  MOD_RES (160)..(168): Any amino acid
  MOD_RES (201)..(205): Any amino acid

SEQ ID NO: 420370 - protein, 205 aa, Influenza virus; identical to SEQ ID NO: 418712
  MOD_RES (1)..(146): Any amino acid
  MOD_RES (160)..(176): Any amino acid
  MOD_RES (203)..(205): Any amino acid

SEQ ID NO: 420371 - protein, 205 aa, Influenza virus; identical to SEQ ID NO: 418713
  MOD_RES (1)..(146): Any amino acid
  MOD_RES (160)..(178): Any amino acid
  MOD_RES (203)..(205): Any amino acid

SEQ ID NO: 420372 - protein, 205 aa, Influenza virus; identical to SEQ ID NO: 418714
  MOD_RES (1)..(147): Any amino acid
  MOD_RES (158)..(186): Any amino acid
  MOD_RES (200)..(205): Any amino acid

SEQ ID NO: 420373 - protein, 734 aa, Influenza virus; identical to SEQ ID NO: 418715
  MOD_RES (27)..(29): Any amino acid
  MOD_RES (58)..(66): Any amino acid
  MOD_RES (96)..(101): Any amino acid
  MOD_RES (208)..(214): Any amino acid
  MOD_RES (228)..(229): Any amino acid
  MOD_RES (256)..(277): Any amino acid
  MOD_RES (325)..(352): Any amino acid
  MOD_RES (361)..(370): Any amino acid
  MOD_RES (388)..(410): Any amino acid
  MOD_RES (426)..(428): Any amino acid
  MOD_RES (554)..(568): Any amino acid
  MOD_RES (623)..(625): Any amino acid

SEQ ID NO: 420374 - protein, 734 aa, Influenza virus; identical to SEQ ID NO: 418716
  MOD_RES (27)..(29): Any amino acid
  MOD_RES (58)..(66): Any amino acid
  MOD_RES (76)..(77): Any amino acid
  MOD_RES (96)..(101): Any amino acid
  MOD_RES (159)..(159): Any amino acid
  MOD_RES (171)..(175): Any amino acid
  MOD_RES (208)..(214): Any amino acid
  MOD_RES (228)..(229): Any amino acid
  MOD_RES (256)..(277): Any amino acid
  MOD_RES (323)..(370): Any amino acid
  MOD_RES (388)..(410): Any amino acid
  MOD_RES (532)..(532): Any amino acid
  MOD_RES (554)..(568): Any amino acid
  MOD_RES (623)..(625): Any amino acid
  MOD_RES (665)..(666): Any amino acid
  MOD_RES (706)..(713): Any amino acid
  MOD_RES (732)..(734): Any amino acid

SEQ ID NO: 420375 - protein, 734 aa, Influenza virus; identical to SEQ ID NO: 418717
  MOD_RES (27)..(29): Any amino acid
  MOD_RES (58)..(66): Any amino acid
  MOD_RES (96)..(101): Any amino acid
  MOD_RES (208)..(214): Any amino acid
  MOD_RES (228)..(229): Any amino acid
  MOD_RES (256)..(277): Any amino acid
  MOD_RES (287)..(290): Any amino acid
  MOD_RES (325)..(370): Any amino acid
  MOD_RES (388)..(410): Any amino acid
  MOD_RES (428)..(428): Any amino acid
  MOD_RES (506)..(521): Any amino acid
  MOD_RES (532)..(533): Any amino acid
  MOD_RES (554)..(568): Any amino acid
  MOD_RES (578)..(597): Any amino acid
  MOD_RES (623)..(625): Any amino acid
  MOD_RES (647)..(649): Any amino acid
  MOD_RES (684)..(685): Any amino acid
  MOD_RES (705)..(713): Any amino acid
  MOD_RES (727)..(734): Any amino acid

SEQ ID NO: 420376 - protein, 734 aa, Influenza virus; identical to SEQ ID NO: 418718
  MOD_RES (22)..(29): Any amino acid
  MOD_RES (45)..(49): Any amino acid
  MOD_RES (58)..(66): Any amino acid
  MOD_RES (75)..(77): Any amino acid
  MOD_RES (96)..(101): Any amino acid
  MOD_RES (137)..(140): Any amino acid
  MOD_RES (150)..(150): Any amino acid
  MOD_RES (168)..(177): Any amino acid
  MOD_RES (187)..(197): Any amino acid
  MOD_RES (208)..(214): Any amino acid
  MOD_RES (227)..(229): Any amino acid
  MOD_RES (256)..(277): Any amino acid
  MOD_RES (287)..(290): Any amino acid
  MOD_RES (300)..(305): Any amino acid
  MOD_RES (324)..(370): Any amino acid
  MOD_RES (388)..(410): Any amino acid
  MOD_RES (420)..(420): Any amino acid
  MOD_RES (485)..(492): Any amino acid
  MOD_RES (508)..(524): Any amino acid
  MOD_RES (539)..(542): Any amino acid
  MOD_RES (554)..(568): Any amino acid
  MOD_RES (578)..(600): Any amino acid
  MOD_RES (623)..(625): Any amino acid
  MOD_RES (644)..(652): Any amino acid
  MOD_RES (667)..(670): Any amino acid
  MOD_RES (684)..(685): Any amino acid
  MOD_RES (705)..(713): Any amino acid
  MOD_RES (734)..(734): Any amino acid

SEQ ID NO: 420377 - protein, 734 aa, Influenza virus; identical to SEQ ID NO: 418719
  MOD_RES (1)..(1): Any amino acid
  MOD_RES (22)..(29): Any amino acid
  MOD_RES (38)..(49): Any amino acid
  MOD_RES (58)..(79): Any amino acid
  MOD_RES (96)..(101): Any amino acid
  MOD_RES (113)..(124): Any amino acid
  MOD_RES (137)..(140): Any amino acid
  MOD_RES (150)..(150): Any amino acid
  MOD_RES (159)..(163): Any amino acid
  MOD_RES (172)..(178): Any amino acid
  MOD_RES (194)..(200): Any amino acid
  MOD_RES (209)..(214): Any amino acid
  MOD_RES (223)..(238): Any amino acid
  MOD_RES (247)..(292): Any amino acid
  MOD_RES (302)..(312): Any amino acid
  MOD_RES (323)..(371): Any amino acid
  MOD_RES (380)..(418): Any amino acid
  MOD_RES (427)..(430): Any amino acid
  MOD_RES (472)..(525): Any amino acid
  MOD_RES (551)..(568): Any amino acid
  MOD_RES (577)..(604): Any amino acid
  MOD_RES (620)..(625): Any amino acid
  MOD_RES (645)..(654): Any amino acid
  MOD_RES (665)..(670): Any amino acid
  MOD_RES (684)..(713): Any amino acid
  MOD_RES (723)..(734): Any amino acid

SEQ ID NO: 420378 - protein, 829 aa, Influenza virus; identical to SEQ ID NO: 418725
  MOD_RES (58)..(59): Any amino acid
  MOD_RES (115)..(115): Any amino acid
  MOD_RES (156)..(159): Any amino acid
  MOD_RES (174)..(181): Any amino acid
  MOD_RES (213)..(217): Any amino acid
  MOD_RES (376)..(379): Any amino acid
  MOD_RES (388)..(391): Any amino acid
  MOD_RES (404)..(405): Any amino acid
  MOD_RES (440)..(440): Any amino acid
  MOD_RES (462)..(463): Any amino acid
  MOD_RES (585)..(594): Any amino acid
  MOD_RES (625)..(626): Any amino acid
  MOD_RES (667)..(684): Any amino acid
  MOD_RES (801)..(809): Any amino acid

SEQ ID NO: 420379 - protein, 829 aa, Influenza virus; identical to SEQ ID NO: 418726
  MOD_RES (1)..(3): Any amino acid
  MOD_RES (24)..(38): Any amino acid
  MOD_RES (58)..(59): Any amino acid
  MOD_RES (72)..(77): Any amino acid
  MOD_RES (90)..(90): Any amino acid
  MOD_RES (115)..(115): Any amino acid
  MOD_RES (139)..(143): Any amino acid
  MOD_RES (156)..(159): Any amino acid
  MOD_RES (174)..(181): Any amino acid
  MOD_RES (213)..(217): Any amino acid
  MOD_RES (226)..(247): Any amino acid
  MOD_RES (266)..(286): Any amino acid
  MOD_RES (307)..(311): Any amino acid
  MOD_RES (376)..(379): Any amino acid
  MOD_RES (388)..(394): Any amino acid
  MOD_RES (404)..(405): Any amino acid
  MOD_RES (415)..(425): Any amino acid
  MOD_RES (440)..(440): Any amino acid
  MOD_RES (450)..(451): Any amino acid
  MOD_RES (462)..(463): Any amino acid
  MOD_RES (501)..(516): Any amino acid
  MOD_RES (542)..(562): Any amino acid
  MOD_RES (585)..(594): Any amino acid
  MOD_RES (606)..(610): Any amino acid
  MOD_RES (623)..(626): Any amino acid
  MOD_RES (642)..(658): Any amino acid
  MOD_RES (667)..(684): Any amino acid
  MOD_RES (718)..(731): Any amino acid
  MOD_RES (756)..(758): Any amino acid
  MOD_RES (801)..(809): Any amino acid
  MOD_RES (826)..(829): Any amino acid

SEQ ID NO: 420380 - protein, 829 aa, Influenza virus; identical to SEQ ID NO: 418727
  MOD_RES (1)..(4): Any amino acid
  MOD_RES (24)..(48): Any amino acid
  MOD_RES (58)..(59): Any amino acid
  MOD_RES (86)..(91): Any amino acid
  MOD_RES (115)..(115): Any amino acid
  MOD_RES (131)..(146): Any amino acid
  MOD_RES (156)..(159): Any amino acid
  MOD_RES (174)..(181): Any amino acid
  MOD_RES (213)..(217): Any amino acid
  MOD_RES (226)..(251): Any amino acid
  MOD_RES (271)..(292): Any amino acid
  MOD_RES (308)..(311): Any amino acid
  MOD_RES (376)..(379): Any amino acid
  MOD_RES (388)..(394): Any amino acid
  MOD_RES (404)..(405): Any amino acid
  MOD_RES (416)..(428): Any amino acid
  MOD_RES (440)..(440): Any amino acid
  MOD_RES (450)..(453): Any amino acid
  MOD_RES (462)..(463): Any amino acid
  MOD_RES (495)..(530): Any amino acid
  MOD_RES (546)..(565): Any amino acid
  MOD_RES (585)..(595): Any amino acid
  MOD_RES (607)..(613): Any amino acid
  MOD_RES (625)..(626): Any amino acid
  MOD_RES (642)..(658): Any amino acid
  MOD_RES (667)..(684): Any amino acid
  MOD_RES (705)..(743): Any amino acid
  MOD_RES (759)..(764): Any amino acid
  MOD_RES (780)..(784): Any amino acid
  MOD_RES (793)..(829): Any amino acid

SEQ ID NO: 420381 - protein, 829 aa, Influenza virus; identical to SEQ ID NO: 418728
  MOD_RES (1)..(5): Any amino acid
  MOD_RES (23)..(48): Any amino acid
  MOD_RES (58)..(59): Any amino acid
  MOD_RES (87)..(91): Any amino acid
  MOD_RES (115)..(146): Any amino acid
  MOD_RES (156)..(165): Any amino acid
  MOD_RES (174)..(181): Any amino acid
  MOD_RES (213)..(217): Any amino acid
  MOD_RES (230)..(251): Any amino acid
  MOD_RES (271)..(292): Any amino acid
  MOD_RES (302)..(313): Any amino acid
  MOD_RES (343)..(357): Any amino acid
  MOD_RES (375)..(379): Any amino acid
  MOD_RES (388)..(394): Any amino acid
  MOD_RES (404)..(429): Any amino acid
  MOD_RES (440)..(440): Any amino acid
  MOD_RES (450)..(453): Any amino acid
  MOD_RES (462)..(463): Any amino acid
  MOD_RES (472)..(566): Any amino acid
  MOD_RES (585)..(627): Any amino acid
  MOD_RES (642)..(658): Any amino acid
  MOD_RES (667)..(743): Any amino acid
  MOD_RES (759)..(764): Any amino acid
  MOD_RES (780)..(784): Any amino acid
  MOD_RES (793)..(829): Any amino acid

SEQ ID NO: 420382 - protein, 829 aa, Influenza virus; identical to SEQ ID NO: 418729
  MOD_RES (1)..(6): Any amino acid
  MOD_RES (16)..(59): Any amino acid
  MOD_RES (74)..(77): Any amino acid
  MOD_RES (86)..(92): Any amino acid
  MOD_RES (113)..(165): Any amino acid
  MOD_RES (174)..(181): Any amino acid
  MOD_RES (207)..(217): Any amino acid
  MOD_RES (228)..(256): Any amino acid
  MOD_RES (266)..(292): Any amino acid
  MOD_RES (301)..(315): Any amino acid
  MOD_RES (343)..(365): Any amino acid
  MOD_RES (376)..(379): Any amino acid
  MOD_RES (388)..(394): Any amino acid
  MOD_RES (404)..(429): Any amino acid
  MOD_RES (440)..(440): Any amino acid
  MOD_RES (450)..(463): Any amino acid
  MOD_RES (472)..(566): Any amino acid
  MOD_RES (576)..(576): Any amino acid
  MOD_RES (585)..(633): Any amino acid
  MOD_RES (642)..(658): Any amino acid
  MOD_RES (667)..(771): Any amino acid
  MOD_RES (784)..(784): Any amino acid
  MOD_RES (793)..(829): Any amino acid

SEQ ID NO: 420383 - protein, 780 aa, Influenza virus; identical to SEQ ID NO: 418737
  MOD_RES (74)..(78): Any amino acid
  MOD_RES (91)..(94): Any amino acid
  MOD_RES (117)..(121): Any amino acid
  MOD_RES (134)..(139): Any amino acid
  MOD_RES (197)..(198): Any amino acid
  MOD_RES (207)..(210): Any amino acid
  MOD_RES (305)..(308): Any amino acid
  MOD_RES (351)..(353): Any amino acid
  MOD_RES (368)..(368): Any amino acid
  MOD_RES (408)..(411): Any amino acid
  MOD_RES (459)..(469): Any amino acid
  MOD_RES (483)..(491): Any amino acid
  MOD_RES (507)..(507): Any amino acid
  MOD_RES (572)..(573): Any amino acid
  MOD_RES (583)..(583): Any amino acid
  MOD_RES (601)..(601): Any amino acid
  MOD_RES (674)..(674): Any amino acid
  MOD_RES (689)..(698): Any amino acid
  MOD_RES (778)..(780): Any amino acid

SEQ ID NO: 420384 - protein, 780 aa, Influenza virus; identical to SEQ ID NO: 418738
  MOD_RES (57)..(58): Any amino acid
  MOD_RES (74)..(78): Any amino acid
  MOD_RES (91)..(94): Any amino acid
  MOD_RES (117)..(121): Any amino acid
  MOD_RES (134)..(139): Any amino acid
  MOD_RES (177)..(180): Any amino acid
  MOD_RES (197)..(198): Any amino acid
  MOD_RES (207)..(210): Any amino acid
  MOD_RES (220)..(226): Any amino acid
  MOD_RES (292)..(293): Any amino acid
  MOD_RES (305)..(308): Any amino acid
  MOD_RES (339)..(339): Any amino acid
  MOD_RES (351)..(353): Any amino acid
  MOD_RES (368)..(368): Any amino acid
  MOD_RES (408)..(411): Any amino acid
  MOD_RES (429)..(435): Any amino acid
  MOD_RES (459)..(469): Any amino acid
  MOD_RES (483)..(491): Any amino acid
  MOD_RES (507)..(507): Any amino acid
  MOD_RES (572)..(573): Any amino acid
  MOD_RES (583)..(583): Any amino acid
  MOD_RES (601)..(601): Any amino acid
  MOD_RES (612)..(612): Any amino acid
  MOD_RES (644)..(644): Any amino acid
  MOD_RES (674)..(674): Any amino acid
  MOD_RES (689)..(698): Any amino acid

SEQ ID NO: 420385 - protein, 780 aa, Influenza virus; identical to SEQ ID NO: 418739
  MOD_RES (14)..(17): Any amino acid
  MOD_RES (35)..(40): Any amino acid
  MOD_RES (64)..(64): Any amino acid
  MOD_RES (74)..(78): Any amino acid
  MOD_RES (91)..(94): Any amino acid
  MOD_RES (116)..(121): Any amino acid
  MOD_RES (134)..(140): Any amino acid
  MOD_RES (175)..(183): Any amino acid
  MOD_RES (197)..(198): Any amino acid
  MOD_RES (207)..(210): Any amino acid
  MOD_RES (219)..(226): Any amino acid
  MOD_RES (305)..(308): Any amino acid
  MOD_RES (335)..(339): Any amino acid
  MOD_RES (348)..(353): Any amino acid
  MOD_RES (368)..(368): Any amino acid
  MOD_RES (408)..(416): Any amino acid
  MOD_RES (432)..(448): Any amino acid
  MOD_RES (459)..(469): Any amino acid
  MOD_RES (480)..(491): Any amino acid
  MOD_RES (507)..(507): Any amino acid
  MOD_RES (572)..(573): Any amino acid
  MOD_RES (583)..(583): Any amino acid
  MOD_RES (601)..(601): Any amino acid
  MOD_RES (611)..(616): Any amino acid
  MOD_RES (674)..(674): Any amino acid
  MOD_RES (689)..(698): Any amino acid
  MOD_RES (721)..(722): Any amino acid
  MOD_RES (741)..(766): Any amino acid

SEQ ID NO: 420386 - protein, 780 aa, Influenza virus; identical to SEQ ID NO: 418740
  MOD_RES (1)..(17): Any amino acid
  MOD_RES (35)..(43): Any amino acid
  MOD_RES (53)..(64): Any amino acid
  MOD_RES (73)..(81): Any amino acid
  MOD_RES (91)..(94): Any amino acid
  MOD_RES (105)..(106): Any amino acid
  MOD_RES (115)..(121): Any amino acid
  MOD_RES (134)..(140): Any amino acid
  MOD_RES (175)..(187): Any amino acid
  MOD_RES (196)..(198): Any amino acid
  MOD_RES (207)..(230): Any amino acid
  MOD_RES (246)..(254): Any amino acid
  MOD_RES (272)..(276): Any amino acid
  MOD_RES (292)..(308): Any amino acid
  MOD_RES (317)..(320): Any amino acid
  MOD_RES (336)..(341): Any amino acid
  MOD_RES (351)..(356): Any amino acid
  MOD_RES (368)..(368): Any amino acid
  MOD_RES (408)..(416): Any amino acid
  MOD_RES (431)..(449): Any amino acid
  MOD_RES (459)..(469): Any amino acid
  MOD_RES (483)..(491): Any amino acid
  MOD_RES (507)..(507): Any amino acid
  MOD_RES (529)..(529): Any amino acid
  MOD_RES (556)..(574): Any amino acid
  MOD_RES (583)..(583): Any amino acid
  MOD_RES (595)..(601): Any amino acid
  MOD_RES (612)..(619): Any amino acid
  MOD_RES (648)..(648): Any amino acid
  MOD_RES (674)..(674): Any amino acid
  MOD_RES (689)..(698): Any amino acid
  MOD_RES (707)..(708): Any amino acid
  MOD_RES (721)..(723): Any amino acid
  MOD_RES (740)..(766): Any amino acid
  MOD_RES (775)..(780): Any amino acid

SEQ ID NO: 420387 - protein, 780 aa, Influenza virus; identical to SEQ ID NO: 418741
  MOD_RES (1)..(17): Any amino acid
  MOD_RES (26)..(43): Any amino acid
  MOD_RES (55)..(65): Any amino acid
  MOD_RES (74)..(81): Any amino acid
  MOD_RES (91)..(96): Any amino acid
  MOD_RES (111)..(121): Any amino acid
  MOD_RES (134)..(158): Any amino acid
  MOD_RES (176)..(198): Any amino acid
  MOD_RES (207)..(236): Any amino acid
  MOD_RES (246)..(254): Any amino acid
  MOD_RES (268)..(283): Any amino acid
  MOD_RES (292)..(320): Any amino acid
  MOD_RES (336)..(341): Any amino acid
  MOD_RES (351)..(359): Any amino acid
  MOD_RES (368)..(368): Any amino acid
  MOD_RES (378)..(382): Any amino acid
  MOD_RES (408)..(419): Any amino acid
  MOD_RES (430)..(449): Any amino acid
  MOD_RES (459)..(469): Any amino acid
  MOD_RES (483)..(491): Any amino acid
  MOD_RES (507)..(507): Any amino acid
  MOD_RES (524)..(529): Any amino acid
  MOD_RES (539)..(540): Any amino acid
  MOD_RES (551)..(574): Any amino acid
  MOD_RES (583)..(601): Any amino acid
  MOD_RES (611)..(619): Any amino acid
  MOD_RES (634)..(635): Any amino acid
  MOD_RES (651)..(654): Any amino acid
  MOD_RES (670)..(674): Any amino acid
  MOD_RES (689)..(709): Any amino acid
  MOD_RES (732)..(769): Any amino acid
  MOD_RES (778)..(780): Any amino acid

SEQ ID NO: 420388 - protein, 742 aa, Influenza virus; identical to SEQ ID NO: 418749
  MOD_RES (12)..(14): Any amino acid
  MOD_RES (25)..(31): Any amino acid
  MOD_RES (47)..(74): Any amino acid
  MOD_RES (95)..(154): Any amino acid
  MOD_RES (165)..(223): Any amino acid
  MOD_RES (233)..(233): Any amino acid
  MOD_RES (243)..(280): Any amino acid
  MOD_RES (290)..(298): Any amino acid
  MOD_RES (312)..(341): Any amino acid
  MOD_RES (358)..(369): Any amino acid
  MOD_RES (388)..(393): Any amino acid
  MOD_RES (403)..(422): Any amino acid
  MOD_RES (432)..(432): Any amino acid
  MOD_RES (459)..(459): Any amino acid
  MOD_RES (471)..(477): Any amino acid
  MOD_RES (491)..(496): Any amino acid
  MOD_RES (507)..(641): Any amino acid
  MOD_RES (659)..(681): Any amino acid
  MOD_RES (696)..(718): Any amino acid

SEQ ID NO: 420389 - protein, 742 aa, Influenza virus; identical to SEQ ID NO: 418750
  MOD_RES (1)..(2): Any amino acid
  MOD_RES (12)..(14): Any amino acid
  MOD_RES (25)..(40): Any amino acid
  MOD_RES (50)..(223): Any amino acid
  MOD_RES (233)..(341): Any amino acid
  MOD_RES (355)..(378): Any amino acid
  MOD_RES (388)..(422): Any amino acid
  MOD_RES (447)..(459): Any amino acid
  MOD_RES (479)..(479): Any amino acid
  MOD_RES (491)..(688): Any amino acid
  MOD_RES (704)..(732): Any amino acid
  MOD_RES (742)..(742): Any amino acid

SEQ ID NO: 420390 - protein, 742 aa, Influenza virus; identical to SEQ ID NO: 418751
  MOD_RES (1)..(2): Any amino acid
  MOD_RES (12)..(14): Any amino acid
  MOD_RES (25)..(43): Any amino acid
  MOD_RES (53)..(223): Any amino acid
  MOD_RES (233)..(341): Any amino acid
  MOD_RES (351)..(383): Any amino acid
  MOD_RES (395)..(424): Any amino acid
  MOD_RES (440)..(440): Any amino acid
  MOD_RES (450)..(459): Any amino acid
  MOD_RES (479)..(732): Any amino acid

SEQ ID NO: 420391 - protein, 742 aa, Influenza virus; identical to SEQ ID NO: 418752
  MOD_RES (1)..(2): Any amino acid
  MOD_RES (12)..(17): Any amino acid
  MOD_RES (27)..(43): Any amino acid
  MOD_RES (53)..(430): Any amino acid
  MOD_RES (440)..(440): Any amino acid
  MOD_RES (450)..(459): Any amino acid
  MOD_RES (487)..(742): Any amino acid

SEQ ID NO: 420392 - protein, 742 aa, Influenza virus; identical to SEQ ID NO: 418753
  MOD_RES (1)..(17): Any amino acid
  MOD_RES (27)..(430): Any amino acid
  MOD_RES (440)..(461): Any amino acid
  MOD_RES (471)..(742): Any amino acid

SEQ ID NO: 420393 - protein, 694 aa, Influenza virus; identical to SEQ ID NO: 418759
  MOD_RES (27)..(76): Any amino acid
  MOD_RES (88)..(385): Any amino acid
  MOD_RES (397)..(410): Any amino acid
  MOD_RES (421)..(425): Any amino acid
  MOD_RES (435)..(441): Any amino acid
  MOD_RES (451)..(453): Any amino acid
  MOD_RES (463)..(473): Any amino acid
  MOD_RES (483)..(546): Any amino acid
  MOD_RES (557)..(659): Any amino acid
  MOD_RES (677)..(677): Any amino acid
  MOD_RES (687)..(694): Any amino acid

SEQ ID NO: 420394 - protein, 694 aa, Influenza virus; identical to SEQ ID NO: 418760
  MOD_RES (31)..(385): Any amino acid
  MOD_RES (397)..(410): Any amino acid
  MOD_RES (421)..(425): Any amino acid
  MOD_RES (435)..(441): Any amino acid
  MOD_RES (451)..(453): Any amino acid
  MOD_RES (463)..(546): Any amino acid
  MOD_RES (556)..(684): Any amino acid

SEQ ID NO: 420395 - protein, 694 aa, Influenza virus; identical to SEQ ID NO: 418761
  MOD_RES (1)..(1): Any amino acid
  MOD_RES (20)..(385): Any amino acid
  MOD_RES (397)..(411): Any amino acid
  MOD_RES (421)..(425): Any amino acid
  MOD_RES (435)..(441): Any amino acid
  MOD_RES (451)..(694): Any amino acid

SEQ ID NO: 420396 - protein, 694 aa, Influenza virus; identical to SEQ ID NO: 418762
  MOD_RES (1)..(5): Any amino acid
  MOD_RES (19)..(387): Any amino acid
  MOD_RES (397)..(417): Any amino acid
  MOD_RES (428)..(441): Any amino acid
  MOD_RES (451)..(694): Any amino acid

SEQ ID NO: 420397 - protein, 694 aa, Influenza virus; identical to SEQ ID NO: 418763
  MOD_RES (1)..(5): Any amino acid
  MOD_RES (19)..(387): Any amino acid
  MOD_RES (397)..(694): Any amino acid

SEQ ID NO: 420398 - protein, 502 aa, Influenza virus; identical to SEQ ID NO: 418764
  MOD_RES (30)..(43): Any amino acid
  MOD_RES (53)..(110): Any amino acid
  MOD_RES (165)..(165): Any amino acid
  MOD_RES (229)..(237): Any amino acid
  MOD_RES (249)..(249): Any amino acid
  MOD_RES (272)..(276): Any amino acid
  MOD_RES (286)..(289): Any amino acid
  MOD_RES (305)..(307): Any amino acid
  MOD_RES (328)..(330): Any amino acid
  MOD_RES (348)..(364): Any amino acid
  MOD_RES (385)..(389): Any amino acid
  MOD_RES (401)..(416): Any amino acid
  MOD_RES (452)..(454): Any amino acid
  MOD_RES (471)..(472): Any amino acid
  MOD_RES (496)..(502): Any amino acid

SEQ ID NO: 420399 - protein, 502 aa, Influenza virus; identical to SEQ ID NO: 418765
  MOD_RES (20)..(43): Any amino acid
  MOD_RES (53)..(110): Any amino acid
  MOD_RES (165)..(165): Any amino acid
  MOD_RES (190)..(194): Any amino acid
  MOD_RES (229)..(237): Any amino acid
  MOD_RES (248)..(249): Any amino acid
  MOD_RES (263)..(268): Any amino acid
  MOD_RES (286)..(289): Any amino acid
  MOD_RES (305)..(307): Any amino acid
  MOD_RES (328)..(330): Any amino acid
  MOD_RES (348)..(364): Any amino acid
  MOD_RES (385)..(389): Any amino acid
  MOD_RES (401)..(416): Any amino acid
  MOD_RES (452)..(454): Any amino acid
  MOD_RES (471)..(484): Any amino acid
  MOD_RES (496)..(502): Any amino acid

SEQ ID NO: 420400 - protein, 502 aa, Influenza virus; identical to SEQ ID NO: 418766
  MOD_RES (1)..(1): Any amino acid
  MOD_RES (20)..(110): Any amino acid
  MOD_RES (151)..(155): Any amino acid
  MOD_RES (165)..(165): Any amino acid
  MOD_RES (229)..(238): Any amino acid
  MOD_RES (249)..(249): Any amino acid
  MOD_RES (263)..(276): Any amino acid
  MOD_RES (286)..(289): Any amino acid
  MOD_RES (305)..(307): Any amino acid
  MOD_RES (328)..(330): Any amino acid
  MOD_RES (348)..(364): Any amino acid
  MOD_RES (381)..(389): Any amino acid
  MOD_RES (401)..(416): Any amino acid
  MOD_RES (426)..(426): Any amino acid
  MOD_RES (452)..(455): Any amino acid
  MOD_RES (471)..(484): Any amino acid
  MOD_RES (496)..(502): Any amino acid

SEQ ID NO: 420401 - protein, 502 aa, Influenza virus; identical to SEQ ID NO: 418767
  MOD_RES (1)..(5): Any amino acid
  MOD_RES (28)..(110): Any amino acid
  MOD_RES (137)..(141): Any amino acid
  MOD_RES (151)..(155): Any amino acid
  MOD_RES (165)..(165): Any amino acid
  MOD_RES (187)..(194): Any amino acid
  MOD_RES (229)..(249): Any amino acid
  MOD_RES (263)..(289): Any amino acid
  MOD_RES (305)..(307): Any amino acid
  MOD_RES (328)..(330): Any amino acid
  MOD_RES (347)..(364): Any amino acid
  MOD_RES (384)..(416): Any amino acid
  MOD_RES (426)..(427): Any amino acid
  MOD_RES (452)..(455): Any amino acid
  MOD_RES (466)..(484): Any amino acid
  MOD_RES (496)..(502): Any amino acid

SEQ ID NO: 420402 - protein, 502 aa, Influenza virus; identical to SEQ ID NO: 418768
  MOD_RES (1)..(110): Any amino acid
  MOD_RES (137)..(155): Any amino acid
  MOD_RES (165)..(165): Any amino acid
  MOD_RES (187)..(194): Any amino acid
  MOD_RES (204)..(205): Any amino acid
  MOD_RES (229)..(249): Any amino acid
  MOD_RES (259)..(289): Any amino acid
  MOD_RES (302)..(318): Any amino acid
  MOD_RES (328)..(330): Any amino acid
  MOD_RES (348)..(364): Any amino acid
  MOD_RES (384)..(435): Any amino acid
  MOD_RES (448)..(455): Any amino acid
  MOD_RES (471)..(486): Any amino acid
  MOD_RES (496)..(502): Any amino acid

SEQ ID NO: 420403 - protein, 494 aa, Influenza virus; identical to SEQ ID NO: 418771
  MOD_RES (22)..(53): Any amino acid
  MOD_RES (63)..(71): Any amino acid
  MOD_RES (81)..(85): Any amino acid
  MOD_RES (96)..(109): Any amino acid
  MOD_RES (127)..(127): Any amino acid
  MOD_RES (140)..(141): Any amino acid
  MOD_RES (155)..(167): Any amino acid
  MOD_RES (211)..(234): Any amino acid
  MOD_RES (250)..(250): Any amino acid
  MOD_RES (263)..(285): Any amino acid
  MOD_RES (301)..(303): Any amino acid
  MOD_RES (329)..(333): Any amino acid
  MOD_RES (347)..(364): Any amino acid
  MOD_RES (375)..(388): Any amino acid
  MOD_RES (398)..(421): Any amino acid
  MOD_RES (432)..(434): Any amino acid
  MOD_RES (449)..(453): Any amino acid

SEQ ID NO: 420404 - protein, 494 aa, Influenza virus; identical to SEQ ID NO: 418772
  MOD_RES (1)..(53): Any amino acid
  MOD_RES (63)..(109): Any amino acid
  MOD_RES (127)..(127): Any amino acid
  MOD_RES (140)..(141): Any amino acid
  MOD_RES (151)..(167): Any amino acid
  MOD_RES (211)..(234): Any amino acid
  MOD_RES (250)..(250): Any amino acid
  MOD_RES (263)..(285): Any amino acid
  MOD_RES (301)..(303): Any amino acid
  MOD_RES (320)..(333): Any amino acid
  MOD_RES (347)..(364): Any amino acid
  MOD_RES (375)..(388): Any amino acid
  MOD_RES (398)..(421): Any amino acid
  MOD_RES (432)..(434): Any amino acid
  MOD_RES (449)..(453): Any amino acid
  MOD_RES (493)..(494): Any amino acid

SEQ ID NO: 420405 - protein, 494 aa, Influenza virus; identical to SEQ ID NO: 418773
  MOD_RES (1)..(58): Any amino acid
  MOD_RES (70)..(109): Any amino acid
  MOD_RES (127)..(127): Any amino acid
  MOD_RES (140)..(141): Any amino acid
  MOD_RES (151)..(167): Any amino acid
  MOD_RES (208)..(234): Any amino acid
  MOD_RES (250)..(250): Any amino acid
  MOD_RES (263)..(285): Any amino acid
  MOD_RES (301)..(303): Any amino acid
  MOD_RES (320)..(333): Any amino acid
  MOD_RES (347)..(364): Any amino acid
  MOD_RES (375)..(388): Any amino acid
  MOD_RES (398)..(421): Any amino acid
  MOD_RES (432)..(439): Any amino acid
  MOD_RES (449)..(453): Any amino acid
  MOD_RES (492)..(494): Any amino acid

SEQ ID NO: 420406 - protein, 494 aa, Influenza virus; identical to SEQ ID NO: 418774
  MOD_RES (1)..(109): Any amino acid
  MOD_RES (124)..(127): Any amino acid
  MOD_RES (140)..(167): Any amino acid
  MOD_RES (211)..(234): Any amino acid
  MOD_RES (250)..(250): Any amino acid
  MOD_RES (263)..(290): Any amino acid
  MOD_RES (309)..(310): Any amino acid
  MOD_RES (320)..(337): Any amino acid
  MOD_RES (347)..(365): Any amino acid
  MOD_RES (375)..(388): Any amino acid
  MOD_RES (398)..(453): Any amino acid
  MOD_RES (493)..(494): Any amino acid

SEQ ID NO: 420407 - protein, 494 aa, Influenza virus; identical to SEQ ID NO: 418775
  MOD_RES (1)..(110): Any amino acid
  MOD_RES (123)..(130): Any amino acid
  MOD_RES (140)..(167): Any amino acid
  MOD_RES (177)..(177): Any amino acid
  MOD_RES (188)..(234): Any amino acid
  MOD_RES (250)..(253): Any amino acid
  MOD_RES (263)..(291): Any amino acid
  MOD_RES (301)..(304): Any amino acid
  MOD_RES (314)..(337): Any amino acid
  MOD_RES (347)..(365): Any amino acid
  MOD_RES (375)..(388): Any amino acid
  MOD_RES (398)..(455): Any amino acid
  MOD_RES (471)..(473): Any amino acid
  MOD_RES (483)..(483): Any amino acid
  MOD_RES (493)..(494): Any amino acid

SEQ ID NO: 420408 - protein, 515 aa, Influenza virus; identical to SEQ ID NO: 418781
  MOD_RES (1)..(20): Any amino acid
  MOD_RES (37)..(88): Any amino acid
  MOD_RES (112)..(114): Any amino acid
  MOD_RES (127)..(127): Any amino acid
  MOD_RES (175)..(175): Any amino acid
  MOD_RES (195)..(266): Any amino acid
  MOD_RES (281)..(288): Any amino acid
  MOD_RES (306)..(318): Any amino acid
  MOD_RES (332)..(332): Any amino acid
  MOD_RES (379)..(390): Any amino acid
  MOD_RES (401)..(401): Any amino acid
  MOD_RES (413)..(415): Any amino acid
  MOD_RES (425)..(438): Any amino acid
  MOD_RES (458)..(460): Any amino acid
  MOD_RES (476)..(481): Any amino acid

SEQ ID NO: 420409 - protein, 515 aa, Influenza virus; identical to SEQ ID NO: 418782
  MOD_RES (1)..(20): Any amino acid
  MOD_RES (37)..(88): Any amino acid
  MOD_RES (112)..(114): Any amino acid
  MOD_RES (127)..(127): Any amino acid
  MOD_RES (175)..(175): Any amino acid
  MOD_RES (195)..(266): Any amino acid
  MOD_RES (281)..(288): Any amino acid
  MOD_RES (306)..(318): Any amino acid
  MOD_RES (332)..(332): Any amino acid
  MOD_RES (379)..(390): Any amino acid
  MOD_RES (401)..(401): Any amino acid
  MOD_RES (412)..(415): Any amino acid
  MOD_RES (425)..(438): Any amino acid
  MOD_RES (458)..(460): Any amino acid
  MOD_RES (476)..(481): Any amino acid

SEQ ID NO: 420410 - protein, 515 aa, Influenza virus; identical to SEQ ID NO: 418783
  MOD_RES (1)..(20): Any amino acid
  MOD_RES (37)..(88): Any amino acid
  MOD_RES (112)..(114): Any amino acid
  MOD_RES (124)..(127): Any amino acid
  MOD_RES (175)..(175): Any amino acid
  MOD_RES (195)..(266): Any amino acid
  MOD_RES (277)..(288): Any amino acid
  MOD_RES (306)..(318): Any amino acid
  MOD_RES (332)..(332): Any amino acid
  MOD_RES (379)..(390): Any amino acid
  MOD_RES (401)..(401): Any amino acid
  MOD_RES (413)..(415): Any amino acid
  MOD_RES (425)..(438): Any amino acid
  MOD_RES (448)..(448): Any amino acid
  MOD_RES (458)..(460): Any amino acid
  MOD_RES (476)..(481): Any amino acid
  MOD_RES (503)..(503): Any amino acid

SEQ ID NO: 420411 - protein, 515 aa, Influenza virus; identical to SEQ ID NO: 418784
  MOD_RES (1)..(20): Any amino acid
  MOD_RES (37)..(102): Any amino acid
  MOD_RES (112)..(114): Any amino acid
  MOD_RES (127)..(127): Any amino acid
  MOD_RES (173)..(184): Any amino acid
  MOD_RES (195)..(266): Any amino acid
  MOD_RES (276)..(288): Any amino acid
  MOD_RES (306)..(318): Any amino acid
  MOD_RES (329)..(332): Any amino acid
  MOD_RES (343)..(343): Any amino acid
  MOD_RES (379)..(390): Any amino acid
  MOD_RES (401)..(401): Any amino acid
  MOD_RES (412)..(415): Any amino acid
  MOD_RES (425)..(438): Any amino acid
  MOD_RES (458)..(460): Any amino acid
  MOD_RES (470)..(481): Any amino acid
  MOD_RES (491)..(499): Any amino acid
  MOD_RES (514)..(515): Any amino acid

SEQ ID NO: 420412 - protein, 515 aa, Influenza virus; identical to SEQ ID NO: 418785
  MOD_RES (1)..(20): Any amino acid
  MOD_RES (30)..(114): Any amino acid
  MOD_RES (127)..(127): Any amino acid
  MOD_RES (137)..(144): Any amino acid
  MOD_RES (165)..(165): Any amino acid
  MOD_RES (175)..(266): Any amino acid
  MOD_RES (276)..(288): Any amino acid
  MOD_RES (306)..(318): Any amino acid
  MOD_RES (330)..(344): Any amino acid
  MOD_RES (379)..(390): Any amino acid
  MOD_RES (400)..(401): Any amino acid
  MOD_RES (413)..(438): Any amino acid
  MOD_RES (448)..(466): Any amino acid
  MOD_RES (476)..(482): Any amino acid
  MOD_RES (492)..(499): Any amino acid
  MOD_RES (509)..(515): Any amino acid

SEQ ID NO: 420413 - protein, 470 aa, Influenza virus; identical to SEQ ID NO: 418790
  MOD_RES (16)..(16): Any amino acid
  MOD_RES (44)..(47): Any amino acid
  MOD_RES (74)..(89): Any amino acid
  MOD_RES (264)..(269): Any amino acid
  MOD_RES (335)..(335): Any amino acid

SEQ ID NO: 420414 - protein, 470 aa, Influenza virus; identical to SEQ ID NO: 418791
  MOD_RES (16)..(16): Any amino acid
  MOD_RES (29)..(31): Any amino acid
  MOD_RES (44)..(47): Any amino acid
  MOD_RES (74)..(89): Any amino acid
  MOD_RES (103)..(111): Any amino acid
  MOD_RES (135)..(153): Any amino acid
  MOD_RES (171)..(178): Any amino acid
  MOD_RES (224)..(232): Any amino acid
  MOD_RES (264)..(269): Any amino acid
  MOD_RES (335)..(335): Any amino acid
  MOD_RES (347)..(356): Any amino acid
  MOD_RES (468)..(470): Any amino acid

SEQ ID NO: 420415 - protein, 470 aa, Influenza virus; identical to SEQ ID NO: 418792
  MOD_RES (16)..(17): Any amino acid
  MOD_RES (31)..(32): Any amino acid
  MOD_RES (44)..(56): Any amino acid
  MOD_RES (74)..(89): Any amino acid
  MOD_RES (102)..(112): Any amino acid
  MOD_RES (135)..(153): Any amino acid
  MOD_RES (171)..(183): Any amino acid
  MOD_RES (219)..(232): Any amino acid
  MOD_RES (264)..(269): Any amino acid
  MOD_RES (295)..(295): Any amino acid
  MOD_RES (335)..(335): Any amino acid
  MOD_RES (345)..(361): Any amino acid
  MOD_RES (396)..(427): Any amino acid
  MOD_RES (466)..(470): Any amino acid

SEQ ID NO: 420416 - protein, 470 aa, Influenza virus; identical to SEQ ID NO: 418793
  MOD_RES (1)..(1): Any amino acid
  MOD_RES (16)..(18): Any amino acid
  MOD_RES (43)..(56): Any amino acid
  MOD_RES (74)..(116): Any amino acid
  MOD_RES (134)..(156): Any amino acid
  MOD_RES (170)..(190): Any amino acid
  MOD_RES (212)..(238): Any amino acid
  MOD_RES (263)..(269): Any amino acid
  MOD_RES (295)..(300): Any amino acid
  MOD_RES (318)..(318): Any amino acid
  MOD_RES (335)..(375): Any amino acid
  MOD_RES (391)..(427): Any amino acid
  MOD_RES (442)..(446): Any amino acid

SEQ ID NO: 420417 - protein, 470 aa, Influenza virus; identical to SEQ ID NO: 418794
  MOD_RES (1)..(3): Any amino acid
  MOD_RES (16)..(18): Any amino acid
  MOD_RES (29)..(34): Any amino acid
  MOD_RES (44)..(60): Any amino acid
  MOD_RES (72)..(120): Any amino acid
  MOD_RES (130)..(157): Any amino acid
  MOD_RES (169)..(197): Any amino acid
  MOD_RES (208)..(247): Any amino acid
  MOD_RES (264)..(269): Any amino acid
  MOD_RES (279)..(285): Any amino acid
  MOD_RES (295)..(302): Any amino acid
  MOD_RES (331)..(446): Any amino acid
  MOD_RES (457)..(470): Any amino acid

SEQ ID NO: 420418 - protein, 473 aa, Influenza virus; identical to SEQ ID NO: 418797
  MOD_RES (18)..(20): Any amino acid
  MOD_RES (30)..(47): Any amino acid
  MOD_RES (61)..(61): Any amino acid
  MOD_RES (71)..(79): Any amino acid
  MOD_RES (189)..(190): Any amino acid
  MOD_RES (234)..(234): Any amino acid
  MOD_RES (257)..(264): Any amino acid
  MOD_RES (302)..(308): Any amino acid
  MOD_RES (329)..(336): Any amino acid
  MOD_RES (383)..(393): Any amino acid
  MOD_RES (413)..(418): Any amino acid

SEQ ID NO: 420419 - protein, 473 aa, Influenza virus; identical to SEQ ID NO: 418798
  MOD_RES (1)..(4): Any amino acid
  MOD_RES (18)..(20): Any amino acid
  MOD_RES (30)..(47): Any amino acid
  MOD_RES (60)..(61): Any amino acid
  MOD_RES (71)..(79): Any amino acid
  MOD_RES (149)..(151): Any amino acid
  MOD_RES (189)..(190): Any amino acid
  MOD_RES (234)..(236): Any amino acid
  MOD_RES (257)..(264): Any amino acid
  MOD_RES (291)..(291): Any amino acid
  MOD_RES (302)..(308): Any amino acid
  MOD_RES (329)..(336): Any amino acid
  MOD_RES (347)..(348): Any amino acid
  MOD_RES (383)..(393): Any amino acid
  MOD_RES (413)..(418): Any amino acid
  MOD_RES (473)..(473): Any amino acid

SEQ ID NO: 420420 - protein, 473 aa, Influenza virus; identical to SEQ ID NO: 418799
  MOD_RES (1)..(4): Any amino acid
  MOD_RES (18)..(20): Any amino acid
  MOD_RES (30)..(47): Any amino acid
  MOD_RES (61)..(61): Any amino acid
  MOD_RES (71)..(79): Any amino acid
  MOD_RES (131)..(132): Any amino acid
  MOD_RES (144)..(152): Any amino acid
  MOD_RES (189)..(190): Any amino acid
  MOD_RES (234)..(237): Any amino acid
  MOD_RES (257)..(264): Any amino acid
  MOD_RES (291)..(308): Any amino acid
  MOD_RES (319)..(319): Any amino acid
  MOD_RES (329)..(336): Any amino acid
  MOD_RES (383)..(393): Any amino acid
  MOD_RES (408)..(425): Any amino acid
  MOD_RES (443)..(448): Any amino acid
  MOD_RES (472)..(473): Any amino acid

SEQ ID NO: 420421 - protein, 473 aa, Influenza virus; identical to SEQ ID NO: 418800
  MOD_RES (1)..(4): Any amino acid
  MOD_RES (18)..(47): Any amino acid
  MOD_RES (61)..(61): Any amino acid
  MOD_RES (71)..(79): Any amino acid
  MOD_RES (106)..(115): Any amino acid
  MOD_RES (129)..(155): Any amino acid
  MOD_RES (171)..(171): Any amino acid
  MOD_RES (189)..(190): Any amino acid
  MOD_RES (201)..(204): Any amino acid
  MOD_RES (222)..(223): Any amino acid
  MOD_RES (234)..(237): Any amino acid
  MOD_RES (257)..(264): Any amino acid
  MOD_RES (293)..(308): Any amino acid
  MOD_RES (319)..(319): Any amino acid
  MOD_RES (329)..(336): Any amino acid
  MOD_RES (346)..(349): Any amino acid
  MOD_RES (383)..(393): Any amino acid
  MOD_RES (408)..(427): Any amino acid
  MOD_RES (445)..(449): Any amino acid
  MOD_RES (460)..(473): Any amino acid

SEQ ID NO: 420422 - protein, 473 aa, Influenza virus; identical to SEQ ID NO: 418801
  MOD_RES (1)..(5): Any amino acid
  MOD_RES (18)..(47): Any amino acid
  MOD_RES (61)..(61): Any amino acid
  MOD_RES (71)..(87): Any amino acid
  MOD_RES (105)..(115): Any amino acid
  MOD_RES (133)..(179): Any amino acid
  MOD_RES (189)..(192): Any amino acid
  MOD_RES (204)..(204): Any amino acid
  MOD_RES (228)..(242): Any amino acid
  MOD_RES (257)..(265): Any amino acid
  MOD_RES (290)..(319): Any amino acid
  MOD_RES (329)..(337): Any amino acid
  MOD_RES (347)..(356): Any amino acid
  MOD_RES (367)..(393): Any amino acid
  MOD_RES (413)..(432): Any amino acid
  MOD_RES (444)..(450): Any amino acid
  MOD_RES (464)..(473): Any amino acid

SEQ ID NO: 420423 - protein, 471 aa, Influenza virus; identical to SEQ ID NO: 418804
  MOD_RES (37)..(55): Any amino acid
  MOD_RES (65)..(89): Any amino acid
  MOD_RES (128)..(128): Any amino acid
  MOD_RES (173)..(174): Any amino acid
  MOD_RES (210)..(214): Any amino acid
  MOD_RES (253)..(271): Any amino acid
  MOD_RES (286)..(288): Any amino acid
  MOD_RES (309)..(311): Any amino acid
  MOD_RES (334)..(343): Any amino acid
  MOD_RES (360)..(360): Any amino acid
  MOD_RES (386)..(397): Any amino acid
  MOD_RES (416)..(417): Any amino acid

SEQ ID NO: 420424 - protein, 471 aa, Influenza virus; identical to SEQ ID NO: 418805
  MOD_RES (37)..(89): Any amino acid
  MOD_RES (128)..(128): Any amino acid
  MOD_RES (173)..(174): Any amino acid
  MOD_RES (210)..(214): Any amino acid
  MOD_RES (227)..(227): Any amino acid
  MOD_RES (253)..(271): Any amino acid
  MOD_RES (286)..(288): Any amino acid
  MOD_RES (309)..(311): Any amino acid
  MOD_RES (334)..(343): Any amino acid
  MOD_RES (360)..(360): Any amino acid
  MOD_RES (386)..(397): Any amino acid
  MOD_RES (416)..(417): Any amino acid

SEQ ID NO: 420425 - protein, 471 aa, Influenza virus; identical to SEQ ID NO: 418806
  MOD_RES (24)..(24): Any amino acid
  MOD_RES (35)..(89): Any amino acid
  MOD_RES (103)..(103): Any amino acid
  MOD_RES (121)..(128): Any amino acid
  MOD_RES (173)..(174): Any amino acid
  MOD_RES (203)..(214): Any amino acid
  MOD_RES (250)..(271): Any amino acid
  MOD_RES (282)..(288): Any amino acid
  MOD_RES (309)..(311): Any amino acid
  MOD_RES (334)..(343): Any amino acid
  MOD_RES (360)..(363): Any amino acid
  MOD_RES (386)..(397): Any amino acid
  MOD_RES (416)..(418): Any amino acid

SEQ ID NO: 420426 - protein, 471 aa, Influenza virus; identical to SEQ ID NO: 418807
  MOD_RES (1)..(3): Any amino acid
  MOD_RES (37)..(89): Any amino acid
  MOD_RES (121)..(141): Any amino acid
  MOD_RES (172)..(174): Any amino acid
  MOD_RES (210)..(214): Any amino acid
  MOD_RES (227)..(229): Any amino acid
  MOD_RES (243)..(243): Any amino acid
  MOD_RES (253)..(271): Any amino acid
  MOD_RES (281)..(297): Any amino acid
  MOD_RES (309)..(311): Any amino acid
  MOD_RES (331)..(343): Any amino acid
  MOD_RES (360)..(363): Any amino acid
  MOD_RES (381)..(397): Any amino acid
  MOD_RES (416)..(426): Any amino acid
  MOD_RES (463)..(471): Any amino acid

SEQ ID NO: 420427 - protein, 471 aa, Influenza virus; identical to SEQ ID NO: 418808
  MOD_RES (1)..(8): Any amino acid
  MOD_RES (24)..(24): Any amino acid
  MOD_RES (36)..(104): Any amino acid
  MOD_RES (121)..(147): Any amino acid
  MOD_RES (165)..(180): Any amino acid
  MOD_RES (202)..(215): Any amino acid
  MOD_RES (225)..(233): Any amino acid
  MOD_RES (243)..(243): Any amino acid
  MOD_RES (253)..(272): Any amino acid
  MOD_RES (282)..(299): Any amino acid
  MOD_RES (309)..(311): Any amino acid
  MOD_RES (331)..(349): Any amino acid
  MOD_RES (360)..(369): Any amino acid
  MOD_RES (386)..(398): Any amino acid
  MOD_RES (408)..(428): Any amino acid
  MOD_RES (438)..(445): Any amino acid
  MOD_RES (455)..(471): Any amino acid

SEQ ID NO: 420428 - protein, 471 aa, Influenza virus; identical to SEQ ID NO: 418810
  MOD_RES (16)..(19): Any amino acid
  MOD_RES (39)..(61): Any amino acid
  MOD_RES (73)..(82): Any amino acid
  MOD_RES (94)..(94): Any amino acid
  MOD_RES (164)..(168): Any amino acid
  MOD_RES (251)..(267): Any amino acid
  MOD_RES (285)..(285): Any amino acid
  MOD_RES (308)..(311): Any amino acid
  MOD_RES (332)..(333): Any amino acid
  MOD_RES (357)..(357): Any amino acid
  MOD_RES (387)..(400): Any amino acid
  MOD_RES (416)..(416): Any amino acid

SEQ ID NO: 420429 - protein, 471 aa, Influenza virus; identical to SEQ ID NO: 418811
  MOD_RES (16)..(19): Any amino acid
  MOD_RES (39)..(61): Any amino acid
  MOD_RES (73)..(82): Any amino acid
  MOD_RES (94)..(94): Any amino acid
  MOD_RES (114)..(117): Any amino acid
  MOD_RES (164)..(168): Any amino acid
  MOD_RES (251)..(267): Any amino acid
  MOD_RES (285)..(285): Any amino acid
  MOD_RES (308)..(311): Any amino acid
  MOD_RES (332)..(333): Any amino acid
  MOD_RES (357)..(357): Any amino acid
  MOD_RES (387)..(400): Any amino acid
  MOD_RES (416)..(416): Any amino acid
  MOD_RES (426)..(429): Any amino acid

SEQ ID NO: 420430 - protein, 471 aa, Influenza virus; identical to SEQ ID NO: 418812
  MOD_RES (16)..(19): Any amino acid
  MOD_RES (39)..(61): Any amino acid
  MOD_RES (73)..(82): Any amino acid
  MOD_RES (94)..(94): Any amino acid
  MOD_RES (136)..(137): Any amino acid
  MOD_RES (164)..(168): Any amino acid
  MOD_RES (239)..(240): Any amino acid
  MOD_RES (251)..(267): Any amino acid
  MOD_RES (284)..(285): Any amino acid
  MOD_RES (308)..(311): Any amino acid
  MOD_RES (332)..(333): Any amino acid
  MOD_RES (357)..(357): Any amino acid
  MOD_RES (384)..(400): Any amino acid
  MOD_RES (416)..(416): Any amino acid
  MOD_RES (427)..(431): Any amino acid

SEQ ID NO: 420431 - protein, 471 aa, Influenza virus; identical to SEQ ID NO: 418813
  MOD_RES (13)..(19): Any amino acid
  MOD_RES (39)..(61): Any amino acid
  MOD_RES (71)..(82): Any amino acid
  MOD_RES (94)..(94): Any amino acid
  MOD_RES (136)..(139): Any amino acid
  MOD_RES (162)..(168): Any amino acid
  MOD_RES (199)..(200): Any amino acid
  MOD_RES (251)..(267): Any amino acid
  MOD_RES (283)..(285): Any amino acid
  MOD_RES (296)..(297): Any amino acid
  MOD_RES (308)..(311): Any amino acid
  MOD_RES (332)..(336): Any amino acid
  MOD_RES (349)..(357): Any amino acid
  MOD_RES (382)..(416): Any amino acid
  MOD_RES (427)..(433): Any amino acid
  MOD_RES (471)..(471): Any amino acid

SEQ ID NO: 420432 - protein, 471 aa, Influenza virus; identical to SEQ ID NO: 418814
  MOD_RES (1)..(1): Any amino acid
  MOD_RES (16)..(19): Any amino acid
  MOD_RES (36)..(62): Any amino acid
  MOD_RES (73)..(83): Any amino acid
  MOD_RES (94)..(96): Any amino acid
  MOD_RES (114)..(143): Any amino acid
  MOD_RES (164)..(168): Any amino acid
  MOD_RES (181)..(182): Any amino acid
  MOD_RES (206)..(206): Any amino acid
  MOD_RES (251)..(269): Any amino acid
  MOD_RES (285)..(285): Any amino acid
  MOD_RES (297)..(320): Any amino acid
  MOD_RES (330)..(336): Any amino acid
  MOD_RES (346)..(357): Any amino acid
  MOD_RES (387)..(416): Any amino acid
  MOD_RES (426)..(445): Any amino acid
  MOD_RES (455)..(455): Any amino acid
  MOD_RES (468)..(471): Any amino acid

SEQ ID NO: 420433 - protein, 548 aa, Influenza virus; identical to SEQ ID NO: 418818
  MOD_RES (1)..(51): Any amino acid
  MOD_RES (61)..(168): Any amino acid
  MOD_RES (201)..(201): Any amino acid
  MOD_RES (267)..(291): Any amino acid
  MOD_RES (326)..(344): Any amino acid
  MOD_RES (408)..(417): Any amino acid
  MOD_RES (435)..(470): Any amino acid
  MOD_RES (489)..(491): Any amino acid
  MOD_RES (510)..(510): Any amino acid
  MOD_RES (527)..(528): Any amino acid

SEQ ID NO: 420434 - protein, 548 aa, Influenza virus; identical to SEQ ID NO: 418819
  MOD_RES (1)..(51): Any amino acid
  MOD_RES (61)..(168): Any amino acid
  MOD_RES (198)..(201): Any amino acid
  MOD_RES (267)..(291): Any amino acid
  MOD_RES (326)..(344): Any amino acid
  MOD_RES (368)..(368): Any amino acid
  MOD_RES (406)..(417): Any amino acid
  MOD_RES (435)..(470): Any amino acid
  MOD_RES (489)..(491): Any amino acid
  MOD_RES (510)..(510): Any amino acid
  MOD_RES (527)..(528): Any amino acid
  MOD_RES (544)..(548): Any amino acid

SEQ ID NO: 420435 - protein, 548 aa, Influenza virus; identical to SEQ ID NO: 418820
  MOD_RES (1)..(51): Any amino acid
  MOD_RES (61)..(168): Any amino acid
  MOD_RES (178)..(179): Any amino acid
  MOD_RES (197)..(201): Any amino acid
  MOD_RES (255)..(256): Any amino acid
  MOD_RES (266)..(291): Any amino acid
  MOD_RES (326)..(344): Any amino acid
  MOD_RES (408)..(417): Any amino acid
  MOD_RES (435)..(470): Any amino acid
  MOD_RES (489)..(491): Any amino acid
  MOD_RES (510)..(510): Any amino acid
  MOD_RES (527)..(528): Any amino acid

SEQ ID NO: 420436 - protein, 548 aa, Influenza virus; identical to SEQ ID NO: 418821
  MOD_RES (1)..(51): Any amino acid
  MOD_RES (61)..(168): Any amino acid
  MOD_RES (178)..(187): Any amino acid
  MOD_RES (199)..(201): Any amino acid
  MOD_RES (248)..(257): Any amino acid
  MOD_RES (267)..(291): Any amino acid
  MOD_RES (326)..(344): Any amino acid
  MOD_RES (356)..(356): Any amino acid
  MOD_RES (368)..(370): Any amino acid
  MOD_RES (380)..(383): Any amino acid
  MOD_RES (395)..(396): Any amino acid
  MOD_RES (408)..(424): Any amino acid
  MOD_RES (435)..(470): Any amino acid
  MOD_RES (489)..(491): Any amino acid
  MOD_RES (501)..(510): Any amino acid
  MOD_RES (527)..(528): Any amino acid
  MOD_RES (544)..(548): Any amino acid

SEQ ID NO: 420437 - protein, 548 aa, Influenza virus; identical to SEQ ID NO: 418822
  MOD_RES (1)..(51): Any amino acid
  MOD_RES (61)..(206): Any amino acid
  MOD_RES (256)..(257): Any amino acid
  MOD_RES (267)..(291): Any amino acid
  MOD_RES (301)..(344): Any amino acid
  MOD_RES (355)..(371): Any amino acid
  MOD_RES (395)..(396): Any amino acid
  MOD_RES (408)..(491): Any amino acid
  MOD_RES (501)..(517): Any amino acid
  MOD_RES (527)..(529): Any amino acid
  MOD_RES (542)..(548): Any amino acid

SEQ ID NO: 420438 - protein, 470 aa, Influenza virus; identical to SEQ ID NO: 418825
  MOD_RES (16)..(26): Any amino acid
  MOD_RES (40)..(53): Any amino acid
  MOD_RES (76)..(84): Any amino acid
  MOD_RES (286)..(288): Any amino acid
  MOD_RES (310)..(310): Any amino acid
  MOD_RES (359)..(359): Any amino acid
  MOD_RES (392)..(392): Any amino acid

SEQ ID NO: 420439 - protein, 470 aa, Influenza virus; identical to SEQ ID NO: 418826
  MOD_RES (16)..(26): Any amino acid
  MOD_RES (40)..(53): Any amino acid
  MOD_RES (66)..(66): Any amino acid
  MOD_RES (76)..(84): Any amino acid
  MOD_RES (135)..(135): Any amino acid
  MOD_RES (224)..(227): Any amino acid
  MOD_RES (283)..(288): Any amino acid
  MOD_RES (310)..(310): Any amino acid
  MOD_RES (320)..(325): Any amino acid
  MOD_RES (359)..(359): Any amino acid
  MOD_RES (392)..(392): Any amino acid
  MOD_RES (425)..(427): Any amino acid
  MOD_RES (469)..(470): Any amino acid

SEQ ID NO: 420440 - protein, 470 aa, Influenza virus; identical to SEQ ID NO: 418827
  MOD_RES (11)..(26): Any amino acid
  MOD_RES (36)..(53): Any amino acid
  MOD_RES (76)..(84): Any amino acid
  MOD_RES (119)..(119): Any amino acid
  MOD_RES (137)..(151): Any amino acid
  MOD_RES (175)..(181): Any amino acid
  MOD_RES (223)..(227): Any amino acid
  MOD_RES (245)..(247): Any amino acid
  MOD_RES (260)..(261): Any amino acid
  MOD_RES (286)..(288): Any amino acid
  MOD_RES (299)..(299): Any amino acid
  MOD_RES (310)..(310): Any amino acid
  MOD_RES (320)..(325): Any amino acid
  MOD_RES (355)..(359): Any amino acid
  MOD_RES (392)..(392): Any amino acid
  MOD_RES (427)..(428): Any amino acid
  MOD_RES (446)..(456): Any amino acid

SEQ ID NO: 420441 - protein, 470 aa, Influenza virus; identical to SEQ ID NO: 418828
  MOD_RES (1)..(1): Any amino acid
  MOD_RES (16)..(26): Any amino acid
  MOD_RES (40)..(53): Any amino acid
  MOD_RES (76)..(84): Any amino acid
  MOD_RES (138)..(155): Any amino acid
  MOD_RES (194)..(198): Any amino acid
  MOD_RES (208)..(210): Any amino acid
  MOD_RES (220)..(229): Any amino acid
  MOD_RES (239)..(247): Any amino acid
  MOD_RES (286)..(310): Any amino acid
  MOD_RES (320)..(325): Any amino acid
  MOD_RES (335)..(339): Any amino acid
  MOD_RES (353)..(360): Any amino acid
  MOD_RES (392)..(392): Any amino acid
  MOD_RES (404)..(407): Any amino acid
  MOD_RES (418)..(429): Any amino acid
  MOD_RES (446)..(460): Any amino acid

SEQ ID NO: 420442 - protein, 470 aa, Influenza virus; identical to SEQ ID NO: 418829
  MOD_RES (1)..(2): Any amino acid
  MOD_RES (16)..(55): Any amino acid
  MOD_RES (76)..(85): Any amino acid
  MOD_RES (103)..(103): Any amino acid
  MOD_RES (120)..(165): Any amino acid
  MOD_RES (175)..(181): Any amino acid
  MOD_RES (192)..(199): Any amino acid
  MOD_RES (223)..(230): Any amino acid
  MOD_RES (240)..(253): Any amino acid
  MOD_RES (271)..(274): Any amino acid
  MOD_RES (284)..(310): Any amino acid
  MOD_RES (322)..(325): Any amino acid
  MOD_RES (335)..(339): Any amino acid
  MOD_RES (359)..(360): Any amino acid
  MOD_RES (392)..(395): Any amino acid
  MOD_RES (405)..(408): Any amino acid
  MOD_RES (426)..(460): Any amino acid
  MOD_RES (470)..(470): Any amino acid

SEQ ID NO: 420443 - protein, 568 aa, Influenza virus; identical to SEQ ID NO: 418833
  MOD_RES (1)..(15): Any amino acid
  MOD_RES (38)..(39): Any amino acid
  MOD_RES (53)..(65): Any amino acid
  MOD_RES (77)..(88): Any amino acid
  MOD_RES (98)..(109): Any amino acid
  MOD_RES (126)..(153): Any amino acid
  MOD_RES (163)..(167): Any amino acid
  MOD_RES (184)..(189): Any amino acid
  MOD_RES (199)..(203): Any amino acid
  MOD_RES (245)..(248): Any amino acid
  MOD_RES (268)..(286): Any amino acid
  MOD_RES (337)..(337): Any amino acid
  MOD_RES (485)..(486): Any amino acid
  MOD_RES (541)..(546): Any amino acid

SEQ ID NO: 420444 - protein, 568 aa, Influenza virus; identical to SEQ ID NO: 418834
  MOD_RES (1)..(15): Any amino acid
  MOD_RES (38)..(39): Any amino acid
  MOD_RES (53)..(65): Any amino acid
  MOD_RES (77)..(88): Any amino acid
  MOD_RES (98)..(109): Any amino acid
  MOD_RES (125)..(153): Any amino acid
  MOD_RES (163)..(167): Any amino acid
  MOD_RES (184)..(189): Any amino acid
  MOD_RES (199)..(203): Any amino acid
  MOD_RES (245)..(248): Any amino acid
  MOD_RES (268)..(286): Any amino acid
  MOD_RES (310)..(311): Any amino acid
  MOD_RES (337)..(337): Any amino acid
  MOD_RES (348)..(349): Any amino acid
  MOD_RES (395)..(402): Any amino acid
  MOD_RES (420)..(426): Any amino acid
  MOD_RES (442)..(442): Any amino acid
  MOD_RES (485)..(486): Any amino acid
  MOD_RES (541)..(546): Any amino acid
  MOD_RES (557)..(568): Any amino acid

SEQ ID NO: 420445 - protein, 568 aa, Influenza virus; identical to SEQ ID NO: 418835
  MOD_RES (1)..(15): Any amino acid
  MOD_RES (38)..(39): Any amino acid
  MOD_RES (49)..(65): Any amino acid
  MOD_RES (77)..(88): Any amino acid
  MOD_RES (98)..(109): Any amino acid
  MOD_RES (126)..(153): Any amino acid
  MOD_RES (163)..(167): Any amino acid
  MOD_RES (184)..(189): Any amino acid
  MOD_RES (199)..(203): Any amino acid
  MOD_RES (245)..(248): Any amino acid
  MOD_RES (268)..(286): Any amino acid
  MOD_RES (310)..(311): Any amino acid
  MOD_RES (337)..(337): Any amino acid
  MOD_RES (355)..(366): Any amino acid
  MOD_RES (395)..(404): Any amino acid
  MOD_RES (422)..(431): Any amino acid
  MOD_RES (441)..(445): Any amino acid
  MOD_RES (458)..(475): Any amino acid
  MOD_RES (485)..(486): Any amino acid
  MOD_RES (525)..(528): Any amino acid
  MOD_RES (541)..(546): Any amino acid
  MOD_RES (557)..(568): Any amino acid

SEQ ID NO: 420446 - protein, 568 aa, Influenza virus; identical to SEQ ID NO: 418836
  MOD_RES (1)..(15): Any amino acid
  MOD_RES (38)..(39): Any amino acid
  MOD_RES (49)..(65): Any amino acid
  MOD_RES (77)..(88): Any amino acid
  MOD_RES (98)..(109): Any amino acid
  MOD_RES (126)..(153): Any amino acid
  MOD_RES (163)..(167): Any amino acid
  MOD_RES (184)..(189): Any amino acid
  MOD_RES (199)..(205): Any amino acid
  MOD_RES (245)..(248): Any amino acid
  MOD_RES (266)..(287): Any amino acid
  MOD_RES (308)..(312): Any amino acid
  MOD_RES (331)..(368): Any amino acid
  MOD_RES (383)..(383): Any amino acid
  MOD_RES (394)..(406): Any amino acid
  MOD_RES (421)..(433): Any amino acid
  MOD_RES (444)..(446): Any amino acid
  MOD_RES (460)..(475): Any amino acid
  MOD_RES (485)..(486): Any amino acid
  MOD_RES (525)..(546): Any amino acid
  MOD_RES (556)..(568): Any amino acid

SEQ ID NO: 420447 - protein, 568 aa, Influenza virus; identical to SEQ ID NO: 418837
  MOD_RES (1)..(39): Any amino acid
  MOD_RES (49)..(65): Any amino acid
  MOD_RES (77)..(88): Any amino acid
  MOD_RES (98)..(109): Any amino acid
  MOD_RES (120)..(153): Any amino acid
  MOD_RES (163)..(167): Any amino acid
  MOD_RES (177)..(206): Any amino acid
  MOD_RES (241)..(248): Any amino acid
  MOD_RES (268)..(288): Any amino acid
  MOD_RES (301)..(312): Any amino acid
  MOD_RES (331)..(374): Any amino acid
  MOD_RES (397)..(409): Any amino acid
  MOD_RES (424)..(447): Any amino acid
  MOD_RES (459)..(475): Any amino acid
  MOD_RES (485)..(486): Any amino acid
  MOD_RES (528)..(546): Any amino acid
  MOD_RES (556)..(568): Any amino acid

SEQ ID NO: 420448 - protein, 561 aa, Influenza virus; identical to SEQ ID NO: 418842
  MOD_RES (1)..(15): Any amino acid
  MOD_RES (54)..(64): Any amino acid
  MOD_RES (131)..(131): Any amino acid
  MOD_RES (143)..(150): Any amino acid
  MOD_RES (184)..(184): Any amino acid
  MOD_RES (246)..(246): Any amino acid
  MOD_RES (281)..(283): Any amino acid
  MOD_RES (337)..(337): Any amino acid

SEQ ID NO: 420449 - protein, 561 aa, Influenza virus; identical to SEQ ID NO: 418843
  MOD_RES (1)..(15): Any amino acid
  MOD_RES (54)..(64): Any amino acid
  MOD_RES (131)..(131): Any amino acid
  MOD_RES (141)..(150): Any amino acid
  MOD_RES (184)..(184): Any amino acid
  MOD_RES (228)..(232): Any amino acid
  MOD_RES (246)..(246): Any amino acid
  MOD_RES (281)..(283): Any amino acid
  MOD_RES (303)..(311): Any amino acid
  MOD_RES (337)..(337): Any amino acid
  MOD_RES (353)..(370): Any amino acid
  MOD_RES (392)..(402): Any amino acid
  MOD_RES (420)..(431): Any amino acid
  MOD_RES (441)..(445): Any amino acid
  MOD_RES (561)..(561): Any amino acid

SEQ ID NO: 420450 - protein, 561 aa, Influenza virus; identical to SEQ ID NO: 418844
  MOD_RES (1)..(15): Any amino acid
  MOD_RES (54)..(64): Any amino acid
  MOD_RES (117)..(119): Any amino acid
  MOD_RES (131)..(131): Any amino acid
  MOD_RES (141)..(150): Any amino acid
  MOD_RES (184)..(184): Any amino acid
  MOD_RES (231)..(236): Any amino acid
  MOD_RES (246)..(246): Any amino acid
  MOD_RES (269)..(271): Any amino acid
  MOD_RES (281)..(283): Any amino acid
  MOD_RES (308)..(312): Any amino acid
  MOD_RES (337)..(344): Any amino acid
  MOD_RES (355)..(374): Any amino acid
  MOD_RES (397)..(404): Any amino acid
  MOD_RES (422)..(432): Any amino acid
  MOD_RES (444)..(448): Any amino acid
  MOD_RES (463)..(474): Any amino acid
  MOD_RES (524)..(532): Any amino acid
  MOD_RES (555)..(561): Any amino acid

SEQ ID NO: 420451 - protein, 561 aa, Influenza virus; identical to SEQ ID NO: 418845
  MOD_RES (1)..(15): Any amino acid
  MOD_RES (54)..(64): Any amino acid
  MOD_RES (117)..(119): Any amino acid
  MOD_RES (131)..(131): Any amino acid
  MOD_RES (143)..(150): Any amino acid
  MOD_RES (184)..(184): Any amino acid
  MOD_RES (223)..(247): Any amino acid
  MOD_RES (281)..(292): Any amino acid
  MOD_RES (310)..(312): Any amino acid
  MOD_RES (331)..(376): Any amino acid
  MOD_RES (394)..(406): Any amino acid
  MOD_RES (424)..(474): Any amino acid
  MOD_RES (500)..(508): Any amino acid
  MOD_RES (526)..(532): Any amino acid
  MOD_RES (560)..(561): Any amino acid

SEQ ID NO: 420452 - protein, 561 aa, Influenza virus; identical to SEQ ID NO: 418846
  MOD_RES (1)..(22): Any amino acid
  MOD_RES (51)..(64): Any amino acid
  MOD_RES (131)..(131): Any amino acid
  MOD_RES (143)..(157): Any amino acid
  MOD_RES (178)..(184): Any amino acid
  MOD_RES (227)..(254): Any amino acid
  MOD_RES (281)..(321): Any amino acid
  MOD_RES (331)..(379): Any amino acid
  MOD_RES (393)..(474): Any amino acid
  MOD_RES (499)..(508): Any amino acid
  MOD_RES (526)..(532): Any amino acid
  MOD_RES (542)..(561): Any amino acid

SEQ ID NO: 420453 - protein, 471 aa, Influenza virus; identical to SEQ ID NO: 418850
  MOD_RES (19)..(19): Any amino acid
  MOD_RES (48)..(53): Any amino acid
  MOD_RES (75)..(82): Any amino acid
  MOD_RES (308)..(308): Any amino acid
  MOD_RES (332)..(333): Any amino acid
  MOD_RES (389)..(390): Any amino acid
  MOD_RES (416)..(416): Any amino acid

SEQ ID NO: 420454 - protein, 471 aa, Influenza virus; identical to SEQ ID NO: 418851
  MOD_RES (19)..(19): Any amino acid
  MOD_RES (48)..(53): Any amino acid
  MOD_RES (75)..(82): Any amino acid
  MOD_RES (114)..(117): Any amino acid
  MOD_RES (229)..(229): Any amino acid
  MOD_RES (308)..(308): Any amino acid
  MOD_RES (332)..(333): Any amino acid
  MOD_RES (346)..(347): Any amino acid
  MOD_RES (388)..(390): Any amino acid
  MOD_RES (416)..(416): Any amino acid
  MOD_RES (426)..(427): Any amino acid

SEQ ID NO: 420455 - protein, 471 aa, Influenza virus; identical to SEQ ID NO: 418852
  MOD_RES (19)..(19): Any amino acid
  MOD_RES (48)..(53): Any amino acid
  MOD_RES (75)..(82): Any amino acid
  MOD_RES (135)..(155): Any amino acid
  MOD_RES (226)..(231): Any amino acid
  MOD_RES (308)..(308): Any amino acid
  MOD_RES (332)..(336): Any amino acid
  MOD_RES (367)..(374): Any amino acid
  MOD_RES (389)..(390): Any amino acid
  MOD_RES (416)..(416): Any amino acid
  MOD_RES (427)..(445): Any amino acid

SEQ ID NO: 420456 - protein, 471 aa, Influenza virus; identical to SEQ ID NO: 418853
  MOD_RES (1)..(2): Any amino acid
  MOD_RES (19)..(19): Any amino acid
  MOD_RES (29)..(38): Any amino acid
  MOD_RES (48)..(53): Any amino acid
  MOD_RES (63)..(64): Any amino acid
  MOD_RES (75)..(82): Any amino acid
  MOD_RES (96)..(104): Any amino acid
  MOD_RES (138)..(156): Any amino acid
  MOD_RES (181)..(185): Any amino acid
  MOD_RES (230)..(236): Any amino acid
  MOD_RES (294)..(297): Any amino acid
  MOD_RES (308)..(308): Any amino acid
  MOD_RES (320)..(322): Any amino acid
  MOD_RES (332)..(336): Any amino acid
  MOD_RES (346)..(348): Any amino acid
  MOD_RES (373)..(375): Any amino acid
  MOD_RES (389)..(390): Any amino acid
  MOD_RES (410)..(416): Any amino acid
  MOD_RES (427)..(446): Any amino acid
  MOD_RES (470)..(471): Any amino acid

SEQ ID NO: 420457 - protein, 471 aa, Influenza virus; identical to SEQ ID NO: 418854
  MOD_RES (1)..(6): Any amino acid
  MOD_RES (18)..(55): Any amino acid
  MOD_RES (75)..(83): Any amino acid
  MOD_RES (101)..(121): Any amino acid
  MOD_RES (134)..(158): Any amino acid
  MOD_RES (183)..(189): Any amino acid
  MOD_RES (200)..(202): Any amino acid
  MOD_RES (217)..(238): Any amino acid
  MOD_RES (255)..(255): Any amino acid
  MOD_RES (275)..(276): Any amino acid
  MOD_RES (289)..(297): Any amino acid
  MOD_RES (307)..(308): Any amino acid
  MOD_RES (320)..(359): Any amino acid
  MOD_RES (375)..(378): Any amino acid
  MOD_RES (389)..(390): Any amino acid
  MOD_RES (409)..(416): Any amino acid
  MOD_RES (427)..(446): Any amino acid
  MOD_RES (456)..(471): Any amino acid

SEQ ID NO: 420458 - protein, 565 aa, Influenza virus; identical to SEQ ID NO: 418858
  MOD_RES (1)..(14): Any amino acid
  MOD_RES (52)..(52): Any amino acid
  MOD_RES (113)..(157): Any amino acid
  MOD_RES (177)..(179): Any amino acid
  MOD_RES (190)..(205): Any amino acid
  MOD_RES (215)..(234): Any amino acid
  MOD_RES (250)..(255): Any amino acid
  MOD_RES (275)..(292): Any amino acid
  MOD_RES (304)..(307): Any amino acid
  MOD_RES (387)..(414): Any amino acid
  MOD_RES (424)..(431): Any amino acid
  MOD_RES (522)..(523): Any amino acid
  MOD_RES (549)..(551): Any amino acid

SEQ ID NO: 420459 - protein, 565 aa, Influenza virus; identical to SEQ ID NO: 418859
  MOD_RES (1)..(14): Any amino acid
  MOD_RES (52)..(52): Any amino acid
  MOD_RES (113)..(157): Any amino acid
  MOD_RES (177)..(179): Any amino acid
  MOD_RES (189)..(205): Any amino acid
  MOD_RES (215)..(234): Any amino acid
  MOD_RES (250)..(255): Any amino acid
  MOD_RES (275)..(292): Any amino acid
  MOD_RES (304)..(307): Any amino acid
  MOD_RES (350)..(362): Any amino acid
  MOD_RES (387)..(414): Any amino acid
  MOD_RES (424)..(431): Any amino acid
  MOD_RES (522)..(523): Any amino acid
  MOD_RES (549)..(551): Any amino acid
  MOD_RES (562)..(565): Any amino acid

SEQ ID NO: 420460 - protein, 565 aa, Influenza virus; identical to SEQ ID NO: 418860
  MOD_RES (1)..(14): Any amino acid
  MOD_RES (52)..(52): Any amino acid
  MOD_RES (113)..(157): Any amino acid
  MOD_RES (177)..(179): Any amino acid
  MOD_RES (190)..(205): Any amino acid
  MOD_RES (215)..(238): Any amino acid
  MOD_RES (250)..(255): Any amino acid
  MOD_RES (275)..(292): Any amino acid
  MOD_RES (304)..(307): Any amino acid
  MOD_RES (350)..(364): Any amino acid
  MOD_RES (387)..(414): Any amino acid
  MOD_RES (424)..(431): Any amino acid
  MOD_RES (448)..(450): Any amino acid
  MOD_RES (522)..(523): Any amino acid
  MOD_RES (549)..(551): Any amino acid
  MOD_RES (564)..(565): Any amino acid

SEQ ID NO: 420461 - protein, 565 aa, Influenza virus; identical to SEQ ID NO: 418861
  MOD_RES (1)..(15): Any amino acid
  MOD_RES (49)..(52): Any amino acid
  MOD_RES (113)..(157): Any amino acid
  MOD_RES (177)..(179): Any amino acid
  MOD_RES (190)..(205): Any amino acid
  MOD_RES (215)..(238): Any amino acid
  MOD_RES (248)..(255): Any amino acid
  MOD_RES (275)..(292): Any amino acid
  MOD_RES (304)..(307): Any amino acid
  MOD_RES (357)..(370): Any amino acid
  MOD_RES (387)..(414): Any amino acid
  MOD_RES (424)..(431): Any amino acid
  MOD_RES (444)..(453): Any amino acid
  MOD_RES (522)..(524): Any amino acid
  MOD_RES (534)..(536): Any amino acid
  MOD_RES (549)..(551): Any amino acid
  MOD_RES (564)..(565): Any amino acid

SEQ ID NO: 420462 - protein, 565 aa, Influenza virus; identical to SEQ ID NO: 418862
  MOD_RES (1)..(17): Any amino acid
  MOD_RES (42)..(54): Any amino acid
  MOD_RES (72)..(76): Any amino acid
  MOD_RES (100)..(164): Any amino acid
  MOD_RES (175)..(179): Any amino acid
  MOD_RES (190)..(205): Any amino acid
  MOD_RES (215)..(239): Any amino acid
  MOD_RES (250)..(255): Any amino acid
  MOD_RES (275)..(292): Any amino acid
  MOD_RES (304)..(307): Any amino acid
  MOD_RES (341)..(377): Any amino acid
  MOD_RES (387)..(414): Any amino acid
  MOD_RES (424)..(432): Any amino acid
  MOD_RES (442)..(454): Any amino acid
  MOD_RES (464)..(467): Any amino acid
  MOD_RES (478)..(479): Any amino acid
  MOD_RES (497)..(500): Any amino acid
  MOD_RES (522)..(532): Any amino acid
  MOD_RES (548)..(551): Any amino acid
  MOD_RES (562)..(565): Any amino acid

SEQ ID NO: 420463 - protein, 564 aa, Influenza virus; identical to SEQ ID NO: 418866
  MOD_RES (10)..(14): Any amino acid
  MOD_RES (57)..(60): Any amino acid
  MOD_RES (189)..(189): Any amino acid
  MOD_RES (205)..(219): Any amino acid
  MOD_RES (287)..(291): Any amino acid
  MOD_RES (406)..(410): Any amino acid
  MOD_RES (489)..(492): Any amino acid

SEQ ID NO: 420464 - protein, 564 aa, Influenza virus; identical to SEQ ID NO: 418867
  MOD_RES (10)..(14): Any amino acid
  MOD_RES (57)..(60): Any amino acid
  MOD_RES (189)..(189): Any amino acid
  MOD_RES (205)..(219): Any amino acid
  MOD_RES (287)..(291): Any amino acid
  MOD_RES (406)..(410): Any amino acid
  MOD_RES (450)..(453): Any amino acid
  MOD_RES (489)..(492): Any amino acid
  MOD_RES (525)..(534): Any amino acid

SEQ ID NO: 420465 - protein, 564 aa, Influenza virus; identical to SEQ ID NO: 418868
  MOD_RES (10)..(14): Any amino acid
  MOD_RES (24)..(28): Any amino acid
  MOD_RES (57)..(60): Any amino acid
  MOD_RES (122)..(128): Any amino acid
  MOD_RES (173)..(178): Any amino acid
  MOD_RES (189)..(189): Any amino acid
  MOD_RES (205)..(219): Any amino acid
  MOD_RES (243)..(251): Any amino acid
  MOD_RES (287)..(291): Any amino acid
  MOD_RES (357)..(365): Any amino acid
  MOD_RES (394)..(394): Any amino acid
  MOD_RES (406)..(410): Any amino acid
  MOD_RES (439)..(455): Any amino acid
  MOD_RES (489)..(492): Any amino acid
  MOD_RES (516)..(564): Any amino acid

SEQ ID NO: 420466 - protein, 564 aa, Influenza virus; identical to SEQ ID NO: 418869
  MOD_RES (10)..(28): Any amino acid
  MOD_RES (57)..(69): Any amino acid
  MOD_RES (87)..(97): Any amino acid
  MOD_RES (128)..(134): Any amino acid
  MOD_RES (180)..(192): Any amino acid
  MOD_RES (205)..(219): Any amino acid
  MOD_RES (245)..(263): Any amino acid
  MOD_RES (281)..(291): Any amino acid
  MOD_RES (348)..(367): Any amino acid
  MOD_RES (394)..(396): Any amino acid
  MOD_RES (406)..(410): Any amino acid
  MOD_RES (436)..(455): Any amino acid
  MOD_RES (489)..(493): Any amino acid
  MOD_RES (503)..(503): Any amino acid
  MOD_RES (524)..(564): Any amino acid

SEQ ID NO: 420467 - protein, 564 aa, Influenza virus; identical to SEQ ID NO: 418870
  MOD_RES (10)..(28): Any amino acid
  MOD_RES (40)..(46): Any amino acid
  MOD_RES (57)..(71): Any amino acid
  MOD_RES (89)..(104): Any amino acid
  MOD_RES (129)..(146): Any amino acid
  MOD_RES (172)..(195): Any amino acid
  MOD_RES (205)..(219): Any amino acid
  MOD_RES (246)..(292): Any amino acid
  MOD_RES (310)..(316): Any amino acid
  MOD_RES (350)..(368): Any amino acid
  MOD_RES (398)..(410): Any amino acid
  MOD_RES (440)..(456): Any amino acid
  MOD_RES (489)..(493): Any amino acid
  MOD_RES (523)..(564): Any amino acid

SEQ ID NO: 420468 - protein, 567 aa, Influenza virus; identical to SEQ ID NO: 418872
  MOD_RES (1)..(17): Any amino acid
  MOD_RES (86)..(89): Any amino acid
  MOD_RES (138)..(154): Any amino acid
  MOD_RES (169)..(172): Any amino acid
  MOD_RES (200)..(213): Any amino acid
  MOD_RES (225)..(231): Any amino acid
  MOD_RES (251)..(256): Any amino acid
  MOD_RES (289)..(290): Any amino acid
  MOD_RES (341)..(343): Any amino acid
  MOD_RES (468)..(472): Any amino acid
  MOD_RES (565)..(567): Any amino acid

SEQ ID NO: 420469 - protein, 567 aa, Influenza virus; identical to SEQ ID NO: 418873
  MOD_RES (1)..(17): Any amino acid
  MOD_RES (86)..(89): Any amino acid
  MOD_RES (138)..(154): Any amino acid
  MOD_RES (169)..(179): Any amino acid
  MOD_RES (200)..(213): Any amino acid
  MOD_RES (225)..(231): Any amino acid
  MOD_RES (251)..(256): Any amino acid
  MOD_RES (289)..(290): Any amino acid
  MOD_RES (341)..(343): Any amino acid
  MOD_RES (358)..(367): Any amino acid
  MOD_RES (444)..(444): Any amino acid
  MOD_RES (468)..(472): Any amino acid
  MOD_RES (565)..(567): Any amino acid

SEQ ID NO: 420470 - protein, 567 aa, Influenza virus; identical to SEQ ID NO: 418874
  MOD_RES (1)..(17): Any amino acid
  MOD_RES (65)..(65): Any amino acid
  MOD_RES (83)..(89): Any amino acid
  MOD_RES (111)..(124): Any amino acid
  MOD_RES (138)..(154): Any amino acid
  MOD_RES (169)..(179): Any amino acid
  MOD_RES (200)..(213): Any amino acid
  MOD_RES (225)..(231): Any amino acid
  MOD_RES (251)..(256): Any amino acid
  MOD_RES (274)..(277): Any amino acid
  MOD_RES (289)..(290): Any amino acid
  MOD_RES (328)..(329): Any amino acid
  MOD_RES (341)..(343): Any amino acid
  MOD_RES (355)..(367): Any amino acid
  MOD_RES (385)..(410): Any amino acid
  MOD_RES (428)..(432): Any amino acid
  MOD_RES (468)..(472): Any amino acid
  MOD_RES (534)..(535): Any amino acid
  MOD_RES (565)..(567): Any amino acid

SEQ ID NO: 420471 - protein, 567 aa, Influenza virus; identical to SEQ ID NO: 418875
  MOD_RES (1)..(24): Any amino acid
  MOD_RES (65)..(71): Any amino acid
  MOD_RES (86)..(93): Any amino acid
  MOD_RES (111)..(154): Any amino acid
  MOD_RES (169)..(179): Any amino acid
  MOD_RES (200)..(213): Any amino acid
  MOD_RES (225)..(231): Any amino acid
  MOD_RES (251)..(256): Any amino acid
  MOD_RES (266)..(277): Any amino acid
  MOD_RES (289)..(305): Any amino acid
  MOD_RES (322)..(331): Any amino acid
  MOD_RES (341)..(343): Any amino acid
  MOD_RES (356)..(369): Any amino acid
  MOD_RES (385)..(410): Any amino acid
  MOD_RES (428)..(451): Any amino acid
  MOD_RES (468)..(485): Any amino acid
  MOD_RES (505)..(512): Any amino acid
  MOD_RES (536)..(538): Any amino acid
  MOD_RES (557)..(567): Any amino acid

SEQ ID NO: 420472 - protein, 567 aa, Influenza virus; identical to SEQ ID NO: 418876
  MOD_RES (1)..(26): Any amino acid
  MOD_RES (54)..(97): Any amino acid
  MOD_RES (115)..(154): Any amino acid
  MOD_RES (169)..(179): Any amino acid
  MOD_RES (190)..(213): Any amino acid
  MOD_RES (225)..(232): Any amino acid
  MOD_RES (251)..(310): Any amino acid
  MOD_RES (328)..(331): Any amino acid
  MOD_RES (341)..(372): Any amino acid
  MOD_RES (390)..(410): Any amino acid
  MOD_RES (424)..(457): Any amino acid
  MOD_RES (468)..(495): Any amino acid
  MOD_RES (505)..(514): Any amino acid
  MOD_RES (539)..(542): Any amino acid
  MOD_RES (564)..(567): Any amino acid

SEQ ID NO: 420473 - protein, 568 aa, Influenza virus; identical to SEQ ID NO: 418424

SEQ ID NO: 420474 - protein, 568 aa, Influenza virus; identical to SEQ ID NO: 418880
  MOD_RES (1)..(9): Any amino acid
  MOD_RES (21)..(164): Any amino acid
  MOD_RES (182)..(568): Any amino acid

SEQ ID NO: 420475 - protein, 570 aa, Influenza virus; identical to SEQ ID NO: 418426

SEQ ID NO: 420476 - protein, 570 aa, Influenza virus; identical to SEQ ID NO: 418882
  MOD_RES (1)..(8): Any amino acid
  MOD_RES (66)..(77): Any amino acid
  MOD_RES (98)..(100): Any amino acid
  MOD_RES (118)..(121): Any amino acid
  MOD_RES (148)..(153): Any amino acid
  MOD_RES (189)..(197): Any amino acid
  MOD_RES (237)..(268): Any amino acid
  MOD_RES (286)..(310): Any amino acid
  MOD_RES (332)..(338): Any amino acid
  MOD_RES (356)..(401): Any amino acid
  MOD_RES (419)..(520): Any amino acid
  MOD_RES (538)..(570): Any amino acid

SEQ ID NO: 420477 - protein, 570 aa, Influenza virus; identical to SEQ ID NO: 418883
  MOD_RES (1)..(156): Any amino acid
  MOD_RES (174)..(339): Any amino acid
  MOD_RES (364)..(570): Any amino acid

SEQ ID NO: 420478 - protein, 570 aa, Influenza virus; identical to SEQ ID NO: 418884
  MOD_RES (1)..(157): Any amino acid
  MOD_RES (175)..(570): Any amino acid

SEQ ID NO: 420479 - protein, 569 aa, Influenza virus; identical to SEQ ID NO: 418885
  MOD_RES (11)..(15): Any amino acid
  MOD_RES (172)..(173): Any amino acid
  MOD_RES (343)..(343): Any amino acid
  MOD_RES (471)..(471): Any amino acid

SEQ ID NO: 420480 - protein, 569 aa, Influenza virus; identical to SEQ ID NO: 418886
  MOD_RES (1)..(15): Any amino acid
  MOD_RES (77)..(81): Any amino acid
  MOD_RES (99)..(99): Any amino acid
  MOD_RES (125)..(130): Any amino acid
  MOD_RES (172)..(173): Any amino acid
  MOD_RES (192)..(194): Any amino acid
  MOD_RES (218)..(218): Any amino acid
  MOD_RES (327)..(332): Any amino acid
  MOD_RES (350)..(376): Any amino acid
  MOD_RES (401)..(417): Any amino acid
  MOD_RES (471)..(471): Any amino acid

SEQ ID NO: 420481 - protein, 569 aa, Influenza virus; identical to SEQ ID NO: 418887
  MOD_RES (1)..(15): Any amino acid
  MOD_RES (52)..(62): Any amino acid
  MOD_RES (80)..(101): Any amino acid
  MOD_RES (121)..(130): Any amino acid
  MOD_RES (172)..(179): Any amino acid
  MOD_RES (189)..(196): Any amino acid
  MOD_RES (217)..(226): Any amino acid
  MOD_RES (244)..(244): Any amino acid
  MOD_RES (268)..(278): Any amino acid
  MOD_RES (305)..(306): Any amino acid
  MOD_RES (324)..(333): Any amino acid
  MOD_RES (343)..(343): Any amino acid
  MOD_RES (353)..(376): Any amino acid
  MOD_RES (394)..(420): Any amino acid
  MOD_RES (438)..(442): Any amino acid
  MOD_RES (457)..(457): Any amino acid
  MOD_RES (471)..(471): Any amino acid
  MOD_RES (494)..(507): Any amino acid

SEQ ID NO: 420482 - protein, 569 aa, Influenza virus; identical to SEQ ID NO: 418888
  MOD_RES (1)..(15): Any amino acid
  MOD_RES (26)..(27): Any amino acid
  MOD_RES (42)..(62): Any amino acid
  MOD_RES (77)..(103): Any amino acid
  MOD_RES (119)..(132): Any amino acid
  MOD_RES (172)..(179): Any amino acid
  MOD_RES (190)..(196): Any amino acid
  MOD_RES (222)..(238): Any amino acid
  MOD_RES (272)..(279): Any amino acid
  MOD_RES (313)..(343): Any amino acid
  MOD_RES (353)..(382): Any amino acid
  MOD_RES (400)..(446): Any amino acid
  MOD_RES (471)..(471): Any amino acid
  MOD_RES (496)..(524): Any amino acid
  MOD_RES (569)..(569): Any amino acid

SEQ ID NO: 420483 - protein, 569 aa, Influenza virus; identical to SEQ ID NO: 418889
  MOD_RES (1)..(15): Any amino acid
  MOD_RES (25)..(28): Any amino acid
  MOD_RES (46)..(103): Any amino acid
  MOD_RES (121)..(132): Any amino acid
  MOD_RES (172)..(197): Any amino acid
  MOD_RES (218)..(244): Any amino acid
  MOD_RES (256)..(258): Any amino acid
  MOD_RES (268)..(281): Any amino acid
  MOD_RES (305)..(343): Any amino acid
  MOD_RES (353)..(383): Any amino acid
  MOD_RES (394)..(457): Any amino acid
  MOD_RES (471)..(537): Any amino acid
  MOD_RES (553)..(569): Any amino acid

SEQ ID NO: 420484 - protein, 627 aa, Influenza virus; identical to SEQ ID NO: 418891
  MOD_RES (17)..(26): Any amino acid
  MOD_RES (46)..(304): Any amino acid
  MOD_RES (323)..(342): Any amino acid
  MOD_RES (354)..(385): Any amino acid
  MOD_RES (415)..(479): Any amino acid
  MOD_RES (496)..(519): Any amino acid
  MOD_RES (529)..(573): Any amino acid
  MOD_RES (583)..(603): Any amino acid

SEQ ID NO: 420485 - protein, 627 aa, Influenza virus; identical to SEQ ID NO: 418892
  MOD_RES (1)..(2): Any amino acid
  MOD_RES (17)..(304): Any amino acid
  MOD_RES (320)..(389): Any amino acid
  MOD_RES (415)..(479): Any amino acid
  MOD_RES (496)..(519): Any amino acid
  MOD_RES (529)..(573): Any amino acid
  MOD_RES (583)..(611): Any amino acid
  MOD_RES (622)..(627): Any amino acid

SEQ ID NO: 420486 - protein, 627 aa, Influenza virus; identical to SEQ ID NO: 418893
  MOD_RES (1)..(5): Any amino acid
  MOD_RES (17)..(392): Any amino acid
  MOD_RES (415)..(479): Any amino acid
  MOD_RES (496)..(519): Any amino acid
  MOD_RES (529)..(573): Any amino acid
  MOD_RES (583)..(611): Any amino acid
  MOD_RES (626)..(627): Any amino acid

SEQ ID NO: 420487 - protein, 627 aa, Influenza virus; identical to SEQ ID NO: 418894
  MOD_RES (1)..(6): Any amino acid
  MOD_RES (17)..(395): Any amino acid
  MOD_RES (413)..(479): Any amino acid
  MOD_RES (496)..(519): Any amino acid
  MOD_RES (529)..(573): Any amino acid
  MOD_RES (583)..(611): Any amino acid
  MOD_RES (625)..(627): Any amino acid

SEQ ID NO: 420488 - protein, 627 aa, Influenza virus; identical to SEQ ID NO: 418895
  MOD_RES (1)..(395): Any amino acid
  MOD_RES (415)..(479): Any amino acid
  MOD_RES (496)..(519): Any amino acid
  MOD_RES (529)..(573): Any amino acid
  MOD_RES (583)..(611): Any amino acid

SEQ ID NO: 420489 - protein, 599 aa, Influenza virus; identical to SEQ ID NO: 418897
  MOD_RES (18)..(26): Any amino acid
  MOD_RES (62)..(83): Any amino acid
  MOD_RES (95)..(123): Any amino acid
  MOD_RES (147)..(180): Any amino acid
  MOD_RES (191)..(201): Any amino acid
  MOD_RES (212)..(253): Any amino acid
  MOD_RES (263)..(266): Any amino acid
  MOD_RES (281)..(316): Any amino acid
  MOD_RES (402)..(406): Any amino acid
  MOD_RES (431)..(434): Any amino acid
  MOD_RES (473)..(486): Any amino acid
  MOD_RES (506)..(506): Any amino acid
  MOD_RES (528)..(541): Any amino acid

SEQ ID NO: 420490 - protein, 599 aa, Influenza virus; identical to SEQ ID NO: 418898
  MOD_RES (1)..(2): Any amino acid
  MOD_RES (18)..(26): Any amino acid
  MOD_RES (61)..(83): Any amino acid
  MOD_RES (95)..(123): Any amino acid
  MOD_RES (147)..(180): Any amino acid
  MOD_RES (191)..(201): Any amino acid
  MOD_RES (212)..(253): Any amino acid
  MOD_RES (263)..(266): Any amino acid
  MOD_RES (281)..(320): Any amino acid
  MOD_RES (362)..(368): Any amino acid
  MOD_RES (402)..(406): Any amino acid
  MOD_RES (431)..(434): Any amino acid
  MOD_RES (473)..(486): Any amino acid
  MOD_RES (506)..(506): Any amino acid
  MOD_RES (528)..(541): Any amino acid

SEQ ID NO: 420491 - protein, 599 aa, Influenza virus; identical to SEQ ID NO: 418899
  MOD_RES (1)..(5): Any amino acid
  MOD_RES (18)..(26): Any amino acid
  MOD_RES (62)..(83): Any amino acid
  MOD_RES (95)..(123): Any amino acid
  MOD_RES (147)..(201): Any amino acid
  MOD_RES (212)..(253): Any amino acid
  MOD_RES (263)..(266): Any amino acid
  MOD_RES (281)..(320): Any amino acid
  MOD_RES (365)..(382): Any amino acid
  MOD_RES (402)..(406): Any amino acid
  MOD_RES (429)..(434): Any amino acid
  MOD_RES (456)..(463): Any amino acid
  MOD_RES (473)..(486): Any amino acid
  MOD_RES (506)..(506): Any amino acid
  MOD_RES (528)..(541): Any amino acid
  MOD_RES (581)..(583): Any amino acid
  MOD_RES (594)..(599): Any amino acid

SEQ ID NO: 420492 - protein, 599 aa, Influenza virus; identical to SEQ ID NO: 418900
  MOD_RES (1)..(8): Any amino acid
  MOD_RES (18)..(39): Any amino acid
  MOD_RES (53)..(83): Any amino acid
  MOD_RES (93)..(123): Any amino acid
  MOD_RES (143)..(201): Any amino acid
  MOD_RES (212)..(253): Any amino acid
  MOD_RES (263)..(266): Any amino acid
  MOD_RES (277)..(320): Any amino acid
  MOD_RES (355)..(406): Any amino acid
  MOD_RES (429)..(434): Any amino acid
  MOD_RES (450)..(463): Any amino acid
  MOD_RES (473)..(496): Any amino acid
  MOD_RES (506)..(508): Any amino acid
  MOD_RES (528)..(541): Any amino acid
  MOD_RES (568)..(570): Any amino acid
  MOD_RES (581)..(583): Any amino acid
  MOD_RES (598)..(599): Any amino acid

SEQ ID NO: 420493 - protein, 599 aa, Influenza virus; identical to SEQ ID NO: 418901
  MOD_RES (1)..(12): Any amino acid
  MOD_RES (22)..(40): Any amino acid
  MOD_RES (58)..(130): Any amino acid
  MOD_RES (144)..(201): Any amino acid
  MOD_RES (212)..(253): Any amino acid
  MOD_RES (263)..(266): Any amino acid
  MOD_RES (281)..(320): Any amino acid
  MOD_RES (338)..(342): Any amino acid
  MOD_RES (352)..(406): Any amino acid
  MOD_RES (431)..(439): Any amino acid
  MOD_RES (457)..(463): Any amino acid
  MOD_RES (473)..(518): Any amino acid
  MOD_RES (528)..(552): Any amino acid
  MOD_RES (597)..(599): Any amino acid

SEQ ID NO: 420494 - protein, 484 aa, Influenza virus; identical to SEQ ID NO: 418906
  MOD_RES (20)..(106): Any amino acid
  MOD_RES (231)..(232): Any amino acid
  MOD_RES (268)..(282): Any amino acid
  MOD_RES (298)..(299): Any amino acid
  MOD_RES (323)..(323): Any amino acid
  MOD_RES (341)..(354): Any amino acid
  MOD_RES (379)..(382): Any amino acid
  MOD_RES (395)..(409): Any amino acid
  MOD_RES (445)..(447): Any amino acid
  MOD_RES (465)..(467): Any amino acid
  MOD_RES (482)..(484): Any amino acid

SEQ ID NO: 420495 - protein, 484 aa, Influenza virus; identical to SEQ ID NO: 418907
  MOD_RES (1)..(106): Any amino acid
  MOD_RES (142)..(145): Any amino acid
  MOD_RES (231)..(232): Any amino acid
  MOD_RES (259)..(282): Any amino acid
  MOD_RES (298)..(299): Any amino acid
  MOD_RES (323)..(323): Any amino acid
  MOD_RES (335)..(354): Any amino acid
  MOD_RES (379)..(382): Any amino acid
  MOD_RES (395)..(409): Any amino acid
  MOD_RES (445)..(447): Any amino acid
  MOD_RES (465)..(467): Any amino acid
  MOD_RES (482)..(484): Any amino acid

SEQ ID NO: 420496 - protein, 484 aa, Influenza virus; identical to SEQ ID NO: 418908
  MOD_RES (1)..(106): Any amino acid
  MOD_RES (142)..(151): Any amino acid
  MOD_RES (186)..(190): Any amino acid
  MOD_RES (230)..(232): Any amino acid
  MOD_RES (259)..(282): Any amino acid
  MOD_RES (298)..(299): Any amino acid
  MOD_RES (323)..(323): Any amino acid
  MOD_RES (341)..(354): Any amino acid
  MOD_RES (379)..(382): Any amino acid
  MOD_RES (395)..(409): Any amino acid
  MOD_RES (419)..(420): Any amino acid
  MOD_RES (445)..(448): Any amino acid
  MOD_RES (465)..(467): Any amino acid
  MOD_RES (482)..(484): Any amino acid

SEQ ID NO: 420497 - protein, 484 aa, Influenza virus; identical to SEQ ID NO: 418909
  MOD_RES (1)..(107): Any amino acid
  MOD_RES (142)..(151): Any amino acid
  MOD_RES (183)..(190): Any amino acid
  MOD_RES (211)..(216): Any amino acid
  MOD_RES (227)..(232): Any amino acid
  MOD_RES (259)..(282): Any amino acid
  MOD_RES (298)..(299): Any amino acid
  MOD_RES (309)..(312): Any amino acid
  MOD_RES (323)..(323): Any amino acid
  MOD_RES (341)..(354): Any amino acid
  MOD_RES (379)..(409): Any amino acid
  MOD_RES (419)..(420): Any amino acid
  MOD_RES (432)..(448): Any amino acid
  MOD_RES (465)..(467): Any amino acid
  MOD_RES (482)..(484): Any amino acid

SEQ ID NO: 420498 - protein, 484 aa, Influenza virus; identical to SEQ ID NO: 418910
  MOD_RES (1)..(110): Any amino acid
  MOD_RES (126)..(132): Any amino acid
  MOD_RES (150)..(152): Any amino acid
  MOD_RES (170)..(190): Any amino acid
  MOD_RES (200)..(216): Any amino acid
  MOD_RES (231)..(236): Any amino acid
  MOD_RES (250)..(282): Any amino acid
  MOD_RES (295)..(312): Any amino acid
  MOD_RES (323)..(325): Any amino acid
  MOD_RES (335)..(355): Any amino acid
  MOD_RES (372)..(422): Any amino acid
  MOD_RES (440)..(448): Any amino acid
  MOD_RES (465)..(467): Any amino acid
  MOD_RES (482)..(484): Any amino acid

SEQ ID NO: 420499 - protein, 566 aa, Influenza virus; identical to SEQ ID NO: 418913
  MOD_RES (1)..(17): Any amino acid
  MOD_RES (36)..(38): Any amino acid
  MOD_RES (52)..(73): Any amino acid
  MOD_RES (85)..(114): Any amino acid
  MOD_RES (124)..(307): Any amino acid
  MOD_RES (327)..(328): Any amino acid
  MOD_RES (338)..(339): Any amino acid
  MOD_RES (369)..(371): Any amino acid
  MOD_RES (382)..(421): Any amino acid
  MOD_RES (433)..(433): Any amino acid
  MOD_RES (460)..(471): Any amino acid
  MOD_RES (491)..(491): Any amino acid
  MOD_RES (504)..(550): Any amino acid

SEQ ID NO: 420500 - protein, 566 aa, Influenza virus; identical to SEQ ID NO: 418914
  MOD_RES (1)..(17): Any amino acid
  MOD_RES (36)..(38): Any amino acid
  MOD_RES (50)..(73): Any amino acid
  MOD_RES (85)..(114): Any amino acid
  MOD_RES (124)..(307): Any amino acid
  MOD_RES (327)..(328): Any amino acid
  MOD_RES (338)..(339): Any amino acid
  MOD_RES (352)..(353): Any amino acid
  MOD_RES (369)..(371): Any amino acid
  MOD_RES (382)..(421): Any amino acid
  MOD_RES (433)..(433): Any amino acid
  MOD_RES (460)..(471): Any amino acid
  MOD_RES (491)..(491): Any amino acid
  MOD_RES (504)..(550): Any amino acid

SEQ ID NO: 420501 - protein, 566 aa, Influenza virus; identical to SEQ ID NO: 418915
  MOD_RES (1)..(17): Any amino acid
  MOD_RES (36)..(38): Any amino acid
  MOD_RES (52)..(73): Any amino acid
  MOD_RES (85)..(114): Any amino acid
  MOD_RES (124)..(307): Any amino acid
  MOD_RES (327)..(328): Any amino acid
  MOD_RES (338)..(339): Any amino acid
  MOD_RES (350)..(354): Any amino acid
  MOD_RES (369)..(371): Any amino acid
  MOD_RES (382)..(421): Any amino acid
  MOD_RES (433)..(433): Any amino acid
  MOD_RES (444)..(445): Any amino acid
  MOD_RES (460)..(471): Any amino acid
  MOD_RES (491)..(491): Any amino acid
  MOD_RES (504)..(550): Any amino acid

SEQ ID NO: 420502 - protein, 566 aa, Influenza virus; identical to SEQ ID NO: 418916
  MOD_RES (1)..(17): Any amino acid
  MOD_RES (27)..(38): Any amino acid
  MOD_RES (48)..(73): Any amino acid
  MOD_RES (85)..(114): Any amino acid
  MOD_RES (124)..(307): Any amino acid
  MOD_RES (319)..(328): Any amino acid
  MOD_RES (338)..(339): Any amino acid
  MOD_RES (351)..(372): Any amino acid
  MOD_RES (382)..(421): Any amino acid
  MOD_RES (433)..(433): Any amino acid
  MOD_RES (443)..(448): Any amino acid
  MOD_RES (460)..(471): Any amino acid
  MOD_RES (491)..(491): Any amino acid
  MOD_RES (504)..(550): Any amino acid
  MOD_RES (564)..(566): Any amino acid

SEQ ID NO: 420503 - protein, 566 aa, Influenza virus; identical to SEQ ID NO: 418917
  MOD_RES (1)..(18): Any amino acid
  MOD_RES (28)..(38): Any amino acid
  MOD_RES (48)..(73): Any amino acid
  MOD_RES (83)..(114): Any amino acid
  MOD_RES (124)..(307): Any amino acid
  MOD_RES (324)..(328): Any amino acid
  MOD_RES (338)..(339): Any amino acid
  MOD_RES (352)..(372): Any amino acid
  MOD_RES (382)..(421): Any amino acid
  MOD_RES (432)..(449): Any amino acid
  MOD_RES (459)..(471): Any amino acid
  MOD_RES (491)..(494): Any amino acid
  MOD_RES (504)..(554): Any amino acid
  MOD_RES (564)..(566): Any amino acid

SEQ ID NO: 420504 - protein, 475 aa, Influenza virus; identical to SEQ ID NO: 418920
  MOD_RES (1)..(46): Any amino acid
  MOD_RES (56)..(84): Any amino acid
  MOD_RES (94)..(94): Any amino acid
  MOD_RES (127)..(128): Any amino acid
  MOD_RES (144)..(151): Any amino acid
  MOD_RES (198)..(221): Any amino acid
  MOD_RES (235)..(236): Any amino acid
  MOD_RES (250)..(270): Any amino acid
  MOD_RES (287)..(287): Any amino acid
  MOD_RES (307)..(314): Any amino acid
  MOD_RES (329)..(345): Any amino acid
  MOD_RES (358)..(371): Any amino acid
  MOD_RES (382)..(403): Any amino acid
  MOD_RES (415)..(416): Any amino acid
  MOD_RES (433)..(436): Any amino acid

SEQ ID NO: 420505 - protein, 475 aa, Influenza virus; identical to SEQ ID NO: 418921
  MOD_RES (1)..(46): Any amino acid
  MOD_RES (56)..(84): Any amino acid
  MOD_RES (94)..(94): Any amino acid
  MOD_RES (123)..(128): Any amino acid
  MOD_RES (144)..(151): Any amino acid
  MOD_RES (198)..(221): Any amino acid
  MOD_RES (235)..(236): Any amino acid
  MOD_RES (250)..(270): Any amino acid
  MOD_RES (287)..(287): Any amino acid
  MOD_RES (307)..(314): Any amino acid
  MOD_RES (327)..(345): Any amino acid
  MOD_RES (358)..(371): Any amino acid
  MOD_RES (382)..(403): Any amino acid
  MOD_RES (415)..(416): Any amino acid
  MOD_RES (433)..(436): Any amino acid
  MOD_RES (466)..(475): Any amino acid

SEQ ID NO: 420506 - protein, 475 aa, Influenza virus; identical to SEQ ID NO: 418922
  MOD_RES (1)..(84): Any amino acid
  MOD_RES (94)..(94): Any amino acid
  MOD_RES (104)..(105): Any amino acid
  MOD_RES (127)..(133): Any amino acid
  MOD_RES (144)..(151): Any amino acid
  MOD_RES (194)..(221): Any amino acid
  MOD_RES (235)..(236): Any amino acid
  MOD_RES (250)..(270): Any amino acid
  MOD_RES (287)..(288): Any amino acid
  MOD_RES (306)..(314): Any amino acid
  MOD_RES (327)..(345): Any amino acid
  MOD_RES (358)..(371): Any amino acid
  MOD_RES (382)..(403): Any amino acid
  MOD_RES (415)..(416): Any amino acid
  MOD_RES (433)..(436): Any amino acid
  MOD_RES (466)..(475): Any amino acid

SEQ ID NO: 420507 - protein, 475 aa, Influenza virus; identical to SEQ ID NO: 418923
  MOD_RES (1)..(84): Any amino acid
  MOD_RES (94)..(94): Any amino acid
  MOD_RES (105)..(106): Any amino acid
  MOD_RES (127)..(133): Any amino acid
  MOD_RES (144)..(151): Any amino acid
  MOD_RES (177)..(180): Any amino acid
  MOD_RES (198)..(221): Any amino acid
  MOD_RES (235)..(236): Any amino acid
  MOD_RES (250)..(270): Any amino acid
  MOD_RES (287)..(295): Any amino acid
  MOD_RES (307)..(345): Any amino acid
  MOD_RES (358)..(372): Any amino acid
  MOD_RES (382)..(403): Any amino acid
  MOD_RES (413)..(416): Any amino acid
  MOD_RES (433)..(437): Any amino acid
  MOD_RES (474)..(475): Any amino acid

SEQ ID NO: 420508 - protein, 475 aa, Influenza virus; identical to SEQ ID NO: 418924
  MOD_RES (1)..(84): Any amino acid
  MOD_RES (94)..(94): Any amino acid
  MOD_RES (105)..(107): Any amino acid
  MOD_RES (127)..(151): Any amino acid
  MOD_RES (162)..(164): Any amino acid
  MOD_RES (182)..(184): Any amino acid
  MOD_RES (198)..(236): Any amino acid
  MOD_RES (249)..(295): Any amino acid
  MOD_RES (307)..(345): Any amino acid
  MOD_RES (358)..(372): Any amino acid
  MOD_RES (382)..(403): Any amino acid
  MOD_RES (413)..(423): Any amino acid
  MOD_RES (433)..(440): Any amino acid
  MOD_RES (464)..(475): Any amino acid

SEQ ID NO: 420509 - protein, 569 aa, Influenza virus; identical to SEQ ID NO: 418929
  MOD_RES (16)..(21): Any amino acid
  MOD_RES (94)..(94): Any amino acid
  MOD_RES (106)..(161): Any amino acid
  MOD_RES (173)..(182): Any amino acid
  MOD_RES (195)..(245): Any amino acid
  MOD_RES (255)..(259): Any amino acid
  MOD_RES (289)..(294): Any amino acid
  MOD_RES (330)..(331): Any amino acid
  MOD_RES (341)..(341): Any amino acid
  MOD_RES (392)..(399): Any amino acid
  MOD_RES (409)..(412): Any amino acid
  MOD_RES (436)..(437): Any amino acid
  MOD_RES (523)..(527): Any amino acid

SEQ ID NO: 420510 - protein, 569 aa, Influenza virus; identical to SEQ ID NO: 418930
  MOD_RES (16)..(21): Any amino acid
  MOD_RES (65)..(65): Any amino acid
  MOD_RES (94)..(94): Any amino acid
  MOD_RES (106)..(161): Any amino acid
  MOD_RES (171)..(182): Any amino acid
  MOD_RES (195)..(245): Any amino acid
  MOD_RES (255)..(259): Any amino acid
  MOD_RES (289)..(294): Any amino acid
  MOD_RES (330)..(331): Any amino acid
  MOD_RES (341)..(341): Any amino acid
  MOD_RES (353)..(356): Any amino acid
  MOD_RES (392)..(399): Any amino acid
  MOD_RES (409)..(412): Any amino acid
  MOD_RES (436)..(437): Any amino acid
  MOD_RES (523)..(527): Any amino acid
  MOD_RES (539)..(541): Any amino acid
  MOD_RES (564)..(569): Any amino acid

SEQ ID NO: 420511 - protein, 569 aa, Influenza virus; identical to SEQ ID NO: 418931
  MOD_RES (13)..(21): Any amino acid
  MOD_RES (82)..(82): Any amino acid
  MOD_RES (94)..(94): Any amino acid
  MOD_RES (106)..(161): Any amino acid
  MOD_RES (173)..(182): Any amino acid
  MOD_RES (195)..(245): Any amino acid
  MOD_RES (255)..(259): Any amino acid
  MOD_RES (289)..(294): Any amino acid
  MOD_RES (307)..(310): Any amino acid
  MOD_RES (330)..(331): Any amino acid
  MOD_RES (341)..(341): Any amino acid
  MOD_RES (355)..(377): Any amino acid
  MOD_RES (392)..(399): Any amino acid
  MOD_RES (409)..(412): Any amino acid
  MOD_RES (436)..(437): Any amino acid
  MOD_RES (523)..(527): Any amino acid
  MOD_RES (539)..(541): Any amino acid
  MOD_RES (564)..(569): Any amino acid

SEQ ID NO: 420512 - protein, 569 aa, Influenza virus; identical to SEQ ID NO: 418932
  MOD_RES (12)..(22): Any amino acid
  MOD_RES (41)..(43): Any amino acid
  MOD_RES (78)..(82): Any amino acid
  MOD_RES (94)..(95): Any amino acid
  MOD_RES (106)..(182): Any amino acid
  MOD_RES (195)..(260): Any amino acid
  MOD_RES (289)..(294): Any amino acid
  MOD_RES (310)..(331): Any amino acid
  MOD_RES (341)..(341): Any amino acid
  MOD_RES (353)..(399): Any amino acid
  MOD_RES (409)..(412): Any amino acid
  MOD_RES (434)..(437): Any amino acid
  MOD_RES (447)..(448): Any amino acid
  MOD_RES (486)..(488): Any amino acid
  MOD_RES (523)..(528): Any amino acid
  MOD_RES (538)..(545): Any amino acid
  MOD_RES (563)..(569): Any amino acid

SEQ ID NO: 420513 - protein, 569 aa, Influenza virus; identical to SEQ ID NO: 418933
  MOD_RES (1)..(22): Any amino acid
  MOD_RES (41)..(45): Any amino acid
  MOD_RES (78)..(83): Any amino acid
  MOD_RES (94)..(96): Any amino acid
  MOD_RES (106)..(182): Any amino acid
  MOD_RES (192)..(260): Any amino acid
  MOD_RES (270)..(277): Any amino acid
  MOD_RES (289)..(294): Any amino acid
  MOD_RES (315)..(331): Any amino acid
  MOD_RES (341)..(341): Any amino acid
  MOD_RES (355)..(399): Any amino acid
  MOD_RES (409)..(423): Any amino acid
  MOD_RES (436)..(449): Any amino acid
  MOD_RES (520)..(545): Any amino acid
  MOD_RES (563)..(569): Any amino acid

SEQ ID NO: 420514 - protein, 562 aa, Influenza virus; identical to SEQ ID NO: 418936
  MOD_RES (1)..(12): Any amino acid
  MOD_RES (101)..(102): Any amino acid
  MOD_RES (120)..(122): Any amino acid
  MOD_RES (136)..(154): Any amino acid
  MOD_RES (166)..(172): Any amino acid
  MOD_RES (199)..(203): Any amino acid
  MOD_RES (214)..(238): Any amino acid
  MOD_RES (248)..(249): Any amino acid
  MOD_RES (286)..(286): Any amino acid
  MOD_RES (386)..(391): Any amino acid

SEQ ID NO: 420515 - protein, 562 aa, Influenza virus; identical to SEQ ID NO: 418937
  MOD_RES (1)..(12): Any amino acid
  MOD_RES (78)..(78): Any amino acid
  MOD_RES (101)..(102): Any amino acid
  MOD_RES (120)..(122): Any amino acid
  MOD_RES (136)..(154): Any amino acid
  MOD_RES (164)..(172): Any amino acid
  MOD_RES (199)..(203): Any amino acid
  MOD_RES (214)..(238): Any amino acid
  MOD_RES (248)..(249): Any amino acid
  MOD_RES (286)..(286): Any amino acid
  MOD_RES (346)..(349): Any amino acid
  MOD_RES (386)..(391): Any amino acid
  MOD_RES (561)..(562): Any amino acid

SEQ ID NO: 420516 - protein, 562 aa, Influenza virus; identical to SEQ ID NO: 418938
  MOD_RES (1)..(12): Any amino acid
  MOD_RES (67)..(67): Any amino acid
  MOD_RES (77)..(78): Any amino acid
  MOD_RES (101)..(102): Any amino acid
  MOD_RES (120)..(122): Any amino acid
  MOD_RES (136)..(154): Any amino acid
  MOD_RES (166)..(172): Any amino acid
  MOD_RES (199)..(203): Any amino acid
  MOD_RES (214)..(238): Any amino acid
  MOD_RES (248)..(249): Any amino acid
  MOD_RES (286)..(286): Any amino acid
  MOD_RES (343)..(370): Any amino acid
  MOD_RES (386)..(391): Any amino acid
  MOD_RES (437)..(440): Any amino acid
  MOD_RES (476)..(477): Any amino acid
  MOD_RES (529)..(534): Any amino acid
  MOD_RES (548)..(552): Any amino acid

SEQ ID NO: 420517 - protein, 562 aa, Influenza virus; identical to SEQ ID NO: 418939
  MOD_RES (1)..(12): Any amino acid
  MOD_RES (39)..(41): Any amino acid
  MOD_RES (69)..(78): Any amino acid
  MOD_RES (101)..(102): Any amino acid
  MOD_RES (120)..(122): Any amino acid
  MOD_RES (136)..(172): Any amino acid
  MOD_RES (199)..(203): Any amino acid
  MOD_RES (214)..(238): Any amino acid
  MOD_RES (248)..(249): Any amino acid
  MOD_RES (259)..(260): Any amino acid
  MOD_RES (286)..(286): Any amino acid
  MOD_RES (298)..(308): Any amino acid
  MOD_RES (346)..(376): Any amino acid
  MOD_RES (386)..(391): Any amino acid
  MOD_RES (439)..(442): Any amino acid
  MOD_RES (479)..(487): Any amino acid
  MOD_RES (532)..(538): Any amino acid
  MOD_RES (556)..(562): Any amino acid

SEQ ID NO: 420518 - protein, 562 aa, Influenza virus; identical to SEQ ID NO: 418940
  MOD_RES (1)..(24): Any amino acid
  MOD_RES (39)..(42): Any amino acid
  MOD_RES (54)..(78): Any amino acid
  MOD_RES (88)..(90): Any amino acid
  MOD_RES (101)..(102): Any amino acid
  MOD_RES (120)..(122): Any amino acid
  MOD_RES (136)..(172): Any amino acid
  MOD_RES (199)..(249): Any amino acid
  MOD_RES (263)..(273): Any amino acid
  MOD_RES (286)..(286): Any amino acid
  MOD_RES (297)..(315): Any amino acid
  MOD_RES (345)..(376): Any amino acid
  MOD_RES (386)..(391): Any amino acid
  MOD_RES (438)..(445): Any amino acid
  MOD_RES (469)..(487): Any amino acid
  MOD_RES (529)..(538): Any amino acid
  MOD_RES (556)..(562): Any amino acid

SEQ ID NO: 420519 - protein, 469 aa, Influenza virus; identical to SEQ ID NO: 418943
  MOD_RES (17)..(24): Any amino acid
  MOD_RES (44)..(51): Any amino acid
  MOD_RES (62)..(62): Any amino acid
  MOD_RES (73)..(83): Any amino acid
  MOD_RES (210)..(212): Any amino acid
  MOD_RES (386)..(399): Any amino acid

SEQ ID NO: 420520 - protein, 469 aa, Influenza virus; identical to SEQ ID NO: 418944
  MOD_RES (17)..(24): Any amino acid
  MOD_RES (44)..(51): Any amino acid
  MOD_RES (62)..(62): Any amino acid
  MOD_RES (73)..(83): Any amino acid
  MOD_RES (102)..(102): Any amino acid
  MOD_RES (210)..(212): Any amino acid
  MOD_RES (386)..(399): Any amino acid
  MOD_RES (453)..(454): Any amino acid

SEQ ID NO: 420521 - protein, 469 aa, Influenza virus; identical to SEQ ID NO: 418945
  MOD_RES (1)..(2): Any amino acid
  MOD_RES (17)..(24): Any amino acid
  MOD_RES (44)..(51): Any amino acid
  MOD_RES (62)..(62): Any amino acid
  MOD_RES (73)..(83): Any amino acid
  MOD_RES (98)..(102): Any amino acid
  MOD_RES (126)..(126): Any amino acid
  MOD_RES (162)..(163): Any amino acid
  MOD_RES (181)..(183): Any amino acid
  MOD_RES (210)..(212): Any amino acid
  MOD_RES (224)..(224): Any amino acid
  MOD_RES (318)..(320): Any amino acid
  MOD_RES (386)..(399): Any amino acid
  MOD_RES (450)..(456): Any amino acid

SEQ ID NO: 420522 - protein, 469 aa, Influenza virus; identical to SEQ ID NO: 418946
  MOD_RES (1)..(2): Any amino acid
  MOD_RES (16)..(24): Any amino acid
  MOD_RES (42)..(51): Any amino acid
  MOD_RES (62)..(62): Any amino acid
  MOD_RES (73)..(86): Any amino acid
  MOD_RES (99)..(106): Any amino acid
  MOD_RES (158)..(167): Any amino acid
  MOD_RES (181)..(185): Any amino acid
  MOD_RES (209)..(212): Any amino acid
  MOD_RES (245)..(248): Any amino acid
  MOD_RES (331)..(332): Any amino acid
  MOD_RES (381)..(399): Any amino acid
  MOD_RES (410)..(414): Any amino acid
  MOD_RES (449)..(456): Any amino acid

SEQ ID NO: 420523 - protein, 469 aa, Influenza virus; identical to SEQ ID NO: 418947
  MOD_RES (1)..(3): Any amino acid
  MOD_RES (17)..(24): Any amino acid
  MOD_RES (44)..(62): Any amino acid
  MOD_RES (73)..(87): Any amino acid
  MOD_RES (102)..(107): Any amino acid
  MOD_RES (136)..(140): Any amino acid
  MOD_RES (158)..(167): Any amino acid
  MOD_RES (185)..(192): Any amino acid
  MOD_RES (208)..(227): Any amino acid
  MOD_RES (240)..(249): Any amino acid
  MOD_RES (274)..(277): Any amino acid
  MOD_RES (296)..(296): Any amino acid
  MOD_RES (354)..(356): Any amino acid
  MOD_RES (367)..(375): Any amino acid
  MOD_RES (386)..(399): Any amino acid
  MOD_RES (409)..(414): Any amino acid
  MOD_RES (443)..(457): Any amino acid

SEQ ID NO: 420524 - protein, 580 aa, Influenza virus; identical to SEQ ID NO: 418951
  MOD_RES (23)..(29): Any amino acid
  MOD_RES (51)..(57): Any amino acid
  MOD_RES (72)..(86): Any amino acid
  MOD_RES (105)..(133): Any amino acid
  MOD_RES (148)..(172): Any amino acid
  MOD_RES (183)..(200): Any amino acid
  MOD_RES (213)..(259): Any amino acid
  MOD_RES (269)..(273): Any amino acid
  MOD_RES (287)..(291): Any amino acid
  MOD_RES (301)..(306): Any amino acid
  MOD_RES (332)..(340): Any amino acid
  MOD_RES (386)..(386): Any amino acid
  MOD_RES (408)..(414): Any amino acid
  MOD_RES (508)..(509): Any amino acid
  MOD_RES (519)..(520): Any amino acid
  MOD_RES (530)..(539): Any amino acid
  MOD_RES (559)..(561): Any amino acid

SEQ ID NO: 420525 - protein, 580 aa, Influenza virus; identical to SEQ ID NO: 418952
  MOD_RES (1)..(3): Any amino acid
  MOD_RES (23)..(32): Any amino acid
  MOD_RES (51)..(57): Any amino acid
  MOD_RES (72)..(90): Any amino acid
  MOD_RES (105)..(133): Any amino acid
  MOD_RES (148)..(172): Any amino acid
  MOD_RES (183)..(200): Any amino acid
  MOD_RES (213)..(259): Any amino acid
  MOD_RES (269)..(273): Any amino acid
  MOD_RES (287)..(306): Any amino acid
  MOD_RES (332)..(342): Any amino acid
  MOD_RES (385)..(386): Any amino acid
  MOD_RES (408)..(414): Any amino acid
  MOD_RES (508)..(509): Any amino acid
  MOD_RES (519)..(520): Any amino acid
  MOD_RES (530)..(539): Any amino acid
  MOD_RES (559)..(561): Any amino acid
  MOD_RES (580)..(580): Any amino acid

SEQ ID NO: 420526 - protein, 580 aa, Influenza virus; identical to SEQ ID NO: 418953
  MOD_RES (1)..(10): Any amino acid
  MOD_RES (21)..(35): Any amino acid
  MOD_RES (51)..(57): Any amino acid
  MOD_RES (72)..(90): Any amino acid
  MOD_RES (105)..(133): Any amino acid
  MOD_RES (147)..(172): Any amino acid
  MOD_RES (183)..(200): Any amino acid
  MOD_RES (213)..(259): Any amino acid
  MOD_RES (269)..(273): Any amino acid
  MOD_RES (287)..(306): Any amino acid
  MOD_RES (332)..(345): Any amino acid
  MOD_RES (365)..(366): Any amino acid
  MOD_RES (384)..(386): Any amino acid
  MOD_RES (408)..(414): Any amino acid
  MOD_RES (426)..(428): Any amino acid
  MOD_RES (439)..(439): Any amino acid
  MOD_RES (506)..(509): Any amino acid
  MOD_RES (519)..(520): Any amino acid
  MOD_RES (530)..(539): Any amino acid
  MOD_RES (559)..(561): Any amino acid

SEQ ID NO: 420527 - protein, 580 aa, Influenza virus; identical to SEQ ID NO: 418954
  MOD_RES (1)..(10): Any amino acid
  MOD_RES (21)..(35): Any amino acid
  MOD_RES (50)..(57): Any amino acid
  MOD_RES (72)..(90): Any amino acid
  MOD_RES (102)..(133): Any amino acid
  MOD_RES (148)..(172): Any amino acid
  MOD_RES (182)..(200): Any amino acid
  MOD_RES (210)..(259): Any amino acid
  MOD_RES (269)..(273): Any amino acid
  MOD_RES (283)..(306): Any amino acid
  MOD_RES (327)..(345): Any amino acid
  MOD_RES (366)..(367): Any amino acid
  MOD_RES (385)..(386): Any amino acid
  MOD_RES (408)..(414): Any amino acid
  MOD_RES (425)..(450): Any amino acid
  MOD_RES (479)..(481): Any amino acid
  MOD_RES (508)..(509): Any amino acid
  MOD_RES (519)..(520): Any amino acid
  MOD_RES (530)..(539): Any amino acid
  MOD_RES (559)..(561): Any amino acid
  MOD_RES (577)..(580): Any amino acid

SEQ ID NO: 420528 - protein, 580 aa, Influenza virus; identical to SEQ ID NO: 418955
  MOD_RES (1)..(10): Any amino acid
  MOD_RES (21)..(35): Any amino acid
  MOD_RES (45)..(57): Any amino acid
  MOD_RES (67)..(95): Any amino acid
  MOD_RES (105)..(136): Any amino acid
  MOD_RES (148)..(173): Any amino acid
  MOD_RES (183)..(200): Any amino acid
  MOD_RES (211)..(310): Any amino acid
  MOD_RES (327)..(345): Any amino acid
  MOD_RES (365)..(374): Any amino acid
  MOD_RES (386)..(395): Any amino acid
  MOD_RES (406)..(414): Any amino acid
  MOD_RES (424)..(463): Any amino acid
  MOD_RES (480)..(488): Any amino acid
  MOD_RES (508)..(539): Any amino acid
  MOD_RES (559)..(562): Any amino acid

SEQ ID NO: 420529 - protein, 574 aa, Influenza virus; identical to SEQ ID NO: 418961
  MOD_RES (11)..(23): Any amino acid
  MOD_RES (51)..(51): Any amino acid
  MOD_RES (66)..(82): Any amino acid
  MOD_RES (99)..(117): Any amino acid
  MOD_RES (127)..(127): Any amino acid
  MOD_RES (142)..(166): Any amino acid
  MOD_RES (177)..(194): Any amino acid
  MOD_RES (207)..(251): Any amino acid
  MOD_RES (263)..(267): Any amino acid
  MOD_RES (282)..(285): Any amino acid
  MOD_RES (295)..(300): Any amino acid
  MOD_RES (380)..(380): Any amino acid
  MOD_RES (402)..(408): Any amino acid
  MOD_RES (514)..(514): Any amino acid
  MOD_RES (528)..(533): Any amino acid
  MOD_RES (553)..(555): Any amino acid

SEQ ID NO: 420530 - protein, 574 aa, Influenza virus; identical to SEQ ID NO: 418962
  MOD_RES (1)..(1): Any amino acid
  MOD_RES (11)..(26): Any amino acid
  MOD_RES (51)..(51): Any amino acid
  MOD_RES (66)..(84): Any amino acid
  MOD_RES (99)..(117): Any amino acid
  MOD_RES (127)..(127): Any amino acid
  MOD_RES (142)..(166): Any amino acid
  MOD_RES (177)..(194): Any amino acid
  MOD_RES (207)..(251): Any amino acid
  MOD_RES (263)..(267): Any amino acid
  MOD_RES (282)..(300): Any amino acid
  MOD_RES (380)..(380): Any amino acid
  MOD_RES (402)..(408): Any amino acid
  MOD_RES (419)..(420): Any amino acid
  MOD_RES (500)..(500): Any amino acid
  MOD_RES (514)..(514): Any amino acid
  MOD_RES (528)..(533): Any amino acid
  MOD_RES (548)..(555): Any amino acid
  MOD_RES (574)..(574): Any amino acid

SEQ ID NO: 420531 - protein, 574 aa, Influenza virus; identical to SEQ ID NO: 418963
  MOD_RES (1)..(29): Any amino acid
  MOD_RES (51)..(51): Any amino acid
  MOD_RES (66)..(84): Any amino acid
  MOD_RES (97)..(117): Any amino acid
  MOD_RES (127)..(127): Any amino acid
  MOD_RES (141)..(166): Any amino acid
  MOD_RES (177)..(194): Any amino acid
  MOD_RES (204)..(251): Any amino acid
  MOD_RES (263)..(267): Any amino acid
  MOD_RES (281)..(300): Any amino acid
  MOD_RES (357)..(360): Any amino acid
  MOD_RES (388)..(390): Any amino acid
  MOD_RES (402)..(408): Any amino acid
  MOD_RES (419)..(433): Any amino acid
  MOD_RES (514)..(514): Any amino acid
  MOD_RES (526)..(533): Any amino acid
  MOD_RES (553)..(555): Any amino acid

SEQ ID NO: 420532 - protein, 574 aa, Influenza virus; identical to SEQ ID NO: 418964
  MOD_RES (1)..(29): Any amino acid
  MOD_RES (51)..(87): Any amino acid
  MOD_RES (97)..(117): Any amino acid
  MOD_RES (127)..(127): Any amino acid
  MOD_RES (142)..(167): Any amino acid
  MOD_RES (177)..(194): Any amino acid
  MOD_RES (207)..(251): Any amino acid
  MOD_RES (262)..(272): Any amino acid
  MOD_RES (282)..(300): Any amino acid
  MOD_RES (329)..(329): Any amino acid
  MOD_RES (357)..(361): Any amino acid
  MOD_RES (388)..(390): Any amino acid
  MOD_RES (400)..(408): Any amino acid
  MOD_RES (418)..(446): Any amino acid
  MOD_RES (460)..(461): Any amino acid
  MOD_RES (471)..(482): Any amino acid
  MOD_RES (514)..(515): Any amino acid
  MOD_RES (528)..(533): Any amino acid
  MOD_RES (553)..(556): Any amino acid

SEQ ID NO: 420533 - protein, 574 aa, Influenza virus; identical to SEQ ID NO: 418965
  MOD_RES (1)..(38): Any amino acid
  MOD_RES (50)..(87): Any amino acid
  MOD_RES (97)..(117): Any amino acid
  MOD_RES (127)..(251): Any amino acid
  MOD_RES (262)..(272): Any amino acid
  MOD_RES (282)..(304): Any amino acid
  MOD_RES (339)..(339): Any amino acid
  MOD_RES (357)..(371): Any amino acid
  MOD_RES (387)..(390): Any amino acid
  MOD_RES (400)..(446): Any amino acid
  MOD_RES (460)..(462): Any amino acid
  MOD_RES (472)..(483): Any amino acid
  MOD_RES (502)..(502): Any amino acid
  MOD_RES (512)..(516): Any amino acid
  MOD_RES (528)..(534): Any amino acid
  MOD_RES (548)..(560): Any amino acid
  MOD_RES (571)..(574): Any amino acid

SEQ ID NO: 420534 - protein, 486 aa, Influenza virus; identical to SEQ ID NO: 418970
  MOD_RES (16)..(79): Any amino acid
  MOD_RES (90)..(91): Any amino acid
  MOD_RES (101)..(101): Any amino acid
  MOD_RES (134)..(134): Any amino acid
  MOD_RES (151)..(159): Any amino acid
  MOD_RES (205)..(206): Any amino acid
  MOD_RES (218)..(228): Any amino acid
  MOD_RES (257)..(263): Any amino acid
  MOD_RES (275)..(278): Any amino acid
  MOD_RES (318)..(324): Any amino acid
  MOD_RES (340)..(357): Any amino acid
  MOD_RES (379)..(381): Any amino acid
  MOD_RES (392)..(413): Any amino acid
  MOD_RES (442)..(445): Any amino acid

SEQ ID NO: 420535 - protein, 486 aa, Influenza virus; identical to SEQ ID NO: 418971
  MOD_RES (1)..(6): Any amino acid
  MOD_RES (16)..(91): Any amino acid
  MOD_RES (101)..(101): Any amino acid
  MOD_RES (134)..(134): Any amino acid
  MOD_RES (151)..(159): Any amino acid
  MOD_RES (189)..(193): Any amino acid
  MOD_RES (205)..(206): Any amino acid
  MOD_RES (218)..(228): Any amino acid
  MOD_RES (251)..(278): Any amino acid
  MOD_RES (318)..(324): Any amino acid
  MOD_RES (340)..(357): Any amino acid
  MOD_RES (379)..(381): Any amino acid
  MOD_RES (392)..(413): Any amino acid
  MOD_RES (442)..(445): Any amino acid
  MOD_RES (457)..(457): Any amino acid
  MOD_RES (485)..(486): Any amino acid

SEQ ID NO: 420536 - protein, 486 aa, Influenza virus; identical to SEQ ID NO: 418972
  MOD_RES (1)..(6): Any amino acid
  MOD_RES (16)..(91): Any amino acid
  MOD_RES (101)..(112): Any amino acid
  MOD_RES (134)..(134): Any amino acid
  MOD_RES (151)..(159): Any amino acid
  MOD_RES (170)..(171): Any amino acid
  MOD_RES (193)..(206): Any amino acid
  MOD_RES (218)..(228): Any amino acid
  MOD_RES (257)..(278): Any amino acid
  MOD_RES (316)..(324): Any amino acid
  MOD_RES (337)..(357): Any amino acid
  MOD_RES (379)..(381): Any amino acid
  MOD_RES (392)..(413): Any amino acid
  MOD_RES (436)..(445): Any amino acid
  MOD_RES (455)..(465): Any amino acid
  MOD_RES (484)..(486): Any amino acid

SEQ ID NO: 420537 - protein, 486 aa, Influenza virus; identical to SEQ ID NO: 418973
  MOD_RES (1)..(6): Any amino acid
  MOD_RES (16)..(91): Any amino acid
  MOD_RES (101)..(120): Any amino acid
  MOD_RES (130)..(134): Any amino acid
  MOD_RES (144)..(166): Any amino acid
  MOD_RES (185)..(206): Any amino acid
  MOD_RES (216)..(228): Any amino acid
  MOD_RES (257)..(278): Any amino acid
  MOD_RES (298)..(305): Any amino acid
  MOD_RES (318)..(324): Any amino acid
  MOD_RES (337)..(359): Any amino acid
  MOD_RES (379)..(382): Any amino acid
  MOD_RES (392)..(413): Any amino acid
  MOD_RES (427)..(445): Any amino acid
  MOD_RES (455)..(465): Any amino acid
  MOD_RES (476)..(486): Any amino acid

SEQ ID NO: 420538 - protein, 486 aa, Influenza virus; identical to SEQ ID NO: 418974
  MOD_RES (1)..(6): Any amino acid
  MOD_RES (16)..(91): Any amino acid
  MOD_RES (101)..(124): Any amino acid
  MOD_RES (134)..(171): Any amino acid
  MOD_RES (182)..(206): Any amino acid
  MOD_RES (218)..(240): Any amino acid
  MOD_RES (255)..(278): Any amino acid
  MOD_RES (288)..(288): Any amino acid
  MOD_RES (298)..(305): Any amino acid
  MOD_RES (318)..(367): Any amino acid
  MOD_RES (378)..(445): Any amino acid
  MOD_RES (455)..(472): Any amino acid
  MOD_RES (483)..(486): Any amino acid

SEQ ID NO: 420539 - protein, 571 aa, Influenza virus; identical to SEQ ID NO: 418976
  MOD_RES (1)..(18): Any amino acid
  MOD_RES (45)..(46): Any amino acid
  MOD_RES (60)..(62): Any amino acid
  MOD_RES (76)..(76): Any amino acid
  MOD_RES (93)..(95): Any amino acid
  MOD_RES (105)..(107): Any amino acid
  MOD_RES (139)..(141): Any amino acid
  MOD_RES (157)..(157): Any amino acid
  MOD_RES (168)..(173): Any amino acid
  MOD_RES (206)..(207): Any amino acid
  MOD_RES (222)..(223): Any amino acid
  MOD_RES (233)..(233): Any amino acid
  MOD_RES (275)..(288): Any amino acid
  MOD_RES (303)..(306): Any amino acid
  MOD_RES (317)..(317): Any amino acid
  MOD_RES (342)..(343): Any amino acid

SEQ ID NO: 420540 - protein, 571 aa, Influenza virus; identical to SEQ ID NO: 418977
  MOD_RES (1)..(18): Any amino acid
  MOD_RES (45)..(46): Any amino acid
  MOD_RES (60)..(62): Any amino acid
  MOD_RES (76)..(76): Any amino acid
  MOD_RES (93)..(95): Any amino acid
  MOD_RES (105)..(108): Any amino acid
  MOD_RES (139)..(141): Any amino acid
  MOD_RES (157)..(157): Any amino acid
  MOD_RES (168)..(173): Any amino acid
  MOD_RES (206)..(207): Any amino acid
  MOD_RES (222)..(223): Any amino acid
  MOD_RES (233)..(233): Any amino acid
  MOD_RES (275)..(288): Any amino acid
  MOD_RES (303)..(306): Any amino acid
  MOD_RES (317)..(317): Any amino acid
  MOD_RES (342)..(343): Any amino acid
  MOD_RES (353)..(364): Any amino acid
  MOD_RES (435)..(445): Any amino acid

SEQ ID NO: 420541 - protein, 571 aa, Influenza virus; identical to SEQ ID NO: 418978
  MOD_RES (1)..(18): Any amino acid
  MOD_RES (45)..(46): Any amino acid
  MOD_RES (60)..(62): Any amino acid
  MOD_RES (76)..(76): Any amino acid
  MOD_RES (91)..(95): Any amino acid
  MOD_RES (105)..(108): Any amino acid
  MOD_RES (126)..(126): Any amino acid
  MOD_RES (139)..(141): Any amino acid
  MOD_RES (155)..(157): Any amino acid
  MOD_RES (167)..(173): Any amino acid
  MOD_RES (194)..(194): Any amino acid
  MOD_RES (206)..(207): Any amino acid
  MOD_RES (222)..(223): Any amino acid
  MOD_RES (233)..(233): Any amino acid
  MOD_RES (275)..(288): Any amino acid
  MOD_RES (303)..(306): Any amino acid
  MOD_RES (317)..(317): Any amino acid
  MOD_RES (339)..(382): Any amino acid
  MOD_RES (442)..(448): Any amino acid
  MOD_RES (477)..(478): Any amino acid
  MOD_RES (569)..(571): Any amino acid

SEQ ID NO: 420542 - protein, 571 aa, Influenza virus; identical to SEQ ID NO: 418979
  MOD_RES (1)..(18): Any amino acid
  MOD_RES (28)..(28): Any amino acid
  MOD_RES (45)..(46): Any amino acid
  MOD_RES (56)..(62): Any amino acid
  MOD_RES (74)..(76): Any amino acid
  MOD_RES (91)..(95): Any amino acid
  MOD_RES (105)..(108): Any amino acid
  MOD_RES (126)..(126): Any amino acid
  MOD_RES (139)..(141): Any amino acid
  MOD_RES (157)..(157): Any amino acid
  MOD_RES (168)..(174): Any amino acid
  MOD_RES (189)..(207): Any amino acid
  MOD_RES (220)..(223): Any amino acid
  MOD_RES (233)..(233): Any amino acid
  MOD_RES (243)..(243): Any amino acid
  MOD_RES (267)..(288): Any amino acid
  MOD_RES (303)..(306): Any amino acid
  MOD_RES (317)..(317): Any amino acid
  MOD_RES (331)..(383): Any amino acid
  MOD_RES (397)..(414): Any amino acid
  MOD_RES (435)..(451): Any amino acid
  MOD_RES (467)..(481): Any amino acid
  MOD_RES (491)..(495): Any amino acid
  MOD_RES (525)..(527): Any amino acid

SEQ ID NO: 420543 - protein, 571 aa, Influenza virus; identical to SEQ ID NO: 418980
  MOD_RES (1)..(18): Any amino acid
  MOD_RES (28)..(28): Any amino acid
  MOD_RES (45)..(46): Any amino acid
  MOD_RES (60)..(63): Any amino acid
  MOD_RES (76)..(113): Any amino acid
  MOD_RES (127)..(128): Any amino acid
  MOD_RES (139)..(141): Any amino acid
  MOD_RES (151)..(174): Any amino acid
  MOD_RES (196)..(208): Any amino acid
  MOD_RES (222)..(223): Any amino acid
  MOD_RES (233)..(233): Any amino acid
  MOD_RES (251)..(253): Any amino acid
  MOD_RES (263)..(288): Any amino acid
  MOD_RES (303)..(306): Any amino acid
  MOD_RES (316)..(317): Any amino acid
  MOD_RES (328)..(384): Any amino acid
  MOD_RES (402)..(414): Any amino acid
  MOD_RES (424)..(424): Any amino acid
  MOD_RES (434)..(452): Any amino acid
  MOD_RES (470)..(487): Any amino acid
  MOD_RES (498)..(502): Any amino acid
  MOD_RES (538)..(541): Any amino acid
  MOD_RES (570)..(571): Any amino acid

SEQ ID NO: 420544 - protein, 608 aa, Influenza virus; identical to SEQ ID NO: 418984
  MOD_RES (12)..(18): Any amino acid
  MOD_RES (28)..(35): Any amino acid
  MOD_RES (57)..(68): Any amino acid
  MOD_RES (92)..(93): Any amino acid
  MOD_RES (104)..(138): Any amino acid
  MOD_RES (148)..(163): Any amino acid
  MOD_RES (173)..(197): Any amino acid
  MOD_RES (207)..(222): Any amino acid
  MOD_RES (236)..(266): Any amino acid
  MOD_RES (283)..(302): Any amino acid
  MOD_RES (339)..(340): Any amino acid
  MOD_RES (350)..(352): Any amino acid
  MOD_RES (433)..(441): Any amino acid
  MOD_RES (516)..(516): Any amino acid
  MOD_RES (527)..(551): Any amino acid
  MOD_RES (580)..(580): Any amino acid
  MOD_RES (608)..(608): Any amino acid

SEQ ID NO: 420545 - protein, 608 aa, Influenza virus; identical to SEQ ID NO: 418985
  MOD_RES (12)..(18): Any amino acid
  MOD_RES (28)..(35): Any amino acid
  MOD_RES (57)..(68): Any amino acid
  MOD_RES (92)..(93): Any amino acid
  MOD_RES (104)..(163): Any amino acid
  MOD_RES (173)..(197): Any amino acid
  MOD_RES (207)..(222): Any amino acid
  MOD_RES (236)..(266): Any amino acid
  MOD_RES (283)..(304): Any amino acid
  MOD_RES (314)..(316): Any amino acid
  MOD_RES (339)..(340): Any amino acid
  MOD_RES (350)..(358): Any amino acid
  MOD_RES (368)..(378): Any amino acid
  MOD_RES (433)..(441): Any amino acid
  MOD_RES (468)..(470): Any amino acid
  MOD_RES (516)..(516): Any amino acid
  MOD_RES (527)..(551): Any amino acid
  MOD_RES (567)..(580): Any amino acid
  MOD_RES (608)..(608): Any amino acid

SEQ ID NO: 420546 - protein, 608 aa, Influenza virus; identical to SEQ ID NO: 418986
  MOD_RES (1)..(18): Any amino acid
  MOD_RES (28)..(35): Any amino acid
  MOD_RES (57)..(68): Any amino acid
  MOD_RES (92)..(93): Any amino acid
  MOD_RES (104)..(163): Any amino acid
  MOD_RES (173)..(197): Any amino acid
  MOD_RES (207)..(222): Any amino acid
  MOD_RES (236)..(266): Any amino acid
  MOD_RES (283)..(304): Any amino acid
  MOD_RES (314)..(316): Any amino acid
  MOD_RES (336)..(340): Any amino acid
  MOD_RES (350)..(358): Any amino acid
  MOD_RES (368)..(384): Any amino acid
  MOD_RES (433)..(441): Any amino acid
  MOD_RES (474)..(476): Any amino acid
  MOD_RES (516)..(516): Any amino acid
  MOD_RES (527)..(551): Any amino acid
  MOD_RES (567)..(580): Any amino acid
  MOD_RES (595)..(598): Any amino acid
  MOD_RES (608)..(608): Any amino acid

SEQ ID NO: 420547 - protein, 608 aa, Influenza virus; identical to SEQ ID NO: 418987
  MOD_RES (1)..(18): Any amino acid
  MOD_RES (28)..(35): Any amino acid
  MOD_RES (57)..(68): Any amino acid
  MOD_RES (91)..(197): Any amino acid
  MOD_RES (207)..(222): Any amino acid
  MOD_RES (236)..(266): Any amino acid
  MOD_RES (283)..(304): Any amino acid
  MOD_RES (314)..(316): Any amino acid
  MOD_RES (339)..(358): Any amino acid
  MOD_RES (368)..(387): Any amino acid
  MOD_RES (398)..(399): Any amino acid
  MOD_RES (433)..(441): Any amino acid
  MOD_RES (467)..(480): Any amino acid
  MOD_RES (505)..(506): Any amino acid
  MOD_RES (516)..(516): Any amino acid
  MOD_RES (527)..(551): Any amino acid
  MOD_RES (575)..(580): Any amino acid

SEQ ID NO: 420548 - protein, 608 aa, Influenza virus; identical to SEQ ID NO: 418988
  MOD_RES (1)..(18): Any amino acid
  MOD_RES (28)..(44): Any amino acid
  MOD_RES (57)..(68): Any amino acid
  MOD_RES (92)..(197): Any amino acid
  MOD_RES (207)..(222): Any amino acid
  MOD_RES (236)..(273): Any amino acid
  MOD_RES (283)..(304): Any amino acid
  MOD_RES (314)..(316): Any amino acid
  MOD_RES (336)..(358): Any amino acid
  MOD_RES (368)..(403): Any amino acid
  MOD_RES (433)..(448): Any amino acid
  MOD_RES (468)..(481): Any amino acid
  MOD_RES (502)..(516): Any amino acid
  MOD_RES (527)..(553): Any amino acid
  MOD_RES (563)..(563): Any amino acid
  MOD_RES (574)..(580): Any amino acid
  MOD_RES (599)..(608): Any amino acid

SEQ ID NO: 420549 - protein, 599 aa, Influenza virus; identical to SEQ ID NO: 418993
  MOD_RES (12)..(18): Any amino acid
  MOD_RES (61)..(64): Any amino acid
  MOD_RES (92)..(92): Any amino acid
  MOD_RES (104)..(115): Any amino acid
  MOD_RES (130)..(135): Any amino acid
  MOD_RES (145)..(163): Any amino acid
  MOD_RES (173)..(193): Any amino acid
  MOD_RES (203)..(217): Any amino acid
  MOD_RES (232)..(260): Any amino acid
  MOD_RES (285)..(298): Any amino acid
  MOD_RES (346)..(348): Any amino acid
  MOD_RES (432)..(432): Any amino acid
  MOD_RES (507)..(507): Any amino acid
  MOD_RES (523)..(541): Any amino acid
  MOD_RES (563)..(571): Any amino acid
  MOD_RES (599)..(599): Any amino acid

SEQ ID NO: 420550 - protein, 599 aa, Influenza virus; identical to SEQ ID NO: 418994
  MOD_RES (12)..(18): Any amino acid
  MOD_RES (57)..(64): Any amino acid
  MOD_RES (92)..(92): Any amino acid
  MOD_RES (104)..(115): Any amino acid
  MOD_RES (130)..(163): Any amino acid
  MOD_RES (173)..(193): Any amino acid
  MOD_RES (203)..(217): Any amino acid
  MOD_RES (232)..(260): Any amino acid
  MOD_RES (285)..(300): Any amino acid
  MOD_RES (345)..(355): Any amino acid
  MOD_RES (432)..(432): Any amino acid
  MOD_RES (444)..(467): Any amino acid
  MOD_RES (507)..(507): Any amino acid
  MOD_RES (523)..(541): Any amino acid
  MOD_RES (563)..(571): Any amino acid
  MOD_RES (585)..(589): Any amino acid
  MOD_RES (599)..(599): Any amino acid

SEQ ID NO: 420551 - protein, 599 aa, Influenza virus; identical to SEQ ID NO: 418995
  MOD_RES (1)..(18): Any amino acid
  MOD_RES (61)..(64): Any amino acid
  MOD_RES (81)..(82): Any amino acid
  MOD_RES (92)..(92): Any amino acid
  MOD_RES (102)..(115): Any amino acid
  MOD_RES (130)..(163): Any amino acid
  MOD_RES (173)..(193): Any amino acid
  MOD_RES (203)..(217): Any amino acid
  MOD_RES (232)..(260): Any amino acid
  MOD_RES (285)..(300): Any amino acid
  MOD_RES (332)..(335): Any amino acid
  MOD_RES (346)..(355): Any amino acid
  MOD_RES (374)..(375): Any amino acid
  MOD_RES (432)..(433): Any amino acid
  MOD_RES (448)..(471): Any amino acid
  MOD_RES (489)..(496): Any amino acid
  MOD_RES (507)..(507): Any amino acid
  MOD_RES (523)..(541): Any amino acid
  MOD_RES (571)..(571): Any amino acid

SEQ ID NO: 420552 - protein, 599 aa, Influenza virus; identical to SEQ ID NO: 418996
  MOD_RES (1)..(18): Any amino acid
  MOD_RES (54)..(64): Any amino acid
  MOD_RES (78)..(92): Any amino acid
  MOD_RES (102)..(115): Any amino acid
  MOD_RES (130)..(163): Any amino acid
  MOD_RES (173)..(193): Any amino acid
  MOD_RES (203)..(217): Any amino acid
  MOD_RES (229)..(260): Any amino acid
  MOD_RES (285)..(300): Any amino acid
  MOD_RES (314)..(314): Any amino acid
  MOD_RES (324)..(326): Any amino acid
  MOD_RES (345)..(357): Any amino acid
  MOD_RES (373)..(380): Any amino acid
  MOD_RES (432)..(433): Any amino acid
  MOD_RES (451)..(472): Any amino acid
  MOD_RES (490)..(497): Any amino acid
  MOD_RES (507)..(507): Any amino acid
  MOD_RES (520)..(541): Any amino acid
  MOD_RES (563)..(571): Any amino acid
  MOD_RES (599)..(599): Any amino acid

SEQ ID NO: 420553 - protein, 599 aa, Influenza virus; identical to SEQ ID NO: 418997
  MOD_RES (1)..(21): Any amino acid
  MOD_RES (57)..(64): Any amino acid
  MOD_RES (77)..(115): Any amino acid
  MOD_RES (130)..(217): Any amino acid
  MOD_RES (227)..(271): Any amino acid
  MOD_RES (281)..(300): Any amino acid
  MOD_RES (314)..(326): Any amino acid
  MOD_RES (336)..(357): Any amino acid
  MOD_RES (367)..(380): Any amino acid
  MOD_RES (396)..(399): Any amino acid
  MOD_RES (427)..(507): Any amino acid
  MOD_RES (523)..(549): Any amino acid
  MOD_RES (563)..(571): Any amino acid
  MOD_RES (590)..(599): Any amino acid

SEQ ID NO: 420554 - protein, 500 aa, Influenza virus; identical to SEQ ID NO: 419004
  MOD_RES (30)..(41): Any amino acid
  MOD_RES (54)..(74): Any amino acid
  MOD_RES (86)..(114): Any amino acid
  MOD_RES (240)..(240): Any amino acid
  MOD_RES (267)..(271): Any amino acid
  MOD_RES (289)..(292): Any amino acid
  MOD_RES (310)..(310): Any amino acid
  MOD_RES (331)..(333): Any amino acid
  MOD_RES (354)..(366): Any amino acid
  MOD_RES (388)..(388): Any amino acid
  MOD_RES (403)..(417): Any amino acid
  MOD_RES (456)..(456): Any amino acid
  MOD_RES (472)..(472): Any amino acid

SEQ ID NO: 420555 - protein, 500 aa, Influenza virus; identical to SEQ ID NO: 419005
  MOD_RES (1)..(1): Any amino acid
  MOD_RES (30)..(51): Any amino acid
  MOD_RES (61)..(74): Any amino acid
  MOD_RES (86)..(114): Any amino acid
  MOD_RES (240)..(240): Any amino acid
  MOD_RES (267)..(279): Any amino acid
  MOD_RES (289)..(292): Any amino acid
  MOD_RES (310)..(310): Any amino acid
  MOD_RES (331)..(333): Any amino acid
  MOD_RES (354)..(366): Any amino acid
  MOD_RES (388)..(388): Any amino acid
  MOD_RES (403)..(417): Any amino acid
  MOD_RES (456)..(456): Any amino acid
  MOD_RES (472)..(483): Any amino acid
  MOD_RES (496)..(500): Any amino acid

SEQ ID NO: 420556 - protein, 500 aa, Influenza virus; identical to SEQ ID NO: 419006
  MOD_RES (1)..(1): Any amino acid
  MOD_RES (20)..(74): Any amino acid
  MOD_RES (86)..(114): Any amino acid
  MOD_RES (194)..(198): Any amino acid
  MOD_RES (240)..(240): Any amino acid
  MOD_RES (267)..(292): Any amino acid
  MOD_RES (310)..(310): Any amino acid
  MOD_RES (331)..(333): Any amino acid
  MOD_RES (354)..(366): Any amino acid
  MOD_RES (388)..(388): Any amino acid
  MOD_RES (400)..(417): Any amino acid
  MOD_RES (456)..(456): Any amino acid
  MOD_RES (472)..(483): Any amino acid

SEQ ID NO: 420557 - protein, 500 aa, Influenza virus; identical to SEQ ID NO: 419007
  MOD_RES (1)..(5): Any amino acid
  MOD_RES (28)..(74): Any amino acid
  MOD_RES (86)..(114): Any amino acid
  MOD_RES (155)..(159): Any amino acid
  MOD_RES (190)..(199): Any amino acid
  MOD_RES (240)..(240): Any amino acid
  MOD_RES (250)..(254): Any amino acid
  MOD_RES (265)..(299): Any amino acid
  MOD_RES (310)..(310): Any amino acid
  MOD_RES (320)..(320): Any amino acid
  MOD_RES (331)..(333): Any amino acid
  MOD_RES (354)..(366): Any amino acid
  MOD_RES (388)..(391): Any amino acid
  MOD_RES (403)..(417): Any amino acid
  MOD_RES (428)..(429): Any amino acid
  MOD_RES (455)..(456): Any amino acid
  MOD_RES (472)..(483): Any amino acid
  MOD_RES (496)..(500): Any amino acid

SEQ ID NO: 420558 - protein, 500 aa, Influenza virus; identical to SEQ ID NO: 419008
  MOD_RES (1)..(75): Any amino acid
  MOD_RES (85)..(118): Any amino acid
  MOD_RES (150)..(161): Any amino acid
  MOD_RES (178)..(180): Any amino acid
  MOD_RES (193)..(199): Any amino acid
  MOD_RES (213)..(213): Any amino acid
  MOD_RES (236)..(240): Any amino acid
  MOD_RES (250)..(300): Any amino acid
  MOD_RES (310)..(321): Any amino acid
  MOD_RES (331)..(335): Any amino acid
  MOD_RES (354)..(366): Any amino acid
  MOD_RES (377)..(378): Any amino acid
  MOD_RES (388)..(417): Any amino acid
  MOD_RES (427)..(434): Any amino acid
  MOD_RES (456)..(456): Any amino acid
  MOD_RES (467)..(483): Any amino acid
  MOD_RES (493)..(500): Any amino acid

SEQ ID NO: 420559 - protein, 573 aa, Influenza virus; identical to SEQ ID NO: 419012
  MOD_RES (1)..(15): Any amino acid
  MOD_RES (48)..(73): Any amino acid
  MOD_RES (84)..(88): Any amino acid
  MOD_RES (102)..(152): Any amino acid
  MOD_RES (171)..(217): Any amino acid
  MOD_RES (227)..(229): Any amino acid
  MOD_RES (242)..(257): Any amino acid
  MOD_RES (276)..(287): Any amino acid
  MOD_RES (299)..(339): Any amino acid
  MOD_RES (401)..(441): Any amino acid
  MOD_RES (511)..(536): Any amino acid

SEQ ID NO: 420560 - protein, 573 aa, Influenza virus; identical to SEQ ID NO: 419013
  MOD_RES (1)..(15): Any amino acid
  MOD_RES (47)..(73): Any amino acid
  MOD_RES (84)..(88): Any amino acid
  MOD_RES (102)..(152): Any amino acid
  MOD_RES (169)..(217): Any amino acid
  MOD_RES (227)..(229): Any amino acid
  MOD_RES (242)..(257): Any amino acid
  MOD_RES (276)..(287): Any amino acid
  MOD_RES (299)..(344): Any amino acid
  MOD_RES (401)..(441): Any amino acid
  MOD_RES (511)..(536): Any amino acid

SEQ ID NO: 420561 - protein, 573 aa, Influenza virus; identical to SEQ ID NO: 419014
  MOD_RES (1)..(15): Any amino acid
  MOD_RES (48)..(73): Any amino acid
  MOD_RES (84)..(88): Any amino acid
  MOD_RES (102)..(157): Any amino acid
  MOD_RES (170)..(217): Any amino acid
  MOD_RES (227)..(229): Any amino acid
  MOD_RES (242)..(263): Any amino acid
  MOD_RES (276)..(287): Any amino acid
  MOD_RES (299)..(344): Any amino acid
  MOD_RES (355)..(360): Any amino acid
  MOD_RES (401)..(441): Any amino acid
  MOD_RES (497)..(497): Any amino acid
  MOD_RES (511)..(536): Any amino acid

SEQ ID NO: 420562 - protein, 573 aa, Influenza virus; identical to SEQ ID NO: 419015
  MOD_RES (1)..(15): Any amino acid
  MOD_RES (48)..(73): Any amino acid
  MOD_RES (84)..(91): Any amino acid
  MOD_RES (102)..(157): Any amino acid
  MOD_RES (171)..(217): Any amino acid
  MOD_RES (227)..(229): Any amino acid
  MOD_RES (240)..(266): Any amino acid
  MOD_RES (276)..(287): Any amino acid
  MOD_RES (299)..(348): Any amino acid
  MOD_RES (359)..(369): Any amino acid
  MOD_RES (401)..(444): Any amino acid
  MOD_RES (511)..(536): Any amino acid
  MOD_RES (567)..(573): Any amino acid

SEQ ID NO: 420563 - protein, 573 aa, Influenza virus; identical to SEQ ID NO: 419016
  MOD_RES (1)..(15): Any amino acid
  MOD_RES (48)..(91): Any amino acid
  MOD_RES (102)..(159): Any amino acid
  MOD_RES (171)..(217): Any amino acid
  MOD_RES (227)..(229): Any amino acid
  MOD_RES (242)..(266): Any amino acid
  MOD_RES (276)..(348): Any amino acid
  MOD_RES (358)..(378): Any amino acid
  MOD_RES (401)..(446): Any amino acid
  MOD_RES (456)..(467): Any amino acid
  MOD_RES (488)..(488): Any amino acid
  MOD_RES (509)..(536): Any amino acid
  MOD_RES (548)..(549): Any amino acid
  MOD_RES (561)..(573): Any amino acid

SEQ ID NO: 420564 - protein, 471 aa, Influenza virus; identical to SEQ ID NO: 419022
  MOD_RES (1)..(6): Any amino acid
  MOD_RES (16)..(83): Any amino acid
  MOD_RES (126)..(127): Any amino acid
  MOD_RES (205)..(216): Any amino acid
  MOD_RES (235)..(236): Any amino acid
  MOD_RES (251)..(265): Any amino acid
  MOD_RES (283)..(283): Any amino acid
  MOD_RES (313)..(315): Any amino acid
  MOD_RES (334)..(334): Any amino acid
  MOD_RES (359)..(360): Any amino acid
  MOD_RES (383)..(403): Any amino acid
  MOD_RES (416)..(417): Any amino acid
  MOD_RES (436)..(436): Any amino acid
  MOD_RES (471)..(471): Any amino acid

SEQ ID NO: 420565 - protein, 471 aa, Influenza virus; identical to SEQ ID NO: 419023
  MOD_RES (1)..(6): Any amino acid
  MOD_RES (16)..(83): Any amino acid
  MOD_RES (126)..(127): Any amino acid
  MOD_RES (205)..(216): Any amino acid
  MOD_RES (234)..(236): Any amino acid
  MOD_RES (251)..(265): Any amino acid
  MOD_RES (277)..(283): Any amino acid
  MOD_RES (304)..(315): Any amino acid
  MOD_RES (334)..(334): Any amino acid
  MOD_RES (359)..(360): Any amino acid
  MOD_RES (383)..(403): Any amino acid
  MOD_RES (416)..(417): Any amino acid
  MOD_RES (436)..(436): Any amino acid
  MOD_RES (451)..(456): Any amino acid
  MOD_RES (471)..(471): Any amino acid

SEQ ID NO: 420566 - protein, 471 aa, Influenza virus; identical to SEQ ID NO: 419024
  MOD_RES (1)..(6): Any amino acid
  MOD_RES (16)..(83): Any amino acid
  MOD_RES (104)..(106): Any amino acid
  MOD_RES (116)..(116): Any amino acid
  MOD_RES (126)..(132): Any amino acid
  MOD_RES (142)..(142): Any amino acid
  MOD_RES (205)..(216): Any amino acid
  MOD_RES (235)..(236): Any amino acid
  MOD_RES (251)..(265): Any amino acid
  MOD_RES (276)..(287): Any amino acid
  MOD_RES (304)..(315): Any amino acid
  MOD_RES (334)..(334): Any amino acid
  MOD_RES (359)..(360): Any amino acid
  MOD_RES (383)..(403): Any amino acid
  MOD_RES (416)..(417): Any amino acid
  MOD_RES (434)..(437): Any amino acid
  MOD_RES (448)..(459): Any amino acid
  MOD_RES (471)..(471): Any amino acid

SEQ ID NO: 420567 - protein, 471 aa, Influenza virus; identical to SEQ ID NO: 419025
  MOD_RES (1)..(6): Any amino acid
  MOD_RES (16)..(83): Any amino acid
  MOD_RES (101)..(106): Any amino acid
  MOD_RES (116)..(133): Any amino acid
  MOD_RES (143)..(144): Any amino acid
  MOD_RES (170)..(171): Any amino acid
  MOD_RES (204)..(216): Any amino acid
  MOD_RES (235)..(236): Any amino acid
  MOD_RES (251)..(265): Any amino acid
  MOD_RES (277)..(287): Any amino acid
  MOD_RES (300)..(315): Any amino acid
  MOD_RES (334)..(334): Any amino acid
  MOD_RES (345)..(346): Any amino acid
  MOD_RES (359)..(360): Any amino acid
  MOD_RES (383)..(417): Any amino acid
  MOD_RES (427)..(438): Any amino acid
  MOD_RES (456)..(461): Any amino acid
  MOD_RES (471)..(471): Any amino acid

SEQ ID NO: 420568 - protein, 471 aa, Influenza virus; identical to SEQ ID NO: 419026
  MOD_RES (1)..(6): Any amino acid
  MOD_RES (16)..(83): Any amino acid
  MOD_RES (101)..(106): Any amino acid
  MOD_RES (116)..(133): Any amino acid
  MOD_RES (143)..(153): Any amino acid
  MOD_RES (163)..(167): Any amino acid
  MOD_RES (193)..(194): Any amino acid
  MOD_RES (205)..(225): Any amino acid
  MOD_RES (235)..(241): Any amino acid
  MOD_RES (251)..(265): Any amino acid
  MOD_RES (279)..(287): Any amino acid
  MOD_RES (304)..(334): Any amino acid
  MOD_RES (359)..(364): Any amino acid
  MOD_RES (383)..(417): Any amino acid
  MOD_RES (427)..(461): Any amino acid
  MOD_RES (471)..(471): Any amino acid

SEQ ID NO: 420569 - protein, 570 aa, Influenza virus; identical to SEQ ID NO: 419029
  MOD_RES (1)..(13): Any amino acid
  MOD_RES (52)..(73): Any amino acid
  MOD_RES (85)..(89): Any amino acid
  MOD_RES (100)..(100): Any amino acid
  MOD_RES (110)..(157): Any amino acid
  MOD_RES (168)..(188): Any amino acid
  MOD_RES (200)..(240): Any amino acid
  MOD_RES (274)..(277): Any amino acid
  MOD_RES (287)..(306): Any amino acid
  MOD_RES (329)..(329): Any amino acid
  MOD_RES (343)..(344): Any amino acid
  MOD_RES (391)..(393): Any amino acid
  MOD_RES (413)..(413): Any amino acid
  MOD_RES (424)..(424): Any amino acid
  MOD_RES (463)..(467): Any amino acid
  MOD_RES (495)..(496): Any amino acid
  MOD_RES (510)..(526): Any amino acid
  MOD_RES (550)..(554): Any amino acid

SEQ ID NO: 420570 - protein, 570 aa, Influenza virus; identical to SEQ ID NO: 419030
  MOD_RES (1)..(13): Any amino acid
  MOD_RES (52)..(73): Any amino acid
  MOD_RES (85)..(89): Any amino acid
  MOD_RES (100)..(100): Any amino acid
  MOD_RES (110)..(157): Any amino acid
  MOD_RES (168)..(188): Any amino acid
  MOD_RES (199)..(240): Any amino acid
  MOD_RES (274)..(306): Any amino acid
  MOD_RES (329)..(329): Any amino acid
  MOD_RES (343)..(344): Any amino acid
  MOD_RES (372)..(375): Any amino acid
  MOD_RES (391)..(393): Any amino acid
  MOD_RES (413)..(413): Any amino acid
  MOD_RES (424)..(424): Any amino acid
  MOD_RES (463)..(467): Any amino acid
  MOD_RES (495)..(496): Any amino acid
  MOD_RES (510)..(526): Any amino acid
  MOD_RES (550)..(554): Any amino acid
  MOD_RES (569)..(570): Any amino acid

SEQ ID NO: 420571 - protein, 570 aa, Influenza virus; identical to SEQ ID NO: 419031
  MOD_RES (1)..(13): Any amino acid
  MOD_RES (52)..(73): Any amino acid
  MOD_RES (83)..(89): Any amino acid
  MOD_RES (100)..(100): Any amino acid
  MOD_RES (110)..(157): Any amino acid
  MOD_RES (168)..(188): Any amino acid
  MOD_RES (200)..(240): Any amino acid
  MOD_RES (274)..(306): Any amino acid
  MOD_RES (329)..(329): Any amino acid
  MOD_RES (343)..(344): Any amino acid
  MOD_RES (354)..(355): Any amino acid
  MOD_RES (373)..(380): Any amino acid
  MOD_RES (391)..(393): Any amino acid
  MOD_RES (413)..(413): Any amino acid
  MOD_RES (424)..(424): Any amino acid
  MOD_RES (463)..(467): Any amino acid
  MOD_RES (482)..(483): Any amino acid
  MOD_RES (495)..(496): Any amino acid
  MOD_RES (509)..(526): Any amino acid
  MOD_RES (537)..(537): Any amino acid
  MOD_RES (549)..(554): Any amino acid
  MOD_RES (569)..(570): Any amino acid

SEQ ID NO: 420572 - protein, 570 aa, Influenza virus; identical to SEQ ID NO: 419032
  MOD_RES (1)..(13): Any amino acid
  MOD_RES (23)..(24): Any amino acid
  MOD_RES (52)..(73): Any amino acid
  MOD_RES (85)..(89): Any amino acid
  MOD_RES (100)..(100): Any amino acid
  MOD_RES (110)..(188): Any amino acid
  MOD_RES (198)..(240): Any amino acid
  MOD_RES (259)..(264): Any amino acid
  MOD_RES (274)..(306): Any amino acid
  MOD_RES (316)..(317): Any amino acid
  MOD_RES (329)..(331): Any amino acid
  MOD_RES (341)..(344): Any amino acid
  MOD_RES (354)..(380): Any amino acid
  MOD_RES (391)..(393): Any amino acid
  MOD_RES (413)..(424): Any amino acid
  MOD_RES (460)..(467): Any amino acid
  MOD_RES (479)..(484): Any amino acid
  MOD_RES (495)..(496): Any amino acid
  MOD_RES (508)..(526): Any amino acid
  MOD_RES (548)..(554): Any amino acid
  MOD_RES (564)..(570): Any amino acid

SEQ ID NO: 420573 - protein, 570 aa, Influenza virus; identical to SEQ ID NO: 419033
  MOD_RES (1)..(13): Any amino acid
  MOD_RES (23)..(26): Any amino acid
  MOD_RES (52)..(73): Any amino acid
  MOD_RES (85)..(89): Any amino acid
  MOD_RES (100)..(100): Any amino acid
  MOD_RES (110)..(188): Any amino acid
  MOD_RES (198)..(240): Any amino acid
  MOD_RES (267)..(308): Any amino acid
  MOD_RES (321)..(398): Any amino acid
  MOD_RES (408)..(424): Any amino acid
  MOD_RES (441)..(448): Any amino acid
  MOD_RES (459)..(469): Any amino acid
  MOD_RES (482)..(496): Any amino acid
  MOD_RES (506)..(526): Any amino acid
  MOD_RES (536)..(540): Any amino acid
  MOD_RES (550)..(556): Any amino acid
  MOD_RES (569)..(570): Any amino acid

SEQ ID NO: 420574 - protein, 619 aa, Influenza virus; identical to SEQ ID NO: 419037
  MOD_RES (14)..(23): Any amino acid
  MOD_RES (42)..(42): Any amino acid
  MOD_RES (67)..(93): Any amino acid
  MOD_RES (105)..(170): Any amino acid
  MOD_RES (185)..(204): Any amino acid
  MOD_RES (214)..(252): Any amino acid
  MOD_RES (264)..(273): Any amino acid
  MOD_RES (289)..(331): Any amino acid
  MOD_RES (341)..(341): Any amino acid
  MOD_RES (355)..(356): Any amino acid
  MOD_RES (375)..(375): Any amino acid
  MOD_RES (387)..(393): Any amino acid
  MOD_RES (449)..(449): Any amino acid
  MOD_RES (459)..(465): Any amino acid
  MOD_RES (480)..(483): Any amino acid
  MOD_RES (539)..(539): Any amino acid
  MOD_RES (552)..(553): Any amino acid
  MOD_RES (563)..(571): Any amino acid
  MOD_RES (593)..(598): Any amino acid
  MOD_RES (614)..(619): Any amino acid

SEQ ID NO: 420575 - protein, 619 aa, Influenza virus; identical to SEQ ID NO: 419038
  MOD_RES (14)..(30): Any amino acid
  MOD_RES (40)..(42): Any amino acid
  MOD_RES (67)..(93): Any amino acid
  MOD_RES (105)..(171): Any amino acid
  MOD_RES (185)..(204): Any amino acid
  MOD_RES (214)..(252): Any amino acid
  MOD_RES (264)..(273): Any amino acid
  MOD_RES (289)..(331): Any amino acid
  MOD_RES (341)..(341): Any amino acid
  MOD_RES (355)..(356): Any amino acid
  MOD_RES (366)..(375): Any amino acid
  MOD_RES (395)..(401): Any amino acid
  MOD_RES (449)..(449): Any amino acid
  MOD_RES (459)..(465): Any amino acid
  MOD_RES (480)..(483): Any amino acid
  MOD_RES (539)..(539): Any amino acid
  MOD_RES (551)..(553): Any amino acid
  MOD_RES (563)..(571): Any amino acid
  MOD_RES (593)..(598): Any amino acid
  MOD_RES (614)..(619): Any amino acid

SEQ ID NO: 420576 - protein, 619 aa, Influenza virus; identical to SEQ ID NO: 419039
  MOD_RES (1)..(1): Any amino acid
  MOD_RES (14)..(42): Any amino acid
  MOD_RES (67)..(93): Any amino acid
  MOD_RES (105)..(171): Any amino acid
  MOD_RES (185)..(204): Any amino acid
  MOD_RES (214)..(252): Any amino acid
  MOD_RES (264)..(273): Any amino acid
  MOD_RES (289)..(331): Any amino acid
  MOD_RES (341)..(341): Any amino acid
  MOD_RES (353)..(356): Any amino acid
  MOD_RES (366)..(375): Any amino acid
  MOD_RES (386)..(402): Any amino acid
  MOD_RES (449)..(449): Any amino acid
  MOD_RES (459)..(465): Any amino acid
  MOD_RES (480)..(483): Any amino acid
  MOD_RES (501)..(504): Any amino acid
  MOD_RES (525)..(529): Any amino acid
  MOD_RES (539)..(539): Any amino acid
  MOD_RES (552)..(553): Any amino acid
  MOD_RES (563)..(571): Any amino acid
  MOD_RES (593)..(598): Any amino acid
  MOD_RES (608)..(608): Any amino acid

SEQ ID NO: 420577 - protein, 619 aa, Influenza virus; identical to SEQ ID NO: 419040
  MOD_RES (1)..(2): Any amino acid
  MOD_RES (14)..(42): Any amino acid
  MOD_RES (67)..(93): Any amino acid
  MOD_RES (105)..(204): Any amino acid
  MOD_RES (214)..(252): Any amino acid
  MOD_RES (264)..(273): Any amino acid
  MOD_RES (289)..(331): Any amino acid
  MOD_RES (341)..(343): Any amino acid
  MOD_RES (355)..(375): Any amino acid
  MOD_RES (394)..(407): Any amino acid
  MOD_RES (425)..(431): Any amino acid
  MOD_RES (449)..(449): Any amino acid
  MOD_RES (459)..(465): Any amino acid
  MOD_RES (478)..(487): Any amino acid
  MOD_RES (503)..(504): Any amino acid
  MOD_RES (524)..(541): Any amino acid
  MOD_RES (552)..(553): Any amino acid
  MOD_RES (563)..(571): Any amino acid
  MOD_RES (581)..(581): Any amino acid
  MOD_RES (593)..(598): Any amino acid
  MOD_RES (612)..(619): Any amino acid

SEQ ID NO: 420578 - protein, 619 aa, Influenza virus; identical to SEQ ID NO: 419041
  MOD_RES (1)..(2): Any amino acid
  MOD_RES (14)..(42): Any amino acid
  MOD_RES (63)..(204): Any amino acid
  MOD_RES (214)..(253): Any amino acid
  MOD_RES (264)..(278): Any amino acid
  MOD_RES (289)..(377): Any amino acid
  MOD_RES (387)..(408): Any amino acid
  MOD_RES (426)..(449): Any amino acid
  MOD_RES (459)..(466): Any amino acid
  MOD_RES (476)..(487): Any amino acid
  MOD_RES (503)..(504): Any amino acid
  MOD_RES (526)..(541): Any amino acid
  MOD_RES (551)..(553): Any amino acid
  MOD_RES (563)..(571): Any amino acid
  MOD_RES (581)..(581): Any amino acid
  MOD_RES (591)..(605): Any amino acid
  MOD_RES (615)..(619): Any amino acid

SEQ ID NO: 420579 - protein, 573 aa, Influenza virus; identical to SEQ ID NO: 419044
  MOD_RES (16)..(22): Any amino acid
  MOD_RES (62)..(74): Any amino acid
  MOD_RES (98)..(98): Any amino acid
  MOD_RES (137)..(138): Any amino acid
  MOD_RES (151)..(155): Any amino acid
  MOD_RES (175)..(191): Any amino acid
  MOD_RES (202)..(204): Any amino acid
  MOD_RES (219)..(232): Any amino acid
  MOD_RES (254)..(255): Any amino acid
  MOD_RES (279)..(300): Any amino acid
  MOD_RES (568)..(573): Any amino acid

SEQ ID NO: 420580 - protein, 573 aa, Influenza virus; identical to SEQ ID NO: 419045
  MOD_RES (1)..(22): Any amino acid
  MOD_RES (62)..(74): Any amino acid
  MOD_RES (95)..(98): Any amino acid
  MOD_RES (137)..(138): Any amino acid
  MOD_RES (151)..(155): Any amino acid
  MOD_RES (175)..(191): Any amino acid
  MOD_RES (202)..(204): Any amino acid
  MOD_RES (219)..(232): Any amino acid
  MOD_RES (253)..(255): Any amino acid
  MOD_RES (279)..(300): Any amino acid
  MOD_RES (354)..(355): Any amino acid
  MOD_RES (384)..(394): Any amino acid
  MOD_RES (478)..(483): Any amino acid
  MOD_RES (568)..(573): Any amino acid

SEQ ID NO: 420581 - protein, 573 aa, Influenza virus; identical to SEQ ID NO: 419046
  MOD_RES (1)..(22): Any amino acid
  MOD_RES (62)..(75): Any amino acid
  MOD_RES (98)..(98): Any amino acid
  MOD_RES (137)..(138): Any amino acid
  MOD_RES (150)..(155): Any amino acid
  MOD_RES (175)..(191): Any amino acid
  MOD_RES (202)..(204): Any amino acid
  MOD_RES (219)..(232): Any amino acid
  MOD_RES (254)..(255): Any amino acid
  MOD_RES (279)..(300): Any amino acid
  MOD_RES (354)..(356): Any amino acid
  MOD_RES (373)..(394): Any amino acid
  MOD_RES (442)..(444): Any amino acid
  MOD_RES (479)..(484): Any amino acid
  MOD_RES (535)..(538): Any amino acid
  MOD_RES (562)..(562): Any amino acid

SEQ ID NO: 420582 - protein, 573 aa, Influenza virus; identical to SEQ ID NO: 419047
  MOD_RES (1)..(22): Any amino acid
  MOD_RES (32)..(40): Any amino acid
  MOD_RES (50)..(52): Any amino acid
  MOD_RES (62)..(78): Any amino acid
  MOD_RES (97)..(100): Any amino acid
  MOD_RES (137)..(138): Any amino acid
  MOD_RES (151)..(155): Any amino acid
  MOD_RES (175)..(191): Any amino acid
  MOD_RES (202)..(204): Any amino acid
  MOD_RES (219)..(232): Any amino acid
  MOD_RES (253)..(255): Any amino acid
  MOD_RES (266)..(268): Any amino acid
  MOD_RES (279)..(300): Any amino acid
  MOD_RES (316)..(316): Any amino acid
  MOD_RES (340)..(342): Any amino acid
  MOD_RES (354)..(394): Any amino acid
  MOD_RES (419)..(425): Any amino acid
  MOD_RES (443)..(453): Any amino acid
  MOD_RES (478)..(484): Any amino acid
  MOD_RES (530)..(539): Any amino acid
  MOD_RES (563)..(573): Any amino acid

SEQ ID NO: 420583 - protein, 573 aa, Influenza virus; identical to SEQ ID NO: 419048
  MOD_RES (1)..(22): Any amino acid
  MOD_RES (33)..(78): Any amino acid
  MOD_RES (90)..(100): Any amino acid
  MOD_RES (137)..(141): Any amino acid
  MOD_RES (151)..(156): Any amino acid
  MOD_RES (167)..(191): Any amino acid
  MOD_RES (202)..(204): Any amino acid
  MOD_RES (214)..(232): Any amino acid
  MOD_RES (254)..(257): Any amino acid
  MOD_RES (267)..(300): Any amino acid
  MOD_RES (345)..(398): Any amino acid
  MOD_RES (418)..(428): Any amino acid
  MOD_RES (440)..(453): Any amino acid
  MOD_RES (470)..(498): Any amino acid
  MOD_RES (516)..(539): Any amino acid
  MOD_RES (561)..(573): Any amino acid

SEQ ID NO: 420584 - protein, 469 aa, Influenza virus; identical to SEQ ID NO: 419055
  MOD_RES (20)..(20): Any amino acid
  MOD_RES (30)..(58): Any amino acid
  MOD_RES (72)..(83): Any amino acid
  MOD_RES (210)..(210): Any amino acid
  MOD_RES (255)..(258): Any amino acid
  MOD_RES (308)..(311): Any amino acid
  MOD_RES (392)..(393): Any amino acid
  MOD_RES (414)..(414): Any amino acid
  MOD_RES (469)..(469): Any amino acid

SEQ ID NO: 420585 - protein, 469 aa, Influenza virus; identical to SEQ ID NO: 419056
  MOD_RES (1)..(4): Any amino acid
  MOD_RES (20)..(20): Any amino acid
  MOD_RES (30)..(58): Any amino acid
  MOD_RES (72)..(83): Any amino acid
  MOD_RES (163)..(163): Any amino acid
  MOD_RES (181)..(183): Any amino acid
  MOD_RES (210)..(210): Any amino acid
  MOD_RES (225)..(227): Any amino acid
  MOD_RES (253)..(258): Any amino acid
  MOD_RES (272)..(274): Any amino acid
  MOD_RES (292)..(293): Any amino acid
  MOD_RES (308)..(311): Any amino acid
  MOD_RES (392)..(393): Any amino acid
  MOD_RES (410)..(414): Any amino acid
  MOD_RES (453)..(456): Any amino acid
  MOD_RES (469)..(469): Any amino acid

SEQ ID NO: 420586 - protein, 469 aa, Influenza virus; identical to SEQ ID NO: 419057
  MOD_RES (1)..(7): Any amino acid
  MOD_RES (20)..(20): Any amino acid
  MOD_RES (30)..(58): Any amino acid
  MOD_RES (72)..(83): Any amino acid
  MOD_RES (162)..(168): Any amino acid
  MOD_RES (185)..(185): Any amino acid
  MOD_RES (210)..(210): Any amino acid
  MOD_RES (221)..(229): Any amino acid
  MOD_RES (255)..(258): Any amino acid
  MOD_RES (272)..(277): Any amino acid
  MOD_RES (307)..(311): Any amino acid
  MOD_RES (392)..(393): Any amino acid
  MOD_RES (414)..(414): Any amino acid
  MOD_RES (452)..(456): Any amino acid
  MOD_RES (469)..(469): Any amino acid

SEQ ID NO: 420587 - protein, 469 aa, Influenza virus; identical to SEQ ID NO: 419058
  MOD_RES (1)..(9): Any amino acid
  MOD_RES (20)..(20): Any amino acid
  MOD_RES (30)..(58): Any amino acid
  MOD_RES (72)..(83): Any amino acid
  MOD_RES (100)..(104): Any amino acid
  MOD_RES (162)..(190): Any amino acid
  MOD_RES (208)..(229): Any amino acid
  MOD_RES (255)..(258): Any amino acid
  MOD_RES (272)..(296): Any amino acid
  MOD_RES (308)..(311): Any amino acid
  MOD_RES (321)..(325): Any amino acid
  MOD_RES (365)..(372): Any amino acid
  MOD_RES (390)..(393): Any amino acid
  MOD_RES (411)..(425): Any amino acid
  MOD_RES (443)..(443): Any amino acid
  MOD_RES (454)..(457): Any amino acid
  MOD_RES (469)..(469): Any amino acid

SEQ ID NO: 420588 - protein, 469 aa, Influenza virus; identical to SEQ ID NO: 419059
  MOD_RES (1)..(10): Any amino acid
  MOD_RES (20)..(20): Any amino acid
  MOD_RES (30)..(58): Any amino acid
  MOD_RES (72)..(84): Any amino acid
  MOD_RES (94)..(105): Any amino acid
  MOD_RES (152)..(152): Any amino acid
  MOD_RES (162)..(190): Any amino acid
  MOD_RES (210)..(229): Any amino acid
  MOD_RES (242)..(242): Any amino acid
  MOD_RES (255)..(258): Any amino acid
  MOD_RES (271)..(312): Any amino acid
  MOD_RES (322)..(325): Any amino acid
  MOD_RES (365)..(375): Any amino acid
  MOD_RES (392)..(394): Any amino acid
  MOD_RES (404)..(425): Any amino acid
  MOD_RES (444)..(459): Any amino acid
  MOD_RES (469)..(469): Any amino acid

SEQ ID NO: 420589 - protein, 597 aa, Influenza virus; identical to SEQ ID NO: 419063
  MOD_RES (16)..(24): Any amino acid
  MOD_RES (61)..(74): Any amino acid
  MOD_RES (99)..(100): Any amino acid
  MOD_RES (110)..(112): Any amino acid
  MOD_RES (123)..(125): Any amino acid
  MOD_RES (137)..(141): Any amino acid
  MOD_RES (151)..(163): Any amino acid
  MOD_RES (182)..(197): Any amino acid
  MOD_RES (209)..(212): Any amino acid
  MOD_RES (228)..(228): Any amino acid
  MOD_RES (244)..(244): Any amino acid
  MOD_RES (284)..(307): Any amino acid
  MOD_RES (335)..(335): Any amino acid
  MOD_RES (352)..(352): Any amino acid
  MOD_RES (371)..(377): Any amino acid
  MOD_RES (523)..(523): Any amino acid
  MOD_RES (578)..(582): Any amino acid

SEQ ID NO: 420590 - protein, 597 aa, Influenza virus; identical to SEQ ID NO: 419064
  MOD_RES (1)..(1): Any amino acid
  MOD_RES (16)..(24): Any amino acid
  MOD_RES (61)..(74): Any amino acid
  MOD_RES (96)..(100): Any amino acid
  MOD_RES (110)..(112): Any amino acid
  MOD_RES (123)..(125): Any amino acid
  MOD_RES (137)..(141): Any amino acid
  MOD_RES (151)..(163): Any amino acid
  MOD_RES (182)..(197): Any amino acid
  MOD_RES (209)..(212): Any amino acid
  MOD_RES (228)..(228): Any amino acid
  MOD_RES (244)..(244): Any amino acid
  MOD_RES (284)..(307): Any amino acid
  MOD_RES (334)..(335): Any amino acid
  MOD_RES (352)..(352): Any amino acid
  MOD_RES (379)..(385): Any amino acid
  MOD_RES (476)..(483): Any amino acid
  MOD_RES (509)..(513): Any amino acid
  MOD_RES (523)..(523): Any amino acid
  MOD_RES (578)..(582): Any amino acid
  MOD_RES (595)..(597): Any amino acid

SEQ ID NO: 420591 - protein, 597 aa, Influenza virus; identical to SEQ ID NO: 419065
  MOD_RES (1)..(2): Any amino acid
  MOD_RES (16)..(27): Any amino acid
  MOD_RES (61)..(74): Any amino acid
  MOD_RES (99)..(100): Any amino acid
  MOD_RES (110)..(112): Any amino acid
  MOD_RES (123)..(125): Any amino acid
  MOD_RES (137)..(141): Any amino acid
  MOD_RES (151)..(163): Any amino acid
  MOD_RES (182)..(197): Any amino acid
  MOD_RES (209)..(212): Any amino acid
  MOD_RES (228)..(228): Any amino acid
  MOD_RES (244)..(244): Any amino acid
  MOD_RES (284)..(307): Any amino acid
  MOD_RES (323)..(324): Any amino acid
  MOD_RES (335)..(335): Any amino acid
  MOD_RES (352)..(352): Any amino acid
  MOD_RES (378)..(386): Any amino acid
  MOD_RES (404)..(409): Any amino acid
  MOD_RES (480)..(483): Any amino acid
  MOD_RES (504)..(523): Any amino acid
  MOD_RES (578)..(582): Any amino acid
  MOD_RES (593)..(597): Any amino acid

SEQ ID NO: 420592 - protein, 597 aa, Influenza virus; identical to SEQ ID NO: 419066
  MOD_RES (1)..(5): Any amino acid
  MOD_RES (16)..(27): Any amino acid
  MOD_RES (61)..(74): Any amino acid
  MOD_RES (99)..(100): Any amino acid
  MOD_RES (110)..(112): Any amino acid
  MOD_RES (123)..(125): Any amino acid
  MOD_RES (137)..(141): Any amino acid
  MOD_RES (151)..(163): Any amino acid
  MOD_RES (182)..(197): Any amino acid
  MOD_RES (209)..(212): Any amino acid
  MOD_RES (226)..(228): Any amino acid
  MOD_RES (244)..(244): Any amino acid
  MOD_RES (284)..(307): Any amino acid
  MOD_RES (335)..(340): Any amino acid
  MOD_RES (352)..(353): Any amino acid
  MOD_RES (363)..(392): Any amino acid
  MOD_RES (410)..(413): Any amino acid
  MOD_RES (476)..(484): Any amino acid
  MOD_RES (508)..(527): Any amino acid
  MOD_RES (565)..(565): Any amino acid
  MOD_RES (575)..(582): Any amino acid
  MOD_RES (597)..(597): Any amino acid

SEQ ID NO: 420593 - protein, 597 aa, Influenza virus; identical to SEQ ID NO: 419067
  MOD_RES (1)..(31): Any amino acid
  MOD_RES (61)..(74): Any amino acid
  MOD_RES (94)..(112): Any amino acid
  MOD_RES (123)..(127): Any amino acid
  MOD_RES (137)..(141): Any amino acid
  MOD_RES (151)..(163): Any amino acid
  MOD_RES (181)..(215): Any amino acid
  MOD_RES (228)..(228): Any amino acid
  MOD_RES (244)..(244): Any amino acid
  MOD_RES (273)..(274): Any amino acid
  MOD_RES (284)..(307): Any amino acid
  MOD_RES (334)..(342): Any amino acid
  MOD_RES (352)..(353): Any amino acid
  MOD_RES (363)..(425): Any amino acid
  MOD_RES (455)..(458): Any amino acid
  MOD_RES (472)..(485): Any amino acid
  MOD_RES (503)..(536): Any amino acid
  MOD_RES (564)..(566): Any amino acid
  MOD_RES (578)..(583): Any amino acid
  MOD_RES (596)..(597): Any amino acid

SEQ ID NO: 420594 - protein, 515 aa, Influenza virus; identical to SEQ ID NO: 419073
  MOD_RES (1)..(10): Any amino acid
  MOD_RES (38)..(62): Any amino acid
  MOD_RES (80)..(84): Any amino acid
  MOD_RES (127)..(127): Any amino acid
  MOD_RES (198)..(255): Any amino acid
  MOD_RES (309)..(318): Any amino acid
  MOD_RES (458)..(459): Any amino acid
  MOD_RES (478)..(478): Any amino acid

SEQ ID NO: 420595 - protein, 515 aa, Influenza virus; identical to SEQ ID NO: 419074
  MOD_RES (1)..(10): Any amino acid
  MOD_RES (38)..(62): Any amino acid
  MOD_RES (80)..(84): Any amino acid
  MOD_RES (97)..(97): Any amino acid
  MOD_RES (127)..(127): Any amino acid
  MOD_RES (198)..(255): Any amino acid
  MOD_RES (309)..(318): Any amino acid
  MOD_RES (447)..(447): Any amino acid
  MOD_RES (458)..(459): Any amino acid
  MOD_RES (478)..(478): Any amino acid

SEQ ID NO: 420596 - protein, 515 aa, Influenza virus; identical to SEQ ID NO: 419075
  MOD_RES (1)..(10): Any amino acid
  MOD_RES (38)..(62): Any amino acid
  MOD_RES (80)..(84): Any amino acid
  MOD_RES (127)..(127): Any amino acid
  MOD_RES (184)..(185): Any amino acid
  MOD_RES (197)..(255): Any amino acid
  MOD_RES (268)..(271): Any amino acid
  MOD_RES (281)..(281): Any amino acid
  MOD_RES (309)..(318): Any amino acid
  MOD_RES (458)..(459): Any amino acid
  MOD_RES (474)..(478): Any amino acid
  MOD_RES (490)..(494): Any amino acid
  MOD_RES (514)..(515): Any amino acid

SEQ ID NO: 420597 - protein, 515 aa, Influenza virus; identical to SEQ ID NO: 419076
  MOD_RES (1)..(10): Any amino acid
  MOD_RES (38)..(62): Any amino acid
  MOD_RES (80)..(84): Any amino acid
  MOD_RES (122)..(127): Any amino acid
  MOD_RES (186)..(186): Any amino acid
  MOD_RES (198)..(255): Any amino acid
  MOD_RES (267)..(272): Any amino acid
  MOD_RES (309)..(318): Any amino acid
  MOD_RES (341)..(344): Any amino acid
  MOD_RES (362)..(366): Any amino acid
  MOD_RES (403)..(405): Any amino acid
  MOD_RES (447)..(459): Any amino acid
  MOD_RES (478)..(478): Any amino acid
  MOD_RES (494)..(500): Any amino acid
  MOD_RES (510)..(515): Any amino acid

SEQ ID NO: 420598 - protein, 515 aa, Influenza virus; identical to SEQ ID NO: 419077
  MOD_RES (1)..(10): Any amino acid
  MOD_RES (38)..(62): Any amino acid
  MOD_RES (80)..(85): Any amino acid
  MOD_RES (95)..(98): Any amino acid
  MOD_RES (112)..(112): Any amino acid
  MOD_RES (124)..(134): Any amino acid
  MOD_RES (185)..(186): Any amino acid
  MOD_RES (198)..(255): Any amino acid
  MOD_RES (268)..(272): Any amino acid
  MOD_RES (283)..(285): Any amino acid
  MOD_RES (307)..(323): Any amino acid
  MOD_RES (341)..(345): Any amino acid
  MOD_RES (359)..(375): Any amino acid
  MOD_RES (392)..(392): Any amino acid
  MOD_RES (403)..(408): Any amino acid
  MOD_RES (433)..(434): Any amino acid
  MOD_RES (453)..(459): Any amino acid
  MOD_RES (478)..(478): Any amino acid
  MOD_RES (488)..(500): Any amino acid
  MOD_RES (512)..(515): Any amino acid

SEQ ID NO: 420599 - protein, 585 aa, Influenza virus; identical to SEQ ID NO: 419080
  MOD_RES (16)..(23): Any amino acid
  MOD_RES (42)..(42): Any amino acid
  MOD_RES (67)..(80): Any amino acid
  MOD_RES (91)..(91): Any amino acid
  MOD_RES (104)..(105): Any amino acid
  MOD_RES (115)..(125): Any amino acid
  MOD_RES (139)..(143): Any amino acid
  MOD_RES (156)..(161): Any amino acid
  MOD_RES (178)..(182): Any amino acid
  MOD_RES (193)..(196): Any amino acid
  MOD_RES (207)..(211): Any amino acid
  MOD_RES (221)..(224): Any amino acid
  MOD_RES (235)..(241): Any amino acid
  MOD_RES (258)..(261): Any amino acid
  MOD_RES (282)..(311): Any amino acid
  MOD_RES (334)..(334): Any amino acid
  MOD_RES (348)..(349): Any amino acid
  MOD_RES (528)..(531): Any amino acid
  MOD_RES (566)..(568): Any amino acid

SEQ ID NO: 420600 - protein, 585 aa, Influenza virus; identical to SEQ ID NO: 419081
  MOD_RES (16)..(30): Any amino acid
  MOD_RES (42)..(42): Any amino acid
  MOD_RES (67)..(80): Any amino acid
  MOD_RES (90)..(91): Any amino acid
  MOD_RES (101)..(105): Any amino acid
  MOD_RES (115)..(125): Any amino acid
  MOD_RES (139)..(143): Any amino acid
  MOD_RES (156)..(161): Any amino acid
  MOD_RES (178)..(182): Any amino acid
  MOD_RES (193)..(196): Any amino acid
  MOD_RES (207)..(211): Any amino acid
  MOD_RES (221)..(224): Any amino acid
  MOD_RES (235)..(241): Any amino acid
  MOD_RES (258)..(261): Any amino acid
  MOD_RES (282)..(311): Any amino acid
  MOD_RES (333)..(334): Any amino acid
  MOD_RES (346)..(349): Any amino acid
  MOD_RES (400)..(400): Any amino acid
  MOD_RES (528)..(531): Any amino acid
  MOD_RES (566)..(568): Any amino acid

SEQ ID NO: 420601 - protein, 585 aa, Influenza virus; identical to SEQ ID NO: 419082
  MOD_RES (1)..(2): Any amino acid
  MOD_RES (16)..(30): Any amino acid
  MOD_RES (42)..(42): Any amino acid
  MOD_RES (67)..(80): Any amino acid
  MOD_RES (91)..(91): Any amino acid
  MOD_RES (104)..(105): Any amino acid
  MOD_RES (115)..(125): Any amino acid
  MOD_RES (139)..(143): Any amino acid
  MOD_RES (156)..(161): Any amino acid
  MOD_RES (178)..(182): Any amino acid
  MOD_RES (193)..(196): Any amino acid
  MOD_RES (207)..(211): Any amino acid
  MOD_RES (221)..(224): Any amino acid
  MOD_RES (235)..(241): Any amino acid
  MOD_RES (258)..(261): Any amino acid
  MOD_RES (282)..(311): Any amino acid
  MOD_RES (334)..(334): Any amino acid
  MOD_RES (348)..(349): Any amino acid
  MOD_RES (368)..(379): Any amino acid
  MOD_RES (401)..(401): Any amino acid
  MOD_RES (508)..(511): Any amino acid
  MOD_RES (528)..(531): Any amino acid
  MOD_RES (566)..(568): Any amino acid

SEQ ID NO: 420602 - protein, 585 aa, Influenza virus; identical to SEQ ID NO: 419083
  MOD_RES (1)..(5): Any amino acid
  MOD_RES (16)..(32): Any amino acid
  MOD_RES (42)..(42): Any amino acid
  MOD_RES (54)..(80): Any amino acid
  MOD_RES (91)..(91): Any amino acid
  MOD_RES (101)..(105): Any amino acid
  MOD_RES (115)..(125): Any amino acid
  MOD_RES (139)..(143): Any amino acid
  MOD_RES (154)..(161): Any amino acid
  MOD_RES (178)..(182): Any amino acid
  MOD_RES (193)..(196): Any amino acid
  MOD_RES (207)..(211): Any amino acid
  MOD_RES (221)..(224): Any amino acid
  MOD_RES (235)..(241): Any amino acid
  MOD_RES (253)..(261): Any amino acid
  MOD_RES (275)..(311): Any amino acid
  MOD_RES (334)..(349): Any amino acid
  MOD_RES (361)..(361): Any amino acid
  MOD_RES (371)..(380): Any amino acid
  MOD_RES (398)..(401): Any amino acid
  MOD_RES (527)..(531): Any amino acid
  MOD_RES (566)..(568): Any amino acid

SEQ ID NO: 420603 - protein, 585 aa, Influenza virus; identical to SEQ ID NO: 419084
  MOD_RES (1)..(44): Any amino acid
  MOD_RES (57)..(81): Any amino acid
  MOD_RES (91)..(105): Any amino acid
  MOD_RES (115)..(125): Any amino acid
  MOD_RES (139)..(143): Any amino acid
  MOD_RES (153)..(161): Any amino acid
  MOD_RES (172)..(224): Any amino acid
  MOD_RES (234)..(261): Any amino acid
  MOD_RES (282)..(311): Any amino acid
  MOD_RES (321)..(323): Any amino acid
  MOD_RES (334)..(350): Any amino acid
  MOD_RES (361)..(361): Any amino acid
  MOD_RES (371)..(384): Any amino acid
  MOD_RES (402)..(405): Any amino acid
  MOD_RES (421)..(426): Any amino acid
  MOD_RES (450)..(452): Any amino acid
  MOD_RES (464)..(467): Any amino acid
  MOD_RES (483)..(497): Any amino acid
  MOD_RES (528)..(531): Any amino acid
  MOD_RES (566)..(568): Any amino acid
  MOD_RES (583)..(585): Any amino acid

SEQ ID NO: 420604 - protein, 471 aa, Influenza virus; identical to SEQ ID NO: 419089
  MOD_RES (39)..(61): Any amino acid
  MOD_RES (73)..(81): Any amino acid
  MOD_RES (164)..(168): Any amino acid
  MOD_RES (251)..(267): Any amino acid
  MOD_RES (285)..(286): Any amino acid
  MOD_RES (309)..(309): Any amino acid
  MOD_RES (332)..(333): Any amino acid
  MOD_RES (387)..(392): Any amino acid
  MOD_RES (416)..(416): Any amino acid
  MOD_RES (454)..(454): Any amino acid

SEQ ID NO: 420605 - protein, 471 aa, Influenza virus; identical to SEQ ID NO: 419090
  MOD_RES (39)..(61): Any amino acid
  MOD_RES (73)..(81): Any amino acid
  MOD_RES (136)..(137): Any amino acid
  MOD_RES (164)..(168): Any amino acid
  MOD_RES (251)..(267): Any amino acid
  MOD_RES (285)..(286): Any amino acid
  MOD_RES (309)..(309): Any amino acid
  MOD_RES (332)..(333): Any amino acid
  MOD_RES (387)..(392): Any amino acid
  MOD_RES (416)..(416): Any amino acid
  MOD_RES (426)..(431): Any amino acid
  MOD_RES (449)..(454): Any amino acid

SEQ ID NO: 420606 - protein, 471 aa, Influenza virus; identical to SEQ ID NO: 419091
  MOD_RES (39)..(61): Any amino acid
  MOD_RES (73)..(81): Any amino acid
  MOD_RES (138)..(139): Any amino acid
  MOD_RES (164)..(168): Any amino acid
  MOD_RES (251)..(267): Any amino acid
  MOD_RES (285)..(286): Any amino acid
  MOD_RES (296)..(299): Any amino acid
  MOD_RES (309)..(309): Any amino acid
  MOD_RES (332)..(333): Any amino acid
  MOD_RES (387)..(392): Any amino acid
  MOD_RES (416)..(433): Any amino acid
  MOD_RES (451)..(454): Any amino acid
  MOD_RES (467)..(471): Any amino acid

SEQ ID NO: 420607 - protein, 471 aa, Influenza virus; identical to SEQ ID NO: 419092
  MOD_RES (1)..(1): Any amino acid
  MOD_RES (39)..(61): Any amino acid
  MOD_RES (71)..(81): Any amino acid
  MOD_RES (102)..(117): Any amino acid
  MOD_RES (127)..(143): Any amino acid
  MOD_RES (164)..(168): Any amino acid
  MOD_RES (247)..(275): Any amino acid
  MOD_RES (285)..(286): Any amino acid
  MOD_RES (297)..(299): Any amino acid
  MOD_RES (309)..(309): Any amino acid
  MOD_RES (332)..(336): Any amino acid
  MOD_RES (387)..(392): Any amino acid
  MOD_RES (409)..(438): Any amino acid
  MOD_RES (454)..(454): Any amino acid

SEQ ID NO: 420608 - protein, 471 aa, Influenza virus; identical to SEQ ID NO: 419093
  MOD_RES (1)..(7): Any amino acid
  MOD_RES (39)..(62): Any amino acid
  MOD_RES (73)..(84): Any amino acid
  MOD_RES (109)..(117): Any amino acid
  MOD_RES (127)..(144): Any amino acid
  MOD_RES (164)..(182): Any amino acid
  MOD_RES (206)..(206): Any amino acid
  MOD_RES (224)..(229): Any amino acid
  MOD_RES (251)..(286): Any amino acid
  MOD_RES (299)..(299): Any amino acid
  MOD_RES (309)..(309): Any amino acid
  MOD_RES (320)..(345): Any amino acid
  MOD_RES (368)..(369): Any amino acid
  MOD_RES (379)..(392): Any amino acid
  MOD_RES (409)..(471): Any amino acid

SEQ ID NO: 420609 - protein, 567 aa, Influenza virus; identical to SEQ ID NO: 419097
  MOD_RES (1)..(9): Any amino acid
  MOD_RES (179)..(183): Any amino acid
  MOD_RES (417)..(418): Any amino acid

SEQ ID NO: 420610 - protein, 567 aa, Influenza virus; identical to SEQ ID NO: 419098
  MOD_RES (1)..(9): Any amino acid
  MOD_RES (21)..(22): Any amino acid
  MOD_RES (101)..(102): Any amino acid
  MOD_RES (179)..(183): Any amino acid
  MOD_RES (244)..(266): Any amino acid
  MOD_RES (400)..(400): Any amino acid
  MOD_RES (417)..(418): Any amino acid
  MOD_RES (439)..(443): Any amino acid
  MOD_RES (537)..(537): Any amino acid

SEQ ID NO: 420611 - protein, 567 aa, Influenza virus; identical to SEQ ID NO: 419099
  MOD_RES (1)..(9): Any amino acid
  MOD_RES (21)..(25): Any amino acid
  MOD_RES (74)..(77): Any amino acid
  MOD_RES (101)..(103): Any amino acid
  MOD_RES (160)..(162): Any amino acid
  MOD_RES (248)..(270): Any amino acid
  MOD_RES (352)..(382): Any amino acid
  MOD_RES (400)..(402): Any amino acid
  MOD_RES (417)..(418): Any amino acid
  MOD_RES (444)..(446): Any amino acid
  MOD_RES (539)..(539): Any amino acid
  MOD_RES (557)..(567): Any amino acid

SEQ ID NO: 420612 - protein, 567 aa, Influenza virus; identical to SEQ ID NO: 419100
  MOD_RES (1)..(9): Any amino acid
  MOD_RES (26)..(28): Any amino acid
  MOD_RES (64)..(80): Any amino acid
  MOD_RES (98)..(122): Any amino acid
  MOD_RES (179)..(183): Any amino acid
  MOD_RES (252)..(271): Any amino acid
  MOD_RES (289)..(291): Any amino acid
  MOD_RES (351)..(382): Any amino acid
  MOD_RES (400)..(403): Any amino acid
  MOD_RES (417)..(418): Any amino acid
  MOD_RES (444)..(464): Any amino acid
  MOD_RES (485)..(497): Any amino acid
  MOD_RES (531)..(567): Any amino acid

SEQ ID NO: 420613 - protein, 567 aa, Influenza virus; identical to SEQ ID NO: 419101
  MOD_RES (1)..(9): Any amino acid
  MOD_RES (19)..(28): Any amino acid
  MOD_RES (46)..(46): Any amino acid
  MOD_RES (65)..(86): Any amino acid
  MOD_RES (101)..(133): Any amino acid
  MOD_RES (143)..(149): Any amino acid
  MOD_RES (167)..(171): Any amino acid
  MOD_RES (196)..(201): Any amino acid
  MOD_RES (221)..(234): Any amino acid
  MOD_RES (252)..(272): Any amino acid
  MOD_RES (290)..(291): Any amino acid
  MOD_RES (351)..(388): Any amino acid
  MOD_RES (406)..(418): Any amino acid
  MOD_RES (444)..(464): Any amino acid
  MOD_RES (489)..(497): Any amino acid
  MOD_RES (512)..(513): Any amino acid
  MOD_RES (531)..(567): Any amino acid

SEQ ID NO: 420614 - protein, 562 aa, Influenza virus; identical to SEQ ID NO: 419106
  MOD_RES (11)..(25): Any amino acid
  MOD_RES (39)..(55): Any amino acid
  MOD_RES (65)..(76): Any amino acid
  MOD_RES (89)..(95): Any amino acid
  MOD_RES (106)..(156): Any amino acid
  MOD_RES (166)..(245): Any amino acid
  MOD_RES (269)..(302): Any amino acid
  MOD_RES (315)..(323): Any amino acid
  MOD_RES (334)..(339): Any amino acid
  MOD_RES (372)..(425): Any amino acid
  MOD_RES (453)..(471): Any amino acid
  MOD_RES (486)..(487): Any amino acid
  MOD_RES (498)..(520): Any amino acid
  MOD_RES (538)..(562): Any amino acid

SEQ ID NO: 420615 - protein, 562 aa, Influenza virus; identical to SEQ ID NO: 419107
  MOD_RES (1)..(25): Any amino acid
  MOD_RES (39)..(55): Any amino acid
  MOD_RES (65)..(76): Any amino acid
  MOD_RES (89)..(95): Any amino acid
  MOD_RES (106)..(156): Any amino acid
  MOD_RES (166)..(245): Any amino acid
  MOD_RES (269)..(302): Any amino acid
  MOD_RES (315)..(323): Any amino acid
  MOD_RES (334)..(339): Any amino acid
  MOD_RES (372)..(425): Any amino acid
  MOD_RES (453)..(471): Any amino acid
  MOD_RES (486)..(487): Any amino acid
  MOD_RES (498)..(520): Any amino acid
  MOD_RES (538)..(562): Any amino acid

SEQ ID NO: 420616 - protein, 562 aa, Influenza virus; identical to SEQ ID NO: 419108
  MOD_RES (1)..(25): Any amino acid
  MOD_RES (39)..(55): Any amino acid
  MOD_RES (65)..(76): Any amino acid
  MOD_RES (89)..(95): Any amino acid
  MOD_RES (106)..(156): Any amino acid
  MOD_RES (166)..(245): Any amino acid
  MOD_RES (269)..(302): Any amino acid
  MOD_RES (315)..(323): Any amino acid
  MOD_RES (334)..(349): Any amino acid
  MOD_RES (372)..(425): Any amino acid
  MOD_RES (453)..(471): Any amino acid
  MOD_RES (486)..(487): Any amino acid
  MOD_RES (498)..(520): Any amino acid
  MOD_RES (538)..(562): Any amino acid

SEQ ID NO: 420617 - protein, 562 aa, Influenza virus; identical to SEQ ID NO: 419109
  MOD_RES (1)..(25): Any amino acid
  MOD_RES (39)..(55): Any amino acid
  MOD_RES (65)..(76): Any amino acid
  MOD_RES (89)..(95): Any amino acid
  MOD_RES (105)..(156): Any amino acid
  MOD_RES (166)..(245): Any amino acid
  MOD_RES (269)..(302): Any amino acid
  MOD_RES (315)..(323): Any amino acid
  MOD_RES (334)..(360): Any amino acid
  MOD_RES (372)..(425): Any amino acid
  MOD_RES (453)..(471): Any amino acid
  MOD_RES (486)..(487): Any amino acid
  MOD_RES (498)..(520): Any amino acid
  MOD_RES (538)..(562): Any amino acid

SEQ ID NO: 420618 - protein, 562 aa, Influenza virus; identical to SEQ ID NO: 419110
  MOD_RES (1)..(25): Any amino acid
  MOD_RES (39)..(55): Any amino acid
  MOD_RES (65)..(79): Any amino acid
  MOD_RES (89)..(96): Any amino acid
  MOD_RES (106)..(156): Any amino acid
  MOD_RES (166)..(249): Any amino acid
  MOD_RES (269)..(302): Any amino acid
  MOD_RES (315)..(323): Any amino acid
  MOD_RES (334)..(425): Any amino acid
  MOD_RES (436)..(438): Any amino acid
  MOD_RES (453)..(472): Any amino acid
  MOD_RES (482)..(487): Any amino acid
  MOD_RES (498)..(520): Any amino acid
  MOD_RES (530)..(562): Any amino acid

SEQ ID NO: 420619 - protein, 562 aa, Influenza virus; identical to SEQ ID NO: 419113
  MOD_RES (11)..(25): Any amino acid
  MOD_RES (39)..(55): Any amino acid
  MOD_RES (65)..(76): Any amino acid
  MOD_RES (89)..(95): Any amino acid
  MOD_RES (106)..(156): Any amino acid
  MOD_RES (166)..(244): Any amino acid
  MOD_RES (269)..(302): Any amino acid
  MOD_RES (320)..(323): Any amino acid
  MOD_RES (334)..(339): Any amino acid
  MOD_RES (372)..(424): Any amino acid
  MOD_RES (457)..(471): Any amino acid
  MOD_RES (486)..(487): Any amino acid
  MOD_RES (498)..(520): Any amino acid
  MOD_RES (538)..(562): Any amino acid

SEQ ID NO: 420620 - protein, 562 aa, Influenza virus; identical to SEQ ID NO: 419114
  MOD_RES (1)..(25): Any amino acid
  MOD_RES (39)..(55): Any amino acid
  MOD_RES (65)..(76): Any amino acid
  MOD_RES (89)..(95): Any amino acid
  MOD_RES (106)..(156): Any amino acid
  MOD_RES (166)..(244): Any amino acid
  MOD_RES (269)..(302): Any amino acid
  MOD_RES (320)..(323): Any amino acid
  MOD_RES (334)..(346): Any amino acid
  MOD_RES (372)..(424): Any amino acid
  MOD_RES (457)..(471): Any amino acid
  MOD_RES (486)..(487): Any amino acid
  MOD_RES (498)..(520): Any amino acid
  MOD_RES (538)..(562): Any amino acid

SEQ ID NO: 420621 - protein, 562 aa, Influenza virus; identical to SEQ ID NO: 419115
  MOD_RES (1)..(25): Any amino acid
  MOD_RES (39)..(55): Any amino acid
  MOD_RES (65)..(76): Any amino acid
  MOD_RES (89)..(95): Any amino acid
  MOD_RES (106)..(156): Any amino acid
  MOD_RES (166)..(244): Any amino acid
  MOD_RES (269)..(302): Any amino acid
  MOD_RES (320)..(323): Any amino acid
  MOD_RES (334)..(349): Any amino acid
  MOD_RES (372)..(424): Any amino acid
  MOD_RES (455)..(471): Any amino acid
  MOD_RES (486)..(487): Any amino acid
  MOD_RES (498)..(520): Any amino acid
  MOD_RES (538)..(562): Any amino acid

SEQ ID NO: 420622 - protein, 562 aa, Influenza virus; identical to SEQ ID NO: 419116
  MOD_RES (1)..(25): Any amino acid
  MOD_RES (39)..(55): Any amino acid
  MOD_RES (65)..(76): Any amino acid
  MOD_RES (89)..(95): Any amino acid
  MOD_RES (105)..(156): Any amino acid
  MOD_RES (166)..(244): Any amino acid
  MOD_RES (269)..(302): Any amino acid
  MOD_RES (320)..(323): Any amino acid
  MOD_RES (334)..(360): Any amino acid
  MOD_RES (372)..(424): Any amino acid
  MOD_RES (457)..(471): Any amino acid
  MOD_RES (486)..(487): Any amino acid
  MOD_RES (498)..(520): Any amino acid
  MOD_RES (538)..(562): Any amino acid

SEQ ID NO: 420623 - protein, 562 aa, Influenza virus; identical to SEQ ID NO: 419117
  MOD_RES (1)..(25): Any amino acid
  MOD_RES (35)..(55): Any amino acid
  MOD_RES (65)..(79): Any amino acid
  MOD_RES (89)..(96): Any amino acid
  MOD_RES (106)..(156): Any amino acid
  MOD_RES (166)..(244): Any amino acid
  MOD_RES (269)..(302): Any amino acid
  MOD_RES (320)..(323): Any amino acid
  MOD_RES (334)..(424): Any amino acid
  MOD_RES (434)..(444): Any amino acid
  MOD_RES (457)..(472): Any amino acid
  MOD_RES (482)..(487): Any amino acid
  MOD_RES (498)..(523): Any amino acid
  MOD_RES (537)..(562): Any amino acid

SEQ ID NO: 420624 - protein, 473 aa, Influenza virus; identical to SEQ ID NO: 419121
  MOD_RES (1)..(8): Any amino acid
  MOD_RES (18)..(51): Any amino acid
  MOD_RES (63)..(90): Any amino acid
  MOD_RES (104)..(110): Any amino acid
  MOD_RES (129)..(131): Any amino acid
  MOD_RES (145)..(157): Any amino acid
  MOD_RES (174)..(174): Any amino acid
  MOD_RES (196)..(224): Any amino acid
  MOD_RES (248)..(273): Any amino acid
  MOD_RES (289)..(292): Any amino acid
  MOD_RES (307)..(319): Any amino acid
  MOD_RES (333)..(350): Any amino acid
  MOD_RES (360)..(420): Any amino acid
  MOD_RES (436)..(449): Any amino acid
  MOD_RES (469)..(473): Any amino acid

SEQ ID NO: 420625 - protein, 473 aa, Influenza virus; identical to SEQ ID NO: 419122
  MOD_RES (1)..(90): Any amino acid
  MOD_RES (104)..(110): Any amino acid
  MOD_RES (129)..(131): Any amino acid
  MOD_RES (145)..(157): Any amino acid
  MOD_RES (174)..(174): Any amino acid
  MOD_RES (196)..(224): Any amino acid
  MOD_RES (248)..(273): Any amino acid
  MOD_RES (289)..(292): Any amino acid
  MOD_RES (307)..(319): Any amino acid
  MOD_RES (333)..(350): Any amino acid
  MOD_RES (360)..(420): Any amino acid
  MOD_RES (436)..(449): Any amino acid
  MOD_RES (469)..(473): Any amino acid

SEQ ID NO: 420626 - protein, 473 aa, Influenza virus; identical to SEQ ID NO: 419123
  MOD_RES (1)..(90): Any amino acid
  MOD_RES (104)..(110): Any amino acid
  MOD_RES (129)..(131): Any amino acid
  MOD_RES (141)..(157): Any amino acid
  MOD_RES (173)..(174): Any amino acid
  MOD_RES (194)..(224): Any amino acid
  MOD_RES (246)..(273): Any amino acid
  MOD_RES (289)..(292): Any amino acid
  MOD_RES (307)..(319): Any amino acid
  MOD_RES (329)..(350): Any amino acid
  MOD_RES (360)..(425): Any amino acid
  MOD_RES (436)..(449): Any amino acid
  MOD_RES (469)..(473): Any amino acid

SEQ ID NO: 420627 - protein, 473 aa, Influenza virus; identical to SEQ ID NO: 419124
  MOD_RES (1)..(90): Any amino acid
  MOD_RES (104)..(110): Any amino acid
  MOD_RES (129)..(131): Any amino acid
  MOD_RES (145)..(157): Any amino acid
  MOD_RES (167)..(174): Any amino acid
  MOD_RES (196)..(224): Any amino acid
  MOD_RES (246)..(273): Any amino acid
  MOD_RES (289)..(292): Any amino acid
  MOD_RES (307)..(323): Any amino acid
  MOD_RES (333)..(449): Any amino acid
  MOD_RES (469)..(473): Any amino acid

SEQ ID NO: 420628 - protein, 473 aa, Influenza virus; identical to SEQ ID NO: 419125
  MOD_RES (1)..(90): Any amino acid
  MOD_RES (100)..(110): Any amino acid
  MOD_RES (129)..(131): Any amino acid
  MOD_RES (143)..(162): Any amino acid
  MOD_RES (174)..(174): Any amino acid
  MOD_RES (184)..(185): Any amino acid
  MOD_RES (196)..(224): Any amino acid
  MOD_RES (234)..(236): Any amino acid
  MOD_RES (248)..(273): Any amino acid
  MOD_RES (289)..(293): Any amino acid
  MOD_RES (303)..(323): Any amino acid
  MOD_RES (333)..(449): Any amino acid
  MOD_RES (469)..(473): Any amino acid

SEQ ID NO: 420629 - protein, 275 aa, Influenza virus; identical to SEQ ID NO: 419131
  MOD_RES (143)..(145): Any amino acid
  MOD_RES (210)..(211): Any amino acid
  MOD_RES (227)..(234): Any amino acid

SEQ ID NO: 420630 - protein, 275 aa, Influenza virus; identical to SEQ ID NO: 419132
  MOD_RES (1)..(9): Any amino acid
  MOD_RES (71)..(74): Any amino acid
  MOD_RES (128)..(131): Any amino acid
  MOD_RES (143)..(145): Any amino acid
  MOD_RES (186)..(186): Any amino acid
  MOD_RES (210)..(211): Any amino acid
  MOD_RES (227)..(234): Any amino acid
  MOD_RES (256)..(256): Any amino acid
  MOD_RES (274)..(275): Any amino acid

SEQ ID NO: 420631 - protein, 275 aa, Influenza virus; identical to SEQ ID NO: 419133
  MOD_RES (1)..(9): Any amino acid
  MOD_RES (24)..(24): Any amino acid
  MOD_RES (49)..(57): Any amino acid
  MOD_RES (68)..(79): Any amino acid
  MOD_RES (143)..(145): Any amino acid
  MOD_RES (193)..(194): Any amino acid
  MOD_RES (209)..(211): Any amino acid
  MOD_RES (227)..(234): Any amino acid
  MOD_RES (256)..(275): Any amino acid

SEQ ID NO: 420632 - protein, 275 aa, Influenza virus; identical to SEQ ID NO: 419134
  MOD_RES (1)..(24): Any amino acid
  MOD_RES (48)..(90): Any amino acid
  MOD_RES (130)..(133): Any amino acid
  MOD_RES (143)..(154): Any amino acid
  MOD_RES (179)..(199): Any amino acid
  MOD_RES (210)..(211): Any amino acid
  MOD_RES (227)..(234): Any amino acid
  MOD_RES (256)..(275): Any amino acid

SEQ ID NO: 420633 - protein, 275 aa, Influenza virus; identical to SEQ ID NO: 419135
  MOD_RES (1)..(24): Any amino acid
  MOD_RES (40)..(95): Any amino acid
  MOD_RES (107)..(109): Any amino acid
  MOD_RES (123)..(211): Any amino acid
  MOD_RES (227)..(234): Any amino acid
  MOD_RES (256)..(275): Any amino acid

SEQ ID NO: 420634 - protein, 99 aa, Influenza virus; identical to SEQ ID NO: 419138
  MOD_RES (11)..(34): Any amino acid
  MOD_RES (44)..(67): Any amino acid
  MOD_RES (81)..(90): Any amino acid

SEQ ID NO: 420635 - protein, 99 aa, Influenza virus; identical to SEQ ID NO: 419139
  MOD_RES (1)..(1): Any amino acid
  MOD_RES (11)..(34): Any amino acid
  MOD_RES (44)..(67): Any amino acid
  MOD_RES (81)..(90): Any amino acid

SEQ ID NO: 420636 - protein, 99 aa, Influenza virus; identical to SEQ ID NO: 419140
  MOD_RES (1)..(1): Any amino acid
  MOD_RES (11)..(34): Any amino acid
  MOD_RES (44)..(67): Any amino acid
  MOD_RES (81)..(99): Any amino acid

SEQ ID NO: 420637 - protein, 99 aa, Influenza virus; identical to SEQ ID NO: 419141
  MOD_RES (1)..(1): Any amino acid
  MOD_RES (11)..(34): Any amino acid
  MOD_RES (44)..(67): Any amino acid
  MOD_RES (81)..(99): Any amino acid

SEQ ID NO: 420638 - protein, 99 aa, Influenza virus; identical to SEQ ID NO: 419142
  MOD_RES (1)..(9): Any amino acid
  MOD_RES (19)..(71): Any amino acid
  MOD_RES (81)..(99): Any amino acid

SEQ ID NO: 420639 - protein, 527 aa, Influenza virus; identical to SEQ ID NO: 419143
  MOD_RES (34)..(37): Any amino acid
  MOD_RES (116)..(130): Any amino acid
  MOD_RES (146)..(146): Any amino acid
  MOD_RES (305)..(305): Any amino acid
  MOD_RES (328)..(335): Any amino acid
  MOD_RES (367)..(375): Any amino acid
  MOD_RES (393)..(399): Any amino acid
  MOD_RES (421)..(422): Any amino acid
  MOD_RES (445)..(452): Any amino acid
  MOD_RES (478)..(480): Any amino acid
  MOD_RES (495)..(497): Any amino acid

SEQ ID NO: 420640 - protein, 527 aa, Influenza virus; identical to SEQ ID NO: 419144
  MOD_RES (1)..(9): Any amino acid
  MOD_RES (34)..(37): Any amino acid
  MOD_RES (116)..(130): Any amino acid
  MOD_RES (146)..(146): Any amino acid
  MOD_RES (182)..(190): Any amino acid
  MOD_RES (242)..(242): Any amino acid
  MOD_RES (265)..(265): Any amino acid
  MOD_RES (305)..(305): Any amino acid
  MOD_RES (328)..(335): Any amino acid
  MOD_RES (367)..(375): Any amino acid
  MOD_RES (393)..(399): Any amino acid
  MOD_RES (421)..(422): Any amino acid
  MOD_RES (445)..(452): Any amino acid
  MOD_RES (469)..(480): Any amino acid
  MOD_RES (495)..(497): Any amino acid
  MOD_RES (524)..(527): Any amino acid

SEQ ID NO: 420641 - protein, 527 aa, Influenza virus; identical to SEQ ID NO: 419145
  MOD_RES (1)..(9): Any amino acid
  MOD_RES (34)..(37): Any amino acid
  MOD_RES (83)..(91): Any amino acid
  MOD_RES (116)..(130): Any amino acid
  MOD_RES (146)..(146): Any amino acid
  MOD_RES (161)..(193): Any amino acid
  MOD_RES (242)..(243): Any amino acid
  MOD_RES (305)..(305): Any amino acid
  MOD_RES (328)..(335): Any amino acid
  MOD_RES (367)..(375): Any amino acid
  MOD_RES (390)..(399): Any amino acid
  MOD_RES (421)..(422): Any amino acid
  MOD_RES (445)..(452): Any amino acid
  MOD_RES (469)..(480): Any amino acid
  MOD_RES (494)..(497): Any amino acid
  MOD_RES (523)..(527): Any amino acid

SEQ ID NO: 420642 - protein, 527 aa, Influenza virus; identical to SEQ ID NO: 419146
  MOD_RES (1)..(9): Any amino acid
  MOD_RES (37)..(37): Any amino acid
  MOD_RES (83)..(91): Any amino acid
  MOD_RES (107)..(130): Any amino acid
  MOD_RES (146)..(146): Any amino acid
  MOD_RES (156)..(196): Any amino acid
  MOD_RES (216)..(230): Any amino acid
  MOD_RES (242)..(244): Any amino acid
  MOD_RES (305)..(305): Any amino acid
  MOD_RES (328)..(335): Any amino acid
  MOD_RES (367)..(375): Any amino acid
  MOD_RES (393)..(409): Any amino acid
  MOD_RES (420)..(422): Any amino acid
  MOD_RES (445)..(452): Any amino acid
  MOD_RES (469)..(480): Any amino acid
  MOD_RES (524)..(527): Any amino acid

SEQ ID NO: 420643 - protein, 527 aa, Influenza virus; identical to SEQ ID NO: 419147
  MOD_RES (1)..(11): Any amino acid
  MOD_RES (22)..(22): Any amino acid
  MOD_RES (34)..(37): Any amino acid
  MOD_RES (63)..(67): Any amino acid
  MOD_RES (83)..(92): Any amino acid
  MOD_RES (110)..(130): Any amino acid
  MOD_RES (146)..(196): Any amino acid
  MOD_RES (219)..(230): Any amino acid
  MOD_RES (242)..(247): Any amino acid
  MOD_RES (260)..(268): Any amino acid
  MOD_RES (293)..(294): Any amino acid
  MOD_RES (305)..(305): Any amino acid
  MOD_RES (315)..(320): Any amino acid
  MOD_RES (334)..(375): Any amino acid
  MOD_RES (389)..(411): Any amino acid
  MOD_RES (421)..(422): Any amino acid
  MOD_RES (433)..(452): Any amino acid
  MOD_RES (469)..(480): Any amino acid
  MOD_RES (515)..(527): Any amino acid

SEQ ID NO: 420644 - protein, 308 aa, Influenza virus; identical to SEQ ID NO: 419155
  MOD_RES (37)..(44): Any amino acid
  MOD_RES (58)..(58): Any amino acid
  MOD_RES (72)..(74): Any amino acid
  MOD_RES (91)..(123): Any amino acid
  MOD_RES (137)..(183): Any amino acid
  MOD_RES (194)..(222): Any amino acid
  MOD_RES (232)..(262): Any amino acid
  MOD_RES (281)..(285): Any amino acid

SEQ ID NO: 420645 - protein, 308 aa, Influenza virus; identical to SEQ ID NO: 419156
  MOD_RES (1)..(23): Any amino acid
  MOD_RES (37)..(44): Any amino acid
  MOD_RES (66)..(124): Any amino acid
  MOD_RES (137)..(285): Any amino acid
  MOD_RES (297)..(308): Any amino acid

SEQ ID NO: 420646 - protein, 308 aa, Influenza virus; identical to SEQ ID NO: 419157
  MOD_RES (1)..(23): Any amino acid
  MOD_RES (37)..(44): Any amino acid
  MOD_RES (58)..(58): Any amino acid
  MOD_RES (72)..(125): Any amino acid
  MOD_RES (137)..(285): Any amino acid
  MOD_RES (303)..(308): Any amino acid

SEQ ID NO: 420647 - protein, 308 aa, Influenza virus; identical to SEQ ID NO: 419158
  MOD_RES (1)..(23): Any amino acid
  MOD_RES (37)..(44): Any amino acid
  MOD_RES (58)..(58): Any amino acid
  MOD_RES (72)..(125): Any amino acid
  MOD_RES (136)..(308): Any amino acid

SEQ ID NO: 420648 - protein, 308 aa, Influenza virus; identical to SEQ ID NO: 419159
  MOD_RES (1)..(23): Any amino acid
  MOD_RES (37)..(44): Any amino acid
  MOD_RES (58)..(58): Any amino acid
  MOD_RES (72)..(308): Any amino acid

SEQ ID NO: 420649 - protein, 205 aa, Influenza virus; identical to SEQ ID NO: 419163
  MOD_RES (96)..(100): Any amino acid
  MOD_RES (110)..(149): Any amino acid
  MOD_RES (160)..(168): Any amino acid

SEQ ID NO: 420650 - protein, 205 aa, Influenza virus; identical to SEQ ID NO: 419164
  MOD_RES (1)..(13): Any amino acid
  MOD_RES (35)..(83): Any amino acid
  MOD_RES (96)..(149): Any amino acid
  MOD_RES (160)..(168): Any amino acid
  MOD_RES (201)..(205): Any amino acid

SEQ ID NO: 420651 - protein, 205 aa, Influenza virus; identical to SEQ ID NO: 419165
  MOD_RES (1)..(149): Any amino acid
  MOD_RES (160)..(170): Any amino acid
  MOD_RES (201)..(205): Any amino acid

SEQ ID NO: 420652 - protein, 205 aa, Influenza virus; identical to SEQ ID NO: 419166
  MOD_RES (1)..(149): Any amino acid
  MOD_RES (160)..(170): Any amino acid
  MOD_RES (203)..(205): Any amino acid

SEQ ID NO: 420653 - protein, 205 aa, Influenza virus; identical to SEQ ID NO: 419167
  MOD_RES (1)..(149): Any amino acid
  MOD_RES (160)..(186): Any amino acid
  MOD_RES (203)..(205): Any amino acid

SEQ ID NO: 420654 - protein, 734 aa, Influenza virus; identical to SEQ ID NO: 419168
  MOD_RES (27)..(30): Any amino acid
  MOD_RES (58)..(66): Any amino acid
  MOD_RES (86)..(86): Any amino acid
  MOD_RES (96)..(101): Any amino acid
  MOD_RES (159)..(159): Any amino acid
  MOD_RES (209)..(215): Any amino acid
  MOD_RES (228)..(229): Any amino acid
  MOD_RES (256)..(277): Any amino acid
  MOD_RES (325)..(352): Any amino acid
  MOD_RES (362)..(370): Any amino acid
  MOD_RES (388)..(410): Any amino acid
  MOD_RES (427)..(428): Any amino acid
  MOD_RES (466)..(467): Any amino acid
  MOD_RES (543)..(544): Any amino acid
  MOD_RES (554)..(568): Any amino acid
  MOD_RES (623)..(625): Any amino acid
  MOD_RES (728)..(734): Any amino acid

SEQ ID NO: 420655 - protein, 734 aa, Influenza virus; identical to SEQ ID NO: 419169
  MOD_RES (27)..(30): Any amino acid
  MOD_RES (58)..(66): Any amino acid
  MOD_RES (86)..(86): Any amino acid
  MOD_RES (96)..(101): Any amino acid
  MOD_RES (159)..(159): Any amino acid
  MOD_RES (172)..(174): Any amino acid
  MOD_RES (209)..(215): Any amino acid
  MOD_RES (228)..(229): Any amino acid
  MOD_RES (256)..(277): Any amino acid
  MOD_RES (323)..(370): Any amino acid
  MOD_RES (388)..(410): Any amino acid
  MOD_RES (427)..(428): Any amino acid
  MOD_RES (466)..(467): Any amino acid
  MOD_RES (514)..(519): Any amino acid
  MOD_RES (543)..(544): Any amino acid
  MOD_RES (554)..(568): Any amino acid
  MOD_RES (623)..(625): Any amino acid
  MOD_RES (707)..(712): Any amino acid
  MOD_RES (732)..(734): Any amino acid

SEQ ID NO: 420656 - protein, 734 aa, Influenza virus; identical to SEQ ID NO: 419170
  MOD_RES (27)..(30): Any amino acid
  MOD_RES (46)..(48): Any amino acid
  MOD_RES (58)..(66): Any amino acid
  MOD_RES (86)..(86): Any amino acid
  MOD_RES (96)..(101): Any amino acid
  MOD_RES (159)..(159): Any amino acid
  MOD_RES (209)..(215): Any amino acid
  MOD_RES (228)..(229): Any amino acid
  MOD_RES (256)..(277): Any amino acid
  MOD_RES (288)..(289): Any amino acid
  MOD_RES (301)..(303): Any amino acid
  MOD_RES (325)..(370): Any amino acid
  MOD_RES (388)..(410): Any amino acid
  MOD_RES (427)..(428): Any amino acid
  MOD_RES (543)..(544): Any amino acid
  MOD_RES (554)..(568): Any amino acid
  MOD_RES (591)..(596): Any amino acid
  MOD_RES (623)..(625): Any amino acid
  MOD_RES (706)..(712): Any amino acid
  MOD_RES (727)..(734): Any amino acid

SEQ ID NO: 420657 - protein, 734 aa, Influenza virus; identical to SEQ ID NO: 419171
  MOD_RES (23)..(31): Any amino acid
  MOD_RES (58)..(66): Any amino acid
  MOD_RES (76)..(76): Any amino acid
  MOD_RES (86)..(86): Any amino acid
  MOD_RES (96)..(101): Any amino acid
  MOD_RES (159)..(159): Any amino acid
  MOD_RES (169)..(176): Any amino acid
  MOD_RES (187)..(196): Any amino acid
  MOD_RES (209)..(217): Any amino acid
  MOD_RES (228)..(229): Any amino acid
  MOD_RES (256)..(277): Any amino acid
  MOD_RES (288)..(289): Any amino acid
  MOD_RES (301)..(304): Any amino acid
  MOD_RES (325)..(370): Any amino acid
  MOD_RES (388)..(410): Any amino acid
  MOD_RES (427)..(428): Any amino acid
  MOD_RES (486)..(491): Any amino acid
  MOD_RES (514)..(524): Any amino acid
  MOD_RES (541)..(544): Any amino acid
  MOD_RES (554)..(568): Any amino acid
  MOD_RES (579)..(599): Any amino acid
  MOD_RES (623)..(625): Any amino acid
  MOD_RES (645)..(650): Any amino acid
  MOD_RES (666)..(669): Any amino acid
  MOD_RES (684)..(684): Any amino acid
  MOD_RES (706)..(712): Any amino acid

SEQ ID NO: 420658 - protein, 734 aa, Influenza virus; identical to SEQ ID NO: 419172
  MOD_RES (1)..(1): Any amino acid
  MOD_RES (23)..(33): Any amino acid
  MOD_RES (47)..(48): Any amino acid
  MOD_RES (58)..(86): Any amino acid
  MOD_RES (96)..(101): Any amino acid
  MOD_RES (114)..(120): Any amino acid
  MOD_RES (136)..(140): Any amino acid
  MOD_RES (159)..(163): Any amino acid
  MOD_RES (195)..(200): Any amino acid
  MOD_RES (210)..(231): Any amino acid
  MOD_RES (241)..(246): Any amino acid
  MOD_RES (256)..(291): Any amino acid
  MOD_RES (301)..(312): Any amino acid
  MOD_RES (323)..(370): Any amino acid
  MOD_RES (381)..(417): Any amino acid
  MOD_RES (427)..(429): Any amino acid
  MOD_RES (473)..(478): Any amino acid
  MOD_RES (489)..(496): Any amino acid
  MOD_RES (506)..(525): Any amino acid
  MOD_RES (541)..(568): Any amino acid
  MOD_RES (578)..(603): Any amino acid
  MOD_RES (621)..(625): Any amino acid
  MOD_RES (646)..(651): Any amino acid
  MOD_RES (668)..(669): Any amino acid
  MOD_RES (684)..(696): Any amino acid
  MOD_RES (708)..(712): Any amino acid
  MOD_RES (723)..(734): Any amino acid

SEQ ID NO: 420659 - protein, 829 aa, Influenza virus; identical to SEQ ID NO: 419179
  MOD_RES (12)..(12): Any amino acid
  MOD_RES (58)..(59): Any amino acid
  MOD_RES (113)..(115): Any amino acid
  MOD_RES (156)..(159): Any amino acid
  MOD_RES (174)..(181): Any amino acid
  MOD_RES (213)..(217): Any amino acid
  MOD_RES (332)..(332): Any amino acid
  MOD_RES (367)..(391): Any amino acid
  MOD_RES (403)..(405): Any amino acid
  MOD_RES (440)..(440): Any amino acid
  MOD_RES (462)..(464): Any amino acid
  MOD_RES (585)..(594): Any amino acid
  MOD_RES (625)..(626): Any amino acid
  MOD_RES (666)..(684): Any amino acid
  MOD_RES (802)..(808): Any amino acid

SEQ ID NO: 420660 - protein, 829 aa, Influenza virus; identical to SEQ ID NO: 419180
  MOD_RES (1)..(2): Any amino acid
  MOD_RES (12)..(12): Any amino acid
  MOD_RES (23)..(37): Any amino acid
  MOD_RES (58)..(59): Any amino acid
  MOD_RES (73)..(77): Any amino acid
  MOD_RES (113)..(115): Any amino acid
  MOD_RES (140)..(142): Any amino acid
  MOD_RES (156)..(159): Any amino acid
  MOD_RES (174)..(181): Any amino acid
  MOD_RES (213)..(217): Any amino acid
  MOD_RES (227)..(246): Any amino acid
  MOD_RES (266)..(285): Any amino acid
  MOD_RES (309)..(310): Any amino acid
  MOD_RES (332)..(332): Any amino acid
  MOD_RES (367)..(405): Any amino acid
  MOD_RES (416)..(424): Any amino acid
  MOD_RES (440)..(440): Any amino acid
  MOD_RES (462)..(464): Any amino acid
  MOD_RES (502)..(515): Any amino acid
  MOD_RES (543)..(561): Any amino acid
  MOD_RES (585)..(594): Any amino acid
  MOD_RES (607)..(607): Any amino acid
  MOD_RES (624)..(626): Any amino acid
  MOD_RES (642)..(684): Any amino acid
  MOD_RES (720)..(730): Any amino acid
  MOD_RES (757)..(757): Any amino acid
  MOD_RES (802)..(808): Any amino acid
  MOD_RES (827)..(829): Any amino acid

SEQ ID NO: 420661 - protein, 829 aa, Influenza virus; identical to SEQ ID NO: 419181
  MOD_RES (1)..(3): Any amino acid
  MOD_RES (17)..(45): Any amino acid
  MOD_RES (58)..(59): Any amino acid
  MOD_RES (87)..(90): Any amino acid
  MOD_RES (113)..(115): Any amino acid
  MOD_RES (132)..(145): Any amino acid
  MOD_RES (156)..(159): Any amino acid
  MOD_RES (174)..(181): Any amino acid
  MOD_RES (213)..(217): Any amino acid
  MOD_RES (227)..(250): Any amino acid
  MOD_RES (272)..(287): Any amino acid
  MOD_RES (309)..(310): Any amino acid
  MOD_RES (322)..(322): Any amino acid
  MOD_RES (332)..(332): Any amino acid
  MOD_RES (367)..(405): Any amino acid
  MOD_RES (417)..(427): Any amino acid
  MOD_RES (440)..(440): Any amino acid
  MOD_RES (451)..(452): Any amino acid
  MOD_RES (462)..(464): Any amino acid
  MOD_RES (493)..(527): Any amino acid
  MOD_RES (545)..(564): Any amino acid
  MOD_RES (585)..(594): Any amino acid
  MOD_RES (608)..(612): Any amino acid
  MOD_RES (625)..(626): Any amino acid
  MOD_RES (642)..(684): Any amino acid
  MOD_RES (706)..(736): Any amino acid
  MOD_RES (760)..(763): Any amino acid
  MOD_RES (793)..(829): Any amino acid

SEQ ID NO: 420662 - protein, 829 aa, Influenza virus; identical to SEQ ID NO: 419182
  MOD_RES (1)..(4): Any amino acid
  MOD_RES (17)..(47): Any amino acid
  MOD_RES (58)..(59): Any amino acid
  MOD_RES (89)..(90): Any amino acid
  MOD_RES (113)..(145): Any amino acid
  MOD_RES (156)..(164): Any amino acid
  MOD_RES (174)..(181): Any amino acid
  MOD_RES (213)..(217): Any amino acid
  MOD_RES (231)..(250): Any amino acid
  MOD_RES (272)..(292): Any amino acid
  MOD_RES (305)..(313): Any amino acid
  MOD_RES (330)..(332): Any amino acid
  MOD_RES (343)..(357): Any amino acid
  MOD_RES (367)..(405): Any amino acid
  MOD_RES (415)..(430): Any amino acid
  MOD_RES (440)..(440): Any amino acid
  MOD_RES (451)..(452): Any amino acid
  MOD_RES (462)..(529): Any amino acid
  MOD_RES (547)..(565): Any amino acid
  MOD_RES (585)..(626): Any amino acid
  MOD_RES (642)..(703): Any amino acid
  MOD_RES (714)..(742): Any amino acid
  MOD_RES (760)..(763): Any amino acid
  MOD_RES (781)..(783): Any amino acid
  MOD_RES (793)..(829): Any amino acid

SEQ ID NO: 420663 - protein, 829 aa, Influenza virus; identical to SEQ ID NO: 419183
  MOD_RES (1)..(4): Any amino acid
  MOD_RES (17)..(59): Any amino acid
  MOD_RES (87)..(90): Any amino acid
  MOD_RES (113)..(164): Any amino acid
  MOD_RES (174)..(181): Any amino acid
  MOD_RES (199)..(199): Any amino acid
  MOD_RES (209)..(217): Any amino acid
  MOD_RES (229)..(253): Any amino acid
  MOD_RES (272)..(292): Any amino acid
  MOD_RES (305)..(315): Any amino acid
  MOD_RES (330)..(333): Any amino acid
  MOD_RES (343)..(430): Any amino acid
  MOD_RES (440)..(440): Any amino acid
  MOD_RES (451)..(533): Any amino acid
  MOD_RES (544)..(565): Any amino acid
  MOD_RES (585)..(632): Any amino acid
  MOD_RES (642)..(742): Any amino acid
  MOD_RES (753)..(767): Any amino acid
  MOD_RES (793)..(829): Any amino acid

SEQ ID NO: 420664 - protein, 780 aa, Influenza virus; identical to SEQ ID NO: 419190
  MOD_RES (18)..(18): Any amino acid
  MOD_RES (73)..(78): Any amino acid
  MOD_RES (91)..(101): Any amino acid
  MOD_RES (117)..(121): Any amino acid
  MOD_RES (132)..(139): Any amino acid
  MOD_RES (166)..(168): Any amino acid
  MOD_RES (197)..(210): Any amino acid
  MOD_RES (305)..(308): Any amino acid
  MOD_RES (351)..(353): Any amino acid
  MOD_RES (368)..(370): Any amino acid
  MOD_RES (381)..(381): Any amino acid
  MOD_RES (403)..(411): Any amino acid
  MOD_RES (459)..(491): Any amino acid
  MOD_RES (507)..(507): Any amino acid
  MOD_RES (572)..(573): Any amino acid
  MOD_RES (583)..(583): Any amino acid
  MOD_RES (601)..(601): Any amino acid
  MOD_RES (674)..(674): Any amino acid
  MOD_RES (695)..(698): Any amino acid
  MOD_RES (778)..(780): Any amino acid

SEQ ID NO: 420665 - protein, 780 aa, Influenza virus; identical to SEQ ID NO: 419191
  MOD_RES (11)..(18): Any amino acid
  MOD_RES (57)..(57): Any amino acid
  MOD_RES (73)..(78): Any amino acid
  MOD_RES (91)..(101): Any amino acid
  MOD_RES (117)..(121): Any amino acid
  MOD_RES (132)..(139): Any amino acid
  MOD_RES (166)..(168): Any amino acid
  MOD_RES (178)..(179): Any amino acid
  MOD_RES (197)..(210): Any amino acid
  MOD_RES (221)..(225): Any amino acid
  MOD_RES (305)..(308): Any amino acid
  MOD_RES (351)..(353): Any amino acid
  MOD_RES (368)..(370): Any amino acid
  MOD_RES (381)..(381): Any amino acid
  MOD_RES (403)..(411): Any amino acid
  MOD_RES (430)..(434): Any amino acid
  MOD_RES (459)..(491): Any amino acid
  MOD_RES (507)..(507): Any amino acid
  MOD_RES (569)..(573): Any amino acid
  MOD_RES (583)..(583): Any amino acid
  MOD_RES (601)..(601): Any amino acid
  MOD_RES (674)..(674): Any amino acid
  MOD_RES (687)..(698): Any amino acid

SEQ ID NO: 420666 - protein, 780 aa, Influenza virus; identical to SEQ ID NO: 419192
  MOD_RES (15)..(18): Any amino acid
  MOD_RES (34)..(37): Any amino acid
  MOD_RES (73)..(78): Any amino acid
  MOD_RES (91)..(101): Any amino acid
  MOD_RES (117)..(121): Any amino acid
  MOD_RES (132)..(139): Any amino acid
  MOD_RES (166)..(168): Any amino acid
  MOD_RES (178)..(182): Any amino acid
  MOD_RES (197)..(210): Any amino acid
  MOD_RES (221)..(225): Any amino acid
  MOD_RES (305)..(308): Any amino acid
  MOD_RES (336)..(338): Any amino acid
  MOD_RES (349)..(353): Any amino acid
  MOD_RES (368)..(370): Any amino acid
  MOD_RES (381)..(381): Any amino acid
  MOD_RES (403)..(413): Any amino acid
  MOD_RES (433)..(447): Any amino acid
  MOD_RES (459)..(491): Any amino acid
  MOD_RES (507)..(507): Any amino acid
  MOD_RES (572)..(573): Any amino acid
  MOD_RES (583)..(583): Any amino acid
  MOD_RES (601)..(601): Any amino acid
  MOD_RES (611)..(615): Any amino acid
  MOD_RES (674)..(674): Any amino acid
  MOD_RES (686)..(698): Any amino acid
  MOD_RES (742)..(765): Any amino acid

SEQ ID NO: 420667 - protein, 780 aa, Influenza virus; identical to SEQ ID NO: 419193
  MOD_RES (1)..(23): Any amino acid
  MOD_RES (40)..(40): Any amino acid
  MOD_RES (57)..(63): Any amino acid
  MOD_RES (73)..(81): Any amino acid
  MOD_RES (91)..(101): Any amino acid
  MOD_RES (111)..(121): Any amino acid
  MOD_RES (132)..(139): Any amino acid
  MOD_RES (150)..(150): Any amino acid
  MOD_RES (166)..(168): Any amino acid
  MOD_RES (178)..(184): Any amino acid
  MOD_RES (197)..(229): Any amino acid
  MOD_RES (247)..(253): Any amino acid
  MOD_RES (273)..(275): Any amino acid
  MOD_RES (293)..(308): Any amino acid
  MOD_RES (318)..(319): Any amino acid
  MOD_RES (337)..(340): Any amino acid
  MOD_RES (351)..(355): Any amino acid
  MOD_RES (368)..(370): Any amino acid
  MOD_RES (381)..(381): Any amino acid
  MOD_RES (400)..(414): Any amino acid
  MOD_RES (424)..(448): Any amino acid
  MOD_RES (459)..(491): Any amino acid
  MOD_RES (505)..(507): Any amino acid
  MOD_RES (572)..(573): Any amino acid
  MOD_RES (583)..(583): Any amino acid
  MOD_RES (596)..(601): Any amino acid
  MOD_RES (613)..(620): Any amino acid
  MOD_RES (674)..(674): Any amino acid
  MOD_RES (685)..(698): Any amino acid
  MOD_RES (722)..(722): Any amino acid
  MOD_RES (741)..(765): Any amino acid
  MOD_RES (775)..(780): Any amino acid

SEQ ID NO: 420668 - protein, 780 aa, Influenza virus; identical to SEQ ID NO: 419194
  MOD_RES (1)..(43): Any amino acid
  MOD_RES (54)..(81): Any amino acid
  MOD_RES (91)..(121): Any amino acid
  MOD_RES (132)..(140): Any amino acid
  MOD_RES (166)..(187): Any amino acid
  MOD_RES (197)..(235): Any amino acid
  MOD_RES (247)..(253): Any amino acid
  MOD_RES (275)..(282): Any amino acid
  MOD_RES (296)..(313): Any amino acid
  MOD_RES (337)..(340): Any amino acid
  MOD_RES (351)..(358): Any amino acid
  MOD_RES (368)..(370): Any amino acid
  MOD_RES (380)..(381): Any amino acid
  MOD_RES (403)..(415): Any amino acid
  MOD_RES (432)..(448): Any amino acid
  MOD_RES (459)..(491): Any amino acid
  MOD_RES (507)..(507): Any amino acid
  MOD_RES (524)..(528): Any amino acid
  MOD_RES (539)..(573): Any amino acid
  MOD_RES (583)..(601): Any amino acid
  MOD_RES (611)..(620): Any amino acid
  MOD_RES (671)..(674): Any amino acid
  MOD_RES (685)..(708): Any amino acid
  MOD_RES (732)..(768): Any amino acid
  MOD_RES (778)..(780): Any amino acid

SEQ ID NO: 420669 - protein, 742 aa, Influenza virus; identical to SEQ ID NO: 419202
  MOD_RES (12)..(14): Any amino acid
  MOD_RES (26)..(31): Any amino acid
  MOD_RES (48)..(74): Any amino acid
  MOD_RES (96)..(154): Any amino acid
  MOD_RES (166)..(223): Any amino acid
  MOD_RES (244)..(280): Any amino acid
  MOD_RES (291)..(298): Any amino acid
  MOD_RES (313)..(341): Any amino acid
  MOD_RES (359)..(369): Any amino acid
  MOD_RES (389)..(393): Any amino acid
  MOD_RES (404)..(422): Any amino acid
  MOD_RES (472)..(477): Any amino acid
  MOD_RES (491)..(496): Any amino acid
  MOD_RES (508)..(641): Any amino acid
  MOD_RES (660)..(681): Any amino acid
  MOD_RES (697)..(716): Any amino acid
  MOD_RES (727)..(731): Any amino acid

SEQ ID NO: 420670 - protein, 742 aa, Influenza virus; identical to SEQ ID NO: 419203
  MOD_RES (1)..(1): Any amino acid
  MOD_RES (12)..(14): Any amino acid
  MOD_RES (26)..(40): Any amino acid
  MOD_RES (51)..(223): Any amino acid
  MOD_RES (234)..(341): Any amino acid
  MOD_RES (356)..(378): Any amino acid
  MOD_RES (389)..(422): Any amino acid
  MOD_RES (471)..(477): Any amino acid
  MOD_RES (491)..(688): Any amino acid
  MOD_RES (705)..(716): Any amino acid
  MOD_RES (727)..(731): Any amino acid

SEQ ID NO: 420671 - protein, 742 aa, Influenza virus; identical to SEQ ID NO: 419204
  MOD_RES (1)..(14): Any amino acid
  MOD_RES (26)..(43): Any amino acid
  MOD_RES (54)..(223): Any amino acid
  MOD_RES (234)..(341): Any amino acid
  MOD_RES (352)..(383): Any amino acid
  MOD_RES (396)..(424): Any amino acid
  MOD_RES (452)..(459): Any amino acid
  MOD_RES (471)..(716): Any amino acid
  MOD_RES (727)..(731): Any amino acid
  MOD_RES (742)..(742): Any amino acid

SEQ ID NO: 420672 - protein, 742 aa, Influenza virus; identical to SEQ ID NO: 419205
  MOD_RES (1)..(17): Any amino acid
  MOD_RES (28)..(43): Any amino acid
  MOD_RES (54)..(430): Any amino acid
  MOD_RES (451)..(459): Any amino acid
  MOD_RES (480)..(716): Any amino acid
  MOD_RES (727)..(742): Any amino acid

SEQ ID NO: 420673 - protein, 742 aa, Influenza virus; identical to SEQ ID NO: 419206
  MOD_RES (1)..(17): Any amino acid
  MOD_RES (28)..(430): Any amino acid
  MOD_RES (451)..(461): Any amino acid
  MOD_RES (472)..(718): Any amino acid
  MOD_RES (734)..(742): Any amino acid

SEQ ID NO: 420674 - protein, 694 aa, Influenza virus; identical to SEQ ID NO: 419212
  MOD_RES (32)..(76): Any amino acid
  MOD_RES (89)..(410): Any amino acid
  MOD_RES (422)..(425): Any amino acid
  MOD_RES (436)..(441): Any amino acid
  MOD_RES (452)..(453): Any amino acid
  MOD_RES (464)..(473): Any amino acid
  MOD_RES (484)..(546): Any amino acid
  MOD_RES (558)..(659): Any amino acid
  MOD_RES (688)..(694): Any amino acid

SEQ ID NO: 420675 - protein, 694 aa, Influenza virus; identical to SEQ ID NO: 419213
  MOD_RES (21)..(410): Any amino acid
  MOD_RES (422)..(425): Any amino acid
  MOD_RES (436)..(441): Any amino acid
  MOD_RES (452)..(453): Any amino acid
  MOD_RES (464)..(546): Any amino acid
  MOD_RES (557)..(683): Any amino acid

SEQ ID NO: 420676 - protein, 694 aa, Influenza virus; identical to SEQ ID NO: 419214
  MOD_RES (1)..(1): Any amino acid
  MOD_RES (28)..(411): Any amino acid
  MOD_RES (422)..(425): Any amino acid
  MOD_RES (436)..(441): Any amino acid
  MOD_RES (452)..(694): Any amino acid

SEQ ID NO: 420677 - protein, 694 aa, Influenza virus; identical to SEQ ID NO: 419215
  MOD_RES (1)..(5): Any amino acid
  MOD_RES (21)..(417): Any amino acid
  MOD_RES (429)..(441): Any amino acid
  MOD_RES (452)..(694): Any amino acid

SEQ ID NO: 420678 - protein, 694 aa, Influenza virus; identical to SEQ ID NO: 419216
  MOD_RES (1)..(5): Any amino acid
  MOD_RES (30)..(694): Any amino acid

SEQ ID NO: 420679 - protein, 502 aa, Influenza virus; identical to SEQ ID NO: 419218
  MOD_RES (31)..(43): Any amino acid
  MOD_RES (54)..(115): Any amino acid
  MOD_RES (141)..(141): Any amino acid
  MOD_RES (165)..(165): Any amino acid
  MOD_RES (229)..(237): Any amino acid
  MOD_RES (249)..(249): Any amino acid
  MOD_RES (273)..(276): Any amino acid
  MOD_RES (287)..(289): Any amino acid
  MOD_RES (305)..(308): Any amino acid
  MOD_RES (326)..(333): Any amino acid
  MOD_RES (347)..(371): Any amino acid
  MOD_RES (385)..(389): Any amino acid
  MOD_RES (401)..(416): Any amino acid
  MOD_RES (452)..(454): Any amino acid
  MOD_RES (471)..(472): Any amino acid
  MOD_RES (496)..(502): Any amino acid

SEQ ID NO: 420680 - protein, 502 aa, Influenza virus; identical to SEQ ID NO: 419219
  MOD_RES (21)..(43): Any amino acid
  MOD_RES (54)..(115): Any amino acid
  MOD_RES (141)..(141): Any amino acid
  MOD_RES (165)..(165): Any amino acid
  MOD_RES (191)..(193): Any amino acid
  MOD_RES (229)..(237): Any amino acid
  MOD_RES (249)..(249): Any amino acid
  MOD_RES (263)..(268): Any amino acid
  MOD_RES (280)..(289): Any amino acid
  MOD_RES (305)..(308): Any amino acid
  MOD_RES (326)..(333): Any amino acid
  MOD_RES (347)..(371): Any amino acid
  MOD_RES (385)..(389): Any amino acid
  MOD_RES (401)..(416): Any amino acid
  MOD_RES (452)..(454): Any amino acid
  MOD_RES (471)..(484): Any amino acid
  MOD_RES (496)..(502): Any amino acid

SEQ ID NO: 420681 - protein, 502 aa, Influenza virus; identical to SEQ ID NO: 419220
  MOD_RES (1)..(1): Any amino acid
  MOD_RES (21)..(115): Any amino acid
  MOD_RES (141)..(141): Any amino acid
  MOD_RES (152)..(152): Any amino acid
  MOD_RES (165)..(165): Any amino acid
  MOD_RES (229)..(237): Any amino acid
  MOD_RES (249)..(249): Any amino acid
  MOD_RES (263)..(276): Any amino acid
  MOD_RES (287)..(289): Any amino acid
  MOD_RES (305)..(313): Any amino acid
  MOD_RES (326)..(334): Any amino acid
  MOD_RES (347)..(371): Any amino acid
  MOD_RES (384)..(389): Any amino acid
  MOD_RES (401)..(416): Any amino acid
  MOD_RES (452)..(455): Any amino acid
  MOD_RES (471)..(484): Any amino acid
  MOD_RES (496)..(502): Any amino acid

SEQ ID NO: 420682 - protein, 502 aa, Influenza virus; identical to SEQ ID NO: 419221
  MOD_RES (1)..(5): Any amino acid
  MOD_RES (21)..(115): Any amino acid
  MOD_RES (137)..(141): Any amino acid
  MOD_RES (152)..(154): Any amino acid
  MOD_RES (165)..(165): Any amino acid
  MOD_RES (188)..(193): Any amino acid
  MOD_RES (226)..(249): Any amino acid
  MOD_RES (263)..(276): Any amino acid
  MOD_RES (287)..(289): Any amino acid
  MOD_RES (305)..(313): Any amino acid
  MOD_RES (326)..(334): Any amino acid
  MOD_RES (347)..(371): Any amino acid
  MOD_RES (385)..(416): Any amino acid
  MOD_RES (427)..(427): Any amino acid
  MOD_RES (452)..(455): Any amino acid
  MOD_RES (467)..(484): Any amino acid
  MOD_RES (496)..(502): Any amino acid

SEQ ID NO: 420683 - protein, 502 aa, Influenza virus; identical to SEQ ID NO: 419222
  MOD_RES (1)..(9): Any amino acid
  MOD_RES (30)..(115): Any amino acid
  MOD_RES (137)..(141): Any amino acid
  MOD_RES (152)..(154): Any amino acid
  MOD_RES (165)..(165): Any amino acid
  MOD_RES (176)..(177): Any amino acid
  MOD_RES (188)..(193): Any amino acid
  MOD_RES (229)..(249): Any amino acid
  MOD_RES (262)..(289): Any amino acid
  MOD_RES (303)..(371): Any amino acid
  MOD_RES (385)..(435): Any amino acid
  MOD_RES (449)..(455): Any amino acid
  MOD_RES (471)..(485): Any amino acid
  MOD_RES (496)..(502): Any amino acid

SEQ ID NO: 420684 - protein, 494 aa, Influenza virus; identical to SEQ ID NO: 419224
  MOD_RES (16)..(53): Any amino acid
  MOD_RES (64)..(71): Any amino acid
  MOD_RES (82)..(85): Any amino acid
  MOD_RES (97)..(109): Any amino acid
  MOD_RES (127)..(127): Any amino acid
  MOD_RES (139)..(141): Any amino acid
  MOD_RES (155)..(167): Any amino acid
  MOD_RES (206)..(234): Any amino acid
  MOD_RES (249)..(250): Any amino acid
  MOD_RES (272)..(285): Any amino acid
  MOD_RES (330)..(333): Any amino acid
  MOD_RES (347)..(421): Any amino acid
  MOD_RES (432)..(434): Any amino acid
  MOD_RES (449)..(455): Any amino acid

SEQ ID NO: 420685 - protein, 494 aa, Influenza virus; identical to SEQ ID NO: 419225
  MOD_RES (1)..(12): Any amino acid
  MOD_RES (23)..(53): Any amino acid
  MOD_RES (64)..(109): Any amino acid
  MOD_RES (127)..(127): Any amino acid
  MOD_RES (139)..(141): Any amino acid
  MOD_RES (152)..(167): Any amino acid
  MOD_RES (206)..(234): Any amino acid
  MOD_RES (249)..(250): Any amino acid
  MOD_RES (272)..(285): Any amino acid
  MOD_RES (320)..(333): Any amino acid
  MOD_RES (347)..(421): Any amino acid
  MOD_RES (432)..(434): Any amino acid
  MOD_RES (449)..(455): Any amino acid
  MOD_RES (493)..(494): Any amino acid

SEQ ID NO: 420686 - protein, 494 aa, Influenza virus; identical to SEQ ID NO: 419226
  MOD_RES (1)..(53): Any amino acid
  MOD_RES (64)..(109): Any amino acid
  MOD_RES (127)..(127): Any amino acid
  MOD_RES (139)..(141): Any amino acid
  MOD_RES (152)..(167): Any amino acid
  MOD_RES (206)..(234): Any amino acid
  MOD_RES (249)..(250): Any amino acid
  MOD_RES (262)..(285): Any amino acid
  MOD_RES (300)..(303): Any amino acid
  MOD_RES (320)..(333): Any amino acid
  MOD_RES (347)..(421): Any amino acid
  MOD_RES (432)..(438): Any amino acid
  MOD_RES (449)..(455): Any amino acid
  MOD_RES (492)..(494): Any amino acid

SEQ ID NO: 420687 - protein, 494 aa, Influenza virus; identical to SEQ ID NO: 419227
  MOD_RES (1)..(58): Any amino acid
  MOD_RES (71)..(109): Any amino acid
  MOD_RES (125)..(127): Any amino acid
  MOD_RES (138)..(167): Any amino acid
  MOD_RES (206)..(234): Any amino acid
  MOD_RES (245)..(250): Any amino acid
  MOD_RES (262)..(289): Any amino acid
  MOD_RES (300)..(303): Any amino acid
  MOD_RES (314)..(336): Any amino acid
  MOD_RES (347)..(455): Any amino acid
  MOD_RES (491)..(494): Any amino acid

SEQ ID NO: 420688 - protein, 494 aa, Influenza virus; identical to SEQ ID NO: 419228
  MOD_RES (1)..(109): Any amino acid
  MOD_RES (127)..(167): Any amino acid
  MOD_RES (196)..(234): Any amino acid
  MOD_RES (245)..(260): Any amino acid
  MOD_RES (271)..(289): Any amino acid
  MOD_RES (300)..(303): Any amino acid
  MOD_RES (315)..(336): Any amino acid
  MOD_RES (347)..(455): Any amino acid
  MOD_RES (478)..(479): Any amino acid
  MOD_RES (490)..(494): Any amino acid

SEQ ID NO: 420689 - protein, 515 aa, Influenza virus; identical to SEQ ID NO: 419231
  MOD_RES (1)..(26): Any amino acid
  MOD_RES (37)..(88): Any amino acid
  MOD_RES (112)..(114): Any amino acid
  MOD_RES (127)..(127): Any amino acid
  MOD_RES (165)..(175): Any amino acid
  MOD_RES (195)..(266): Any amino acid
  MOD_RES (281)..(318): Any amino acid
  MOD_RES (332)..(332): Any amino acid
  MOD_RES (379)..(401): Any amino acid
  MOD_RES (413)..(438): Any amino acid
  MOD_RES (458)..(460): Any amino acid
  MOD_RES (476)..(481): Any amino acid

SEQ ID NO: 420690 - protein, 515 aa, Influenza virus; identical to SEQ ID NO: 419232
  MOD_RES (1)..(26): Any amino acid
  MOD_RES (37)..(88): Any amino acid
  MOD_RES (112)..(114): Any amino acid
  MOD_RES (127)..(127): Any amino acid
  MOD_RES (165)..(175): Any amino acid
  MOD_RES (195)..(266): Any amino acid
  MOD_RES (281)..(318): Any amino acid
  MOD_RES (331)..(332): Any amino acid
  MOD_RES (379)..(401): Any amino acid
  MOD_RES (413)..(438): Any amino acid
  MOD_RES (458)..(460): Any amino acid
  MOD_RES (476)..(481): Any amino acid
  MOD_RES (503)..(503): Any amino acid

SEQ ID NO: 420691 - protein, 515 aa, Influenza virus; identical to SEQ ID NO: 419233
  MOD_RES (1)..(26): Any amino acid
  MOD_RES (37)..(88): Any amino acid
  MOD_RES (112)..(114): Any amino acid
  MOD_RES (125)..(127): Any amino acid
  MOD_RES (165)..(175): Any amino acid
  MOD_RES (195)..(266): Any amino acid
  MOD_RES (278)..(318): Any amino acid
  MOD_RES (332)..(332): Any amino acid
  MOD_RES (379)..(401): Any amino acid
  MOD_RES (413)..(438): Any amino acid
  MOD_RES (458)..(460): Any amino acid
  MOD_RES (476)..(481): Any amino acid
  MOD_RES (515)..(515): Any amino acid

SEQ ID NO: 420692 - protein, 515 aa, Influenza virus; identical to SEQ ID NO: 419234
  MOD_RES (1)..(26): Any amino acid
  MOD_RES (37)..(101): Any amino acid
  MOD_RES (112)..(114): Any amino acid
  MOD_RES (127)..(127): Any amino acid
  MOD_RES (165)..(183): Any amino acid
  MOD_RES (195)..(266): Any amino acid
  MOD_RES (277)..(318): Any amino acid
  MOD_RES (332)..(332): Any amino acid
  MOD_RES (379)..(401): Any amino acid
  MOD_RES (413)..(438): Any amino acid
  MOD_RES (458)..(460): Any amino acid
  MOD_RES (471)..(481): Any amino acid

SEQ ID NO: 420693 - protein, 515 aa, Influenza virus; identical to SEQ ID NO: 419235
  MOD_RES (1)..(114): Any amino acid
  MOD_RES (125)..(127): Any amino acid
  MOD_RES (138)..(143): Any amino acid
  MOD_RES (163)..(266): Any amino acid
  MOD_RES (277)..(318): Any amino acid
  MOD_RES (331)..(342): Any amino acid
  MOD_RES (379)..(401): Any amino acid
  MOD_RES (413)..(438): Any amino acid
  MOD_RES (449)..(465): Any amino acid
  MOD_RES (476)..(482): Any amino acid
  MOD_RES (514)..(515): Any amino acid

SEQ ID NO: 420694 - protein, 470 aa, Influenza virus; identical to SEQ ID NO: 419238
  MOD_RES (13)..(16): Any amino acid
  MOD_RES (44)..(47): Any amino acid
  MOD_RES (74)..(89): Any amino acid
  MOD_RES (264)..(269): Any amino acid
  MOD_RES (335)..(335): Any amino acid

SEQ ID NO: 420695 - protein, 470 aa, Influenza virus; identical to SEQ ID NO: 419239
  MOD_RES (12)..(16): Any amino acid
  MOD_RES (30)..(30): Any amino acid
  MOD_RES (44)..(47): Any amino acid
  MOD_RES (74)..(89): Any amino acid
  MOD_RES (104)..(110): Any amino acid
  MOD_RES (135)..(152): Any amino acid
  MOD_RES (172)..(177): Any amino acid
  MOD_RES (225)..(231): Any amino acid
  MOD_RES (264)..(269): Any amino acid
  MOD_RES (335)..(335): Any amino acid
  MOD_RES (348)..(355): Any amino acid
  MOD_RES (421)..(425): Any amino acid
  MOD_RES (468)..(470): Any amino acid

SEQ ID NO: 420696 - protein, 470 aa, Influenza virus; identical to SEQ ID NO: 419240
  MOD_RES (13)..(16): Any amino acid
  MOD_RES (44)..(54): Any amino acid
  MOD_RES (71)..(89): Any amino acid
  MOD_RES (103)..(111): Any amino acid
  MOD_RES (136)..(152): Any amino acid
  MOD_RES (172)..(182): Any amino acid
  MOD_RES (220)..(231): Any amino acid
  MOD_RES (264)..(269): Any amino acid
  MOD_RES (335)..(335): Any amino acid
  MOD_RES (346)..(356): Any amino acid
  MOD_RES (393)..(410): Any amino acid
  MOD_RES (467)..(470): Any amino acid

SEQ ID NO: 420697 - protein, 470 aa, Influenza virus; identical to SEQ ID NO: 419241
  MOD_RES (1)..(1): Any amino acid
  MOD_RES (13)..(17): Any amino acid
  MOD_RES (44)..(55): Any amino acid
  MOD_RES (74)..(112): Any amino acid
  MOD_RES (136)..(155): Any amino acid
  MOD_RES (169)..(189): Any amino acid
  MOD_RES (215)..(237): Any amino acid
  MOD_RES (263)..(269): Any amino acid
  MOD_RES (296)..(299): Any amino acid
  MOD_RES (335)..(368): Any amino acid
  MOD_RES (388)..(426): Any amino acid
  MOD_RES (443)..(445): Any amino acid
  MOD_RES (467)..(470): Any amino acid

SEQ ID NO: 420698 - protein, 470 aa, Influenza virus; identical to SEQ ID NO: 419242
  MOD_RES (1)..(17): Any amino acid
  MOD_RES (30)..(32): Any amino acid
  MOD_RES (43)..(59): Any amino acid
  MOD_RES (74)..(120): Any amino acid
  MOD_RES (131)..(156): Any amino acid
  MOD_RES (171)..(196): Any amino acid
  MOD_RES (207)..(246): Any amino acid
  MOD_RES (264)..(269): Any amino acid
  MOD_RES (281)..(285): Any amino acid
  MOD_RES (296)..(300): Any amino acid
  MOD_RES (331)..(377): Any amino acid
  MOD_RES (394)..(445): Any amino acid
  MOD_RES (457)..(460): Any amino acid

SEQ ID NO: 420699 - protein, 473 aa, Influenza virus; identical to SEQ ID NO: 419244
  MOD_RES (17)..(47): Any amino acid
  MOD_RES (59)..(79): Any amino acid
  MOD_RES (189)..(190): Any amino acid
  MOD_RES (234)..(234): Any amino acid
  MOD_RES (257)..(264): Any amino acid
  MOD_RES (302)..(308): Any amino acid
  MOD_RES (329)..(336): Any amino acid
  MOD_RES (366)..(367): Any amino acid
  MOD_RES (383)..(393): Any amino acid
  MOD_RES (413)..(418): Any amino acid

SEQ ID NO: 420700 - protein, 473 aa, Influenza virus; identical to SEQ ID NO: 419245
  MOD_RES (1)..(3): Any amino acid
  MOD_RES (17)..(47): Any amino acid
  MOD_RES (59)..(79): Any amino acid
  MOD_RES (149)..(150): Any amino acid
  MOD_RES (189)..(190): Any amino acid
  MOD_RES (234)..(235): Any amino acid
  MOD_RES (257)..(264): Any amino acid
  MOD_RES (302)..(308): Any amino acid
  MOD_RES (329)..(336): Any amino acid
  MOD_RES (366)..(367): Any amino acid
  MOD_RES (383)..(393): Any amino acid
  MOD_RES (413)..(418): Any amino acid
  MOD_RES (471)..(473): Any amino acid

SEQ ID NO: 420701 - protein, 473 aa, Influenza virus; identical to SEQ ID NO: 419246
  MOD_RES (1)..(3): Any amino acid
  MOD_RES (17)..(47): Any amino acid
  MOD_RES (58)..(79): Any amino acid
  MOD_RES (150)..(152): Any amino acid
  MOD_RES (189)..(190): Any amino acid
  MOD_RES (234)..(236): Any amino acid
  MOD_RES (257)..(264): Any amino acid
  MOD_RES (292)..(308): Any amino acid
  MOD_RES (329)..(336): Any amino acid
  MOD_RES (364)..(367): Any amino acid
  MOD_RES (383)..(393): Any amino acid
  MOD_RES (408)..(424): Any amino acid
  MOD_RES (447)..(447): Any amino acid
  MOD_RES (473)..(473): Any amino acid

SEQ ID NO: 420702 - protein, 473 aa, Influenza virus; identical to SEQ ID NO: 419247
  MOD_RES (1)..(3): Any amino acid
  MOD_RES (17)..(47): Any amino acid
  MOD_RES (59)..(79): Any amino acid
  MOD_RES (107)..(114): Any amino acid
  MOD_RES (130)..(154): Any amino acid
  MOD_RES (189)..(190): Any amino acid
  MOD_RES (202)..(203): Any amino acid
  MOD_RES (234)..(236): Any amino acid
  MOD_RES (257)..(264): Any amino acid
  MOD_RES (294)..(308): Any amino acid
  MOD_RES (329)..(336): Any amino acid
  MOD_RES (348)..(348): Any amino acid
  MOD_RES (366)..(367): Any amino acid
  MOD_RES (383)..(393): Any amino acid
  MOD_RES (409)..(426): Any amino acid
  MOD_RES (465)..(473): Any amino acid

SEQ ID NO: 420703 - protein, 473 aa, Influenza virus; identical to SEQ ID NO: 419248
  MOD_RES (1)..(4): Any amino acid
  MOD_RES (17)..(47): Any amino acid
  MOD_RES (59)..(86): Any amino acid
  MOD_RES (106)..(114): Any amino acid
  MOD_RES (134)..(178): Any amino acid
  MOD_RES (189)..(192): Any amino acid
  MOD_RES (229)..(241): Any amino acid
  MOD_RES (257)..(265): Any amino acid
  MOD_RES (291)..(318): Any amino acid
  MOD_RES (329)..(355): Any amino acid
  MOD_RES (366)..(370): Any amino acid
  MOD_RES (381)..(393): Any amino acid
  MOD_RES (409)..(432): Any amino acid
  MOD_RES (446)..(448): Any amino acid
  MOD_RES (461)..(473): Any amino acid

SEQ ID NO: 420704 - protein, 471 aa, Influenza virus; identical to SEQ ID NO: 419252
  MOD_RES (24)..(24): Any amino acid
  MOD_RES (37)..(55): Any amino acid
  MOD_RES (66)..(89): Any amino acid
  MOD_RES (128)..(128): Any amino acid
  MOD_RES (173)..(174): Any amino acid
  MOD_RES (210)..(214): Any amino acid
  MOD_RES (250)..(271): Any amino acid
  MOD_RES (286)..(288): Any amino acid
  MOD_RES (309)..(311): Any amino acid
  MOD_RES (334)..(343): Any amino acid
  MOD_RES (360)..(360): Any amino acid
  MOD_RES (386)..(397): Any amino acid
  MOD_RES (416)..(417): Any amino acid
  MOD_RES (438)..(438): Any amino acid

SEQ ID NO: 420705 - protein, 471 aa, Influenza virus; identical to SEQ ID NO: 419253
  MOD_RES (24)..(24): Any amino acid
  MOD_RES (37)..(89): Any amino acid
  MOD_RES (128)..(128): Any amino acid
  MOD_RES (173)..(174): Any amino acid
  MOD_RES (210)..(214): Any amino acid
  MOD_RES (250)..(271): Any amino acid
  MOD_RES (286)..(288): Any amino acid
  MOD_RES (309)..(311): Any amino acid
  MOD_RES (334)..(343): Any amino acid
  MOD_RES (360)..(360): Any amino acid
  MOD_RES (386)..(397): Any amino acid
  MOD_RES (413)..(417): Any amino acid
  MOD_RES (438)..(438): Any amino acid

SEQ ID NO: 420706 - protein, 471 aa, Influenza virus; identical to SEQ ID NO: 419254
  MOD_RES (24)..(24): Any amino acid
  MOD_RES (35)..(89): Any amino acid
  MOD_RES (122)..(128): Any amino acid
  MOD_RES (173)..(174): Any amino acid
  MOD_RES (204)..(214): Any amino acid
  MOD_RES (250)..(271): Any amino acid
  MOD_RES (283)..(288): Any amino acid
  MOD_RES (309)..(311): Any amino acid
  MOD_RES (334)..(343): Any amino acid
  MOD_RES (360)..(362): Any amino acid
  MOD_RES (386)..(397): Any amino acid
  MOD_RES (416)..(417): Any amino acid
  MOD_RES (438)..(438): Any amino acid

SEQ ID NO: 420707 - protein, 471 aa, Influenza virus; identical to SEQ ID NO: 419255
  MOD_RES (1)..(2): Any amino acid
  MOD_RES (23)..(24): Any amino acid
  MOD_RES (37)..(89): Any amino acid
  MOD_RES (122)..(140): Any amino acid
  MOD_RES (170)..(174): Any amino acid
  MOD_RES (210)..(214): Any amino acid
  MOD_RES (225)..(228): Any amino acid
  MOD_RES (243)..(271): Any amino acid
  MOD_RES (282)..(288): Any amino acid
  MOD_RES (309)..(311): Any amino acid
  MOD_RES (331)..(343): Any amino acid
  MOD_RES (360)..(362): Any amino acid
  MOD_RES (382)..(397): Any amino acid
  MOD_RES (411)..(425): Any amino acid
  MOD_RES (436)..(438): Any amino acid
  MOD_RES (464)..(471): Any amino acid

SEQ ID NO: 420708 - protein, 471 aa, Influenza virus; identical to SEQ ID NO: 419256
  MOD_RES (1)..(8): Any amino acid
  MOD_RES (24)..(24): Any amino acid
  MOD_RES (37)..(102): Any amino acid
  MOD_RES (122)..(141): Any amino acid
  MOD_RES (173)..(179): Any amino acid
  MOD_RES (206)..(214): Any amino acid
  MOD_RES (229)..(232): Any amino acid
  MOD_RES (250)..(272): Any amino acid
  MOD_RES (283)..(298): Any amino acid
  MOD_RES (309)..(311): Any amino acid
  MOD_RES (331)..(348): Any amino acid
  MOD_RES (360)..(370): Any amino acid
  MOD_RES (386)..(401): Any amino acid
  MOD_RES (416)..(426): Any amino acid
  MOD_RES (438)..(445): Any amino acid
  MOD_RES (456)..(471): Any amino acid

SEQ ID NO: 420709 - protein, 471 aa, Influenza virus; identical to SEQ ID NO: 419260
  MOD_RES (16)..(20): Any amino acid
  MOD_RES (38)..(61): Any amino acid
  MOD_RES (73)..(82): Any amino acid
  MOD_RES (94)..(94): Any amino acid
  MOD_RES (164)..(168): Any amino acid
  MOD_RES (251)..(267): Any amino acid
  MOD_RES (285)..(285): Any amino acid
  MOD_RES (308)..(317): Any amino acid
  MOD_RES (332)..(333): Any amino acid
  MOD_RES (357)..(357): Any amino acid
  MOD_RES (387)..(400): Any amino acid
  MOD_RES (416)..(416): Any amino acid

SEQ ID NO: 420710 - protein, 471 aa, Influenza virus; identical to SEQ ID NO: 419261
  MOD_RES (16)..(20): Any amino acid
  MOD_RES (38)..(61): Any amino acid
  MOD_RES (73)..(82): Any amino acid
  MOD_RES (94)..(94): Any amino acid
  MOD_RES (115)..(116): Any amino acid
  MOD_RES (164)..(168): Any amino acid
  MOD_RES (251)..(267): Any amino acid
  MOD_RES (285)..(285): Any amino acid
  MOD_RES (308)..(317): Any amino acid
  MOD_RES (332)..(333): Any amino acid
  MOD_RES (357)..(357): Any amino acid
  MOD_RES (384)..(400): Any amino acid
  MOD_RES (416)..(416): Any amino acid
  MOD_RES (427)..(428): Any amino acid

SEQ ID NO: 420711 - protein, 471 aa, Influenza virus; identical to SEQ ID NO: 419262
  MOD_RES (16)..(20): Any amino acid
  MOD_RES (38)..(61): Any amino acid
  MOD_RES (73)..(82): Any amino acid
  MOD_RES (94)..(94): Any amino acid
  MOD_RES (164)..(168): Any amino acid
  MOD_RES (251)..(267): Any amino acid
  MOD_RES (283)..(285): Any amino acid
  MOD_RES (306)..(319): Any amino acid
  MOD_RES (332)..(333): Any amino acid
  MOD_RES (357)..(357): Any amino acid
  MOD_RES (387)..(400): Any amino acid
  MOD_RES (416)..(416): Any amino acid
  MOD_RES (428)..(430): Any amino acid

SEQ ID NO: 420712 - protein, 471 aa, Influenza virus; identical to SEQ ID NO: 419263
  MOD_RES (16)..(20): Any amino acid
  MOD_RES (38)..(61): Any amino acid
  MOD_RES (72)..(82): Any amino acid
  MOD_RES (94)..(94): Any amino acid
  MOD_RES (137)..(138): Any amino acid
  MOD_RES (161)..(168): Any amino acid
  MOD_RES (194)..(194): Any amino acid
  MOD_RES (251)..(267): Any amino acid
  MOD_RES (285)..(285): Any amino acid
  MOD_RES (308)..(319): Any amino acid
  MOD_RES (332)..(335): Any amino acid
  MOD_RES (356)..(357): Any amino acid
  MOD_RES (387)..(416): Any amino acid
  MOD_RES (428)..(432): Any amino acid
  MOD_RES (471)..(471): Any amino acid

SEQ ID NO: 420713 - protein, 471 aa, Influenza virus; identical to SEQ ID NO: 419264
  MOD_RES (11)..(20): Any amino acid
  MOD_RES (38)..(61): Any amino acid
  MOD_RES (72)..(82): Any amino acid
  MOD_RES (94)..(95): Any amino acid
  MOD_RES (115)..(142): Any amino acid
  MOD_RES (164)..(168): Any amino acid
  MOD_RES (182)..(182): Any amino acid
  MOD_RES (194)..(194): Any amino acid
  MOD_RES (226)..(226): Any amino acid
  MOD_RES (239)..(240): Any amino acid
  MOD_RES (251)..(268): Any amino acid
  MOD_RES (285)..(285): Any amino acid
  MOD_RES (308)..(319): Any amino acid
  MOD_RES (332)..(335): Any amino acid
  MOD_RES (349)..(357): Any amino acid
  MOD_RES (387)..(416): Any amino acid
  MOD_RES (427)..(444): Any amino acid
  MOD_RES (455)..(455): Any amino acid
  MOD_RES (471)..(471): Any amino acid

SEQ ID NO: 420714 - protein, 548 aa, Influenza virus; identical to SEQ ID NO: 419269
  MOD_RES (1)..(168): Any amino acid
  MOD_RES (201)..(201): Any amino acid
  MOD_RES (267)..(294): Any amino acid
  MOD_RES (326)..(344): Any amino acid
  MOD_RES (382)..(383): Any amino acid
  MOD_RES (408)..(417): Any amino acid
  MOD_RES (435)..(470): Any amino acid
  MOD_RES (489)..(491): Any amino acid
  MOD_RES (510)..(510): Any amino acid
  MOD_RES (527)..(528): Any amino acid

SEQ ID NO: 420715 - protein, 548 aa, Influenza virus; identical to SEQ ID NO: 419270
  MOD_RES (1)..(168): Any amino acid
  MOD_RES (199)..(201): Any amino acid
  MOD_RES (267)..(294): Any amino acid
  MOD_RES (307)..(309): Any amino acid
  MOD_RES (326)..(344): Any amino acid
  MOD_RES (382)..(383): Any amino acid
  MOD_RES (407)..(417): Any amino acid
  MOD_RES (435)..(470): Any amino acid
  MOD_RES (489)..(491): Any amino acid
  MOD_RES (510)..(510): Any amino acid
  MOD_RES (527)..(528): Any amino acid
  MOD_RES (542)..(548): Any amino acid

SEQ ID NO: 420716 - protein, 548 aa, Influenza virus; identical to SEQ ID NO: 419271
  MOD_RES (1)..(168): Any amino acid
  MOD_RES (198)..(201): Any amino acid
  MOD_RES (267)..(294): Any amino acid
  MOD_RES (326)..(344): Any amino acid
  MOD_RES (382)..(383): Any amino acid
  MOD_RES (408)..(417): Any amino acid
  MOD_RES (435)..(470): Any amino acid
  MOD_RES (489)..(491): Any amino acid
  MOD_RES (510)..(510): Any amino acid
  MOD_RES (527)..(528): Any amino acid

SEQ ID NO: 420717 - protein, 548 aa, Influenza virus; identical to SEQ ID NO: 419272
  MOD_RES (1)..(168): Any amino acid
  MOD_RES (179)..(186): Any amino acid
  MOD_RES (200)..(201): Any amino acid
  MOD_RES (240)..(240): Any amino acid
  MOD_RES (267)..(294): Any amino acid
  MOD_RES (305)..(309): Any amino acid
  MOD_RES (326)..(344): Any amino acid
  MOD_RES (369)..(369): Any amino acid
  MOD_RES (380)..(383): Any amino acid
  MOD_RES (395)..(395): Any amino acid
  MOD_RES (408)..(423): Any amino acid
  MOD_RES (435)..(470): Any amino acid
  MOD_RES (489)..(491): Any amino acid
  MOD_RES (510)..(510): Any amino acid
  MOD_RES (527)..(528): Any amino acid
  MOD_RES (540)..(548): Any amino acid

SEQ ID NO: 420718 - protein, 548 aa, Influenza virus; identical to SEQ ID NO: 419273
  MOD_RES (1)..(170): Any amino acid
  MOD_RES (181)..(204): Any amino acid
  MOD_RES (267)..(294): Any amino acid
  MOD_RES (305)..(344): Any amino acid
  MOD_RES (356)..(370): Any amino acid
  MOD_RES (382)..(383): Any amino acid
  MOD_RES (395)..(395): Any amino acid
  MOD_RES (408)..(491): Any amino acid
  MOD_RES (502)..(516): Any amino acid
  MOD_RES (527)..(528): Any amino acid
  MOD_RES (548)..(548): Any amino acid

SEQ ID NO: 420719 - protein, 470 aa, Influenza virus; identical to SEQ ID NO: 419277
  MOD_RES (15)..(26): Any amino acid
  MOD_RES (40)..(53): Any amino acid
  MOD_RES (67)..(84): Any amino acid
  MOD_RES (260)..(269): Any amino acid
  MOD_RES (286)..(288): Any amino acid
  MOD_RES (310)..(310): Any amino acid
  MOD_RES (359)..(359): Any amino acid
  MOD_RES (392)..(392): Any amino acid

SEQ ID NO: 420720 - protein, 470 aa, Influenza virus; identical to SEQ ID NO: 419278
  MOD_RES (15)..(26): Any amino acid
  MOD_RES (40)..(53): Any amino acid
  MOD_RES (67)..(84): Any amino acid
  MOD_RES (225)..(226): Any amino acid
  MOD_RES (260)..(269): Any amino acid
  MOD_RES (285)..(288): Any amino acid
  MOD_RES (310)..(310): Any amino acid
  MOD_RES (321)..(324): Any amino acid
  MOD_RES (359)..(359): Any amino acid
  MOD_RES (392)..(392): Any amino acid
  MOD_RES (426)..(426): Any amino acid
  MOD_RES (470)..(470): Any amino acid

SEQ ID NO: 420721 - protein, 470 aa, Influenza virus; identical to SEQ ID NO: 419279
  MOD_RES (15)..(26): Any amino acid
  MOD_RES (40)..(53): Any amino acid
  MOD_RES (67)..(84): Any amino acid
  MOD_RES (102)..(102): Any amino acid
  MOD_RES (138)..(150): Any amino acid
  MOD_RES (175)..(180): Any amino acid
  MOD_RES (224)..(226): Any amino acid
  MOD_RES (245)..(246): Any amino acid
  MOD_RES (260)..(269): Any amino acid
  MOD_RES (286)..(288): Any amino acid
  MOD_RES (310)..(310): Any amino acid
  MOD_RES (321)..(324): Any amino acid
  MOD_RES (359)..(359): Any amino acid
  MOD_RES (392)..(392): Any amino acid
  MOD_RES (447)..(455): Any amino acid

SEQ ID NO: 420722 - protein, 470 aa, Influenza virus; identical to SEQ ID NO: 419280
  MOD_RES (13)..(26): Any amino acid
  MOD_RES (37)..(53): Any amino acid
  MOD_RES (67)..(84): Any amino acid
  MOD_RES (139)..(154): Any amino acid
  MOD_RES (194)..(197): Any amino acid
  MOD_RES (208)..(210): Any amino acid
  MOD_RES (221)..(227): Any amino acid
  MOD_RES (244)..(246): Any amino acid
  MOD_RES (260)..(275): Any amino acid
  MOD_RES (286)..(310): Any amino acid
  MOD_RES (321)..(324): Any amino acid
  MOD_RES (335)..(338): Any amino acid
  MOD_RES (356)..(359): Any amino acid
  MOD_RES (392)..(392): Any amino acid
  MOD_RES (405)..(406): Any amino acid
  MOD_RES (418)..(428): Any amino acid
  MOD_RES (447)..(458): Any amino acid

SEQ ID NO: 420723 - protein, 470 aa, Influenza virus; identical to SEQ ID NO: 419281
  MOD_RES (1)..(1): Any amino acid
  MOD_RES (14)..(54): Any amino acid
  MOD_RES (65)..(84): Any amino acid
  MOD_RES (95)..(97): Any amino acid
  MOD_RES (125)..(164): Any amino acid
  MOD_RES (175)..(180): Any amino acid
  MOD_RES (193)..(198): Any amino acid
  MOD_RES (224)..(228): Any amino acid
  MOD_RES (246)..(310): Any amino acid
  MOD_RES (323)..(324): Any amino acid
  MOD_RES (335)..(338): Any amino acid
  MOD_RES (355)..(360): Any amino acid
  MOD_RES (391)..(393): Any amino acid
  MOD_RES (406)..(407): Any amino acid
  MOD_RES (427)..(459): Any amino acid
  MOD_RES (470)..(470): Any amino acid

SEQ ID NO: 420724 - protein, 568 aa, Influenza virus; identical to SEQ ID NO: 419285
  MOD_RES (1)..(15): Any amino acid
  MOD_RES (32)..(39): Any amino acid
  MOD_RES (53)..(65): Any amino acid
  MOD_RES (77)..(110): Any amino acid
  MOD_RES (126)..(168): Any amino acid
  MOD_RES (184)..(203): Any amino acid
  MOD_RES (245)..(248): Any amino acid
  MOD_RES (268)..(286): Any amino acid
  MOD_RES (321)..(321): Any amino acid
  MOD_RES (337)..(337): Any amino acid
  MOD_RES (483)..(486): Any amino acid
  MOD_RES (541)..(552): Any amino acid

SEQ ID NO: 420725 - protein, 568 aa, Influenza virus; identical to SEQ ID NO: 419286
  MOD_RES (1)..(15): Any amino acid
  MOD_RES (32)..(39): Any amino acid
  MOD_RES (53)..(65): Any amino acid
  MOD_RES (77)..(110): Any amino acid
  MOD_RES (126)..(168): Any amino acid
  MOD_RES (184)..(203): Any amino acid
  MOD_RES (245)..(248): Any amino acid
  MOD_RES (265)..(286): Any amino acid
  MOD_RES (321)..(321): Any amino acid
  MOD_RES (337)..(337): Any amino acid
  MOD_RES (396)..(401): Any amino acid
  MOD_RES (421)..(425): Any amino acid
  MOD_RES (483)..(486): Any amino acid
  MOD_RES (541)..(568): Any amino acid

SEQ ID NO: 420726 - protein, 568 aa, Influenza virus; identical to SEQ ID NO: 419287
  MOD_RES (1)..(15): Any amino acid
  MOD_RES (32)..(39): Any amino acid
  MOD_RES (50)..(65): Any amino acid
  MOD_RES (77)..(110): Any amino acid
  MOD_RES (126)..(168): Any amino acid
  MOD_RES (184)..(203): Any amino acid
  MOD_RES (245)..(248): Any amino acid
  MOD_RES (268)..(286): Any amino acid
  MOD_RES (321)..(321): Any amino acid
  MOD_RES (337)..(337): Any amino acid
  MOD_RES (360)..(365): Any amino acid
  MOD_RES (395)..(403): Any amino acid
  MOD_RES (423)..(430): Any amino acid
  MOD_RES (442)..(443): Any amino acid
  MOD_RES (464)..(486): Any amino acid
  MOD_RES (524)..(527): Any amino acid
  MOD_RES (541)..(568): Any amino acid

SEQ ID NO: 420727 - protein, 568 aa, Influenza virus; identical to SEQ ID NO: 419288
  MOD_RES (1)..(15): Any amino acid
  MOD_RES (29)..(39): Any amino acid
  MOD_RES (50)..(65): Any amino acid
  MOD_RES (77)..(114): Any amino acid
  MOD_RES (125)..(168): Any amino acid
  MOD_RES (184)..(204): Any amino acid
  MOD_RES (245)..(248): Any amino acid
  MOD_RES (267)..(287): Any amino acid
  MOD_RES (309)..(321): Any amino acid
  MOD_RES (332)..(366): Any amino acid
  MOD_RES (396)..(405): Any amino acid
  MOD_RES (425)..(432): Any amino acid
  MOD_RES (443)..(444): Any amino acid
  MOD_RES (461)..(486): Any amino acid
  MOD_RES (523)..(568): Any amino acid

SEQ ID NO: 420728 - protein, 568 aa, Influenza virus; identical to SEQ ID NO: 419289
  MOD_RES (1)..(18): Any amino acid
  MOD_RES (32)..(39): Any amino acid
  MOD_RES (50)..(65): Any amino acid
  MOD_RES (77)..(168): Any amino acid
  MOD_RES (179)..(205): Any amino acid
  MOD_RES (241)..(248): Any amino acid
  MOD_RES (268)..(287): Any amino acid
  MOD_RES (309)..(321): Any amino acid
  MOD_RES (332)..(369): Any amino acid
  MOD_RES (398)..(408): Any amino acid
  MOD_RES (422)..(445): Any amino acid
  MOD_RES (456)..(486): Any amino acid
  MOD_RES (524)..(568): Any amino acid

SEQ ID NO: 420729 - protein, 561 aa, Influenza virus; identical to SEQ ID NO: 419293
  MOD_RES (1)..(15): Any amino acid
  MOD_RES (54)..(65): Any amino acid
  MOD_RES (77)..(78): Any amino acid
  MOD_RES (101)..(101): Any amino acid
  MOD_RES (131)..(150): Any amino acid
  MOD_RES (184)..(184): Any amino acid
  MOD_RES (246)..(246): Any amino acid
  MOD_RES (273)..(283): Any amino acid
  MOD_RES (337)..(337): Any amino acid

SEQ ID NO: 420730 - protein, 561 aa, Influenza virus; identical to SEQ ID NO: 419294
  MOD_RES (1)..(15): Any amino acid
  MOD_RES (52)..(65): Any amino acid
  MOD_RES (77)..(78): Any amino acid
  MOD_RES (101)..(101): Any amino acid
  MOD_RES (131)..(150): Any amino acid
  MOD_RES (184)..(184): Any amino acid
  MOD_RES (246)..(246): Any amino acid
  MOD_RES (273)..(283): Any amino acid
  MOD_RES (304)..(310): Any amino acid
  MOD_RES (337)..(337): Any amino acid
  MOD_RES (356)..(369): Any amino acid
  MOD_RES (389)..(401): Any amino acid
  MOD_RES (421)..(430): Any amino acid
  MOD_RES (442)..(444): Any amino acid
  MOD_RES (464)..(465): Any amino acid
  MOD_RES (561)..(561): Any amino acid

SEQ ID NO: 420731 - protein, 561 aa, Influenza virus; identical to SEQ ID NO: 419295
  MOD_RES (1)..(15): Any amino acid
  MOD_RES (54)..(65): Any amino acid
  MOD_RES (77)..(78): Any amino acid
  MOD_RES (101)..(101): Any amino acid
  MOD_RES (118)..(118): Any amino acid
  MOD_RES (131)..(150): Any amino acid
  MOD_RES (184)..(184): Any amino acid
  MOD_RES (230)..(235): Any amino acid
  MOD_RES (246)..(246): Any amino acid
  MOD_RES (273)..(283): Any amino acid
  MOD_RES (309)..(311): Any amino acid
  MOD_RES (337)..(340): Any amino acid
  MOD_RES (360)..(373): Any amino acid
  MOD_RES (398)..(403): Any amino acid
  MOD_RES (423)..(432): Any amino acid
  MOD_RES (445)..(446): Any amino acid
  MOD_RES (470)..(473): Any amino acid
  MOD_RES (525)..(531): Any amino acid
  MOD_RES (561)..(561): Any amino acid

SEQ ID NO: 420732 - protein, 561 aa, Influenza virus; identical to SEQ ID NO: 419296
  MOD_RES (1)..(15): Any amino acid
  MOD_RES (54)..(65): Any amino acid
  MOD_RES (77)..(78): Any amino acid
  MOD_RES (101)..(101): Any amino acid
  MOD_RES (118)..(118): Any amino acid
  MOD_RES (131)..(150): Any amino acid
  MOD_RES (184)..(184): Any amino acid
  MOD_RES (224)..(246): Any amino acid
  MOD_RES (271)..(291): Any amino acid
  MOD_RES (311)..(311): Any amino acid
  MOD_RES (332)..(374): Any amino acid
  MOD_RES (395)..(405): Any amino acid
  MOD_RES (425)..(451): Any amino acid
  MOD_RES (462)..(473): Any amino acid
  MOD_RES (498)..(507): Any amino acid
  MOD_RES (527)..(531): Any amino acid
  MOD_RES (556)..(561): Any amino acid

SEQ ID NO: 420733 - protein, 561 aa, Influenza virus; identical to SEQ ID NO: 419297
  MOD_RES (1)..(18): Any amino acid
  MOD_RES (54)..(65): Any amino acid
  MOD_RES (76)..(78): Any amino acid
  MOD_RES (101)..(101): Any amino acid
  MOD_RES (131)..(156): Any amino acid
  MOD_RES (179)..(184): Any amino acid
  MOD_RES (226)..(249): Any amino acid
  MOD_RES (273)..(321): Any amino acid
  MOD_RES (332)..(378): Any amino acid
  MOD_RES (394)..(473): Any amino acid
  MOD_RES (501)..(507): Any amino acid
  MOD_RES (527)..(531): Any amino acid
  MOD_RES (553)..(561): Any amino acid

SEQ ID NO: 420734 - protein, 471 aa, Influenza virus; identical to SEQ ID NO: 419300
  MOD_RES (18)..(19): Any amino acid
  MOD_RES (49)..(53): Any amino acid
  MOD_RES (75)..(82): Any amino acid
  MOD_RES (308)..(308): Any amino acid
  MOD_RES (332)..(333): Any amino acid
  MOD_RES (389)..(398): Any amino acid
  MOD_RES (416)..(416): Any amino acid

SEQ ID NO: 420735 - protein, 471 aa, Influenza virus; identical to SEQ ID NO: 419301
  MOD_RES (18)..(19): Any amino acid
  MOD_RES (49)..(53): Any amino acid
  MOD_RES (75)..(82): Any amino acid
  MOD_RES (115)..(116): Any amino acid
  MOD_RES (308)..(308): Any amino acid
  MOD_RES (332)..(333): Any amino acid
  MOD_RES (389)..(398): Any amino acid
  MOD_RES (416)..(416): Any amino acid

SEQ ID NO: 420736 - protein, 471 aa, Influenza virus; identical to SEQ ID NO: 419302
  MOD_RES (15)..(19): Any amino acid
  MOD_RES (49)..(53): Any amino acid
  MOD_RES (75)..(82): Any amino acid
  MOD_RES (136)..(154): Any amino acid
  MOD_RES (227)..(230): Any amino acid
  MOD_RES (308)..(308): Any amino acid
  MOD_RES (332)..(335): Any amino acid
  MOD_RES (368)..(373): Any amino acid
  MOD_RES (389)..(398): Any amino acid
  MOD_RES (416)..(416): Any amino acid
  MOD_RES (428)..(444): Any amino acid

SEQ ID NO: 420737 - protein, 471 aa, Influenza virus; identical to SEQ ID NO: 419303
  MOD_RES (1)..(1): Any amino acid
  MOD_RES (14)..(19): Any amino acid
  MOD_RES (30)..(38): Any amino acid
  MOD_RES (49)..(53): Any amino acid
  MOD_RES (64)..(64): Any amino acid
  MOD_RES (75)..(82): Any amino acid
  MOD_RES (102)..(103): Any amino acid
  MOD_RES (139)..(155): Any amino acid
  MOD_RES (231)..(235): Any amino acid
  MOD_RES (295)..(296): Any amino acid
  MOD_RES (308)..(308): Any amino acid
  MOD_RES (320)..(321): Any amino acid
  MOD_RES (332)..(335): Any amino acid
  MOD_RES (346)..(347): Any amino acid
  MOD_RES (374)..(374): Any amino acid
  MOD_RES (389)..(398): Any amino acid
  MOD_RES (410)..(416): Any amino acid
  MOD_RES (428)..(445): Any amino acid
  MOD_RES (464)..(471): Any amino acid

SEQ ID NO: 420738 - protein, 471 aa, Influenza virus; identical to SEQ ID NO: 419304
  MOD_RES (1)..(5): Any amino acid
  MOD_RES (18)..(38): Any amino acid
  MOD_RES (49)..(54): Any amino acid
  MOD_RES (75)..(82): Any amino acid
  MOD_RES (97)..(120): Any amino acid
  MOD_RES (136)..(157): Any amino acid
  MOD_RES (168)..(172): Any amino acid
  MOD_RES (184)..(189): Any amino acid
  MOD_RES (218)..(237): Any amino acid
  MOD_RES (308)..(308): Any amino acid
  MOD_RES (321)..(336): Any amino acid
  MOD_RES (347)..(358): Any amino acid
  MOD_RES (374)..(377): Any amino acid
  MOD_RES (389)..(398): Any amino acid
  MOD_RES (409)..(416): Any amino acid
  MOD_RES (428)..(445): Any amino acid
  MOD_RES (464)..(471): Any amino acid

SEQ ID NO: 420739 - protein, 565 aa, Influenza virus; identical to SEQ ID NO: 419308
  MOD_RES (1)..(14): Any amino acid
  MOD_RES (52)..(52): Any amino acid
  MOD_RES (113)..(157): Any amino acid
  MOD_RES (175)..(179): Any amino acid
  MOD_RES (190)..(234): Any amino acid
  MOD_RES (250)..(255): Any amino acid
  MOD_RES (275)..(293): Any amino acid
  MOD_RES (304)..(308): Any amino acid
  MOD_RES (339)..(340): Any amino acid
  MOD_RES (387)..(431): Any amino acid
  MOD_RES (464)..(467): Any amino acid
  MOD_RES (522)..(523): Any amino acid
  MOD_RES (549)..(551): Any amino acid

SEQ ID NO: 420740 - protein, 565 aa, Influenza virus; identical to SEQ ID NO: 419309
  MOD_RES (1)..(14): Any amino acid
  MOD_RES (52)..(52): Any amino acid
  MOD_RES (113)..(157): Any amino acid
  MOD_RES (175)..(179): Any amino acid
  MOD_RES (190)..(234): Any amino acid
  MOD_RES (250)..(255): Any amino acid
  MOD_RES (275)..(293): Any amino acid
  MOD_RES (304)..(308): Any amino acid
  MOD_RES (339)..(340): Any amino acid
  MOD_RES (351)..(361): Any amino acid
  MOD_RES (387)..(431): Any amino acid
  MOD_RES (464)..(467): Any amino acid
  MOD_RES (486)..(487): Any amino acid
  MOD_RES (522)..(523): Any amino acid
  MOD_RES (549)..(551): Any amino acid
  MOD_RES (563)..(565): Any amino acid

SEQ ID NO: 420741 - protein, 565 aa, Influenza virus; identical to SEQ ID NO: 419310
  MOD_RES (1)..(14): Any amino acid
  MOD_RES (48)..(52): Any amino acid
  MOD_RES (113)..(157): Any amino acid
  MOD_RES (175)..(179): Any amino acid
  MOD_RES (190)..(237): Any amino acid
  MOD_RES (250)..(255): Any amino acid
  MOD_RES (275)..(293): Any amino acid
  MOD_RES (304)..(308): Any amino acid
  MOD_RES (339)..(340): Any amino acid
  MOD_RES (351)..(363): Any amino acid
  MOD_RES (387)..(431): Any amino acid
  MOD_RES (446)..(449): Any amino acid
  MOD_RES (464)..(467): Any amino acid
  MOD_RES (522)..(523): Any amino acid
  MOD_RES (549)..(551): Any amino acid
  MOD_RES (565)..(565): Any amino acid

SEQ ID NO: 420742 - protein, 565 aa, Influenza virus; identical to SEQ ID NO: 419311
  MOD_RES (1)..(14): Any amino acid
  MOD_RES (52)..(52): Any amino acid
  MOD_RES (113)..(157): Any amino acid
  MOD_RES (175)..(179): Any amino acid
  MOD_RES (190)..(237): Any amino acid
  MOD_RES (250)..(255): Any amino acid
  MOD_RES (274)..(293): Any amino acid
  MOD_RES (304)..(308): Any amino acid
  MOD_RES (339)..(340): Any amino acid
  MOD_RES (358)..(366): Any amino acid
  MOD_RES (387)..(431): Any amino acid
  MOD_RES (449)..(449): Any amino acid
  MOD_RES (462)..(467): Any amino acid
  MOD_RES (522)..(523): Any amino acid
  MOD_RES (549)..(551): Any amino acid
  MOD_RES (565)..(565): Any amino acid

SEQ ID NO: 420743 - protein, 565 aa, Influenza virus; identical to SEQ ID NO: 419312
  MOD_RES (1)..(15): Any amino acid
  MOD_RES (43)..(53): Any amino acid
  MOD_RES (73)..(75): Any amino acid
  MOD_RES (102)..(157): Any amino acid
  MOD_RES (175)..(179): Any amino acid
  MOD_RES (190)..(238): Any amino acid
  MOD_RES (249)..(255): Any amino acid
  MOD_RES (275)..(293): Any amino acid
  MOD_RES (304)..(308): Any amino acid
  MOD_RES (338)..(375): Any amino acid
  MOD_RES (386)..(432): Any amino acid
  MOD_RES (443)..(453): Any amino acid
  MOD_RES (464)..(467): Any amino acid
  MOD_RES (498)..(499): Any amino acid
  MOD_RES (520)..(535): Any amino acid
  MOD_RES (548)..(551): Any amino acid
  MOD_RES (563)..(565): Any amino acid

SEQ ID NO: 420744 - protein, 564 aa, Influenza virus; identical to SEQ ID NO: 419315
  MOD_RES (1)..(14): Any amino acid
  MOD_RES (57)..(60): Any amino acid
  MOD_RES (152)..(152): Any amino acid
  MOD_RES (189)..(189): Any amino acid
  MOD_RES (205)..(219): Any amino acid
  MOD_RES (287)..(291): Any amino acid
  MOD_RES (406)..(410): Any amino acid
  MOD_RES (467)..(469): Any amino acid
  MOD_RES (489)..(492): Any amino acid
  MOD_RES (503)..(503): Any amino acid

SEQ ID NO: 420745 - protein, 564 aa, Influenza virus; identical to SEQ ID NO: 419316
  MOD_RES (1)..(14): Any amino acid
  MOD_RES (57)..(60): Any amino acid
  MOD_RES (152)..(152): Any amino acid
  MOD_RES (189)..(189): Any amino acid
  MOD_RES (205)..(219): Any amino acid
  MOD_RES (287)..(291): Any amino acid
  MOD_RES (406)..(410): Any amino acid
  MOD_RES (451)..(452): Any amino acid
  MOD_RES (467)..(469): Any amino acid
  MOD_RES (489)..(492): Any amino acid
  MOD_RES (503)..(503): Any amino acid
  MOD_RES (525)..(533): Any amino acid

SEQ ID NO: 420746 - protein, 564 aa, Influenza virus; identical to SEQ ID NO: 419317
  MOD_RES (1)..(14): Any amino acid
  MOD_RES (25)..(27): Any amino acid
  MOD_RES (57)..(60): Any amino acid
  MOD_RES (123)..(127): Any amino acid
  MOD_RES (147)..(152): Any amino acid
  MOD_RES (189)..(189): Any amino acid
  MOD_RES (205)..(219): Any amino acid
  MOD_RES (245)..(250): Any amino acid
  MOD_RES (287)..(291): Any amino acid
  MOD_RES (358)..(364): Any amino acid
  MOD_RES (406)..(410): Any amino acid
  MOD_RES (440)..(454): Any amino acid
  MOD_RES (467)..(469): Any amino acid
  MOD_RES (489)..(492): Any amino acid
  MOD_RES (503)..(503): Any amino acid
  MOD_RES (526)..(564): Any amino acid

SEQ ID NO: 420747 - protein, 564 aa, Influenza virus; identical to SEQ ID NO: 419318
  MOD_RES (1)..(27): Any amino acid
  MOD_RES (57)..(68): Any amino acid
  MOD_RES (88)..(96): Any amino acid
  MOD_RES (129)..(133): Any amino acid
  MOD_RES (152)..(152): Any amino acid
  MOD_RES (173)..(190): Any amino acid
  MOD_RES (205)..(219): Any amino acid
  MOD_RES (244)..(262): Any amino acid
  MOD_RES (282)..(291): Any amino acid
  MOD_RES (348)..(366): Any amino acid
  MOD_RES (395)..(395): Any amino acid
  MOD_RES (406)..(410): Any amino acid
  MOD_RES (441)..(454): Any amino acid
  MOD_RES (467)..(469): Any amino acid
  MOD_RES (489)..(492): Any amino acid
  MOD_RES (503)..(503): Any amino acid
  MOD_RES (515)..(564): Any amino acid

SEQ ID NO: 420748 - protein, 564 aa, Influenza virus; identical to SEQ ID NO: 419319
  MOD_RES (1)..(27): Any amino acid
  MOD_RES (41)..(45): Any amino acid
  MOD_RES (57)..(70): Any amino acid
  MOD_RES (90)..(103): Any amino acid
  MOD_RES (130)..(136): Any amino acid
  MOD_RES (152)..(152): Any amino acid
  MOD_RES (174)..(194): Any amino acid
  MOD_RES (205)..(219): Any amino acid
  MOD_RES (247)..(291): Any amino acid
  MOD_RES (310)..(315): Any amino acid
  MOD_RES (351)..(367): Any amino acid
  MOD_RES (399)..(410): Any amino acid
  MOD_RES (437)..(455): Any amino acid
  MOD_RES (467)..(469): Any amino acid
  MOD_RES (489)..(492): Any amino acid
  MOD_RES (503)..(504): Any amino acid
  MOD_RES (524)..(564): Any amino acid

SEQ ID NO: 420749 - protein, 567 aa, Influenza virus; identical to SEQ ID NO: 419321
  MOD_RES (1)..(17): Any amino acid
  MOD_RES (86)..(89): Any amino acid
  MOD_RES (138)..(154): Any amino acid
  MOD_RES (165)..(172): Any amino acid
  MOD_RES (200)..(213): Any amino acid
  MOD_RES (225)..(231): Any amino acid
  MOD_RES (249)..(256): Any amino acid
  MOD_RES (289)..(290): Any amino acid
  MOD_RES (341)..(343): Any amino acid
  MOD_RES (468)..(472): Any amino acid
  MOD_RES (564)..(567): Any amino acid

SEQ ID NO: 420750 - protein, 567 aa, Influenza virus; identical to SEQ ID NO: 419322
  MOD_RES (1)..(17): Any amino acid
  MOD_RES (86)..(89): Any amino acid
  MOD_RES (138)..(154): Any amino acid
  MOD_RES (165)..(179): Any amino acid
  MOD_RES (200)..(213): Any amino acid
  MOD_RES (225)..(231): Any amino acid
  MOD_RES (249)..(256): Any amino acid
  MOD_RES (289)..(290): Any amino acid
  MOD_RES (341)..(343): Any amino acid
  MOD_RES (356)..(366): Any amino acid
  MOD_RES (468)..(472): Any amino acid
  MOD_RES (564)..(567): Any amino acid

SEQ ID NO: 420751 - protein, 567 aa, Influenza virus; identical to SEQ ID NO: 419323
  MOD_RES (1)..(17): Any amino acid
  MOD_RES (86)..(89): Any amino acid
  MOD_RES (112)..(123): Any amino acid
  MOD_RES (138)..(154): Any amino acid
  MOD_RES (165)..(179): Any amino acid
  MOD_RES (200)..(213): Any amino acid
  MOD_RES (225)..(231): Any amino acid
  MOD_RES (249)..(256): Any amino acid
  MOD_RES (275)..(276): Any amino acid
  MOD_RES (289)..(290): Any amino acid
  MOD_RES (341)..(343): Any amino acid
  MOD_RES (359)..(366): Any amino acid
  MOD_RES (386)..(409): Any amino acid
  MOD_RES (429)..(431): Any amino acid
  MOD_RES (468)..(472): Any amino acid
  MOD_RES (564)..(567): Any amino acid

SEQ ID NO: 420752 - protein, 567 aa, Influenza virus; identical to SEQ ID NO: 419324
  MOD_RES (1)..(22): Any amino acid
  MOD_RES (84)..(92): Any amino acid
  MOD_RES (112)..(126): Any amino acid
  MOD_RES (137)..(154): Any amino acid
  MOD_RES (165)..(179): Any amino acid
  MOD_RES (200)..(213): Any amino acid
  MOD_RES (225)..(231): Any amino acid
  MOD_RES (243)..(256): Any amino acid
  MOD_RES (267)..(276): Any amino acid
  MOD_RES (289)..(304): Any amino acid
  MOD_RES (323)..(326): Any amino acid
  MOD_RES (337)..(343): Any amino acid
  MOD_RES (357)..(368): Any amino acid
  MOD_RES (386)..(409): Any amino acid
  MOD_RES (429)..(450): Any amino acid
  MOD_RES (468)..(484): Any amino acid
  MOD_RES (505)..(511): Any amino acid
  MOD_RES (537)..(537): Any amino acid
  MOD_RES (557)..(567): Any amino acid

SEQ ID NO: 420753 - protein, 567 aa, Influenza virus; identical to SEQ ID NO: 419325
  MOD_RES (1)..(25): Any amino acid
  MOD_RES (54)..(96): Any amino acid
  MOD_RES (116)..(154): Any amino acid
  MOD_RES (165)..(179): Any amino acid
  MOD_RES (191)..(213): Any amino acid
  MOD_RES (225)..(231): Any amino acid
  MOD_RES (246)..(278): Any amino acid
  MOD_RES (289)..(309): Any amino acid
  MOD_RES (329)..(330): Any amino acid
  MOD_RES (341)..(371): Any amino acid
  MOD_RES (391)..(409): Any amino acid
  MOD_RES (425)..(456): Any amino acid
  MOD_RES (468)..(494): Any amino acid
  MOD_RES (505)..(513): Any amino acid
  MOD_RES (540)..(542): Any amino acid
  MOD_RES (564)..(567): Any amino acid

SEQ ID NO: 420754 - protein, 568 aa, Influenza virus; identical to SEQ ID NO: 418424

SEQ ID NO: 420755 - protein, 568 aa, Influenza virus; identical to SEQ ID NO: 419328
  MOD_RES (1)..(9): Any amino acid
  MOD_RES (22)..(163): Any amino acid
  MOD_RES (183)..(568): Any amino acid

SEQ ID NO: 420756 - protein, 570 aa, Influenza virus; identical to SEQ ID NO: 418426

SEQ ID NO: 420757 - protein, 570 aa, Influenza virus; identical to SEQ ID NO: 419330
  MOD_RES (1)..(7): Any amino acid
  MOD_RES (67)..(76): Any amino acid
  MOD_RES (99)..(99): Any amino acid
  MOD_RES (119)..(120): Any amino acid
  MOD_RES (149)..(152): Any amino acid
  MOD_RES (190)..(196): Any amino acid
  MOD_RES (229)..(267): Any amino acid
  MOD_RES (287)..(309): Any amino acid
  MOD_RES (333)..(337): Any amino acid
  MOD_RES (357)..(400): Any amino acid
  MOD_RES (420)..(519): Any amino acid
  MOD_RES (539)..(570): Any amino acid

SEQ ID NO: 420758 - protein, 570 aa, Influenza virus; identical to SEQ ID NO: 419331
  MOD_RES (1)..(155): Any amino acid
  MOD_RES (175)..(218): Any amino acid
  MOD_RES (238)..(338): Any amino acid
  MOD_RES (365)..(570): Any amino acid

SEQ ID NO: 420759 - protein, 570 aa, Influenza virus; identical to SEQ ID NO: 419332
  MOD_RES (1)..(156): Any amino acid
  MOD_RES (176)..(570): Any amino acid

SEQ ID NO: 420760 - protein, 569 aa, Influenza virus; identical to SEQ ID NO: 419333
  MOD_RES (12)..(15): Any amino acid
  MOD_RES (160)..(160): Any amino acid
  MOD_RES (172)..(173): Any amino acid
  MOD_RES (343)..(343): Any amino acid
  MOD_RES (471)..(471): Any amino acid

SEQ ID NO: 420761 - protein, 569 aa, Influenza virus; identical to SEQ ID NO: 419334
  MOD_RES (1)..(15): Any amino acid
  MOD_RES (78)..(80): Any amino acid
  MOD_RES (126)..(129): Any amino acid
  MOD_RES (160)..(160): Any amino acid
  MOD_RES (172)..(173): Any amino acid
  MOD_RES (193)..(193): Any amino acid
  MOD_RES (328)..(331): Any amino acid
  MOD_RES (351)..(375): Any amino acid
  MOD_RES (402)..(416): Any amino acid
  MOD_RES (471)..(471): Any amino acid

SEQ ID NO: 420762 - protein, 569 aa, Influenza virus; identical to SEQ ID NO: 419335
  MOD_RES (1)..(15): Any amino acid
  MOD_RES (46)..(61): Any amino acid
  MOD_RES (81)..(100): Any amino acid
  MOD_RES (122)..(129): Any amino acid
  MOD_RES (160)..(160): Any amino acid
  MOD_RES (172)..(179): Any amino acid
  MOD_RES (190)..(195): Any amino acid
  MOD_RES (218)..(225): Any amino acid
  MOD_RES (273)..(277): Any amino acid
  MOD_RES (325)..(332): Any amino acid
  MOD_RES (343)..(343): Any amino acid
  MOD_RES (354)..(375): Any amino acid
  MOD_RES (395)..(419): Any amino acid
  MOD_RES (439)..(441): Any amino acid
  MOD_RES (471)..(471): Any amino acid
  MOD_RES (495)..(506): Any amino acid

SEQ ID NO: 420763 - protein, 569 aa, Influenza virus; identical to SEQ ID NO: 419336
  MOD_RES (1)..(15): Any amino acid
  MOD_RES (53)..(61): Any amino acid
  MOD_RES (78)..(102): Any amino acid
  MOD_RES (120)..(131): Any amino acid
  MOD_RES (160)..(161): Any amino acid
  MOD_RES (172)..(179): Any amino acid
  MOD_RES (191)..(195): Any amino acid
  MOD_RES (223)..(237): Any amino acid
  MOD_RES (269)..(278): Any amino acid
  MOD_RES (324)..(343): Any amino acid
  MOD_RES (354)..(381): Any amino acid
  MOD_RES (401)..(445): Any amino acid
  MOD_RES (471)..(471): Any amino acid
  MOD_RES (497)..(523): Any amino acid

SEQ ID NO: 420764 - protein, 569 aa, Influenza virus; identical to SEQ ID NO: 419337
  MOD_RES (1)..(15): Any amino acid
  MOD_RES (26)..(27): Any amino acid
  MOD_RES (47)..(102): Any amino acid
  MOD_RES (122)..(131): Any amino acid
  MOD_RES (156)..(161): Any amino acid
  MOD_RES (172)..(196): Any amino acid
  MOD_RES (219)..(243): Any amino acid
  MOD_RES (269)..(280): Any amino acid
  MOD_RES (302)..(343): Any amino acid
  MOD_RES (354)..(382): Any amino acid
  MOD_RES (395)..(456): Any amino acid
  MOD_RES (471)..(525): Any amino acid
  MOD_RES (545)..(569): Any amino acid

SEQ ID NO: 420765 - protein, 627 aa, Influenza virus; identical to SEQ ID NO: 419339
  MOD_RES (18)..(26): Any amino acid
  MOD_RES (47)..(304): Any amino acid
  MOD_RES (324)..(342): Any amino acid
  MOD_RES (355)..(385): Any amino acid
  MOD_RES (415)..(479): Any amino acid
  MOD_RES (491)..(601): Any amino acid
  MOD_RES (622)..(627): Any amino acid

SEQ ID NO: 420766 - protein, 627 aa, Influenza virus; identical to SEQ ID NO: 419340
  MOD_RES (1)..(1): Any amino acid
  MOD_RES (18)..(304): Any amino acid
  MOD_RES (321)..(388): Any amino acid
  MOD_RES (415)..(479): Any amino acid
  MOD_RES (491)..(601): Any amino acid

SEQ ID NO: 420767 - protein, 627 aa, Influenza virus; identical to SEQ ID NO: 419341
  MOD_RES (1)..(4): Any amino acid
  MOD_RES (18)..(391): Any amino acid
  MOD_RES (415)..(479): Any amino acid
  MOD_RES (491)..(601): Any amino acid

SEQ ID NO: 420768 - protein, 627 aa, Influenza virus; identical to SEQ ID NO: 419342
  MOD_RES (1)..(6): Any amino acid
  MOD_RES (18)..(394): Any amino acid
  MOD_RES (413)..(479): Any amino acid
  MOD_RES (491)..(601): Any amino acid
  MOD_RES (625)..(627): Any amino acid

SEQ ID NO: 420769 - protein, 627 aa, Influenza virus; identical to SEQ ID NO: 419343
  MOD_RES (1)..(394): Any amino acid
  MOD_RES (415)..(479): Any amino acid
  MOD_RES (491)..(603): Any amino acid
  MOD_RES (619)..(627): Any amino acid

SEQ ID NO: 420770 - protein, 599 aa, Influenza virus; identical to SEQ ID NO: 419348
  MOD_RES (19)..(26): Any amino acid
  MOD_RES (62)..(83): Any amino acid
  MOD_RES (95)..(123): Any amino acid
  MOD_RES (147)..(180): Any amino acid
  MOD_RES (192)..(266): Any amino acid
  MOD_RES (281)..(316): Any amino acid
  MOD_RES (329)..(329): Any amino acid
  MOD_RES (402)..(408): Any amino acid
  MOD_RES (431)..(434): Any amino acid
  MOD_RES (473)..(486): Any amino acid
  MOD_RES (506)..(506): Any amino acid
  MOD_RES (528)..(541): Any amino acid
  MOD_RES (582)..(582): Any amino acid
  MOD_RES (594)..(599): Any amino acid

SEQ ID NO: 420771 - protein, 599 aa, Influenza virus; identical to SEQ ID NO: 419349
  MOD_RES (1)..(1): Any amino acid
  MOD_RES (19)..(26): Any amino acid
  MOD_RES (62)..(83): Any amino acid
  MOD_RES (94)..(123): Any amino acid
  MOD_RES (147)..(180): Any amino acid
  MOD_RES (192)..(266): Any amino acid
  MOD_RES (281)..(329): Any amino acid
  MOD_RES (363)..(367): Any amino acid
  MOD_RES (402)..(408): Any amino acid
  MOD_RES (430)..(434): Any amino acid
  MOD_RES (473)..(486): Any amino acid
  MOD_RES (506)..(506): Any amino acid
  MOD_RES (528)..(541): Any amino acid
  MOD_RES (591)..(599): Any amino acid

SEQ ID NO: 420772 - protein, 599 aa, Influenza virus; identical to SEQ ID NO: 419350
  MOD_RES (1)..(4): Any amino acid
  MOD_RES (19)..(26): Any amino acid
  MOD_RES (62)..(83): Any amino acid
  MOD_RES (95)..(123): Any amino acid
  MOD_RES (147)..(266): Any amino acid
  MOD_RES (281)..(329): Any amino acid
  MOD_RES (357)..(381): Any amino acid
  MOD_RES (398)..(408): Any amino acid
  MOD_RES (431)..(434): Any amino acid
  MOD_RES (473)..(486): Any amino acid
  MOD_RES (506)..(506): Any amino acid
  MOD_RES (528)..(541): Any amino acid
  MOD_RES (582)..(582): Any amino acid

SEQ ID NO: 420773 - protein, 599 aa, Influenza virus; identical to SEQ ID NO: 419351
  MOD_RES (1)..(8): Any amino acid
  MOD_RES (19)..(38): Any amino acid
  MOD_RES (56)..(83): Any amino acid
  MOD_RES (94)..(123): Any amino acid
  MOD_RES (147)..(266): Any amino acid
  MOD_RES (278)..(329): Any amino acid
  MOD_RES (366)..(387): Any amino acid
  MOD_RES (398)..(408): Any amino acid
  MOD_RES (431)..(434): Any amino acid
  MOD_RES (450)..(462): Any amino acid
  MOD_RES (473)..(495): Any amino acid
  MOD_RES (506)..(507): Any amino acid
  MOD_RES (528)..(541): Any amino acid
  MOD_RES (569)..(569): Any amino acid
  MOD_RES (582)..(582): Any amino acid

SEQ ID NO: 420774 - protein, 599 aa, Influenza virus; identical to SEQ ID NO: 419352
  MOD_RES (1)..(12): Any amino acid
  MOD_RES (23)..(39): Any amino acid
  MOD_RES (59)..(83): Any amino acid
  MOD_RES (95)..(128): Any amino acid
  MOD_RES (145)..(266): Any amino acid
  MOD_RES (281)..(329): Any amino acid
  MOD_RES (363)..(387): Any amino acid
  MOD_RES (402)..(411): Any amino acid
  MOD_RES (430)..(434): Any amino acid
  MOD_RES (458)..(462): Any amino acid
  MOD_RES (473)..(517): Any amino acid
  MOD_RES (528)..(552): Any amino acid
  MOD_RES (589)..(599): Any amino acid

SEQ ID NO: 420775 - protein, 484 aa, Influenza virus; identical to SEQ ID NO: 419358
  MOD_RES (21)..(106): Any amino acid
  MOD_RES (231)..(232): Any amino acid
  MOD_RES (269)..(282): Any amino acid
  MOD_RES (298)..(299): Any amino acid
  MOD_RES (323)..(325): Any amino acid
  MOD_RES (341)..(354): Any amino acid
  MOD_RES (379)..(382): Any amino acid
  MOD_RES (395)..(409): Any amino acid
  MOD_RES (445)..(447): Any amino acid
  MOD_RES (465)..(468): Any amino acid
  MOD_RES (482)..(484): Any amino acid

SEQ ID NO: 420776 - protein, 484 aa, Influenza virus; identical to SEQ ID NO: 419359
  MOD_RES (1)..(10): Any amino acid
  MOD_RES (21)..(106): Any amino acid
  MOD_RES (231)..(232): Any amino acid
  MOD_RES (259)..(282): Any amino acid
  MOD_RES (298)..(299): Any amino acid
  MOD_RES (323)..(325): Any amino acid
  MOD_RES (341)..(354): Any amino acid
  MOD_RES (379)..(382): Any amino acid
  MOD_RES (395)..(409): Any amino acid
  MOD_RES (445)..(447): Any amino acid
  MOD_RES (465)..(468): Any amino acid
  MOD_RES (482)..(484): Any amino acid

SEQ ID NO: 420777 - protein, 484 aa, Influenza virus; identical to SEQ ID NO: 419360
  MOD_RES (1)..(106): Any amino acid
  MOD_RES (148)..(150): Any amino acid
  MOD_RES (187)..(189): Any amino acid
  MOD_RES (231)..(232): Any amino acid
  MOD_RES (259)..(282): Any amino acid
  MOD_RES (298)..(299): Any amino acid
  MOD_RES (320)..(325): Any amino acid
  MOD_RES (336)..(354): Any amino acid
  MOD_RES (379)..(382): Any amino acid
  MOD_RES (395)..(409): Any amino acid
  MOD_RES (445)..(448): Any amino acid
  MOD_RES (465)..(468): Any amino acid
  MOD_RES (482)..(484): Any amino acid

SEQ ID NO: 420778 - protein, 484 aa, Influenza virus; identical to SEQ ID NO: 419361
  MOD_RES (1)..(106): Any amino acid
  MOD_RES (127)..(127): Any amino acid
  MOD_RES (141)..(150): Any amino acid
  MOD_RES (184)..(189): Any amino acid
  MOD_RES (231)..(232): Any amino acid
  MOD_RES (259)..(282): Any amino acid
  MOD_RES (298)..(299): Any amino acid
  MOD_RES (323)..(325): Any amino acid
  MOD_RES (341)..(354): Any amino acid
  MOD_RES (379)..(409): Any amino acid
  MOD_RES (432)..(448): Any amino acid
  MOD_RES (464)..(470): Any amino acid
  MOD_RES (482)..(484): Any amino acid

SEQ ID NO: 420779 - protein, 484 aa, Influenza virus; identical to SEQ ID NO: 419362
  MOD_RES (1)..(111): Any amino acid
  MOD_RES (135)..(151): Any amino acid
  MOD_RES (177)..(189): Any amino acid
  MOD_RES (200)..(201): Any amino acid
  MOD_RES (231)..(235): Any amino acid
  MOD_RES (250)..(282): Any amino acid
  MOD_RES (296)..(300): Any amino acid
  MOD_RES (320)..(325): Any amino acid
  MOD_RES (336)..(354): Any amino acid
  MOD_RES (365)..(368): Any amino acid
  MOD_RES (379)..(421): Any amino acid
  MOD_RES (441)..(448): Any amino acid
  MOD_RES (465)..(470): Any amino acid
  MOD_RES (482)..(484): Any amino acid

SEQ ID NO: 420780 - protein, 566 aa, Influenza virus; identical to SEQ ID NO: 419366
  MOD_RES (1)..(17): Any amino acid
  MOD_RES (36)..(38): Any amino acid
  MOD_RES (52)..(307): Any amino acid
  MOD_RES (327)..(339): Any amino acid
  MOD_RES (369)..(371): Any amino acid
  MOD_RES (382)..(421): Any amino acid
  MOD_RES (432)..(433): Any amino acid
  MOD_RES (460)..(471): Any amino acid
  MOD_RES (491)..(491): Any amino acid
  MOD_RES (502)..(550): Any amino acid
  MOD_RES (565)..(566): Any amino acid

SEQ ID NO: 420781 - protein, 566 aa, Influenza virus; identical to SEQ ID NO: 419367
  MOD_RES (1)..(17): Any amino acid
  MOD_RES (36)..(38): Any amino acid
  MOD_RES (51)..(307): Any amino acid
  MOD_RES (327)..(339): Any amino acid
  MOD_RES (369)..(371): Any amino acid
  MOD_RES (382)..(421): Any amino acid
  MOD_RES (432)..(433): Any amino acid
  MOD_RES (460)..(471): Any amino acid
  MOD_RES (491)..(491): Any amino acid
  MOD_RES (502)..(550): Any amino acid
  MOD_RES (565)..(566): Any amino acid

SEQ ID NO: 420782 - protein, 566 aa, Influenza virus; identical to SEQ ID NO: 419368
  MOD_RES (1)..(17): Any amino acid
  MOD_RES (36)..(38): Any amino acid
  MOD_RES (52)..(307): Any amino acid
  MOD_RES (327)..(339): Any amino acid
  MOD_RES (351)..(353): Any amino acid
  MOD_RES (369)..(371): Any amino acid
  MOD_RES (382)..(421): Any amino acid
  MOD_RES (432)..(433): Any amino acid
  MOD_RES (460)..(471): Any amino acid
  MOD_RES (491)..(491): Any amino acid
  MOD_RES (502)..(550): Any amino acid
  MOD_RES (565)..(566): Any amino acid

SEQ ID NO: 420783 - protein, 566 aa, Influenza virus; identical to SEQ ID NO: 419369
  MOD_RES (1)..(17): Any amino acid
  MOD_RES (28)..(38): Any amino acid
  MOD_RES (51)..(307): Any amino acid
  MOD_RES (319)..(339): Any amino acid
  MOD_RES (352)..(353): Any amino acid
  MOD_RES (364)..(371): Any amino acid
  MOD_RES (382)..(421): Any amino acid
  MOD_RES (432)..(433): Any amino acid
  MOD_RES (444)..(447): Any amino acid
  MOD_RES (460)..(471): Any amino acid
  MOD_RES (491)..(491): Any amino acid
  MOD_RES (502)..(550): Any amino acid
  MOD_RES (564)..(566): Any amino acid

SEQ ID NO: 420784 - protein, 566 aa, Influenza virus; identical to SEQ ID NO: 419370
  MOD_RES (1)..(18): Any amino acid
  MOD_RES (29)..(38): Any amino acid
  MOD_RES (49)..(307): Any amino acid
  MOD_RES (325)..(339): Any amino acid
  MOD_RES (353)..(371): Any amino acid
  MOD_RES (382)..(421): Any amino acid
  MOD_RES (432)..(434): Any amino acid
  MOD_RES (445)..(448): Any amino acid
  MOD_RES (459)..(471): Any amino acid
  MOD_RES (491)..(553): Any amino acid
  MOD_RES (564)..(566): Any amino acid

SEQ ID NO: 420785 - protein, 475 aa, Influenza virus; identical to SEQ ID NO: 419374
  MOD_RES (1)..(46): Any amino acid
  MOD_RES (57)..(94): Any amino acid
  MOD_RES (126)..(128): Any amino acid
  MOD_RES (144)..(151): Any amino acid
  MOD_RES (195)..(221): Any amino acid
  MOD_RES (235)..(236): Any amino acid
  MOD_RES (250)..(270): Any amino acid
  MOD_RES (287)..(287): Any amino acid
  MOD_RES (307)..(314): Any amino acid
  MOD_RES (329)..(345): Any amino acid
  MOD_RES (357)..(371): Any amino acid
  MOD_RES (382)..(404): Any amino acid
  MOD_RES (415)..(416): Any amino acid
  MOD_RES (433)..(436): Any amino acid
  MOD_RES (462)..(462): Any amino acid

SEQ ID NO: 420786 - protein, 475 aa, Influenza virus; identical to SEQ ID NO: 419375
  MOD_RES (1)..(46): Any amino acid
  MOD_RES (57)..(94): Any amino acid
  MOD_RES (126)..(128): Any amino acid
  MOD_RES (144)..(151): Any amino acid
  MOD_RES (195)..(221): Any amino acid
  MOD_RES (235)..(236): Any amino acid
  MOD_RES (250)..(270): Any amino acid
  MOD_RES (286)..(287): Any amino acid
  MOD_RES (307)..(314): Any amino acid
  MOD_RES (328)..(345): Any amino acid
  MOD_RES (357)..(371): Any amino acid
  MOD_RES (382)..(404): Any amino acid
  MOD_RES (415)..(416): Any amino acid
  MOD_RES (433)..(436): Any amino acid
  MOD_RES (462)..(475): Any amino acid

SEQ ID NO: 420787 - protein, 475 aa, Influenza virus; identical to SEQ ID NO: 419376
  MOD_RES (1)..(46): Any amino acid
  MOD_RES (57)..(94): Any amino acid
  MOD_RES (125)..(132): Any amino acid
  MOD_RES (144)..(151): Any amino acid
  MOD_RES (195)..(221): Any amino acid
  MOD_RES (235)..(236): Any amino acid
  MOD_RES (250)..(270): Any amino acid
  MOD_RES (287)..(287): Any amino acid
  MOD_RES (307)..(314): Any amino acid
  MOD_RES (328)..(345): Any amino acid
  MOD_RES (357)..(371): Any amino acid
  MOD_RES (382)..(404): Any amino acid
  MOD_RES (415)..(416): Any amino acid
  MOD_RES (433)..(436): Any amino acid
  MOD_RES (462)..(475): Any amino acid

SEQ ID NO: 420788 - protein, 475 aa, Influenza virus; identical to SEQ ID NO: 419377
  MOD_RES (1)..(94): Any amino acid
  MOD_RES (124)..(132): Any amino acid
  MOD_RES (144)..(151): Any amino acid
  MOD_RES (177)..(179): Any amino acid
  MOD_RES (195)..(221): Any amino acid
  MOD_RES (235)..(236): Any amino acid
  MOD_RES (250)..(270): Any amino acid
  MOD_RES (287)..(287): Any amino acid
  MOD_RES (298)..(345): Any amino acid
  MOD_RES (357)..(371): Any amino acid
  MOD_RES (382)..(404): Any amino acid
  MOD_RES (415)..(416): Any amino acid
  MOD_RES (433)..(436): Any amino acid
  MOD_RES (456)..(475): Any amino acid

SEQ ID NO: 420789 - protein, 475 aa, Influenza virus; identical to SEQ ID NO: 419378
  MOD_RES (1)..(94): Any amino acid
  MOD_RES (105)..(106): Any amino acid
  MOD_RES (122)..(151): Any amino acid
  MOD_RES (162)..(163): Any amino acid
  MOD_RES (183)..(183): Any amino acid
  MOD_RES (195)..(236): Any amino acid
  MOD_RES (250)..(276): Any amino acid
  MOD_RES (287)..(294): Any amino acid
  MOD_RES (307)..(345): Any amino acid
  MOD_RES (357)..(371): Any amino acid
  MOD_RES (382)..(422): Any amino acid
  MOD_RES (433)..(436): Any amino acid
  MOD_RES (462)..(475): Any amino acid

SEQ ID NO: 420790 - protein, 569 aa, Influenza virus; identical to SEQ ID NO: 419382
  MOD_RES (17)..(21): Any amino acid
  MOD_RES (38)..(38): Any amino acid
  MOD_RES (94)..(94): Any amino acid
  MOD_RES (106)..(161): Any amino acid
  MOD_RES (173)..(182): Any amino acid
  MOD_RES (195)..(259): Any amino acid
  MOD_RES (289)..(294): Any amino acid
  MOD_RES (330)..(341): Any amino acid
  MOD_RES (392)..(418): Any amino acid
  MOD_RES (436)..(437): Any amino acid
  MOD_RES (499)..(500): Any amino acid
  MOD_RES (523)..(527): Any amino acid

SEQ ID NO: 420791 - protein, 569 aa, Influenza virus; identical to SEQ ID NO: 419383
  MOD_RES (13)..(21): Any amino acid
  MOD_RES (38)..(38): Any amino acid
  MOD_RES (94)..(94): Any amino acid
  MOD_RES (106)..(161): Any amino acid
  MOD_RES (172)..(182): Any amino acid
  MOD_RES (195)..(259): Any amino acid
  MOD_RES (289)..(294): Any amino acid
  MOD_RES (330)..(341): Any amino acid
  MOD_RES (354)..(355): Any amino acid
  MOD_RES (392)..(418): Any amino acid
  MOD_RES (436)..(437): Any amino acid
  MOD_RES (499)..(500): Any amino acid
  MOD_RES (523)..(527): Any amino acid
  MOD_RES (540)..(540): Any amino acid
  MOD_RES (565)..(569): Any amino acid

SEQ ID NO: 420792 - protein, 569 aa, Influenza virus; identical to SEQ ID NO: 419384
  MOD_RES (17)..(21): Any amino acid
  MOD_RES (37)..(38): Any amino acid
  MOD_RES (94)..(94): Any amino acid
  MOD_RES (106)..(161): Any amino acid
  MOD_RES (173)..(182): Any amino acid
  MOD_RES (195)..(259): Any amino acid
  MOD_RES (289)..(294): Any amino acid
  MOD_RES (308)..(309): Any amino acid
  MOD_RES (329)..(341): Any amino acid
  MOD_RES (356)..(376): Any amino acid
  MOD_RES (392)..(418): Any amino acid
  MOD_RES (436)..(437): Any amino acid
  MOD_RES (499)..(500): Any amino acid
  MOD_RES (523)..(527): Any amino acid
  MOD_RES (538)..(540): Any amino acid
  MOD_RES (565)..(569): Any amino acid

SEQ ID NO: 420793 - protein, 569 aa, Influenza virus; identical to SEQ ID NO: 419385
  MOD_RES (14)..(21): Any amino acid
  MOD_RES (38)..(42): Any amino acid
  MOD_RES (79)..(81): Any amino acid
  MOD_RES (94)..(94): Any amino acid
  MOD_RES (106)..(182): Any amino acid
  MOD_RES (195)..(259): Any amino acid
  MOD_RES (271)..(272): Any amino acid
  MOD_RES (289)..(294): Any amino acid
  MOD_RES (311)..(318): Any amino acid
  MOD_RES (330)..(341): Any amino acid
  MOD_RES (354)..(418): Any amino acid
  MOD_RES (435)..(437): Any amino acid
  MOD_RES (487)..(487): Any amino acid
  MOD_RES (499)..(500): Any amino acid
  MOD_RES (523)..(528): Any amino acid
  MOD_RES (540)..(544): Any amino acid
  MOD_RES (564)..(569): Any amino acid

SEQ ID NO: 420794 - protein, 569 aa, Influenza virus; identical to SEQ ID NO: 419386
  MOD_RES (1)..(21): Any amino acid
  MOD_RES (38)..(44): Any amino acid
  MOD_RES (58)..(58): Any amino acid
  MOD_RES (78)..(82): Any amino acid
  MOD_RES (94)..(95): Any amino acid
  MOD_RES (106)..(182): Any amino acid
  MOD_RES (193)..(259): Any amino acid
  MOD_RES (275)..(275): Any amino acid
  MOD_RES (289)..(294): Any amino acid
  MOD_RES (316)..(341): Any amino acid
  MOD_RES (356)..(420): Any amino acid
  MOD_RES (435)..(450): Any amino acid
  MOD_RES (499)..(500): Any amino acid
  MOD_RES (523)..(544): Any amino acid
  MOD_RES (564)..(569): Any amino acid

SEQ ID NO: 420795 - protein, 562 aa, Influenza virus; identical to SEQ ID NO: 419389
  MOD_RES (1)..(12): Any amino acid
  MOD_RES (101)..(103): Any amino acid
  MOD_RES (118)..(122): Any amino acid
  MOD_RES (136)..(154): Any amino acid
  MOD_RES (166)..(173): Any amino acid
  MOD_RES (199)..(203): Any amino acid
  MOD_RES (214)..(249): Any amino acid
  MOD_RES (286)..(286): Any amino acid
  MOD_RES (386)..(392): Any amino acid
  MOD_RES (403)..(404): Any amino acid

SEQ ID NO: 420796 - protein, 562 aa, Influenza virus; identical to SEQ ID NO: 419390
  MOD_RES (1)..(12): Any amino acid
  MOD_RES (101)..(103): Any amino acid
  MOD_RES (118)..(122): Any amino acid
  MOD_RES (136)..(154): Any amino acid
  MOD_RES (166)..(173): Any amino acid
  MOD_RES (199)..(203): Any amino acid
  MOD_RES (214)..(249): Any amino acid
  MOD_RES (286)..(286): Any amino acid
  MOD_RES (348)..(348): Any amino acid
  MOD_RES (386)..(392): Any amino acid
  MOD_RES (403)..(404): Any amino acid
  MOD_RES (530)..(533): Any amino acid

SEQ ID NO: 420797 - protein, 562 aa, Influenza virus; identical to SEQ ID NO: 419391
  MOD_RES (1)..(12): Any amino acid
  MOD_RES (101)..(103): Any amino acid
  MOD_RES (118)..(122): Any amino acid
  MOD_RES (136)..(154): Any amino acid
  MOD_RES (165)..(173): Any amino acid
  MOD_RES (199)..(203): Any amino acid
  MOD_RES (214)..(249): Any amino acid
  MOD_RES (286)..(286): Any amino acid
  MOD_RES (344)..(369): Any amino acid
  MOD_RES (386)..(392): Any amino acid
  MOD_RES (403)..(404): Any amino acid
  MOD_RES (437)..(439): Any amino acid
  MOD_RES (548)..(562): Any amino acid

SEQ ID NO: 420798 - protein, 562 aa, Influenza virus; identical to SEQ ID NO: 419392
  MOD_RES (1)..(12): Any amino acid
  MOD_RES (70)..(77): Any amino acid
  MOD_RES (101)..(103): Any amino acid
  MOD_RES (118)..(122): Any amino acid
  MOD_RES (136)..(173): Any amino acid
  MOD_RES (199)..(203): Any amino acid
  MOD_RES (214)..(249): Any amino acid
  MOD_RES (286)..(286): Any amino acid
  MOD_RES (299)..(303): Any amino acid
  MOD_RES (347)..(375): Any amino acid
  MOD_RES (386)..(392): Any amino acid
  MOD_RES (403)..(404): Any amino acid
  MOD_RES (440)..(441): Any amino acid
  MOD_RES (477)..(487): Any amino acid
  MOD_RES (533)..(537): Any amino acid
  MOD_RES (557)..(562): Any amino acid

SEQ ID NO: 420799 - protein, 562 aa, Influenza virus; identical to SEQ ID NO: 419393
  MOD_RES (1)..(20): Any amino acid
  MOD_RES (41)..(41): Any amino acid
  MOD_RES (61)..(77): Any amino acid
  MOD_RES (98)..(122): Any amino acid
  MOD_RES (136)..(173): Any amino acid
  MOD_RES (185)..(188): Any amino acid
  MOD_RES (199)..(249): Any amino acid
  MOD_RES (264)..(268): Any amino acid
  MOD_RES (286)..(286): Any amino acid
  MOD_RES (300)..(311): Any amino acid
  MOD_RES (346)..(375): Any amino acid
  MOD_RES (386)..(392): Any amino acid
  MOD_RES (403)..(404): Any amino acid
  MOD_RES (438)..(444): Any amino acid
  MOD_RES (470)..(487): Any amino acid
  MOD_RES (535)..(537): Any amino acid
  MOD_RES (557)..(562): Any amino acid

SEQ ID NO: 420800 - protein, 469 aa, Influenza virus; identical to SEQ ID NO: 419397
  MOD_RES (16)..(24): Any amino acid
  MOD_RES (44)..(51): Any amino acid
  MOD_RES (62)..(86): Any amino acid
  MOD_RES (210)..(212): Any amino acid
  MOD_RES (367)..(367): Any amino acid
  MOD_RES (386)..(399): Any amino acid

SEQ ID NO: 420801 - protein, 469 aa, Influenza virus; identical to SEQ ID NO: 419398
  MOD_RES (16)..(24): Any amino acid
  MOD_RES (44)..(51): Any amino acid
  MOD_RES (62)..(86): Any amino acid
  MOD_RES (210)..(212): Any amino acid
  MOD_RES (367)..(367): Any amino acid
  MOD_RES (386)..(399): Any amino acid

SEQ ID NO: 420802 - protein, 469 aa, Influenza virus; identical to SEQ ID NO: 419399
  MOD_RES (1)..(1): Any amino acid
  MOD_RES (16)..(24): Any amino acid
  MOD_RES (44)..(51): Any amino acid
  MOD_RES (62)..(86): Any amino acid
  MOD_RES (159)..(162): Any amino acid
  MOD_RES (182)..(182): Any amino acid
  MOD_RES (210)..(212): Any amino acid
  MOD_RES (319)..(319): Any amino acid
  MOD_RES (367)..(367): Any amino acid
  MOD_RES (386)..(399): Any amino acid
  MOD_RES (451)..(454): Any amino acid

SEQ ID NO: 420803 - protein, 469 aa, Influenza virus; identical to SEQ ID NO: 419400
  MOD_RES (1)..(2): Any amino acid
  MOD_RES (16)..(24): Any amino acid
  MOD_RES (43)..(51): Any amino acid
  MOD_RES (62)..(86): Any amino acid
  MOD_RES (99)..(103): Any amino acid
  MOD_RES (163)..(166): Any amino acid
  MOD_RES (182)..(184): Any amino acid
  MOD_RES (210)..(212): Any amino acid
  MOD_RES (332)..(332): Any amino acid
  MOD_RES (367)..(367): Any amino acid
  MOD_RES (379)..(399): Any amino acid
  MOD_RES (411)..(414): Any amino acid
  MOD_RES (450)..(455): Any amino acid
  MOD_RES (469)..(469): Any amino acid

SEQ ID NO: 420804 - protein, 469 aa, Influenza virus; identical to SEQ ID NO: 419401
  MOD_RES (1)..(2): Any amino acid
  MOD_RES (14)..(24): Any amino acid
  MOD_RES (44)..(87): Any amino acid
  MOD_RES (100)..(106): Any amino acid
  MOD_RES (126)..(126): Any amino acid
  MOD_RES (137)..(137): Any amino acid
  MOD_RES (159)..(166): Any amino acid
  MOD_RES (186)..(187): Any amino acid
  MOD_RES (208)..(213): Any amino acid
  MOD_RES (225)..(226): Any amino acid
  MOD_RES (245)..(249): Any amino acid
  MOD_RES (307)..(308): Any amino acid
  MOD_RES (367)..(370): Any amino acid
  MOD_RES (382)..(399): Any amino acid
  MOD_RES (410)..(414): Any amino acid
  MOD_RES (444)..(456): Any amino acid

SEQ ID NO: 420805 - protein, 580 aa, Influenza virus; identical to SEQ ID NO: 419405
  MOD_RES (15)..(29): Any amino acid
  MOD_RES (51)..(57): Any amino acid
  MOD_RES (72)..(86): Any amino acid
  MOD_RES (105)..(133): Any amino acid
  MOD_RES (147)..(200): Any amino acid
  MOD_RES (213)..(273): Any amino acid
  MOD_RES (287)..(291): Any amino acid
  MOD_RES (302)..(306): Any amino acid
  MOD_RES (332)..(340): Any amino acid
  MOD_RES (355)..(356): Any amino acid
  MOD_RES (408)..(414): Any amino acid
  MOD_RES (480)..(480): Any amino acid
  MOD_RES (506)..(539): Any amino acid
  MOD_RES (557)..(562): Any amino acid

SEQ ID NO: 420806 - protein, 580 aa, Influenza virus; identical to SEQ ID NO: 419406
  MOD_RES (1)..(3): Any amino acid
  MOD_RES (15)..(32): Any amino acid
  MOD_RES (49)..(57): Any amino acid
  MOD_RES (72)..(90): Any amino acid
  MOD_RES (105)..(133): Any amino acid
  MOD_RES (147)..(200): Any amino acid
  MOD_RES (213)..(273): Any amino acid
  MOD_RES (287)..(306): Any amino acid
  MOD_RES (332)..(341): Any amino acid
  MOD_RES (355)..(356): Any amino acid
  MOD_RES (408)..(414): Any amino acid
  MOD_RES (480)..(480): Any amino acid
  MOD_RES (506)..(539): Any amino acid
  MOD_RES (555)..(562): Any amino acid

SEQ ID NO: 420807 - protein, 580 aa, Influenza virus; identical to SEQ ID NO: 419407
  MOD_RES (1)..(10): Any amino acid
  MOD_RES (22)..(35): Any amino acid
  MOD_RES (51)..(57): Any amino acid
  MOD_RES (72)..(90): Any amino acid
  MOD_RES (105)..(133): Any amino acid
  MOD_RES (147)..(200): Any amino acid
  MOD_RES (213)..(273): Any amino acid
  MOD_RES (287)..(306): Any amino acid
  MOD_RES (332)..(344): Any amino acid
  MOD_RES (355)..(356): Any amino acid
  MOD_RES (408)..(414): Any amino acid
  MOD_RES (480)..(480): Any amino acid
  MOD_RES (494)..(494): Any amino acid
  MOD_RES (506)..(539): Any amino acid
  MOD_RES (557)..(562): Any amino acid
  MOD_RES (576)..(580): Any amino acid

SEQ ID NO: 420808 - protein, 580 aa, Influenza virus; identical to SEQ ID NO: 419408
  MOD_RES (1)..(10): Any amino acid
  MOD_RES (22)..(35): Any amino acid
  MOD_RES (51)..(57): Any amino acid
  MOD_RES (72)..(90): Any amino acid
  MOD_RES (102)..(133): Any amino acid
  MOD_RES (147)..(200): Any amino acid
  MOD_RES (211)..(273): Any amino acid
  MOD_RES (284)..(306): Any amino acid
  MOD_RES (324)..(344): Any amino acid
  MOD_RES (355)..(366): Any amino acid
  MOD_RES (386)..(386): Any amino acid
  MOD_RES (408)..(414): Any amino acid
  MOD_RES (426)..(438): Any amino acid
  MOD_RES (480)..(480): Any amino acid
  MOD_RES (506)..(539): Any amino acid
  MOD_RES (553)..(562): Any amino acid

SEQ ID NO: 420809 - protein, 580 aa, Influenza virus; identical to SEQ ID NO: 419409
  MOD_RES (1)..(10): Any amino acid
  MOD_RES (22)..(35): Any amino acid
  MOD_RES (48)..(57): Any amino acid
  MOD_RES (68)..(94): Any amino acid
  MOD_RES (105)..(135): Any amino acid
  MOD_RES (147)..(200): Any amino acid
  MOD_RES (212)..(307): Any amino acid
  MOD_RES (324)..(344): Any amino acid
  MOD_RES (355)..(373): Any amino acid
  MOD_RES (387)..(387): Any amino acid
  MOD_RES (407)..(414): Any amino acid
  MOD_RES (425)..(447): Any amino acid
  MOD_RES (458)..(459): Any amino acid
  MOD_RES (480)..(482): Any amino acid
  MOD_RES (493)..(494): Any amino acid
  MOD_RES (506)..(539): Any amino acid
  MOD_RES (557)..(562): Any amino acid
  MOD_RES (578)..(580): Any amino acid

SEQ ID NO: 420810 - protein, 574 aa, Influenza virus; identical to SEQ ID NO: 419415
  MOD_RES (12)..(23): Any amino acid
  MOD_RES (51)..(51): Any amino acid
  MOD_RES (66)..(82): Any amino acid
  MOD_RES (99)..(127): Any amino acid
  MOD_RES (142)..(194): Any amino acid
  MOD_RES (207)..(251): Any amino acid
  MOD_RES (263)..(267): Any amino acid
  MOD_RES (282)..(285): Any amino acid
  MOD_RES (296)..(300): Any amino acid
  MOD_RES (329)..(329): Any amino acid
  MOD_RES (402)..(408): Any amino acid
  MOD_RES (500)..(500): Any amino acid
  MOD_RES (514)..(514): Any amino acid
  MOD_RES (528)..(533): Any amino acid
  MOD_RES (553)..(555): Any amino acid

SEQ ID NO: 420811 - protein, 574 aa, Influenza virus; identical to SEQ ID NO: 419416
  MOD_RES (1)..(1): Any amino acid
  MOD_RES (12)..(26): Any amino acid
  MOD_RES (51)..(51): Any amino acid
  MOD_RES (66)..(84): Any amino acid
  MOD_RES (99)..(127): Any amino acid
  MOD_RES (142)..(194): Any amino acid
  MOD_RES (207)..(251): Any amino acid
  MOD_RES (263)..(267): Any amino acid
  MOD_RES (282)..(300): Any amino acid
  MOD_RES (329)..(329): Any amino acid
  MOD_RES (379)..(380): Any amino acid
  MOD_RES (402)..(408): Any amino acid
  MOD_RES (500)..(500): Any amino acid
  MOD_RES (514)..(514): Any amino acid
  MOD_RES (528)..(533): Any amino acid
  MOD_RES (549)..(555): Any amino acid

SEQ ID NO: 420812 - protein, 574 aa, Influenza virus; identical to SEQ ID NO: 419417
  MOD_RES (1)..(29): Any amino acid
  MOD_RES (51)..(51): Any amino acid
  MOD_RES (66)..(84): Any amino acid
  MOD_RES (98)..(127): Any amino acid
  MOD_RES (142)..(194): Any amino acid
  MOD_RES (205)..(251): Any amino acid
  MOD_RES (263)..(267): Any amino acid
  MOD_RES (282)..(300): Any amino acid
  MOD_RES (322)..(329): Any amino acid
  MOD_RES (358)..(359): Any amino acid
  MOD_RES (379)..(380): Any amino acid
  MOD_RES (402)..(408): Any amino acid
  MOD_RES (420)..(428): Any amino acid
  MOD_RES (474)..(474): Any amino acid
  MOD_RES (500)..(500): Any amino acid
  MOD_RES (514)..(514): Any amino acid
  MOD_RES (526)..(533): Any amino acid
  MOD_RES (553)..(555): Any amino acid

SEQ ID NO: 420813 - protein, 574 aa, Influenza virus; identical to SEQ ID NO: 419418
  MOD_RES (1)..(29): Any amino acid
  MOD_RES (51)..(51): Any amino acid
  MOD_RES (62)..(86): Any amino acid
  MOD_RES (98)..(127): Any amino acid
  MOD_RES (142)..(194): Any amino acid
  MOD_RES (207)..(251): Any amino acid
  MOD_RES (263)..(271): Any amino acid
  MOD_RES (282)..(300): Any amino acid
  MOD_RES (322)..(329): Any amino acid
  MOD_RES (358)..(360): Any amino acid
  MOD_RES (380)..(381): Any amino acid
  MOD_RES (401)..(408): Any amino acid
  MOD_RES (419)..(432): Any amino acid
  MOD_RES (476)..(476): Any amino acid
  MOD_RES (494)..(500): Any amino acid
  MOD_RES (512)..(514): Any amino acid
  MOD_RES (528)..(533): Any amino acid
  MOD_RES (553)..(555): Any amino acid
  MOD_RES (570)..(574): Any amino acid

SEQ ID NO: 420814 - protein, 574 aa, Influenza virus; identical to SEQ ID NO: 419419
  MOD_RES (1)..(29): Any amino acid
  MOD_RES (51)..(86): Any amino acid
  MOD_RES (98)..(194): Any amino acid
  MOD_RES (205)..(251): Any amino acid
  MOD_RES (263)..(271): Any amino acid
  MOD_RES (282)..(300): Any amino acid
  MOD_RES (329)..(329): Any amino acid
  MOD_RES (358)..(368): Any amino acid
  MOD_RES (381)..(389): Any amino acid
  MOD_RES (401)..(445): Any amino acid
  MOD_RES (471)..(482): Any amino acid
  MOD_RES (500)..(501): Any amino acid
  MOD_RES (514)..(515): Any amino acid
  MOD_RES (528)..(534): Any amino acid
  MOD_RES (547)..(555): Any amino acid
  MOD_RES (572)..(574): Any amino acid

SEQ ID NO: 420815 - protein, 486 aa, Influenza virus; identical to SEQ ID NO: 419427
  MOD_RES (16)..(79): Any amino acid
  MOD_RES (91)..(101): Any amino acid
  MOD_RES (134)..(134): Any amino acid
  MOD_RES (151)..(159): Any amino acid
  MOD_RES (205)..(207): Any amino acid
  MOD_RES (218)..(228): Any amino acid
  MOD_RES (257)..(263): Any amino acid
  MOD_RES (276)..(278): Any amino acid
  MOD_RES (318)..(324): Any amino acid
  MOD_RES (340)..(357): Any amino acid
  MOD_RES (378)..(381): Any amino acid
  MOD_RES (392)..(413): Any amino acid
  MOD_RES (442)..(445): Any amino acid

SEQ ID NO: 420816 - protein, 486 aa, Influenza virus; identical to SEQ ID NO: 419428
  MOD_RES (1)..(101): Any amino acid
  MOD_RES (131)..(134): Any amino acid
  MOD_RES (151)..(159): Any amino acid
  MOD_RES (190)..(190): Any amino acid
  MOD_RES (202)..(207): Any amino acid
  MOD_RES (218)..(228): Any amino acid
  MOD_RES (257)..(278): Any amino acid
  MOD_RES (318)..(324): Any amino acid
  MOD_RES (340)..(357): Any amino acid
  MOD_RES (378)..(381): Any amino acid
  MOD_RES (392)..(413): Any amino acid
  MOD_RES (442)..(445): Any amino acid
  MOD_RES (483)..(486): Any amino acid

SEQ ID NO: 420817 - protein, 486 aa, Influenza virus; identical to SEQ ID NO: 419429
  MOD_RES (1)..(111): Any amino acid
  MOD_RES (134)..(134): Any amino acid
  MOD_RES (151)..(159): Any amino acid
  MOD_RES (205)..(207): Any amino acid
  MOD_RES (218)..(228): Any amino acid
  MOD_RES (257)..(278): Any amino acid
  MOD_RES (318)..(324): Any amino acid
  MOD_RES (338)..(357): Any amino acid
  MOD_RES (378)..(381): Any amino acid
  MOD_RES (392)..(413): Any amino acid
  MOD_RES (437)..(445): Any amino acid
  MOD_RES (462)..(464): Any amino acid
  MOD_RES (475)..(486): Any amino acid

SEQ ID NO: 420818 - protein, 486 aa, Influenza virus; identical to SEQ ID NO: 419430
  MOD_RES (1)..(112): Any amino acid
  MOD_RES (134)..(134): Any amino acid
  MOD_RES (145)..(165): Any amino acid
  MOD_RES (186)..(207): Any amino acid
  MOD_RES (218)..(228): Any amino acid
  MOD_RES (257)..(278): Any amino acid
  MOD_RES (317)..(324): Any amino acid
  MOD_RES (338)..(357): Any amino acid
  MOD_RES (378)..(381): Any amino acid
  MOD_RES (392)..(413): Any amino acid
  MOD_RES (427)..(445): Any amino acid
  MOD_RES (456)..(464): Any amino acid
  MOD_RES (475)..(486): Any amino acid

SEQ ID NO: 420819 - protein, 486 aa, Influenza virus; identical to SEQ ID NO: 419431
  MOD_RES (1)..(118): Any amino acid
  MOD_RES (131)..(134): Any amino acid
  MOD_RES (145)..(170): Any amino acid
  MOD_RES (183)..(238): Any amino acid
  MOD_RES (252)..(278): Any amino acid
  MOD_RES (298)..(304): Any amino acid
  MOD_RES (318)..(357): Any amino acid
  MOD_RES (378)..(445): Any amino acid
  MOD_RES (456)..(471): Any amino acid
  MOD_RES (484)..(486): Any amino acid

SEQ ID NO: 420820 - protein, 571 aa, Influenza virus; identical to SEQ ID NO: 419434
  MOD_RES (1)..(18): Any amino acid
  MOD_RES (33)..(34): Any amino acid
  MOD_RES (45)..(46): Any amino acid
  MOD_RES (59)..(63): Any amino acid
  MOD_RES (74)..(76): Any amino acid
  MOD_RES (93)..(107): Any amino acid
  MOD_RES (139)..(141): Any amino acid
  MOD_RES (157)..(157): Any amino acid
  MOD_RES (168)..(174): Any amino acid
  MOD_RES (206)..(207): Any amino acid
  MOD_RES (222)..(233): Any amino acid
  MOD_RES (275)..(288): Any amino acid
  MOD_RES (299)..(317): Any amino acid
  MOD_RES (342)..(343): Any amino acid
  MOD_RES (505)..(505): Any amino acid
  MOD_RES (545)..(549): Any amino acid

SEQ ID NO: 420821 - protein, 571 aa, Influenza virus; identical to SEQ ID NO: 419435
  MOD_RES (1)..(18): Any amino acid
  MOD_RES (33)..(34): Any amino acid
  MOD_RES (45)..(46): Any amino acid
  MOD_RES (59)..(63): Any amino acid
  MOD_RES (74)..(76): Any amino acid
  MOD_RES (93)..(107): Any amino acid
  MOD_RES (139)..(141): Any amino acid
  MOD_RES (157)..(157): Any amino acid
  MOD_RES (168)..(174): Any amino acid
  MOD_RES (206)..(207): Any amino acid
  MOD_RES (222)..(233): Any amino acid
  MOD_RES (275)..(288): Any amino acid
  MOD_RES (299)..(317): Any amino acid
  MOD_RES (342)..(343): Any amino acid
  MOD_RES (354)..(363): Any amino acid
  MOD_RES (436)..(444): Any amino acid
  MOD_RES (505)..(505): Any amino acid
  MOD_RES (545)..(549): Any amino acid

SEQ ID NO: 420822 - protein, 571 aa, Influenza virus; identical to SEQ ID NO: 419436
  MOD_RES (1)..(18): Any amino acid
  MOD_RES (33)..(34): Any amino acid
  MOD_RES (45)..(46): Any amino acid
  MOD_RES (59)..(63): Any amino acid
  MOD_RES (74)..(76): Any amino acid
  MOD_RES (92)..(107): Any amino acid
  MOD_RES (139)..(141): Any amino acid
  MOD_RES (156)..(157): Any amino acid
  MOD_RES (168)..(174): Any amino acid
  MOD_RES (189)..(193): Any amino acid
  MOD_RES (206)..(207): Any amino acid
  MOD_RES (222)..(233): Any amino acid
  MOD_RES (275)..(288): Any amino acid
  MOD_RES (299)..(317): Any amino acid
  MOD_RES (340)..(381): Any amino acid
  MOD_RES (435)..(447): Any amino acid
  MOD_RES (505)..(505): Any amino acid

SEQ ID NO: 420823 - protein, 571 aa, Influenza virus; identical to SEQ ID NO: 419437
  MOD_RES (1)..(18): Any amino acid
  MOD_RES (29)..(34): Any amino acid
  MOD_RES (45)..(46): Any amino acid
  MOD_RES (57)..(63): Any amino acid
  MOD_RES (74)..(76): Any amino acid
  MOD_RES (92)..(107): Any amino acid
  MOD_RES (139)..(141): Any amino acid
  MOD_RES (157)..(157): Any amino acid
  MOD_RES (168)..(174): Any amino acid
  MOD_RES (195)..(207): Any amino acid
  MOD_RES (222)..(233): Any amino acid
  MOD_RES (268)..(288): Any amino acid
  MOD_RES (299)..(317): Any amino acid
  MOD_RES (332)..(382): Any amino acid
  MOD_RES (402)..(413): Any amino acid
  MOD_RES (443)..(448): Any amino acid
  MOD_RES (471)..(480): Any amino acid
  MOD_RES (505)..(505): Any amino acid
  MOD_RES (545)..(549): Any amino acid
  MOD_RES (568)..(571): Any amino acid

SEQ ID NO: 420824 - protein, 571 aa, Influenza virus; identical to SEQ ID NO: 419438
  MOD_RES (1)..(18): Any amino acid
  MOD_RES (29)..(34): Any amino acid
  MOD_RES (45)..(46): Any amino acid
  MOD_RES (59)..(63): Any amino acid
  MOD_RES (74)..(108): Any amino acid
  MOD_RES (119)..(127): Any amino acid
  MOD_RES (139)..(141): Any amino acid
  MOD_RES (152)..(177): Any amino acid
  MOD_RES (197)..(207): Any amino acid
  MOD_RES (222)..(233): Any amino acid
  MOD_RES (264)..(288): Any amino acid
  MOD_RES (299)..(317): Any amino acid
  MOD_RES (329)..(382): Any amino acid
  MOD_RES (399)..(413): Any amino acid
  MOD_RES (434)..(450): Any amino acid
  MOD_RES (476)..(487): Any amino acid
  MOD_RES (499)..(506): Any amino acid
  MOD_RES (569)..(571): Any amino acid

SEQ ID NO: 420825 - protein, 608 aa, Influenza virus; identical to SEQ ID NO: 419444
  MOD_RES (13)..(18): Any amino acid
  MOD_RES (29)..(35): Any amino acid
  MOD_RES (57)..(72): Any amino acid
  MOD_RES (92)..(93): Any amino acid
  MOD_RES (104)..(138): Any amino acid
  MOD_RES (149)..(163): Any amino acid
  MOD_RES (174)..(222): Any amino acid
  MOD_RES (235)..(266): Any amino acid
  MOD_RES (283)..(302): Any amino acid
  MOD_RES (339)..(352): Any amino acid
  MOD_RES (414)..(415): Any amino acid
  MOD_RES (431)..(456): Any amino acid
  MOD_RES (516)..(516): Any amino acid
  MOD_RES (527)..(552): Any amino acid
  MOD_RES (581)..(581): Any amino acid

SEQ ID NO: 420826 - protein, 608 aa, Influenza virus; identical to SEQ ID NO: 419445
  MOD_RES (13)..(18): Any amino acid
  MOD_RES (29)..(35): Any amino acid
  MOD_RES (51)..(72): Any amino acid
  MOD_RES (92)..(93): Any amino acid
  MOD_RES (104)..(163): Any amino acid
  MOD_RES (174)..(222): Any amino acid
  MOD_RES (235)..(266): Any amino acid
  MOD_RES (283)..(319): Any amino acid
  MOD_RES (339)..(358): Any amino acid
  MOD_RES (369)..(377): Any amino acid
  MOD_RES (414)..(415): Any amino acid
  MOD_RES (431)..(456): Any amino acid
  MOD_RES (469)..(469): Any amino acid
  MOD_RES (516)..(516): Any amino acid
  MOD_RES (527)..(552): Any amino acid
  MOD_RES (567)..(581): Any amino acid
  MOD_RES (608)..(608): Any amino acid

SEQ ID NO: 420827 - protein, 608 aa, Influenza virus; identical to SEQ ID NO: 419446
  MOD_RES (1)..(18): Any amino acid
  MOD_RES (29)..(35): Any amino acid
  MOD_RES (57)..(72): Any amino acid
  MOD_RES (92)..(93): Any amino acid
  MOD_RES (104)..(163): Any amino acid
  MOD_RES (174)..(222): Any amino acid
  MOD_RES (235)..(266): Any amino acid
  MOD_RES (283)..(319): Any amino acid
  MOD_RES (336)..(358): Any amino acid
  MOD_RES (369)..(383): Any amino acid
  MOD_RES (414)..(415): Any amino acid
  MOD_RES (431)..(456): Any amino acid
  MOD_RES (468)..(475): Any amino acid
  MOD_RES (503)..(504): Any amino acid
  MOD_RES (516)..(516): Any amino acid
  MOD_RES (527)..(552): Any amino acid
  MOD_RES (576)..(581): Any amino acid
  MOD_RES (596)..(597): Any amino acid
  MOD_RES (608)..(608): Any amino acid

SEQ ID NO: 420828 - protein, 608 aa, Influenza virus; identical to SEQ ID NO: 419447
  MOD_RES (1)..(18): Any amino acid
  MOD_RES (29)..(35): Any amino acid
  MOD_RES (56)..(72): Any amino acid
  MOD_RES (91)..(93): Any amino acid
  MOD_RES (104)..(222): Any amino acid
  MOD_RES (233)..(266): Any amino acid
  MOD_RES (283)..(319): Any amino acid
  MOD_RES (339)..(358): Any amino acid
  MOD_RES (369)..(386): Any amino acid
  MOD_RES (411)..(415): Any amino acid
  MOD_RES (431)..(456): Any amino acid
  MOD_RES (469)..(479): Any amino acid
  MOD_RES (516)..(516): Any amino acid
  MOD_RES (527)..(553): Any amino acid
  MOD_RES (567)..(581): Any amino acid
  MOD_RES (608)..(608): Any amino acid

SEQ ID NO: 420829 - protein, 608 aa, Influenza virus; identical to SEQ ID NO: 419448
  MOD_RES (1)..(18): Any amino acid
  MOD_RES (29)..(35): Any amino acid
  MOD_RES (57)..(72): Any amino acid
  MOD_RES (92)..(222): Any amino acid
  MOD_RES (235)..(272): Any amino acid
  MOD_RES (283)..(319): Any amino acid
  MOD_RES (338)..(358): Any amino acid
  MOD_RES (369)..(386): Any amino acid
  MOD_RES (414)..(420): Any amino acid
  MOD_RES (431)..(456): Any amino acid
  MOD_RES (469)..(480): Any amino acid
  MOD_RES (503)..(516): Any amino acid
  MOD_RES (527)..(553): Any amino acid
  MOD_RES (567)..(581): Any amino acid
  MOD_RES (599)..(608): Any amino acid

SEQ ID NO: 420830 - protein, 599 aa, Influenza virus; identical to SEQ ID NO: 419455
  MOD_RES (13)..(18): Any amino acid
  MOD_RES (57)..(66): Any amino acid
  MOD_RES (92)..(92): Any amino acid
  MOD_RES (104)..(115): Any amino acid
  MOD_RES (130)..(135): Any amino acid
  MOD_RES (146)..(217): Any amino acid
  MOD_RES (232)..(260): Any amino acid
  MOD_RES (285)..(298): Any amino acid
  MOD_RES (346)..(348): Any amino acid
  MOD_RES (432)..(432): Any amino acid
  MOD_RES (507)..(507): Any amino acid
  MOD_RES (518)..(541): Any amino acid
  MOD_RES (599)..(599): Any amino acid

SEQ ID NO: 420831 - protein, 599 aa, Influenza virus; identical to SEQ ID NO: 419456
  MOD_RES (13)..(18): Any amino acid
  MOD_RES (57)..(66): Any amino acid
  MOD_RES (92)..(92): Any amino acid
  MOD_RES (104)..(115): Any amino acid
  MOD_RES (130)..(217): Any amino acid
  MOD_RES (232)..(260): Any amino acid
  MOD_RES (285)..(300): Any amino acid
  MOD_RES (333)..(335): Any amino acid
  MOD_RES (346)..(355): Any amino acid
  MOD_RES (426)..(432): Any amino acid
  MOD_RES (451)..(466): Any amino acid
  MOD_RES (507)..(507): Any amino acid
  MOD_RES (518)..(541): Any amino acid
  MOD_RES (562)..(571): Any amino acid

SEQ ID NO: 420832 - protein, 599 aa, Influenza virus; identical to SEQ ID NO: 419457
  MOD_RES (1)..(18): Any amino acid
  MOD_RES (56)..(66): Any amino acid
  MOD_RES (79)..(80): Any amino acid
  MOD_RES (92)..(92): Any amino acid
  MOD_RES (103)..(115): Any amino acid
  MOD_RES (130)..(217): Any amino acid
  MOD_RES (232)..(260): Any amino acid
  MOD_RES (285)..(300): Any amino acid
  MOD_RES (346)..(355): Any amino acid
  MOD_RES (432)..(432): Any amino acid
  MOD_RES (452)..(470): Any amino acid
  MOD_RES (490)..(495): Any amino acid
  MOD_RES (507)..(507): Any amino acid
  MOD_RES (518)..(541): Any amino acid
  MOD_RES (562)..(571): Any amino acid
  MOD_RES (599)..(599): Any amino acid

SEQ ID NO: 420833 - protein, 599 aa, Influenza virus; identical to SEQ ID NO: 419458
  MOD_RES (1)..(18): Any amino acid
  MOD_RES (57)..(66): Any amino acid
  MOD_RES (79)..(92): Any amino acid
  MOD_RES (103)..(115): Any amino acid
  MOD_RES (127)..(217): Any amino acid
  MOD_RES (230)..(260): Any amino acid
  MOD_RES (279)..(300): Any amino acid
  MOD_RES (321)..(325): Any amino acid
  MOD_RES (346)..(357): Any amino acid
  MOD_RES (374)..(377): Any amino acid
  MOD_RES (432)..(432): Any amino acid
  MOD_RES (452)..(471): Any amino acid
  MOD_RES (491)..(496): Any amino acid
  MOD_RES (507)..(507): Any amino acid
  MOD_RES (518)..(541): Any amino acid
  MOD_RES (571)..(571): Any amino acid
  MOD_RES (599)..(599): Any amino acid

SEQ ID NO: 420834 - protein, 599 aa, Influenza virus; identical to SEQ ID NO: 419459
  MOD_RES (1)..(21): Any amino acid
  MOD_RES (53)..(66): Any amino acid
  MOD_RES (78)..(115): Any amino acid
  MOD_RES (127)..(217): Any amino acid
  MOD_RES (232)..(260): Any amino acid
  MOD_RES (285)..(300): Any amino acid
  MOD_RES (336)..(357): Any amino acid
  MOD_RES (368)..(379): Any amino acid
  MOD_RES (430)..(434): Any amino acid
  MOD_RES (447)..(507): Any amino acid
  MOD_RES (518)..(549): Any amino acid
  MOD_RES (562)..(571): Any amino acid
  MOD_RES (590)..(599): Any amino acid

SEQ ID NO: 420835 - protein, 500 aa, Influenza virus; identical to SEQ ID NO: 419465
  MOD_RES (31)..(41): Any amino acid
  MOD_RES (55)..(74): Any amino acid
  MOD_RES (86)..(118): Any amino acid
  MOD_RES (182)..(182): Any amino acid
  MOD_RES (239)..(240): Any amino acid
  MOD_RES (267)..(271): Any amino acid
  MOD_RES (290)..(292): Any amino acid
  MOD_RES (310)..(310): Any amino acid
  MOD_RES (330)..(335): Any amino acid
  MOD_RES (354)..(366): Any amino acid
  MOD_RES (388)..(388): Any amino acid
  MOD_RES (403)..(417): Any amino acid
  MOD_RES (456)..(457): Any amino acid
  MOD_RES (472)..(472): Any amino acid

SEQ ID NO: 420836 - protein, 500 aa, Influenza virus; identical to SEQ ID NO: 419466
  MOD_RES (1)..(1): Any amino acid
  MOD_RES (31)..(51): Any amino acid
  MOD_RES (62)..(74): Any amino acid
  MOD_RES (86)..(118): Any amino acid
  MOD_RES (182)..(182): Any amino acid
  MOD_RES (239)..(240): Any amino acid
  MOD_RES (267)..(279): Any amino acid
  MOD_RES (290)..(292): Any amino acid
  MOD_RES (310)..(310): Any amino acid
  MOD_RES (330)..(335): Any amino acid
  MOD_RES (354)..(366): Any amino acid
  MOD_RES (388)..(388): Any amino acid
  MOD_RES (403)..(417): Any amino acid
  MOD_RES (456)..(457): Any amino acid
  MOD_RES (472)..(484): Any amino acid

SEQ ID NO: 420837 - protein, 500 aa, Influenza virus; identical to SEQ ID NO: 419467
  MOD_RES (1)..(1): Any amino acid
  MOD_RES (21)..(74): Any amino acid
  MOD_RES (86)..(118): Any amino acid
  MOD_RES (156)..(156): Any amino acid
  MOD_RES (182)..(182): Any amino acid
  MOD_RES (195)..(197): Any amino acid
  MOD_RES (239)..(240): Any amino acid
  MOD_RES (267)..(292): Any amino acid
  MOD_RES (310)..(310): Any amino acid
  MOD_RES (330)..(335): Any amino acid
  MOD_RES (354)..(366): Any amino acid
  MOD_RES (388)..(388): Any amino acid
  MOD_RES (401)..(417): Any amino acid
  MOD_RES (456)..(457): Any amino acid
  MOD_RES (472)..(485): Any amino acid
  MOD_RES (496)..(500): Any amino acid

SEQ ID NO: 420838 - protein, 500 aa, Influenza virus; identical to SEQ ID NO: 419468
  MOD_RES (1)..(5): Any amino acid
  MOD_RES (30)..(74): Any amino acid
  MOD_RES (85)..(118): Any amino acid
  MOD_RES (182)..(182): Any amino acid
  MOD_RES (194)..(198): Any amino acid
  MOD_RES (239)..(240): Any amino acid
  MOD_RES (251)..(254): Any amino acid
  MOD_RES (266)..(298): Any amino acid
  MOD_RES (310)..(310): Any amino acid
  MOD_RES (330)..(335): Any amino acid
  MOD_RES (346)..(366): Any amino acid
  MOD_RES (388)..(390): Any amino acid
  MOD_RES (403)..(417): Any amino acid
  MOD_RES (456)..(457): Any amino acid
  MOD_RES (472)..(485): Any amino acid
  MOD_RES (496)..(500): Any amino acid

SEQ ID NO: 420839 - protein, 500 aa, Influenza virus; identical to SEQ ID NO: 419469
  MOD_RES (1)..(9): Any amino acid
  MOD_RES (30)..(75): Any amino acid
  MOD_RES (86)..(118): Any amino acid
  MOD_RES (179)..(198): Any amino acid
  MOD_RES (236)..(240): Any amino acid
  MOD_RES (252)..(255): Any amino acid
  MOD_RES (266)..(299): Any amino acid
  MOD_RES (310)..(335): Any amino acid
  MOD_RES (354)..(366): Any amino acid
  MOD_RES (377)..(377): Any amino acid
  MOD_RES (388)..(417): Any amino acid
  MOD_RES (428)..(428): Any amino acid
  MOD_RES (456)..(457): Any amino acid
  MOD_RES (468)..(485): Any amino acid
  MOD_RES (496)..(500): Any amino acid

SEQ ID NO: 420840 - protein, 573 aa, Influenza virus; identical to SEQ ID NO: 419472
  MOD_RES (1)..(16): Any amino acid
  MOD_RES (47)..(73): Any amino acid
  MOD_RES (84)..(88): Any amino acid
  MOD_RES (102)..(152): Any amino acid
  MOD_RES (171)..(229): Any amino acid
  MOD_RES (240)..(257): Any amino acid
  MOD_RES (274)..(287): Any amino acid
  MOD_RES (299)..(339): Any amino acid
  MOD_RES (380)..(381): Any amino acid
  MOD_RES (401)..(441): Any amino acid
  MOD_RES (478)..(478): Any amino acid
  MOD_RES (497)..(497): Any amino acid
  MOD_RES (511)..(536): Any amino acid
  MOD_RES (549)..(549): Any amino acid

SEQ ID NO: 420841 - protein, 573 aa, Influenza virus; identical to SEQ ID NO: 419473
  MOD_RES (1)..(16): Any amino acid
  MOD_RES (44)..(73): Any amino acid
  MOD_RES (84)..(88): Any amino acid
  MOD_RES (102)..(152): Any amino acid
  MOD_RES (170)..(229): Any amino acid
  MOD_RES (240)..(257): Any amino acid
  MOD_RES (274)..(287): Any amino acid
  MOD_RES (299)..(344): Any amino acid
  MOD_RES (380)..(381): Any amino acid
  MOD_RES (401)..(441): Any amino acid
  MOD_RES (478)..(478): Any amino acid
  MOD_RES (497)..(497): Any amino acid
  MOD_RES (511)..(536): Any amino acid
  MOD_RES (549)..(549): Any amino acid

SEQ ID NO: 420842 - protein, 573 aa, Influenza virus; identical to SEQ ID NO: 419474
  MOD_RES (1)..(16): Any amino acid
  MOD_RES (47)..(73): Any amino acid
  MOD_RES (84)..(88): Any amino acid
  MOD_RES (102)..(157): Any amino acid
  MOD_RES (171)..(229): Any amino acid
  MOD_RES (240)..(262): Any amino acid
  MOD_RES (274)..(287): Any amino acid
  MOD_RES (299)..(344): Any amino acid
  MOD_RES (356)..(359): Any amino acid
  MOD_RES (379)..(381): Any amino acid
  MOD_RES (401)..(441): Any amino acid
  MOD_RES (478)..(478): Any amino acid
  MOD_RES (497)..(497): Any amino acid
  MOD_RES (511)..(536): Any amino acid
  MOD_RES (549)..(549): Any amino acid

SEQ ID NO: 420843 - protein, 573 aa, Influenza virus; identical to SEQ ID NO: 419475
  MOD_RES (1)..(16): Any amino acid
  MOD_RES (47)..(73): Any amino acid
  MOD_RES (84)..(90): Any amino acid
  MOD_RES (102)..(157): Any amino acid
  MOD_RES (171)..(229): Any amino acid
  MOD_RES (240)..(287): Any amino acid
  MOD_RES (299)..(348): Any amino acid
  MOD_RES (360)..(368): Any amino acid
  MOD_RES (380)..(381): Any amino acid
  MOD_RES (401)..(443): Any amino acid
  MOD_RES (478)..(478): Any amino acid
  MOD_RES (489)..(497): Any amino acid
  MOD_RES (511)..(536): Any amino acid
  MOD_RES (549)..(549): Any amino acid
  MOD_RES (568)..(573): Any amino acid

SEQ ID NO: 420844 - protein, 573 aa, Influenza virus; identical to SEQ ID NO: 419476
  MOD_RES (1)..(20): Any amino acid
  MOD_RES (47)..(90): Any amino acid
  MOD_RES (102)..(158): Any amino acid
  MOD_RES (171)..(229): Any amino acid
  MOD_RES (240)..(348): Any amino acid
  MOD_RES (359)..(368): Any amino acid
  MOD_RES (380)..(381): Any amino acid
  MOD_RES (401)..(445): Any amino acid
  MOD_RES (463)..(467): Any amino acid
  MOD_RES (478)..(479): Any amino acid
  MOD_RES (494)..(497): Any amino acid
  MOD_RES (509)..(536): Any amino acid
  MOD_RES (549)..(549): Any amino acid
  MOD_RES (568)..(573): Any amino acid

SEQ ID NO: 420845 - protein, 471 aa, Influenza virus; identical to SEQ ID NO: 419481
  MOD_RES (1)..(88): Any amino acid
  MOD_RES (113)..(113): Any amino acid
  MOD_RES (126)..(127): Any amino acid
  MOD_RES (142)..(142): Any amino acid
  MOD_RES (199)..(216): Any amino acid
  MOD_RES (235)..(236): Any amino acid
  MOD_RES (249)..(269): Any amino acid
  MOD_RES (283)..(283): Any amino acid
  MOD_RES (314)..(315): Any amino acid
  MOD_RES (334)..(334): Any amino acid
  MOD_RES (358)..(368): Any amino acid
  MOD_RES (383)..(403): Any amino acid
  MOD_RES (416)..(417): Any amino acid
  MOD_RES (436)..(436): Any amino acid
  MOD_RES (471)..(471): Any amino acid

SEQ ID NO: 420846 - protein, 471 aa, Influenza virus; identical to SEQ ID NO: 419482
  MOD_RES (1)..(88): Any amino acid
  MOD_RES (113)..(113): Any amino acid
  MOD_RES (126)..(127): Any amino acid
  MOD_RES (142)..(142): Any amino acid
  MOD_RES (199)..(216): Any amino acid
  MOD_RES (235)..(236): Any amino acid
  MOD_RES (249)..(269): Any amino acid
  MOD_RES (283)..(283): Any amino acid
  MOD_RES (304)..(315): Any amino acid
  MOD_RES (334)..(334): Any amino acid
  MOD_RES (358)..(368): Any amino acid
  MOD_RES (383)..(403): Any amino acid
  MOD_RES (416)..(417): Any amino acid
  MOD_RES (435)..(436): Any amino acid
  MOD_RES (451)..(455): Any amino acid
  MOD_RES (471)..(471): Any amino acid

SEQ ID NO: 420847 - protein, 471 aa, Influenza virus; identical to SEQ ID NO: 419483
  MOD_RES (1)..(88): Any amino acid
  MOD_RES (111)..(115): Any amino acid
  MOD_RES (126)..(131): Any amino acid
  MOD_RES (142)..(142): Any amino acid
  MOD_RES (199)..(216): Any amino acid
  MOD_RES (235)..(236): Any amino acid
  MOD_RES (249)..(269): Any amino acid
  MOD_RES (280)..(287): Any amino acid
  MOD_RES (304)..(315): Any amino acid
  MOD_RES (334)..(334): Any amino acid
  MOD_RES (358)..(368): Any amino acid
  MOD_RES (381)..(403): Any amino acid
  MOD_RES (415)..(417): Any amino acid
  MOD_RES (436)..(436): Any amino acid
  MOD_RES (452)..(458): Any amino acid
  MOD_RES (471)..(471): Any amino acid

SEQ ID NO: 420848 - protein, 471 aa, Influenza virus; identical to SEQ ID NO: 419484
  MOD_RES (1)..(88): Any amino acid
  MOD_RES (101)..(115): Any amino acid
  MOD_RES (126)..(143): Any amino acid
  MOD_RES (198)..(216): Any amino acid
  MOD_RES (229)..(236): Any amino acid
  MOD_RES (249)..(270): Any amino acid
  MOD_RES (281)..(287): Any amino acid
  MOD_RES (301)..(315): Any amino acid
  MOD_RES (334)..(334): Any amino acid
  MOD_RES (346)..(346): Any amino acid
  MOD_RES (358)..(368): Any amino acid
  MOD_RES (383)..(404): Any amino acid
  MOD_RES (416)..(417): Any amino acid
  MOD_RES (436)..(437): Any amino acid
  MOD_RES (457)..(460): Any amino acid
  MOD_RES (471)..(471): Any amino acid

SEQ ID NO: 420849 - protein, 471 aa, Influenza virus; identical to SEQ ID NO: 419485
  MOD_RES (1)..(88): Any amino acid
  MOD_RES (101)..(153): Any amino acid
  MOD_RES (164)..(166): Any amino acid
  MOD_RES (194)..(217): Any amino acid
  MOD_RES (228)..(238): Any amino acid
  MOD_RES (249)..(287): Any amino acid
  MOD_RES (304)..(334): Any amino acid
  MOD_RES (357)..(372): Any amino acid
  MOD_RES (383)..(417): Any amino acid
  MOD_RES (428)..(460): Any amino acid
  MOD_RES (471)..(471): Any amino acid

SEQ ID NO: 420850 - protein, 570 aa, Influenza virus; identical to SEQ ID NO: 419488
  MOD_RES (1)..(14): Any amino acid
  MOD_RES (52)..(73): Any amino acid
  MOD_RES (85)..(157): Any amino acid
  MOD_RES (168)..(189): Any amino acid
  MOD_RES (200)..(247): Any amino acid
  MOD_RES (274)..(277): Any amino acid
  MOD_RES (288)..(306): Any amino acid
  MOD_RES (321)..(329): Any amino acid
  MOD_RES (343)..(344): Any amino acid
  MOD_RES (391)..(413): Any amino acid
  MOD_RES (424)..(431): Any amino acid
  MOD_RES (463)..(471): Any amino acid
  MOD_RES (495)..(498): Any amino acid
  MOD_RES (510)..(527): Any amino acid
  MOD_RES (550)..(554): Any amino acid

SEQ ID NO: 420851 - protein, 570 aa, Influenza virus; identical to SEQ ID NO: 419489
  MOD_RES (1)..(14): Any amino acid
  MOD_RES (52)..(73): Any amino acid
  MOD_RES (85)..(157): Any amino acid
  MOD_RES (168)..(189): Any amino acid
  MOD_RES (200)..(247): Any amino acid
  MOD_RES (274)..(306): Any amino acid
  MOD_RES (321)..(329): Any amino acid
  MOD_RES (343)..(344): Any amino acid
  MOD_RES (373)..(374): Any amino acid
  MOD_RES (391)..(413): Any amino acid
  MOD_RES (424)..(431): Any amino acid
  MOD_RES (463)..(471): Any amino acid
  MOD_RES (495)..(498): Any amino acid
  MOD_RES (510)..(527): Any amino acid
  MOD_RES (550)..(554): Any amino acid
  MOD_RES (569)..(570): Any amino acid

SEQ ID NO: 420852 - protein, 570 aa, Influenza virus; identical to SEQ ID NO: 419490
  MOD_RES (1)..(14): Any amino acid
  MOD_RES (52)..(73): Any amino acid
  MOD_RES (84)..(157): Any amino acid
  MOD_RES (168)..(189): Any amino acid
  MOD_RES (200)..(247): Any amino acid
  MOD_RES (274)..(306): Any amino acid
  MOD_RES (321)..(329): Any amino acid
  MOD_RES (343)..(344): Any amino acid
  MOD_RES (374)..(379): Any amino acid
  MOD_RES (391)..(413): Any amino acid
  MOD_RES (424)..(431): Any amino acid
  MOD_RES (463)..(471): Any amino acid
  MOD_RES (495)..(498): Any amino acid
  MOD_RES (510)..(527): Any amino acid
  MOD_RES (550)..(554): Any amino acid
  MOD_RES (569)..(570): Any amino acid

SEQ ID NO: 420853 - protein, 570 aa, Influenza virus; identical to SEQ ID NO: 419491
  MOD_RES (1)..(14): Any amino acid
  MOD_RES (52)..(73): Any amino acid
  MOD_RES (85)..(157): Any amino acid
  MOD_RES (168)..(247): Any amino acid
  MOD_RES (274)..(306): Any amino acid
  MOD_RES (317)..(330): Any amino acid
  MOD_RES (342)..(344): Any amino acid
  MOD_RES (355)..(379): Any amino acid
  MOD_RES (391)..(413): Any amino acid
  MOD_RES (424)..(431): Any amino acid
  MOD_RES (461)..(471): Any amino acid
  MOD_RES (483)..(483): Any amino acid
  MOD_RES (495)..(498): Any amino acid
  MOD_RES (510)..(527): Any amino acid
  MOD_RES (550)..(555): Any amino acid
  MOD_RES (569)..(570): Any amino acid

SEQ ID NO: 420854 - protein, 570 aa, Influenza virus; identical to SEQ ID NO: 419492
  MOD_RES (1)..(25): Any amino acid
  MOD_RES (52)..(73): Any amino acid
  MOD_RES (85)..(157): Any amino acid
  MOD_RES (168)..(247): Any amino acid
  MOD_RES (258)..(263): Any amino acid
  MOD_RES (274)..(307): Any amino acid
  MOD_RES (321)..(413): Any amino acid
  MOD_RES (424)..(431): Any amino acid
  MOD_RES (444)..(448): Any amino acid
  MOD_RES (463)..(471): Any amino acid
  MOD_RES (488)..(498): Any amino acid
  MOD_RES (509)..(536): Any amino acid
  MOD_RES (549)..(555): Any amino acid
  MOD_RES (569)..(570): Any amino acid

SEQ ID NO: 420855 - protein, 619 aa, Influenza virus; identical to SEQ ID NO: 419495
  MOD_RES (14)..(23): Any amino acid
  MOD_RES (42)..(48): Any amino acid
  MOD_RES (67)..(93): Any amino acid
  MOD_RES (105)..(170): Any amino acid
  MOD_RES (185)..(253): Any amino acid
  MOD_RES (264)..(273): Any amino acid
  MOD_RES (289)..(341): Any amino acid
  MOD_RES (355)..(356): Any amino acid
  MOD_RES (388)..(393): Any amino acid
  MOD_RES (449)..(465): Any amino acid
  MOD_RES (480)..(483): Any amino acid
  MOD_RES (539)..(539): Any amino acid
  MOD_RES (552)..(571): Any amino acid
  MOD_RES (591)..(602): Any amino acid
  MOD_RES (614)..(619): Any amino acid

SEQ ID NO: 420856 - protein, 619 aa, Influenza virus; identical to SEQ ID NO: 419496
  MOD_RES (14)..(30): Any amino acid
  MOD_RES (41)..(48): Any amino acid
  MOD_RES (67)..(93): Any amino acid
  MOD_RES (105)..(171): Any amino acid
  MOD_RES (185)..(253): Any amino acid
  MOD_RES (264)..(273): Any amino acid
  MOD_RES (289)..(341): Any amino acid
  MOD_RES (355)..(356): Any amino acid
  MOD_RES (387)..(400): Any amino acid
  MOD_RES (449)..(465): Any amino acid
  MOD_RES (480)..(483): Any amino acid
  MOD_RES (539)..(539): Any amino acid
  MOD_RES (552)..(571): Any amino acid
  MOD_RES (591)..(602): Any amino acid
  MOD_RES (614)..(619): Any amino acid

SEQ ID NO: 420857 - protein, 619 aa, Influenza virus; identical to SEQ ID NO: 419497
  MOD_RES (14)..(48): Any amino acid
  MOD_RES (67)..(93): Any amino acid
  MOD_RES (105)..(171): Any amino acid
  MOD_RES (185)..(253): Any amino acid
  MOD_RES (264)..(273): Any amino acid
  MOD_RES (289)..(341): Any amino acid
  MOD_RES (354)..(356): Any amino acid
  MOD_RES (367)..(375): Any amino acid
  MOD_RES (387)..(401): Any amino acid
  MOD_RES (448)..(465): Any amino acid
  MOD_RES (480)..(483): Any amino acid
  MOD_RES (504)..(504): Any amino acid
  MOD_RES (536)..(539): Any amino acid
  MOD_RES (552)..(571): Any amino acid
  MOD_RES (591)..(602): Any amino acid
  MOD_RES (613)..(619): Any amino acid

SEQ ID NO: 420858 - protein, 619 aa, Influenza virus; identical to SEQ ID NO: 419498
  MOD_RES (14)..(48): Any amino acid
  MOD_RES (67)..(93): Any amino acid
  MOD_RES (105)..(253): Any amino acid
  MOD_RES (264)..(273): Any amino acid
  MOD_RES (289)..(342): Any amino acid
  MOD_RES (355)..(375): Any amino acid
  MOD_RES (396)..(406): Any amino acid
  MOD_RES (426)..(430): Any amino acid
  MOD_RES (449)..(465): Any amino acid
  MOD_RES (479)..(487): Any amino acid
  MOD_RES (508)..(513): Any amino acid
  MOD_RES (525)..(528): Any amino acid
  MOD_RES (539)..(540): Any amino acid
  MOD_RES (552)..(571): Any amino acid
  MOD_RES (591)..(604): Any amino acid
  MOD_RES (616)..(619): Any amino acid

SEQ ID NO: 420859 - protein, 619 aa, Influenza virus; identical to SEQ ID NO: 419499
  MOD_RES (1)..(1): Any amino acid
  MOD_RES (14)..(48): Any amino acid
  MOD_RES (67)..(253): Any amino acid
  MOD_RES (264)..(277): Any amino acid
  MOD_RES (289)..(342): Any amino acid
  MOD_RES (353)..(377): Any amino acid
  MOD_RES (388)..(407): Any amino acid
  MOD_RES (427)..(433): Any amino acid
  MOD_RES (449)..(465): Any amino acid
  MOD_RES (477)..(487): Any amino acid
  MOD_RES (527)..(540): Any amino acid
  MOD_RES (552)..(571): Any amino acid
  MOD_RES (591)..(608): Any amino acid

SEQ ID NO: 420860 - protein, 573 aa, Influenza virus; identical to SEQ ID NO: 419503
  MOD_RES (17)..(22): Any amino acid
  MOD_RES (62)..(74): Any amino acid
  MOD_RES (98)..(98): Any amino acid
  MOD_RES (111)..(111): Any amino acid
  MOD_RES (134)..(138): Any amino acid
  MOD_RES (151)..(155): Any amino acid
  MOD_RES (175)..(191): Any amino acid
  MOD_RES (202)..(205): Any amino acid
  MOD_RES (219)..(232): Any amino acid
  MOD_RES (246)..(255): Any amino acid
  MOD_RES (279)..(300): Any amino acid
  MOD_RES (316)..(316): Any amino acid
  MOD_RES (568)..(573): Any amino acid

SEQ ID NO: 420861 - protein, 573 aa, Influenza virus; identical to SEQ ID NO: 419504
  MOD_RES (1)..(22): Any amino acid
  MOD_RES (62)..(74): Any amino acid
  MOD_RES (96)..(98): Any amino acid
  MOD_RES (111)..(111): Any amino acid
  MOD_RES (134)..(138): Any amino acid
  MOD_RES (151)..(155): Any amino acid
  MOD_RES (175)..(191): Any amino acid
  MOD_RES (202)..(205): Any amino acid
  MOD_RES (219)..(232): Any amino acid
  MOD_RES (254)..(255): Any amino acid
  MOD_RES (279)..(300): Any amino acid
  MOD_RES (316)..(316): Any amino acid
  MOD_RES (385)..(393): Any amino acid
  MOD_RES (462)..(462): Any amino acid
  MOD_RES (479)..(482): Any amino acid
  MOD_RES (568)..(573): Any amino acid

SEQ ID NO: 420862 - protein, 573 aa, Influenza virus; identical to SEQ ID NO: 419505
  MOD_RES (1)..(22): Any amino acid
  MOD_RES (62)..(74): Any amino acid
  MOD_RES (98)..(98): Any amino acid
  MOD_RES (111)..(111): Any amino acid
  MOD_RES (134)..(138): Any amino acid
  MOD_RES (151)..(155): Any amino acid
  MOD_RES (168)..(191): Any amino acid
  MOD_RES (202)..(205): Any amino acid
  MOD_RES (219)..(232): Any amino acid
  MOD_RES (245)..(255): Any amino acid
  MOD_RES (279)..(300): Any amino acid
  MOD_RES (316)..(316): Any amino acid
  MOD_RES (355)..(355): Any amino acid
  MOD_RES (374)..(393): Any amino acid
  MOD_RES (480)..(483): Any amino acid
  MOD_RES (536)..(537): Any amino acid
  MOD_RES (566)..(573): Any amino acid

SEQ ID NO: 420863 - protein, 573 aa, Influenza virus; identical to SEQ ID NO: 419506
  MOD_RES (1)..(22): Any amino acid
  MOD_RES (33)..(39): Any amino acid
  MOD_RES (51)..(51): Any amino acid
  MOD_RES (62)..(78): Any amino acid
  MOD_RES (98)..(99): Any amino acid
  MOD_RES (111)..(111): Any amino acid
  MOD_RES (134)..(138): Any amino acid
  MOD_RES (149)..(155): Any amino acid
  MOD_RES (175)..(191): Any amino acid
  MOD_RES (202)..(208): Any amino acid
  MOD_RES (219)..(232): Any amino acid
  MOD_RES (246)..(255): Any amino acid
  MOD_RES (279)..(300): Any amino acid
  MOD_RES (315)..(316): Any amino acid
  MOD_RES (341)..(342): Any amino acid
  MOD_RES (355)..(393): Any amino acid
  MOD_RES (424)..(424): Any amino acid
  MOD_RES (444)..(447): Any amino acid
  MOD_RES (470)..(483): Any amino acid
  MOD_RES (531)..(538): Any amino acid
  MOD_RES (566)..(573): Any amino acid

SEQ ID NO: 420864 - protein, 573 aa, Influenza virus; identical to SEQ ID NO: 419507
  MOD_RES (1)..(22): Any amino acid
  MOD_RES (34)..(78): Any amino acid
  MOD_RES (90)..(99): Any amino acid
  MOD_RES (111)..(111): Any amino acid
  MOD_RES (129)..(140): Any amino acid
  MOD_RES (151)..(155): Any amino acid
  MOD_RES (175)..(191): Any amino acid
  MOD_RES (202)..(208): Any amino acid
  MOD_RES (219)..(232): Any amino acid
  MOD_RES (246)..(261): Any amino acid
  MOD_RES (272)..(300): Any amino acid
  MOD_RES (316)..(316): Any amino acid
  MOD_RES (345)..(397): Any amino acid
  MOD_RES (419)..(427): Any amino acid
  MOD_RES (441)..(453): Any amino acid
  MOD_RES (479)..(497): Any amino acid
  MOD_RES (521)..(538): Any amino acid

SEQ ID NO: 420865 - protein, 469 aa, Influenza virus; identical to SEQ ID NO: 419512
  MOD_RES (20)..(58): Any amino acid
  MOD_RES (72)..(83): Any amino acid
  MOD_RES (210)..(210): Any amino acid
  MOD_RES (253)..(258): Any amino acid
  MOD_RES (308)..(311): Any amino acid
  MOD_RES (338)..(338): Any amino acid
  MOD_RES (392)..(393): Any amino acid
  MOD_RES (414)..(414): Any amino acid
  MOD_RES (468)..(469): Any amino acid

SEQ ID NO: 420866 - protein, 469 aa, Influenza virus; identical to SEQ ID NO: 419513
  MOD_RES (1)..(4): Any amino acid
  MOD_RES (18)..(58): Any amino acid
  MOD_RES (72)..(83): Any amino acid
  MOD_RES (182)..(182): Any amino acid
  MOD_RES (208)..(210): Any amino acid
  MOD_RES (226)..(226): Any amino acid
  MOD_RES (253)..(258): Any amino acid
  MOD_RES (273)..(273): Any amino acid
  MOD_RES (308)..(311): Any amino acid
  MOD_RES (338)..(338): Any amino acid
  MOD_RES (392)..(393): Any amino acid
  MOD_RES (411)..(414): Any amino acid
  MOD_RES (454)..(455): Any amino acid
  MOD_RES (468)..(469): Any amino acid

SEQ ID NO: 420867 - protein, 469 aa, Influenza virus; identical to SEQ ID NO: 419514
  MOD_RES (1)..(6): Any amino acid
  MOD_RES (20)..(58): Any amino acid
  MOD_RES (72)..(83): Any amino acid
  MOD_RES (164)..(167): Any amino acid
  MOD_RES (210)..(210): Any amino acid
  MOD_RES (222)..(228): Any amino acid
  MOD_RES (253)..(258): Any amino acid
  MOD_RES (273)..(276): Any amino acid
  MOD_RES (308)..(311): Any amino acid
  MOD_RES (338)..(338): Any amino acid
  MOD_RES (392)..(393): Any amino acid
  MOD_RES (414)..(414): Any amino acid
  MOD_RES (454)..(455): Any amino acid
  MOD_RES (468)..(469): Any amino acid

SEQ ID NO: 420868 - protein, 469 aa, Influenza virus; identical to SEQ ID NO: 419515
  MOD_RES (1)..(8): Any amino acid
  MOD_RES (20)..(58): Any amino acid
  MOD_RES (72)..(83): Any amino acid
  MOD_RES (97)..(102): Any amino acid
  MOD_RES (163)..(189): Any amino acid
  MOD_RES (210)..(228): Any amino acid
  MOD_RES (253)..(258): Any amino acid
  MOD_RES (273)..(295): Any amino acid
  MOD_RES (308)..(311): Any amino acid
  MOD_RES (338)..(338): Any amino acid
  MOD_RES (367)..(371): Any amino acid
  MOD_RES (391)..(393): Any amino acid
  MOD_RES (410)..(415): Any amino acid
  MOD_RES (426)..(430): Any amino acid
  MOD_RES (453)..(456): Any amino acid
  MOD_RES (468)..(469): Any amino acid

SEQ ID NO: 420869 - protein, 469 aa, Influenza virus; identical to SEQ ID NO: 419516
  MOD_RES (1)..(9): Any amino acid
  MOD_RES (20)..(58): Any amino acid
  MOD_RES (72)..(83): Any amino acid
  MOD_RES (95)..(103): Any amino acid
  MOD_RES (163)..(189): Any amino acid
  MOD_RES (210)..(228): Any amino acid
  MOD_RES (248)..(258): Any amino acid
  MOD_RES (272)..(313): Any amino acid
  MOD_RES (324)..(324): Any amino acid
  MOD_RES (338)..(338): Any amino acid
  MOD_RES (366)..(374): Any amino acid
  MOD_RES (392)..(393): Any amino acid
  MOD_RES (409)..(431): Any amino acid
  MOD_RES (444)..(444): Any amino acid
  MOD_RES (455)..(469): Any amino acid

SEQ ID NO: 420870 - protein, 597 aa, Influenza virus; identical to SEQ ID NO: 419519
  MOD_RES (17)..(24): Any amino acid
  MOD_RES (61)..(74): Any amino acid
  MOD_RES (99)..(112): Any amino acid
  MOD_RES (123)..(125): Any amino acid
  MOD_RES (137)..(163): Any amino acid
  MOD_RES (174)..(197): Any amino acid
  MOD_RES (209)..(216): Any amino acid
  MOD_RES (228)..(228): Any amino acid
  MOD_RES (244)..(245): Any amino acid
  MOD_RES (259)..(262): Any amino acid
  MOD_RES (284)..(307): Any amino acid
  MOD_RES (335)..(335): Any amino acid
  MOD_RES (352)..(352): Any amino acid
  MOD_RES (372)..(377): Any amino acid
  MOD_RES (523)..(523): Any amino acid
  MOD_RES (578)..(582): Any amino acid

SEQ ID NO: 420871 - protein, 597 aa, Influenza virus; identical to SEQ ID NO: 419520
  MOD_RES (17)..(24): Any amino acid
  MOD_RES (61)..(74): Any amino acid
  MOD_RES (97)..(112): Any amino acid
  MOD_RES (123)..(125): Any amino acid
  MOD_RES (137)..(163): Any amino acid
  MOD_RES (174)..(197): Any amino acid
  MOD_RES (209)..(216): Any amino acid
  MOD_RES (228)..(228): Any amino acid
  MOD_RES (244)..(245): Any amino acid
  MOD_RES (259)..(262): Any amino acid
  MOD_RES (284)..(307): Any amino acid
  MOD_RES (335)..(335): Any amino acid
  MOD_RES (352)..(352): Any amino acid
  MOD_RES (371)..(384): Any amino acid
  MOD_RES (443)..(445): Any amino acid
  MOD_RES (477)..(482): Any amino acid
  MOD_RES (510)..(512): Any amino acid
  MOD_RES (523)..(523): Any amino acid
  MOD_RES (578)..(582): Any amino acid
  MOD_RES (596)..(597): Any amino acid

SEQ ID NO: 420872 - protein, 597 aa, Influenza virus; identical to SEQ ID NO: 419521
  MOD_RES (1)..(1): Any amino acid
  MOD_RES (17)..(26): Any amino acid
  MOD_RES (61)..(74): Any amino acid
  MOD_RES (99)..(112): Any amino acid
  MOD_RES (123)..(125): Any amino acid
  MOD_RES (137)..(163): Any amino acid
  MOD_RES (174)..(197): Any amino acid
  MOD_RES (209)..(216): Any amino acid
  MOD_RES (228)..(228): Any amino acid
  MOD_RES (244)..(245): Any amino acid
  MOD_RES (259)..(262): Any amino acid
  MOD_RES (284)..(307): Any amino acid
  MOD_RES (324)..(324): Any amino acid
  MOD_RES (335)..(335): Any amino acid
  MOD_RES (352)..(352): Any amino acid
  MOD_RES (380)..(385): Any amino acid
  MOD_RES (405)..(408): Any amino acid
  MOD_RES (477)..(482): Any amino acid
  MOD_RES (509)..(523): Any amino acid
  MOD_RES (578)..(582): Any amino acid
  MOD_RES (594)..(597): Any amino acid

SEQ ID NO: 420873 - protein, 597 aa, Influenza virus; identical to SEQ ID NO: 419522
  MOD_RES (1)..(4): Any amino acid
  MOD_RES (17)..(26): Any amino acid
  MOD_RES (61)..(74): Any amino acid
  MOD_RES (99)..(112): Any amino acid
  MOD_RES (123)..(125): Any amino acid
  MOD_RES (137)..(163): Any amino acid
  MOD_RES (174)..(197): Any amino acid
  MOD_RES (209)..(216): Any amino acid
  MOD_RES (228)..(228): Any amino acid
  MOD_RES (244)..(245): Any amino acid
  MOD_RES (259)..(262): Any amino acid
  MOD_RES (284)..(307): Any amino acid
  MOD_RES (335)..(339): Any amino acid
  MOD_RES (352)..(353): Any amino acid
  MOD_RES (364)..(391): Any amino acid
  MOD_RES (411)..(412): Any amino acid
  MOD_RES (477)..(483): Any amino acid
  MOD_RES (505)..(526): Any amino acid
  MOD_RES (578)..(582): Any amino acid
  MOD_RES (596)..(597): Any amino acid

SEQ ID NO: 420874 - protein, 597 aa, Influenza virus; identical to SEQ ID NO: 419523
  MOD_RES (1)..(30): Any amino acid
  MOD_RES (61)..(74): Any amino acid
  MOD_RES (94)..(112): Any amino acid
  MOD_RES (123)..(126): Any amino acid
  MOD_RES (137)..(163): Any amino acid
  MOD_RES (182)..(216): Any amino acid
  MOD_RES (227)..(228): Any amino acid
  MOD_RES (242)..(245): Any amino acid
  MOD_RES (259)..(262): Any amino acid
  MOD_RES (273)..(273): Any amino acid
  MOD_RES (284)..(307): Any amino acid
  MOD_RES (335)..(341): Any amino acid
  MOD_RES (352)..(353): Any amino acid
  MOD_RES (364)..(421): Any amino acid
  MOD_RES (473)..(484): Any amino acid
  MOD_RES (505)..(536): Any amino acid
  MOD_RES (576)..(582): Any amino acid

SEQ ID NO: 420875 - protein, 515 aa, Influenza virus; identical to SEQ ID NO: 419529
  MOD_RES (1)..(10): Any amino acid
  MOD_RES (38)..(62): Any amino acid
  MOD_RES (79)..(84): Any amino acid
  MOD_RES (113)..(113): Any amino acid
  MOD_RES (127)..(127): Any amino acid
  MOD_RES (149)..(149): Any amino acid
  MOD_RES (198)..(255): Any amino acid
  MOD_RES (309)..(318): Any amino acid
  MOD_RES (418)..(425): Any amino acid
  MOD_RES (458)..(460): Any amino acid
  MOD_RES (478)..(478): Any amino acid

SEQ ID NO: 420876 - protein, 515 aa, Influenza virus; identical to SEQ ID NO: 419530
  MOD_RES (1)..(10): Any amino acid
  MOD_RES (38)..(62): Any amino acid
  MOD_RES (79)..(84): Any amino acid
  MOD_RES (113)..(113): Any amino acid
  MOD_RES (127)..(127): Any amino acid
  MOD_RES (148)..(149): Any amino acid
  MOD_RES (197)..(255): Any amino acid
  MOD_RES (309)..(318): Any amino acid
  MOD_RES (418)..(425): Any amino acid
  MOD_RES (457)..(460): Any amino acid
  MOD_RES (478)..(478): Any amino acid

SEQ ID NO: 420877 - protein, 515 aa, Influenza virus; identical to SEQ ID NO: 419531
  MOD_RES (1)..(10): Any amino acid
  MOD_RES (37)..(62): Any amino acid
  MOD_RES (79)..(84): Any amino acid
  MOD_RES (113)..(113): Any amino acid
  MOD_RES (127)..(127): Any amino acid
  MOD_RES (149)..(149): Any amino acid
  MOD_RES (198)..(255): Any amino acid
  MOD_RES (268)..(270): Any amino acid
  MOD_RES (309)..(318): Any amino acid
  MOD_RES (418)..(425): Any amino acid
  MOD_RES (458)..(460): Any amino acid
  MOD_RES (475)..(478): Any amino acid
  MOD_RES (491)..(493): Any amino acid
  MOD_RES (504)..(504): Any amino acid
  MOD_RES (515)..(515): Any amino acid

SEQ ID NO: 420878 - protein, 515 aa, Influenza virus; identical to SEQ ID NO: 419532
  MOD_RES (1)..(10): Any amino acid
  MOD_RES (38)..(62): Any amino acid
  MOD_RES (77)..(84): Any amino acid
  MOD_RES (113)..(113): Any amino acid
  MOD_RES (124)..(127): Any amino acid
  MOD_RES (149)..(149): Any amino acid
  MOD_RES (198)..(255): Any amino acid
  MOD_RES (269)..(271): Any amino acid
  MOD_RES (309)..(318): Any amino acid
  MOD_RES (342)..(343): Any amino acid
  MOD_RES (363)..(365): Any amino acid
  MOD_RES (403)..(404): Any amino acid
  MOD_RES (418)..(425): Any amino acid
  MOD_RES (447)..(447): Any amino acid
  MOD_RES (458)..(462): Any amino acid
  MOD_RES (478)..(478): Any amino acid
  MOD_RES (513)..(515): Any amino acid

SEQ ID NO: 420879 - protein, 515 aa, Influenza virus; identical to SEQ ID NO: 419533
  MOD_RES (1)..(10): Any amino acid
  MOD_RES (38)..(62): Any amino acid
  MOD_RES (79)..(84): Any amino acid
  MOD_RES (104)..(114): Any amino acid
  MOD_RES (125)..(133): Any amino acid
  MOD_RES (149)..(149): Any amino acid
  MOD_RES (182)..(185): Any amino acid
  MOD_RES (198)..(255): Any amino acid
  MOD_RES (269)..(271): Any amino acid
  MOD_RES (283)..(285): Any amino acid
  MOD_RES (309)..(320): Any amino acid
  MOD_RES (344)..(344): Any amino acid
  MOD_RES (361)..(375): Any amino acid
  MOD_RES (392)..(392): Any amino acid
  MOD_RES (403)..(407): Any amino acid
  MOD_RES (418)..(425): Any amino acid
  MOD_RES (456)..(465): Any amino acid
  MOD_RES (478)..(478): Any amino acid
  MOD_RES (489)..(499): Any amino acid
  MOD_RES (513)..(515): Any amino acid

SEQ ID NO: 420880 - protein, 585 aa, Influenza virus; identical to SEQ ID NO: 419536
  MOD_RES (17)..(23): Any amino acid
  MOD_RES (42)..(42): Any amino acid
  MOD_RES (67)..(80): Any amino acid
  MOD_RES (91)..(91): Any amino acid
  MOD_RES (104)..(128): Any amino acid
  MOD_RES (139)..(143): Any amino acid
  MOD_RES (156)..(161): Any amino acid
  MOD_RES (178)..(182): Any amino acid
  MOD_RES (193)..(196): Any amino acid
  MOD_RES (207)..(224): Any amino acid
  MOD_RES (235)..(241): Any amino acid
  MOD_RES (258)..(261): Any amino acid
  MOD_RES (282)..(313): Any amino acid
  MOD_RES (334)..(334): Any amino acid
  MOD_RES (348)..(349): Any amino acid
  MOD_RES (528)..(536): Any amino acid
  MOD_RES (566)..(568): Any amino acid

SEQ ID NO: 420881 - protein, 585 aa, Influenza virus; identical to SEQ ID NO: 419537
  MOD_RES (17)..(30): Any amino acid
  MOD_RES (42)..(42): Any amino acid
  MOD_RES (67)..(80): Any amino acid
  MOD_RES (91)..(91): Any amino acid
  MOD_RES (102)..(128): Any amino acid
  MOD_RES (139)..(143): Any amino acid
  MOD_RES (156)..(161): Any amino acid
  MOD_RES (178)..(182): Any amino acid
  MOD_RES (193)..(196): Any amino acid
  MOD_RES (207)..(224): Any amino acid
  MOD_RES (235)..(241): Any amino acid
  MOD_RES (258)..(261): Any amino acid
  MOD_RES (282)..(313): Any amino acid
  MOD_RES (334)..(334): Any amino acid
  MOD_RES (347)..(349): Any amino acid
  MOD_RES (360)..(361): Any amino acid
  MOD_RES (528)..(536): Any amino acid
  MOD_RES (566)..(568): Any amino acid
  MOD_RES (584)..(585): Any amino acid

SEQ ID NO: 420882 - protein, 585 aa, Influenza virus; identical to SEQ ID NO: 419538
  MOD_RES (17)..(30): Any amino acid
  MOD_RES (42)..(42): Any amino acid
  MOD_RES (67)..(80): Any amino acid
  MOD_RES (91)..(91): Any amino acid
  MOD_RES (104)..(128): Any amino acid
  MOD_RES (139)..(143): Any amino acid
  MOD_RES (156)..(161): Any amino acid
  MOD_RES (178)..(182): Any amino acid
  MOD_RES (193)..(196): Any amino acid
  MOD_RES (207)..(224): Any amino acid
  MOD_RES (235)..(241): Any amino acid
  MOD_RES (258)..(261): Any amino acid
  MOD_RES (282)..(313): Any amino acid
  MOD_RES (334)..(334): Any amino acid
  MOD_RES (348)..(349): Any amino acid
  MOD_RES (360)..(361): Any amino acid
  MOD_RES (372)..(378): Any amino acid
  MOD_RES (528)..(536): Any amino acid
  MOD_RES (566)..(568): Any amino acid
  MOD_RES (584)..(585): Any amino acid

SEQ ID NO: 420883 - protein, 585 aa, Influenza virus; identical to SEQ ID NO: 419539
  MOD_RES (1)..(4): Any amino acid
  MOD_RES (17)..(31): Any amino acid
  MOD_RES (42)..(42): Any amino acid
  MOD_RES (63)..(80): Any amino acid
  MOD_RES (91)..(91): Any amino acid
  MOD_RES (102)..(128): Any amino acid
  MOD_RES (139)..(143): Any amino acid
  MOD_RES (155)..(161): Any amino acid
  MOD_RES (178)..(182): Any amino acid
  MOD_RES (193)..(196): Any amino acid
  MOD_RES (207)..(224): Any amino acid
  MOD_RES (235)..(241): Any amino acid
  MOD_RES (254)..(261): Any amino acid
  MOD_RES (282)..(313): Any amino acid
  MOD_RES (334)..(349): Any amino acid
  MOD_RES (372)..(379): Any amino acid
  MOD_RES (399)..(400): Any amino acid
  MOD_RES (419)..(419): Any amino acid
  MOD_RES (526)..(536): Any amino acid
  MOD_RES (566)..(568): Any amino acid

SEQ ID NO: 420884 - protein, 585 aa, Influenza virus; identical to SEQ ID NO: 419540
  MOD_RES (1)..(43): Any amino acid
  MOD_RES (58)..(80): Any amino acid
  MOD_RES (91)..(128): Any amino acid
  MOD_RES (139)..(143): Any amino acid
  MOD_RES (154)..(161): Any amino acid
  MOD_RES (173)..(224): Any amino acid
  MOD_RES (235)..(261): Any amino acid
  MOD_RES (277)..(323): Any amino acid
  MOD_RES (334)..(350): Any amino acid
  MOD_RES (372)..(382): Any amino acid
  MOD_RES (393)..(404): Any amino acid
  MOD_RES (424)..(425): Any amino acid
  MOD_RES (451)..(452): Any amino acid
  MOD_RES (464)..(465): Any amino acid
  MOD_RES (483)..(494): Any amino acid
  MOD_RES (528)..(536): Any amino acid
  MOD_RES (566)..(568): Any amino acid
  MOD_RES (584)..(585): Any amino acid

SEQ ID NO: 420885 - protein, 471 aa, Influenza virus; identical to SEQ ID NO: 419544
  MOD_RES (38)..(61): Any amino acid
  MOD_RES (73)..(81): Any amino acid
  MOD_RES (164)..(168): Any amino acid
  MOD_RES (251)..(267): Any amino acid
  MOD_RES (285)..(286): Any amino acid
  MOD_RES (309)..(309): Any amino acid
  MOD_RES (332)..(333): Any amino acid
  MOD_RES (387)..(392): Any amino acid
  MOD_RES (416)..(416): Any amino acid
  MOD_RES (454)..(454): Any amino acid

SEQ ID NO: 420886 - protein, 471 aa, Influenza virus; identical to SEQ ID NO: 419545
  MOD_RES (38)..(61): Any amino acid
  MOD_RES (73)..(81): Any amino acid
  MOD_RES (115)..(116): Any amino acid
  MOD_RES (164)..(168): Any amino acid
  MOD_RES (251)..(267): Any amino acid
  MOD_RES (285)..(286): Any amino acid
  MOD_RES (309)..(309): Any amino acid
  MOD_RES (332)..(333): Any amino acid
  MOD_RES (387)..(392): Any amino acid
  MOD_RES (416)..(416): Any amino acid
  MOD_RES (427)..(430): Any amino acid
  MOD_RES (450)..(454): Any amino acid

SEQ ID NO: 420887 - protein, 471 aa, Influenza virus; identical to SEQ ID NO: 419546
  MOD_RES (38)..(61): Any amino acid
  MOD_RES (72)..(81): Any amino acid
  MOD_RES (164)..(168): Any amino acid
  MOD_RES (251)..(267): Any amino acid
  MOD_RES (285)..(286): Any amino acid
  MOD_RES (297)..(298): Any amino acid
  MOD_RES (309)..(309): Any amino acid
  MOD_RES (332)..(333): Any amino acid
  MOD_RES (387)..(392): Any amino acid
  MOD_RES (416)..(432): Any amino acid
  MOD_RES (452)..(454): Any amino acid
  MOD_RES (468)..(471): Any amino acid

SEQ ID NO: 420888 - protein, 471 aa, Influenza virus; identical to SEQ ID NO: 419547
  MOD_RES (38)..(61): Any amino acid
  MOD_RES (73)..(81): Any amino acid
  MOD_RES (103)..(103): Any amino acid
  MOD_RES (115)..(116): Any amino acid
  MOD_RES (127)..(142): Any amino acid
  MOD_RES (164)..(168): Any amino acid
  MOD_RES (194)..(194): Any amino acid
  MOD_RES (248)..(268): Any amino acid
  MOD_RES (285)..(286): Any amino acid
  MOD_RES (298)..(298): Any amino acid
  MOD_RES (309)..(309): Any amino acid
  MOD_RES (332)..(335): Any amino acid
  MOD_RES (387)..(392): Any amino acid
  MOD_RES (410)..(437): Any amino acid
  MOD_RES (454)..(454): Any amino acid

SEQ ID NO: 420889 - protein, 471 aa, Influenza virus; identical to SEQ ID NO: 419548
  MOD_RES (1)..(6): Any amino acid
  MOD_RES (38)..(61): Any amino acid
  MOD_RES (72)..(83): Any amino acid
  MOD_RES (127)..(143): Any amino acid
  MOD_RES (161)..(182): Any amino acid
  MOD_RES (194)..(198): Any amino acid
  MOD_RES (225)..(228): Any amino acid
  MOD_RES (251)..(286): Any amino acid
  MOD_RES (309)..(309): Any amino acid
  MOD_RES (321)..(345): Any amino acid
  MOD_RES (387)..(392): Any amino acid
  MOD_RES (410)..(471): Any amino acid

SEQ ID NO: 420890 - protein, 567 aa, Influenza virus; identical to SEQ ID NO: 419552
  MOD_RES (1)..(9): Any amino acid
  MOD_RES (180)..(183): Any amino acid
  MOD_RES (417)..(418): Any amino acid

SEQ ID NO: 420891 - protein, 567 aa, Influenza virus; identical to SEQ ID NO: 419553
  MOD_RES (1)..(9): Any amino acid
  MOD_RES (75)..(76): Any amino acid
  MOD_RES (180)..(183): Any amino acid
  MOD_RES (245)..(265): Any amino acid
  MOD_RES (417)..(418): Any amino acid

SEQ ID NO: 420892 - protein, 567 aa, Influenza virus; identical to SEQ ID NO: 419554
  MOD_RES (1)..(9): Any amino acid
  MOD_RES (102)..(102): Any amino acid
  MOD_RES (161)..(161): Any amino acid
  MOD_RES (183)..(183): Any amino acid
  MOD_RES (249)..(269): Any amino acid
  MOD_RES (353)..(381): Any amino acid
  MOD_RES (401)..(401): Any amino acid
  MOD_RES (417)..(418): Any amino acid
  MOD_RES (445)..(445): Any amino acid
  MOD_RES (558)..(567): Any amino acid

SEQ ID NO: 420893 - protein, 567 aa, Influenza virus; identical to SEQ ID NO: 419555
  MOD_RES (1)..(9): Any amino acid
  MOD_RES (20)..(27): Any amino acid
  MOD_RES (66)..(79): Any amino acid
  MOD_RES (99)..(121): Any amino acid
  MOD_RES (180)..(183): Any amino acid
  MOD_RES (253)..(270): Any amino acid
  MOD_RES (290)..(292): Any amino acid
  MOD_RES (355)..(381): Any amino acid
  MOD_RES (401)..(402): Any amino acid
  MOD_RES (417)..(418): Any amino acid
  MOD_RES (440)..(451): Any amino acid
  MOD_RES (486)..(496): Any amino acid
  MOD_RES (532)..(567): Any amino acid

SEQ ID NO: 420894 - protein, 567 aa, Influenza virus; identical to SEQ ID NO: 419556
  MOD_RES (1)..(9): Any amino acid
  MOD_RES (22)..(27): Any amino acid
  MOD_RES (75)..(86): Any amino acid
  MOD_RES (102)..(132): Any amino acid
  MOD_RES (143)..(148): Any amino acid
  MOD_RES (168)..(171): Any amino acid
  MOD_RES (183)..(183): Any amino acid
  MOD_RES (196)..(201): Any amino acid
  MOD_RES (212)..(218): Any amino acid
  MOD_RES (253)..(271): Any amino acid
  MOD_RES (291)..(292): Any amino acid
  MOD_RES (352)..(387): Any amino acid
  MOD_RES (407)..(418): Any amino acid
  MOD_RES (445)..(463): Any amino acid
  MOD_RES (490)..(496): Any amino acid
  MOD_RES (532)..(567): Any amino acid

SEQ ID NO: 420895 - protein, 562 aa, Influenza virus; identical to SEQ ID NO: 419560
  MOD_RES (12)..(26): Any amino acid
  MOD_RES (37)..(77): Any amino acid
  MOD_RES (89)..(246): Any amino acid
  MOD_RES (267)..(323): Any amino acid
  MOD_RES (334)..(339): Any amino acid
  MOD_RES (372)..(425): Any amino acid
  MOD_RES (452)..(471): Any amino acid
  MOD_RES (486)..(487): Any amino acid
  MOD_RES (498)..(520): Any amino acid
  MOD_RES (538)..(562): Any amino acid

SEQ ID NO: 420896 - protein, 562 aa, Influenza virus; identical to SEQ ID NO: 419561
  MOD_RES (1)..(26): Any amino acid
  MOD_RES (37)..(77): Any amino acid
  MOD_RES (89)..(246): Any amino acid
  MOD_RES (267)..(323): Any amino acid
  MOD_RES (334)..(339): Any amino acid
  MOD_RES (372)..(425): Any amino acid
  MOD_RES (452)..(471): Any amino acid
  MOD_RES (486)..(487): Any amino acid
  MOD_RES (498)..(520): Any amino acid
  MOD_RES (538)..(562): Any amino acid

SEQ ID NO: 420897 - protein, 562 aa, Influenza virus; identical to SEQ ID NO: 419562
  MOD_RES (1)..(26): Any amino acid
  MOD_RES (37)..(77): Any amino acid
  MOD_RES (89)..(246): Any amino acid
  MOD_RES (267)..(323): Any amino acid
  MOD_RES (334)..(348): Any amino acid
  MOD_RES (372)..(425): Any amino acid
  MOD_RES (452)..(471): Any amino acid
  MOD_RES (486)..(487): Any amino acid
  MOD_RES (498)..(520): Any amino acid
  MOD_RES (538)..(562): Any amino acid

SEQ ID NO: 420898 - protein, 562 aa, Influenza virus; identical to SEQ ID NO: 419563
  MOD_RES (1)..(26): Any amino acid
  MOD_RES (37)..(78): Any amino acid
  MOD_RES (89)..(246): Any amino acid
  MOD_RES (267)..(323): Any amino acid
  MOD_RES (334)..(349): Any amino acid
  MOD_RES (372)..(425): Any amino acid
  MOD_RES (451)..(471): Any amino acid
  MOD_RES (486)..(487): Any amino acid
  MOD_RES (498)..(520): Any amino acid
  MOD_RES (538)..(562): Any amino acid

SEQ ID NO: 420899 - protein, 562 aa, Influenza virus; identical to SEQ ID NO: 419564
  MOD_RES (1)..(26): Any amino acid
  MOD_RES (37)..(78): Any amino acid
  MOD_RES (89)..(246): Any amino acid
  MOD_RES (262)..(323): Any amino acid
  MOD_RES (334)..(425): Any amino acid
  MOD_RES (437)..(437): Any amino acid
  MOD_RES (452)..(471): Any amino acid
  MOD_RES (482)..(487): Any amino acid
  MOD_RES (498)..(520): Any amino acid
  MOD_RES (538)..(562): Any amino acid

SEQ ID NO: 420900 - protein, 562 aa, Influenza virus; identical to SEQ ID NO: 419568
  MOD_RES (12)..(26): Any amino acid
  MOD_RES (37)..(77): Any amino acid
  MOD_RES (89)..(246): Any amino acid
  MOD_RES (267)..(323): Any amino acid
  MOD_RES (334)..(339): Any amino acid
  MOD_RES (372)..(424): Any amino acid
  MOD_RES (453)..(471): Any amino acid
  MOD_RES (486)..(487): Any amino acid
  MOD_RES (498)..(520): Any amino acid
  MOD_RES (538)..(562): Any amino acid

SEQ ID NO: 420901 - protein, 562 aa, Influenza virus; identical to SEQ ID NO: 419569
  MOD_RES (1)..(26): Any amino acid
  MOD_RES (37)..(77): Any amino acid
  MOD_RES (89)..(246): Any amino acid
  MOD_RES (267)..(323): Any amino acid
  MOD_RES (334)..(345): Any amino acid
  MOD_RES (372)..(424): Any amino acid
  MOD_RES (453)..(471): Any amino acid
  MOD_RES (486)..(487): Any amino acid
  MOD_RES (498)..(520): Any amino acid
  MOD_RES (538)..(562): Any amino acid

SEQ ID NO: 420902 - protein, 562 aa, Influenza virus; identical to SEQ ID NO: 419570
  MOD_RES (1)..(26): Any amino acid
  MOD_RES (37)..(77): Any amino acid
  MOD_RES (89)..(246): Any amino acid
  MOD_RES (267)..(323): Any amino acid
  MOD_RES (334)..(348): Any amino acid
  MOD_RES (372)..(424): Any amino acid
  MOD_RES (453)..(471): Any amino acid
  MOD_RES (486)..(487): Any amino acid
  MOD_RES (498)..(520): Any amino acid
  MOD_RES (538)..(562): Any amino acid

SEQ ID NO: 420903 - protein, 562 aa, Influenza virus; identical to SEQ ID NO: 419571
  MOD_RES (1)..(26): Any amino acid
  MOD_RES (37)..(78): Any amino acid
  MOD_RES (89)..(246): Any amino acid
  MOD_RES (262)..(323): Any amino acid
  MOD_RES (334)..(359): Any amino acid
  MOD_RES (372)..(424): Any amino acid
  MOD_RES (453)..(471): Any amino acid
  MOD_RES (486)..(487): Any amino acid
  MOD_RES (498)..(520): Any amino acid
  MOD_RES (538)..(562): Any amino acid

SEQ ID NO: 420904 - protein, 562 aa, Influenza virus; identical to SEQ ID NO: 419572
  MOD_RES (1)..(26): Any amino acid
  MOD_RES (37)..(78): Any amino acid
  MOD_RES (89)..(246): Any amino acid
  MOD_RES (267)..(323): Any amino acid
  MOD_RES (334)..(424): Any amino acid
  MOD_RES (436)..(440): Any amino acid
  MOD_RES (451)..(471): Any amino acid
  MOD_RES (482)..(487): Any amino acid
  MOD_RES (498)..(520): Any amino acid
  MOD_RES (538)..(562): Any amino acid

SEQ ID NO: 420905 - protein, 473 aa, Influenza virus; identical to SEQ ID NO: 419576
  MOD_RES (1)..(8): Any amino acid
  MOD_RES (19)..(51): Any amino acid
  MOD_RES (64)..(90): Any amino acid
  MOD_RES (103)..(132): Any amino acid
  MOD_RES (145)..(157): Any amino acid
  MOD_RES (173)..(174): Any amino acid
  MOD_RES (196)..(224): Any amino acid
  MOD_RES (237)..(273): Any amino acid
  MOD_RES (288)..(293): Any amino acid
  MOD_RES (307)..(319): Any amino acid
  MOD_RES (333)..(420): Any amino acid
  MOD_RES (436)..(457): Any amino acid
  MOD_RES (468)..(473): Any amino acid

SEQ ID NO: 420906 - protein, 473 aa, Influenza virus; identical to SEQ ID NO: 419577
  MOD_RES (1)..(90): Any amino acid
  MOD_RES (103)..(132): Any amino acid
  MOD_RES (145)..(157): Any amino acid
  MOD_RES (173)..(174): Any amino acid
  MOD_RES (196)..(224): Any amino acid
  MOD_RES (237)..(273): Any amino acid
  MOD_RES (288)..(293): Any amino acid
  MOD_RES (307)..(319): Any amino acid
  MOD_RES (333)..(420): Any amino acid
  MOD_RES (436)..(457): Any amino acid
  MOD_RES (468)..(473): Any amino acid

SEQ ID NO: 420907 - protein, 473 aa, Influenza virus; identical to SEQ ID NO: 419578
  MOD_RES (1)..(90): Any amino acid
  MOD_RES (103)..(132): Any amino acid
  MOD_RES (145)..(157): Any amino acid
  MOD_RES (173)..(174): Any amino acid
  MOD_RES (195)..(224): Any amino acid
  MOD_RES (235)..(273): Any amino acid
  MOD_RES (288)..(293): Any amino acid
  MOD_RES (307)..(319): Any amino acid
  MOD_RES (330)..(421): Any amino acid
  MOD_RES (436)..(457): Any amino acid
  MOD_RES (468)..(473): Any amino acid

SEQ ID NO: 420908 - protein, 473 aa, Influenza virus; identical to SEQ ID NO: 419579
  MOD_RES (1)..(90): Any amino acid
  MOD_RES (103)..(132): Any amino acid
  MOD_RES (144)..(157): Any amino acid
  MOD_RES (173)..(174): Any amino acid
  MOD_RES (196)..(224): Any amino acid
  MOD_RES (237)..(273): Any amino acid
  MOD_RES (288)..(293): Any amino acid
  MOD_RES (304)..(322): Any amino acid
  MOD_RES (333)..(424): Any amino acid
  MOD_RES (435)..(457): Any amino acid
  MOD_RES (468)..(473): Any amino acid

SEQ ID NO: 420909 - protein, 473 aa, Influenza virus; identical to SEQ ID NO: 419580
  MOD_RES (1)..(90): Any amino acid
  MOD_RES (101)..(157): Any amino acid
  MOD_RES (173)..(174): Any amino acid
  MOD_RES (196)..(224): Any amino acid
  MOD_RES (235)..(273): Any amino acid
  MOD_RES (286)..(293): Any amino acid
  MOD_RES (307)..(322): Any amino acid
  MOD_RES (333)..(473): Any amino acid

SEQ ID NO: 420910 - protein, 275 aa, Influenza virus; identical to SEQ ID NO: 419583
  MOD_RES (143)..(145): Any amino acid
  MOD_RES (169)..(169): Any amino acid
  MOD_RES (210)..(214): Any amino acid
  MOD_RES (225)..(234): Any amino acid

SEQ ID NO: 420911 - protein, 275 aa, Influenza virus; identical to SEQ ID NO: 419584
  MOD_RES (1)..(5): Any amino acid
  MOD_RES (50)..(52): Any amino acid
  MOD_RES (72)..(73): Any amino acid
  MOD_RES (143)..(145): Any amino acid
  MOD_RES (169)..(169): Any amino acid
  MOD_RES (210)..(214): Any amino acid
  MOD_RES (225)..(234): Any amino acid
  MOD_RES (256)..(256): Any amino acid
  MOD_RES (275)..(275): Any amino acid

SEQ ID NO: 420912 - protein, 275 aa, Influenza virus; identical to SEQ ID NO: 419585
  MOD_RES (1)..(8): Any amino acid
  MOD_RES (50)..(56): Any amino acid
  MOD_RES (69)..(78): Any amino acid
  MOD_RES (129)..(131): Any amino acid
  MOD_RES (143)..(145): Any amino acid
  MOD_RES (169)..(169): Any amino acid
  MOD_RES (210)..(214): Any amino acid
  MOD_RES (225)..(234): Any amino acid
  MOD_RES (256)..(275): Any amino acid

SEQ ID NO: 420913 - protein, 275 aa, Influenza virus; identical to SEQ ID NO: 419586
  MOD_RES (1)..(23): Any amino acid
  MOD_RES (50)..(91): Any amino acid
  MOD_RES (131)..(132): Any amino acid
  MOD_RES (143)..(153): Any amino acid
  MOD_RES (169)..(169): Any amino acid
  MOD_RES (180)..(195): Any amino acid
  MOD_RES (209)..(214): Any amino acid
  MOD_RES (225)..(234): Any amino acid
  MOD_RES (256)..(275): Any amino acid

SEQ ID NO: 420914 - protein, 275 aa, Influenza virus; identical to SEQ ID NO: 419587
  MOD_RES (1)..(23): Any amino acid
  MOD_RES (39)..(39): Any amino acid
  MOD_RES (59)..(92): Any amino acid
  MOD_RES (104)..(106): Any amino acid
  MOD_RES (129)..(198): Any amino acid
  MOD_RES (210)..(214): Any amino acid
  MOD_RES (225)..(234): Any amino acid
  MOD_RES (265)..(275): Any amino acid

SEQ ID NO: 420915 - protein, 99 aa, Influenza virus; identical to SEQ ID NO: 419590
  MOD_RES (11)..(67): Any amino acid
  MOD_RES (78)..(89): Any amino acid

SEQ ID NO: 420916 - protein, 99 aa, Influenza virus; identical to SEQ ID NO: 419591
  MOD_RES (11)..(67): Any amino acid
  MOD_RES (78)..(89): Any amino acid

SEQ ID NO: 420917 - protein, 99 aa, Influenza virus; identical to SEQ ID NO: 419592
  MOD_RES (11)..(67): Any amino acid
  MOD_RES (78)..(99): Any amino acid

SEQ ID NO: 420918 - protein, 99 aa, Influenza virus; identical to SEQ ID NO: 419593
  MOD_RES (11)..(67): Any amino acid
  MOD_RES (78)..(99): Any amino acid

SEQ ID NO: 420919 - protein, 99 aa, Influenza virus; identical to SEQ ID NO: 419594
  MOD_RES (1)..(9): Any amino acid
  MOD_RES (20)..(99): Any amino acid

SEQ ID NO: 420920 - protein, 527 aa, Influenza virus; identical to SEQ ID NO: 419595
  MOD_RES (35)..(38): Any amino acid
  MOD_RES (68)..(68): Any amino acid
  MOD_RES (116)..(130): Any amino acid
  MOD_RES (146)..(146): Any amino acid
  MOD_RES (304)..(306): Any amino acid
  MOD_RES (328)..(338): Any amino acid
  MOD_RES (367)..(379): Any amino acid
  MOD_RES (393)..(399): Any amino acid
  MOD_RES (421)..(422): Any amino acid
  MOD_RES (445)..(455): Any amino acid
  MOD_RES (479)..(480): Any amino acid
  MOD_RES (496)..(497): Any amino acid

SEQ ID NO: 420921 - protein, 527 aa, Influenza virus; identical to SEQ ID NO: 419596
  MOD_RES (1)..(9): Any amino acid
  MOD_RES (35)..(38): Any amino acid
  MOD_RES (68)..(68): Any amino acid
  MOD_RES (116)..(130): Any amino acid
  MOD_RES (146)..(146): Any amino acid
  MOD_RES (183)..(189): Any amino acid
  MOD_RES (304)..(306): Any amino acid
  MOD_RES (328)..(338): Any amino acid
  MOD_RES (367)..(379): Any amino acid
  MOD_RES (393)..(399): Any amino acid
  MOD_RES (421)..(422): Any amino acid
  MOD_RES (445)..(455): Any amino acid
  MOD_RES (468)..(480): Any amino acid
  MOD_RES (496)..(497): Any amino acid
  MOD_RES (524)..(527): Any amino acid

SEQ ID NO: 420922 - protein, 527 aa, Influenza virus; identical to SEQ ID NO: 419597
  MOD_RES (1)..(9): Any amino acid
  MOD_RES (35)..(38): Any amino acid
  MOD_RES (68)..(68): Any amino acid
  MOD_RES (89)..(90): Any amino acid
  MOD_RES (116)..(130): Any amino acid
  MOD_RES (146)..(146): Any amino acid
  MOD_RES (162)..(192): Any amino acid
  MOD_RES (243)..(243): Any amino acid
  MOD_RES (288)..(289): Any amino acid
  MOD_RES (304)..(306): Any amino acid
  MOD_RES (328)..(338): Any amino acid
  MOD_RES (367)..(379): Any amino acid
  MOD_RES (393)..(399): Any amino acid
  MOD_RES (421)..(422): Any amino acid
  MOD_RES (445)..(456): Any amino acid
  MOD_RES (468)..(480): Any amino acid
  MOD_RES (495)..(497): Any amino acid
  MOD_RES (524)..(527): Any amino acid

SEQ ID NO: 420923 - protein, 527 aa, Influenza virus; identical to SEQ ID NO: 419598
  MOD_RES (1)..(9): Any amino acid
  MOD_RES (35)..(38): Any amino acid
  MOD_RES (67)..(68): Any amino acid
  MOD_RES (81)..(90): Any amino acid
  MOD_RES (108)..(130): Any amino acid
  MOD_RES (146)..(146): Any amino acid
  MOD_RES (157)..(195): Any amino acid
  MOD_RES (217)..(230): Any amino acid
  MOD_RES (243)..(243): Any amino acid
  MOD_RES (304)..(306): Any amino acid
  MOD_RES (328)..(338): Any amino acid
  MOD_RES (355)..(355): Any amino acid
  MOD_RES (367)..(379): Any amino acid
  MOD_RES (391)..(408): Any amino acid
  MOD_RES (421)..(422): Any amino acid
  MOD_RES (440)..(462): Any amino acid
  MOD_RES (473)..(480): Any amino acid
  MOD_RES (491)..(497): Any amino acid
  MOD_RES (523)..(527): Any amino acid

SEQ ID NO: 420924 - protein, 527 aa, Influenza virus; identical to SEQ ID NO: 419599
  MOD_RES (1)..(11): Any amino acid
  MOD_RES (35)..(38): Any amino acid
  MOD_RES (68)..(69): Any amino acid
  MOD_RES (81)..(91): Any amino acid
  MOD_RES (111)..(130): Any amino acid
  MOD_RES (146)..(195): Any amino acid
  MOD_RES (220)..(230): Any amino acid
  MOD_RES (243)..(246): Any amino acid
  MOD_RES (262)..(267): Any amino acid
  MOD_RES (304)..(320): Any amino acid
  MOD_RES (334)..(343): Any amino acid
  MOD_RES (355)..(379): Any amino acid
  MOD_RES (391)..(410): Any amino acid
  MOD_RES (421)..(422): Any amino acid
  MOD_RES (445)..(466): Any amino acid
  MOD_RES (477)..(480): Any amino acid
  MOD_RES (492)..(497): Any amino acid
  MOD_RES (511)..(513): Any amino acid
  MOD_RES (524)..(527): Any amino acid

SEQ ID NO: 420925 - protein, 308 aa, Influenza virus; identical to SEQ ID NO: 419606
  MOD_RES (37)..(44): Any amino acid
  MOD_RES (58)..(58): Any amino acid
  MOD_RES (72)..(74): Any amino acid
  MOD_RES (92)..(123): Any amino acid
  MOD_RES (138)..(183): Any amino acid
  MOD_RES (195)..(222): Any amino acid
  MOD_RES (233)..(262): Any amino acid
  MOD_RES (282)..(284): Any amino acid

SEQ ID NO: 420926 - protein, 308 aa, Influenza virus; identical to SEQ ID NO: 419607
  MOD_RES (1)..(23): Any amino acid
  MOD_RES (36)..(44): Any amino acid
  MOD_RES (67)..(124): Any amino acid
  MOD_RES (138)..(284): Any amino acid
  MOD_RES (304)..(308): Any amino acid

SEQ ID NO: 420927 - protein, 308 aa, Influenza virus; identical to SEQ ID NO: 419608
  MOD_RES (1)..(23): Any amino acid
  MOD_RES (37)..(44): Any amino acid
  MOD_RES (58)..(58): Any amino acid
  MOD_RES (72)..(124): Any amino acid
  MOD_RES (137)..(284): Any amino acid
  MOD_RES (297)..(308): Any amino acid

SEQ ID NO: 420928 - protein, 308 aa, Influenza virus; identical to SEQ ID NO: 419609
  MOD_RES (1)..(23): Any amino acid
  MOD_RES (37)..(44): Any amino acid
  MOD_RES (58)..(58): Any amino acid
  MOD_RES (72)..(125): Any amino acid
  MOD_RES (138)..(308): Any amino acid

SEQ ID NO: 420929 - protein, 308 aa, Influenza virus; identical to SEQ ID NO: 419159
  MOD_RES (1)..(23): Any amino acid
  MOD_RES (37)..(44): Any amino acid
  MOD_RES (58)..(58): Any amino acid
  MOD_RES (72)..(308): Any amino acid

SEQ ID NO: 420930 - protein, 205 aa, Influenza virus; identical to SEQ ID NO: 419614
  MOD_RES (97)..(100): Any amino acid
  MOD_RES (111)..(168): Any amino acid
  MOD_RES (203)..(205): Any amino acid

SEQ ID NO: 420931 - protein, 205 aa, Influenza virus; identical to SEQ ID NO: 419615
  MOD_RES (1)..(13): Any amino acid
  MOD_RES (37)..(82): Any amino acid
  MOD_RES (97)..(168): Any amino acid

SEQ ID NO: 420932 - protein, 205 aa, Influenza virus; identical to SEQ ID NO: 419616
  MOD_RES (1)..(13): Any amino acid
  MOD_RES (33)..(169): Any amino acid
  MOD_RES (201)..(205): Any amino acid

SEQ ID NO: 420933 - protein, 205 aa, Influenza virus; identical to SEQ ID NO: 419617
  MOD_RES (1)..(169): Any amino acid
  MOD_RES (204)..(205): Any amino acid

SEQ ID NO: 420934 - protein, 205 aa, Influenza virus; identical to SEQ ID NO: 419618
  MOD_RES (1)..(186): Any amino acid
  MOD_RES (203)..(205): Any amino acid

SEQ ID NO: 420935 - protein, 734 aa, Influenza virus; identical to SEQ ID NO: 419619
  MOD_RES (27)..(30): Any amino acid
  MOD_RES (58)..(66): Any amino acid
  MOD_RES (86)..(101): Any amino acid
  MOD_RES (159)..(159): Any amino acid
  MOD_RES (209)..(215): Any amino acid
  MOD_RES (227)..(230): Any amino acid
  MOD_RES (254)..(277): Any amino acid
  MOD_RES (315)..(352): Any amino acid
  MOD_RES (363)..(370): Any amino acid
  MOD_RES (387)..(410): Any amino acid
  MOD_RES (428)..(428): Any amino acid
  MOD_RES (467)..(467): Any amino acid
  MOD_RES (534)..(568): Any amino acid
  MOD_RES (623)..(636): Any amino acid
  MOD_RES (728)..(734): Any amino acid

SEQ ID NO: 420936 - protein, 734 aa, Influenza virus; identical to SEQ ID NO: 419620
  MOD_RES (27)..(30): Any amino acid
  MOD_RES (58)..(66): Any amino acid
  MOD_RES (86)..(101): Any amino acid
  MOD_RES (159)..(159): Any amino acid
  MOD_RES (173)..(173): Any amino acid
  MOD_RES (209)..(215): Any amino acid
  MOD_RES (227)..(230): Any amino acid
  MOD_RES (253)..(277): Any amino acid
  MOD_RES (315)..(370): Any amino acid
  MOD_RES (387)..(410): Any amino acid
  MOD_RES (428)..(428): Any amino acid
  MOD_RES (467)..(467): Any amino acid
  MOD_RES (515)..(518): Any amino acid
  MOD_RES (534)..(568): Any amino acid
  MOD_RES (623)..(636): Any amino acid
  MOD_RES (708)..(711): Any amino acid
  MOD_RES (732)..(734): Any amino acid

SEQ ID NO: 420937 - protein, 734 aa, Influenza virus; identical to SEQ ID NO: 419621
  MOD_RES (27)..(30): Any amino acid
  MOD_RES (47)..(47): Any amino acid
  MOD_RES (58)..(66): Any amino acid
  MOD_RES (86)..(101): Any amino acid
  MOD_RES (159)..(159): Any amino acid
  MOD_RES (209)..(215): Any amino acid
  MOD_RES (227)..(230): Any amino acid
  MOD_RES (254)..(277): Any amino acid
  MOD_RES (289)..(289): Any amino acid
  MOD_RES (302)..(302): Any amino acid
  MOD_RES (315)..(370): Any amino acid
  MOD_RES (387)..(410): Any amino acid
  MOD_RES (428)..(428): Any amino acid
  MOD_RES (467)..(467): Any amino acid
  MOD_RES (534)..(568): Any amino acid
  MOD_RES (592)..(595): Any amino acid
  MOD_RES (623)..(636): Any amino acid
  MOD_RES (707)..(711): Any amino acid
  MOD_RES (727)..(734): Any amino acid

SEQ ID NO: 420938 - protein, 734 aa, Influenza virus; identical to SEQ ID NO: 419622
  MOD_RES (27)..(30): Any amino acid
  MOD_RES (58)..(66): Any amino acid
  MOD_RES (86)..(101): Any amino acid
  MOD_RES (135)..(140): Any amino acid
  MOD_RES (159)..(159): Any amino acid
  MOD_RES (170)..(175): Any amino acid
  MOD_RES (209)..(216): Any amino acid
  MOD_RES (227)..(230): Any amino acid
  MOD_RES (249)..(277): Any amino acid
  MOD_RES (289)..(289): Any amino acid
  MOD_RES (302)..(303): Any amino acid
  MOD_RES (315)..(370): Any amino acid
  MOD_RES (384)..(410): Any amino acid
  MOD_RES (428)..(428): Any amino acid
  MOD_RES (467)..(467): Any amino acid
  MOD_RES (510)..(524): Any amino acid
  MOD_RES (543)..(568): Any amino acid
  MOD_RES (580)..(597): Any amino acid
  MOD_RES (623)..(636): Any amino acid
  MOD_RES (667)..(668): Any amino acid
  MOD_RES (707)..(711): Any amino acid

SEQ ID NO: 420939 - protein, 734 aa, Influenza virus; identical to SEQ ID NO: 419623
  MOD_RES (24)..(32): Any amino acid
  MOD_RES (58)..(101): Any amino acid
  MOD_RES (115)..(119): Any amino acid
  MOD_RES (135)..(140): Any amino acid
  MOD_RES (159)..(163): Any amino acid
  MOD_RES (186)..(200): Any amino acid
  MOD_RES (211)..(230): Any amino acid
  MOD_RES (254)..(289): Any amino acid
  MOD_RES (302)..(370): Any amino acid
  MOD_RES (382)..(416): Any amino acid
  MOD_RES (428)..(428): Any amino acid
  MOD_RES (465)..(467): Any amino acid
  MOD_RES (490)..(490): Any amino acid
  MOD_RES (507)..(525): Any amino acid
  MOD_RES (543)..(568): Any amino acid
  MOD_RES (579)..(602): Any amino acid
  MOD_RES (623)..(636): Any amino acid
  MOD_RES (647)..(650): Any amino acid
  MOD_RES (681)..(681): Any amino acid
  MOD_RES (692)..(695): Any amino acid
  MOD_RES (709)..(711): Any amino acid
  MOD_RES (723)..(734): Any amino acid

SEQ ID NO: 420940 - protein, 829 aa, Influenza virus; identical to SEQ ID NO: 419630
  MOD_RES (13)..(14): Any amino acid
  MOD_RES (58)..(60): Any amino acid
  MOD_RES (112)..(115): Any amino acid
  MOD_RES (156)..(159): Any amino acid
  MOD_RES (174)..(182): Any amino acid
  MOD_RES (197)..(200): Any amino acid
  MOD_RES (213)..(217): Any amino acid
  MOD_RES (323)..(332): Any amino acid
  MOD_RES (365)..(391): Any amino acid
  MOD_RES (404)..(405): Any amino acid
  MOD_RES (437)..(440): Any amino acid
  MOD_RES (462)..(464): Any amino acid
  MOD_RES (576)..(594): Any amino acid
  MOD_RES (625)..(626): Any amino acid
  MOD_RES (667)..(684): Any amino acid
  MOD_RES (803)..(807): Any amino acid

SEQ ID NO: 420941 - protein, 829 aa, Influenza virus; identical to SEQ ID NO: 419631
  MOD_RES (1)..(1): Any amino acid
  MOD_RES (13)..(14): Any amino acid
  MOD_RES (26)..(36): Any amino acid
  MOD_RES (58)..(60): Any amino acid
  MOD_RES (74)..(77): Any amino acid
  MOD_RES (112)..(115): Any amino acid
  MOD_RES (141)..(141): Any amino acid
  MOD_RES (156)..(159): Any amino acid
  MOD_RES (174)..(182): Any amino acid
  MOD_RES (197)..(200): Any amino acid
  MOD_RES (213)..(217): Any amino acid
  MOD_RES (228)..(245): Any amino acid
  MOD_RES (273)..(284): Any amino acid
  MOD_RES (323)..(332): Any amino acid
  MOD_RES (365)..(405): Any amino acid
  MOD_RES (417)..(422): Any amino acid
  MOD_RES (437)..(440): Any amino acid
  MOD_RES (462)..(464): Any amino acid
  MOD_RES (503)..(514): Any amino acid
  MOD_RES (544)..(560): Any amino acid
  MOD_RES (576)..(594): Any amino acid
  MOD_RES (625)..(626): Any amino acid
  MOD_RES (642)..(684): Any amino acid
  MOD_RES (713)..(730): Any amino acid
  MOD_RES (803)..(807): Any amino acid
  MOD_RES (828)..(829): Any amino acid

SEQ ID NO: 420942 - protein, 829 aa, Influenza virus; identical to SEQ ID NO: 419632
  MOD_RES (1)..(1): Any amino acid
  MOD_RES (13)..(14): Any amino acid
  MOD_RES (26)..(44): Any amino acid
  MOD_RES (58)..(60): Any amino acid
  MOD_RES (88)..(89): Any amino acid
  MOD_RES (112)..(115): Any amino acid
  MOD_RES (133)..(144): Any amino acid
  MOD_RES (156)..(159): Any amino acid
  MOD_RES (174)..(182): Any amino acid
  MOD_RES (194)..(200): Any amino acid
  MOD_RES (213)..(217): Any amino acid
  MOD_RES (228)..(249): Any amino acid
  MOD_RES (273)..(286): Any amino acid
  MOD_RES (323)..(332): Any amino acid
  MOD_RES (364)..(405): Any amino acid
  MOD_RES (418)..(426): Any amino acid
  MOD_RES (437)..(440): Any amino acid
  MOD_RES (462)..(464): Any amino acid
  MOD_RES (497)..(526): Any amino acid
  MOD_RES (547)..(563): Any amino acid
  MOD_RES (576)..(594): Any amino acid
  MOD_RES (609)..(611): Any amino acid
  MOD_RES (625)..(626): Any amino acid
  MOD_RES (642)..(684): Any amino acid
  MOD_RES (722)..(734): Any amino acid
  MOD_RES (758)..(762): Any amino acid
  MOD_RES (793)..(829): Any amino acid

SEQ ID NO: 420943 - protein, 829 aa, Influenza virus; identical to SEQ ID NO: 419633
  MOD_RES (1)..(2): Any amino acid
  MOD_RES (13)..(46): Any amino acid
  MOD_RES (58)..(60): Any amino acid
  MOD_RES (112)..(115): Any amino acid
  MOD_RES (126)..(144): Any amino acid
  MOD_RES (156)..(163): Any amino acid
  MOD_RES (174)..(182): Any amino acid
  MOD_RES (194)..(200): Any amino acid
  MOD_RES (213)..(217): Any amino acid
  MOD_RES (233)..(249): Any amino acid
  MOD_RES (273)..(293): Any amino acid
  MOD_RES (306)..(312): Any amino acid
  MOD_RES (323)..(332): Any amino acid
  MOD_RES (343)..(344): Any amino acid
  MOD_RES (362)..(405): Any amino acid
  MOD_RES (416)..(440): Any amino acid
  MOD_RES (462)..(470): Any amino acid
  MOD_RES (490)..(528): Any amino acid
  MOD_RES (548)..(564): Any amino acid
  MOD_RES (576)..(611): Any amino acid
  MOD_RES (623)..(626): Any amino acid
  MOD_RES (642)..(703): Any amino acid
  MOD_RES (715)..(734): Any amino acid
  MOD_RES (761)..(762): Any amino acid
  MOD_RES (793)..(829): Any amino acid

SEQ ID NO: 420944 - protein, 829 aa, Influenza virus; identical to SEQ ID NO: 419634
  MOD_RES (1)..(2): Any amino acid
  MOD_RES (13)..(60): Any amino acid
  MOD_RES (89)..(89): Any amino acid
  MOD_RES (112)..(163): Any amino acid
  MOD_RES (174)..(182): Any amino acid
  MOD_RES (197)..(200): Any amino acid
  MOD_RES (213)..(217): Any amino acid
  MOD_RES (230)..(249): Any amino acid
  MOD_RES (260)..(293): Any amino acid
  MOD_RES (306)..(312): Any amino acid
  MOD_RES (323)..(332): Any amino acid
  MOD_RES (343)..(440): Any amino acid
  MOD_RES (452)..(470): Any amino acid
  MOD_RES (481)..(532): Any amino acid
  MOD_RES (545)..(564): Any amino acid
  MOD_RES (576)..(631): Any amino acid
  MOD_RES (642)..(738): Any amino acid
  MOD_RES (754)..(766): Any amino acid
  MOD_RES (793)..(829): Any amino acid

SEQ ID NO: 420945 - protein, 780 aa, Influenza virus; identical to SEQ ID NO: 419641
  MOD_RES (73)..(101): Any amino acid
  MOD_RES (117)..(121): Any amino acid
  MOD_RES (132)..(139): Any amino acid
  MOD_RES (166)..(168): Any amino acid
  MOD_RES (197)..(210): Any amino acid
  MOD_RES (305)..(308): Any amino acid
  MOD_RES (351)..(353): Any amino acid
  MOD_RES (368)..(370): Any amino acid
  MOD_RES (381)..(382): Any amino acid
  MOD_RES (393)..(411): Any amino acid
  MOD_RES (459)..(491): Any amino acid
  MOD_RES (507)..(507): Any amino acid
  MOD_RES (572)..(583): Any amino acid
  MOD_RES (601)..(603): Any amino acid
  MOD_RES (674)..(675): Any amino acid
  MOD_RES (696)..(698): Any amino acid
  MOD_RES (723)..(731): Any amino acid
  MOD_RES (778)..(780): Any amino acid

SEQ ID NO: 420946 - protein, 780 aa, Influenza virus; identical to SEQ ID NO: 419642
  MOD_RES (73)..(101): Any amino acid
  MOD_RES (117)..(121): Any amino acid
  MOD_RES (132)..(139): Any amino acid
  MOD_RES (166)..(168): Any amino acid
  MOD_RES (197)..(210): Any amino acid
  MOD_RES (222)..(224): Any amino acid
  MOD_RES (305)..(308): Any amino acid
  MOD_RES (351)..(353): Any amino acid
  MOD_RES (368)..(370): Any amino acid
  MOD_RES (381)..(382): Any amino acid
  MOD_RES (393)..(411): Any amino acid
  MOD_RES (432)..(433): Any amino acid
  MOD_RES (459)..(491): Any amino acid
  MOD_RES (507)..(507): Any amino acid
  MOD_RES (572)..(583): Any amino acid
  MOD_RES (601)..(603): Any amino acid
  MOD_RES (674)..(675): Any amino acid
  MOD_RES (687)..(698): Any amino acid
  MOD_RES (723)..(731): Any amino acid
  MOD_RES (757)..(760): Any amino acid

SEQ ID NO: 420947 - protein, 780 aa, Influenza virus; identical to SEQ ID NO: 419643
  MOD_RES (16)..(18): Any amino acid
  MOD_RES (35)..(36): Any amino acid
  MOD_RES (73)..(101): Any amino acid
  MOD_RES (117)..(121): Any amino acid
  MOD_RES (132)..(139): Any amino acid
  MOD_RES (166)..(168): Any amino acid
  MOD_RES (179)..(180): Any amino acid
  MOD_RES (197)..(210): Any amino acid
  MOD_RES (305)..(308): Any amino acid
  MOD_RES (337)..(337): Any amino acid
  MOD_RES (351)..(353): Any amino acid
  MOD_RES (368)..(370): Any amino acid
  MOD_RES (381)..(382): Any amino acid
  MOD_RES (393)..(411): Any amino acid
  MOD_RES (431)..(446): Any amino acid
  MOD_RES (459)..(491): Any amino acid
  MOD_RES (507)..(507): Any amino acid
  MOD_RES (572)..(583): Any amino acid
  MOD_RES (598)..(603): Any amino acid
  MOD_RES (674)..(675): Any amino acid
  MOD_RES (687)..(698): Any amino acid
  MOD_RES (723)..(731): Any amino acid
  MOD_RES (744)..(746): Any amino acid

SEQ ID NO: 420948 - protein, 780 aa, Influenza virus; identical to SEQ ID NO: 419644
  MOD_RES (1)..(20): Any amino acid
  MOD_RES (59)..(62): Any amino acid
  MOD_RES (73)..(101): Any amino acid
  MOD_RES (115)..(121): Any amino acid
  MOD_RES (132)..(139): Any amino acid
  MOD_RES (166)..(168): Any amino acid
  MOD_RES (179)..(183): Any amino acid
  MOD_RES (197)..(224): Any amino acid
  MOD_RES (248)..(252): Any amino acid
  MOD_RES (273)..(274): Any amino acid
  MOD_RES (304)..(308): Any amino acid
  MOD_RES (338)..(340): Any amino acid
  MOD_RES (351)..(354): Any amino acid
  MOD_RES (368)..(370): Any amino acid
  MOD_RES (381)..(382): Any amino acid
  MOD_RES (393)..(411): Any amino acid
  MOD_RES (425)..(447): Any amino acid
  MOD_RES (459)..(491): Any amino acid
  MOD_RES (506)..(507): Any amino acid
  MOD_RES (570)..(583): Any amino acid
  MOD_RES (598)..(620): Any amino acid
  MOD_RES (674)..(675): Any amino acid
  MOD_RES (686)..(698): Any amino acid
  MOD_RES (723)..(731): Any amino acid
  MOD_RES (742)..(764): Any amino acid
  MOD_RES (775)..(780): Any amino acid

SEQ ID NO: 420949 - protein, 780 aa, Influenza virus; identical to SEQ ID NO: 419645
  MOD_RES (1)..(21): Any amino acid
  MOD_RES (32)..(40): Any amino acid
  MOD_RES (51)..(121): Any amino acid
  MOD_RES (132)..(139): Any amino acid
  MOD_RES (166)..(186): Any amino acid
  MOD_RES (197)..(228): Any amino acid
  MOD_RES (248)..(252): Any amino acid
  MOD_RES (277)..(281): Any amino acid
  MOD_RES (297)..(312): Any amino acid
  MOD_RES (338)..(340): Any amino acid
  MOD_RES (351)..(356): Any amino acid
  MOD_RES (367)..(370): Any amino acid
  MOD_RES (381)..(382): Any amino acid
  MOD_RES (393)..(413): Any amino acid
  MOD_RES (434)..(447): Any amino acid
  MOD_RES (459)..(491): Any amino acid
  MOD_RES (507)..(507): Any amino acid
  MOD_RES (524)..(527): Any amino acid
  MOD_RES (558)..(587): Any amino acid
  MOD_RES (601)..(620): Any amino acid
  MOD_RES (653)..(653): Any amino acid
  MOD_RES (674)..(675): Any amino acid
  MOD_RES (686)..(707): Any amino acid
  MOD_RES (731)..(767): Any amino acid
  MOD_RES (778)..(780): Any amino acid

SEQ ID NO: 420950 - protein, 742 aa, Influenza virus; identical to SEQ ID NO: 419654
  MOD_RES (13)..(14): Any amino acid
  MOD_RES (27)..(31): Any amino acid
  MOD_RES (49)..(74): Any amino acid
  MOD_RES (97)..(154): Any amino acid
  MOD_RES (167)..(223): Any amino acid
  MOD_RES (235)..(280): Any amino acid
  MOD_RES (292)..(298): Any amino acid
  MOD_RES (314)..(341): Any amino acid
  MOD_RES (360)..(369): Any amino acid
  MOD_RES (381)..(383): Any amino acid
  MOD_RES (397)..(422): Any amino acid
  MOD_RES (473)..(477): Any amino acid
  MOD_RES (491)..(496): Any amino acid
  MOD_RES (509)..(641): Any amino acid
  MOD_RES (661)..(681): Any amino acid
  MOD_RES (698)..(718): Any amino acid
  MOD_RES (734)..(742): Any amino acid

SEQ ID NO: 420951 - protein, 742 aa, Influenza virus; identical to SEQ ID NO: 419655
  MOD_RES (13)..(14): Any amino acid
  MOD_RES (27)..(40): Any amino acid
  MOD_RES (52)..(223): Any amino acid
  MOD_RES (235)..(341): Any amino acid
  MOD_RES (357)..(376): Any amino acid
  MOD_RES (390)..(393): Any amino acid
  MOD_RES (405)..(422): Any amino acid
  MOD_RES (434)..(434): Any amino acid
  MOD_RES (472)..(477): Any amino acid
  MOD_RES (491)..(688): Any amino acid
  MOD_RES (706)..(730): Any amino acid

SEQ ID NO: 420952 - protein, 742 aa, Influenza virus; identical to SEQ ID NO: 419656
  MOD_RES (1)..(14): Any amino acid
  MOD_RES (27)..(43): Any amino acid
  MOD_RES (55)..(223): Any amino acid
  MOD_RES (235)..(341): Any amino acid
  MOD_RES (353)..(378): Any amino acid
  MOD_RES (390)..(424): Any amino acid
  MOD_RES (449)..(459): Any amino acid
  MOD_RES (471)..(477): Any amino acid
  MOD_RES (489)..(730): Any amino acid
  MOD_RES (742)..(742): Any amino acid

SEQ ID NO: 420953 - protein, 742 aa, Influenza virus; identical to SEQ ID NO: 419657
  MOD_RES (1)..(17): Any amino acid
  MOD_RES (29)..(43): Any amino acid
  MOD_RES (55)..(233): Any amino acid
  MOD_RES (245)..(432): Any amino acid
  MOD_RES (457)..(459): Any amino acid
  MOD_RES (471)..(730): Any amino acid

SEQ ID NO: 420954 - protein, 742 aa, Influenza virus; identical to SEQ ID NO: 419658
  MOD_RES (1)..(17): Any amino acid
  MOD_RES (29)..(434): Any amino acid
  MOD_RES (447)..(459): Any amino acid
  MOD_RES (472)..(742): Any amino acid

SEQ ID NO: 420955 - protein, 694 aa, Influenza virus; identical to SEQ ID NO: 419666
  MOD_RES (33)..(76): Any amino acid
  MOD_RES (90)..(410): Any amino acid
  MOD_RES (423)..(425): Any amino acid
  MOD_RES (437)..(441): Any amino acid
  MOD_RES (453)..(453): Any amino acid
  MOD_RES (465)..(473): Any amino acid
  MOD_RES (485)..(546): Any amino acid
  MOD_RES (559)..(659): Any amino acid
  MOD_RES (679)..(683): Any amino acid

SEQ ID NO: 420956 - protein, 694 aa, Influenza virus; identical to SEQ ID NO: 419667
  MOD_RES (22)..(410): Any amino acid
  MOD_RES (423)..(425): Any amino acid
  MOD_RES (437)..(441): Any amino acid
  MOD_RES (453)..(453): Any amino acid
  MOD_RES (465)..(546): Any amino acid
  MOD_RES (558)..(677): Any amino acid
  MOD_RES (689)..(694): Any amino acid

SEQ ID NO: 420957 - protein, 694 aa, Influenza virus; identical to SEQ ID NO: 419668
  MOD_RES (1)..(1): Any amino acid
  MOD_RES (22)..(411): Any amino acid
  MOD_RES (423)..(425): Any amino acid
  MOD_RES (437)..(441): Any amino acid
  MOD_RES (453)..(694): Any amino acid

SEQ ID NO: 420958 - protein, 694 aa, Influenza virus; identical to SEQ ID NO: 419669
  MOD_RES (1)..(5): Any amino acid
  MOD_RES (29)..(417): Any amino acid
  MOD_RES (430)..(441): Any amino acid
  MOD_RES (453)..(694): Any amino acid

SEQ ID NO: 420959 - protein, 694 aa, Influenza virus; identical to SEQ ID NO: 419670
  MOD_RES (1)..(5): Any amino acid
  MOD_RES (32)..(441): Any amino acid
  MOD_RES (453)..(694): Any amino acid

SEQ ID NO: 420960 - protein, 502 aa, Influenza virus; identical to SEQ ID NO: 419672
  MOD_RES (22)..(43): Any amino acid
  MOD_RES (55)..(120): Any amino acid
  MOD_RES (141)..(141): Any amino acid
  MOD_RES (165)..(166): Any amino acid
  MOD_RES (178)..(178): Any amino acid
  MOD_RES (224)..(237): Any amino acid
  MOD_RES (249)..(249): Any amino acid
  MOD_RES (262)..(262): Any amino acid
  MOD_RES (274)..(276): Any amino acid
  MOD_RES (288)..(289): Any amino acid
  MOD_RES (303)..(308): Any amino acid
  MOD_RES (326)..(333): Any amino acid
  MOD_RES (347)..(372): Any amino acid
  MOD_RES (384)..(389): Any amino acid
  MOD_RES (401)..(416): Any amino acid
  MOD_RES (452)..(454): Any amino acid
  MOD_RES (471)..(472): Any amino acid
  MOD_RES (496)..(502): Any amino acid

SEQ ID NO: 420961 - protein, 502 aa, Influenza virus; identical to SEQ ID NO: 419673
  MOD_RES (22)..(43): Any amino acid
  MOD_RES (55)..(120): Any amino acid
  MOD_RES (141)..(141): Any amino acid
  MOD_RES (165)..(166): Any amino acid
  MOD_RES (178)..(178): Any amino acid
  MOD_RES (192)..(192): Any amino acid
  MOD_RES (224)..(237): Any amino acid
  MOD_RES (249)..(249): Any amino acid
  MOD_RES (262)..(268): Any amino acid
  MOD_RES (281)..(289): Any amino acid
  MOD_RES (303)..(308): Any amino acid
  MOD_RES (326)..(333): Any amino acid
  MOD_RES (347)..(372): Any amino acid
  MOD_RES (384)..(389): Any amino acid
  MOD_RES (401)..(416): Any amino acid
  MOD_RES (452)..(454): Any amino acid
  MOD_RES (471)..(484): Any amino acid
  MOD_RES (496)..(502): Any amino acid

SEQ ID NO: 420962 - protein, 502 aa, Influenza virus; identical to SEQ ID NO: 419674
  MOD_RES (1)..(1): Any amino acid
  MOD_RES (22)..(120): Any amino acid
  MOD_RES (141)..(141): Any amino acid
  MOD_RES (165)..(166): Any amino acid
  MOD_RES (178)..(178): Any amino acid
  MOD_RES (224)..(237): Any amino acid
  MOD_RES (249)..(249): Any amino acid
  MOD_RES (262)..(276): Any amino acid
  MOD_RES (288)..(289): Any amino acid
  MOD_RES (303)..(312): Any amino acid
  MOD_RES (326)..(333): Any amino acid
  MOD_RES (347)..(372): Any amino acid
  MOD_RES (384)..(389): Any amino acid
  MOD_RES (401)..(416): Any amino acid
  MOD_RES (452)..(455): Any amino acid
  MOD_RES (471)..(484): Any amino acid
  MOD_RES (496)..(502): Any amino acid

SEQ ID NO: 420963 - protein, 502 aa, Influenza virus; identical to SEQ ID NO: 419675
  MOD_RES (1)..(5): Any amino acid
  MOD_RES (32)..(120): Any amino acid
  MOD_RES (132)..(141): Any amino acid
  MOD_RES (153)..(153): Any amino acid
  MOD_RES (165)..(166): Any amino acid
  MOD_RES (178)..(192): Any amino acid
  MOD_RES (224)..(249): Any amino acid
  MOD_RES (262)..(276): Any amino acid
  MOD_RES (288)..(289): Any amino acid
  MOD_RES (303)..(312): Any amino acid
  MOD_RES (326)..(333): Any amino acid
  MOD_RES (347)..(372): Any amino acid
  MOD_RES (384)..(416): Any amino acid
  MOD_RES (428)..(435): Any amino acid
  MOD_RES (452)..(455): Any amino acid
  MOD_RES (468)..(484): Any amino acid
  MOD_RES (496)..(502): Any amino acid

SEQ ID NO: 420964 - protein, 502 aa, Influenza virus; identical to SEQ ID NO: 419676
  MOD_RES (1)..(8): Any amino acid
  MOD_RES (22)..(129): Any amino acid
  MOD_RES (141)..(141): Any amino acid
  MOD_RES (153)..(153): Any amino acid
  MOD_RES (165)..(192): Any amino acid
  MOD_RES (224)..(249): Any amino acid
  MOD_RES (262)..(289): Any amino acid
  MOD_RES (303)..(335): Any amino acid
  MOD_RES (347)..(416): Any amino acid
  MOD_RES (428)..(435): Any amino acid
  MOD_RES (450)..(455): Any amino acid
  MOD_RES (471)..(484): Any amino acid
  MOD_RES (496)..(502): Any amino acid

SEQ ID NO: 420965 - protein, 494 aa, Influenza virus; identical to SEQ ID NO: 419678
  MOD_RES (17)..(53): Any amino acid
  MOD_RES (65)..(71): Any amino acid
  MOD_RES (83)..(85): Any amino acid
  MOD_RES (98)..(115): Any amino acid
  MOD_RES (127)..(127): Any amino acid
  MOD_RES (139)..(141): Any amino acid
  MOD_RES (155)..(167): Any amino acid
  MOD_RES (206)..(235): Any amino acid
  MOD_RES (249)..(250): Any amino acid
  MOD_RES (273)..(285): Any amino acid
  MOD_RES (331)..(333): Any amino acid
  MOD_RES (347)..(434): Any amino acid
  MOD_RES (449)..(456): Any amino acid
  MOD_RES (490)..(494): Any amino acid

SEQ ID NO: 420966 - protein, 494 aa, Influenza virus; identical to SEQ ID NO: 419679
  MOD_RES (1)..(12): Any amino acid
  MOD_RES (24)..(53): Any amino acid
  MOD_RES (65)..(115): Any amino acid
  MOD_RES (127)..(127): Any amino acid
  MOD_RES (139)..(141): Any amino acid
  MOD_RES (153)..(167): Any amino acid
  MOD_RES (206)..(235): Any amino acid
  MOD_RES (249)..(250): Any amino acid
  MOD_RES (273)..(285): Any amino acid
  MOD_RES (320)..(333): Any amino acid
  MOD_RES (347)..(434): Any amino acid
  MOD_RES (449)..(456): Any amino acid
  MOD_RES (490)..(494): Any amino acid

SEQ ID NO: 420967 - protein, 494 aa, Influenza virus; identical to SEQ ID NO: 419680
  MOD_RES (1)..(53): Any amino acid
  MOD_RES (65)..(115): Any amino acid
  MOD_RES (127)..(127): Any amino acid
  MOD_RES (139)..(141): Any amino acid
  MOD_RES (153)..(167): Any amino acid
  MOD_RES (206)..(237): Any amino acid
  MOD_RES (249)..(250): Any amino acid
  MOD_RES (262)..(285): Any amino acid
  MOD_RES (300)..(303): Any amino acid
  MOD_RES (320)..(333): Any amino acid
  MOD_RES (347)..(437): Any amino acid
  MOD_RES (449)..(456): Any amino acid
  MOD_RES (490)..(494): Any amino acid

SEQ ID NO: 420968 - protein, 494 aa, Influenza virus; identical to SEQ ID NO: 419681
  MOD_RES (1)..(58): Any amino acid
  MOD_RES (72)..(115): Any amino acid
  MOD_RES (127)..(127): Any amino acid
  MOD_RES (139)..(167): Any amino acid
  MOD_RES (206)..(237): Any amino acid
  MOD_RES (249)..(250): Any amino acid
  MOD_RES (262)..(288): Any amino acid
  MOD_RES (300)..(303): Any amino acid
  MOD_RES (315)..(335): Any amino acid
  MOD_RES (347)..(456): Any amino acid
  MOD_RES (490)..(494): Any amino acid

SEQ ID NO: 420969 - protein, 494 aa, Influenza virus; identical to SEQ ID NO: 419682
  MOD_RES (1)..(115): Any amino acid
  MOD_RES (127)..(167): Any amino acid
  MOD_RES (190)..(260): Any amino acid
  MOD_RES (272)..(288): Any amino acid
  MOD_RES (300)..(303): Any amino acid
  MOD_RES (316)..(335): Any amino acid
  MOD_RES (347)..(456): Any amino acid
  MOD_RES (474)..(478): Any amino acid
  MOD_RES (493)..(494): Any amino acid

SEQ ID NO: 420970 - protein, 515 aa, Influenza virus; identical to SEQ ID NO: 419686
  MOD_RES (1)..(88): Any amino acid
  MOD_RES (112)..(114): Any amino acid
  MOD_RES (127)..(128): Any amino acid
  MOD_RES (143)..(150): Any amino acid
  MOD_RES (163)..(175): Any amino acid
  MOD_RES (195)..(266): Any amino acid
  MOD_RES (281)..(318): Any amino acid
  MOD_RES (332)..(332): Any amino acid
  MOD_RES (379)..(438): Any amino acid
  MOD_RES (458)..(460): Any amino acid
  MOD_RES (476)..(481): Any amino acid

SEQ ID NO: 420971 - protein, 515 aa, Influenza virus; identical to SEQ ID NO: 419687
  MOD_RES (1)..(88): Any amino acid
  MOD_RES (112)..(114): Any amino acid
  MOD_RES (127)..(128): Any amino acid
  MOD_RES (143)..(150): Any amino acid
  MOD_RES (163)..(175): Any amino acid
  MOD_RES (195)..(266): Any amino acid
  MOD_RES (281)..(318): Any amino acid
  MOD_RES (332)..(332): Any amino acid
  MOD_RES (379)..(438): Any amino acid
  MOD_RES (458)..(460): Any amino acid
  MOD_RES (476)..(481): Any amino acid

SEQ ID NO: 420972 - protein, 515 aa, Influenza virus; identical to SEQ ID NO: 419688
  MOD_RES (1)..(88): Any amino acid
  MOD_RES (112)..(114): Any amino acid
  MOD_RES (126)..(128): Any amino acid
  MOD_RES (141)..(150): Any amino acid
  MOD_RES (163)..(175): Any amino acid
  MOD_RES (195)..(266): Any amino acid
  MOD_RES (279)..(318): Any amino acid
  MOD_RES (332)..(332): Any amino acid
  MOD_RES (379)..(438): Any amino acid
  MOD_RES (458)..(460): Any amino acid
  MOD_RES (476)..(481): Any amino acid
  MOD_RES (501)..(503): Any amino acid

SEQ ID NO: 420973 - protein, 515 aa, Influenza virus; identical to SEQ ID NO: 419689
  MOD_RES (1)..(100): Any amino acid
  MOD_RES (112)..(114): Any amino acid
  MOD_RES (127)..(129): Any amino acid
  MOD_RES (143)..(150): Any amino acid
  MOD_RES (163)..(178): Any amino acid
  MOD_RES (195)..(266): Any amino acid
  MOD_RES (278)..(318): Any amino acid
  MOD_RES (331)..(332): Any amino acid
  MOD_RES (379)..(438): Any amino acid
  MOD_RES (458)..(460): Any amino acid
  MOD_RES (472)..(481): Any amino acid
  MOD_RES (503)..(503): Any amino acid
  MOD_RES (515)..(515): Any amino acid

SEQ ID NO: 420974 - protein, 515 aa, Influenza virus; identical to SEQ ID NO: 419690
  MOD_RES (1)..(114): Any amino acid
  MOD_RES (126)..(130): Any amino acid
  MOD_RES (143)..(150): Any amino acid
  MOD_RES (163)..(266): Any amino acid
  MOD_RES (278)..(318): Any amino acid
  MOD_RES (332)..(341): Any amino acid
  MOD_RES (379)..(438): Any amino acid
  MOD_RES (458)..(464): Any amino acid
  MOD_RES (476)..(485): Any amino acid
  MOD_RES (509)..(515): Any amino acid

SEQ ID NO: 420975 - protein, 470 aa, Influenza virus; identical to SEQ ID NO: 419694
  MOD_RES (14)..(16): Any amino acid
  MOD_RES (44)..(47): Any amino acid
  MOD_RES (73)..(89): Any amino acid
  MOD_RES (264)..(269): Any amino acid
  MOD_RES (328)..(335): Any amino acid

SEQ ID NO: 420976 - protein, 470 aa, Influenza virus; identical to SEQ ID NO: 419695
  MOD_RES (14)..(16): Any amino acid
  MOD_RES (44)..(47): Any amino acid
  MOD_RES (73)..(89): Any amino acid
  MOD_RES (105)..(109): Any amino acid
  MOD_RES (136)..(151): Any amino acid
  MOD_RES (173)..(176): Any amino acid
  MOD_RES (216)..(230): Any amino acid
  MOD_RES (264)..(269): Any amino acid
  MOD_RES (328)..(335): Any amino acid
  MOD_RES (349)..(354): Any amino acid
  MOD_RES (422)..(422): Any amino acid

SEQ ID NO: 420977 - protein, 470 aa, Influenza virus; identical to SEQ ID NO: 419696
  MOD_RES (14)..(16): Any amino acid
  MOD_RES (44)..(52): Any amino acid
  MOD_RES (73)..(89): Any amino acid
  MOD_RES (104)..(110): Any amino acid
  MOD_RES (137)..(151): Any amino acid
  MOD_RES (173)..(181): Any amino acid
  MOD_RES (226)..(230): Any amino acid
  MOD_RES (264)..(269): Any amino acid
  MOD_RES (287)..(293): Any amino acid
  MOD_RES (327)..(335): Any amino acid
  MOD_RES (347)..(355): Any amino acid
  MOD_RES (398)..(409): Any amino acid
  MOD_RES (468)..(470): Any amino acid

SEQ ID NO: 420978 - protein, 470 aa, Influenza virus; identical to SEQ ID NO: 419697
  MOD_RES (1)..(2): Any amino acid
  MOD_RES (14)..(16): Any amino acid
  MOD_RES (42)..(54): Any amino acid
  MOD_RES (72)..(111): Any amino acid
  MOD_RES (137)..(154): Any amino acid
  MOD_RES (172)..(188): Any amino acid
  MOD_RES (221)..(236): Any amino acid
  MOD_RES (263)..(269): Any amino acid
  MOD_RES (287)..(298): Any amino acid
  MOD_RES (328)..(364): Any amino acid
  MOD_RES (395)..(427): Any amino acid
  MOD_RES (468)..(470): Any amino acid

SEQ ID NO: 420979 - protein, 470 aa, Influenza virus; identical to SEQ ID NO: 419698
  MOD_RES (1)..(2): Any amino acid
  MOD_RES (14)..(16): Any amino acid
  MOD_RES (44)..(58): Any amino acid
  MOD_RES (73)..(120): Any amino acid
  MOD_RES (137)..(159): Any amino acid
  MOD_RES (171)..(196): Any amino acid
  MOD_RES (210)..(243): Any amino acid
  MOD_RES (264)..(269): Any amino acid
  MOD_RES (285)..(302): Any amino acid
  MOD_RES (327)..(373): Any amino acid
  MOD_RES (385)..(444): Any amino acid
  MOD_RES (464)..(470): Any amino acid

SEQ ID NO: 420980 - protein, 473 aa, Influenza virus; identical to SEQ ID NO: 419701
  MOD_RES (18)..(80): Any amino acid
  MOD_RES (189)..(190): Any amino acid
  MOD_RES (234)..(234): Any amino acid
  MOD_RES (256)..(264): Any amino acid
  MOD_RES (302)..(308): Any amino acid
  MOD_RES (329)..(336): Any amino acid
  MOD_RES (366)..(367): Any amino acid
  MOD_RES (383)..(393): Any amino acid
  MOD_RES (413)..(418): Any amino acid

SEQ ID NO: 420981 - protein, 473 aa, Influenza virus; identical to SEQ ID NO: 419702
  MOD_RES (1)..(2): Any amino acid
  MOD_RES (18)..(80): Any amino acid
  MOD_RES (189)..(190): Any amino acid
  MOD_RES (234)..(234): Any amino acid
  MOD_RES (256)..(264): Any amino acid
  MOD_RES (302)..(308): Any amino acid
  MOD_RES (329)..(336): Any amino acid
  MOD_RES (366)..(367): Any amino acid
  MOD_RES (383)..(393): Any amino acid
  MOD_RES (413)..(418): Any amino acid
  MOD_RES (472)..(473): Any amino acid

SEQ ID NO: 420982 - protein, 473 aa, Influenza virus; identical to SEQ ID NO: 419703
  MOD_RES (1)..(2): Any amino acid
  MOD_RES (18)..(80): Any amino acid
  MOD_RES (108)..(109): Any amino acid
  MOD_RES (133)..(133): Any amino acid
  MOD_RES (148)..(151): Any amino acid
  MOD_RES (189)..(190): Any amino acid
  MOD_RES (234)..(235): Any amino acid
  MOD_RES (256)..(264): Any amino acid
  MOD_RES (293)..(308): Any amino acid
  MOD_RES (329)..(336): Any amino acid
  MOD_RES (366)..(367): Any amino acid
  MOD_RES (381)..(393): Any amino acid
  MOD_RES (409)..(423): Any amino acid
  MOD_RES (470)..(473): Any amino acid

SEQ ID NO: 420983 - protein, 473 aa, Influenza virus; identical to SEQ ID NO: 419704
  MOD_RES (1)..(2): Any amino acid
  MOD_RES (14)..(80): Any amino acid
  MOD_RES (131)..(153): Any amino acid
  MOD_RES (186)..(190): Any amino acid
  MOD_RES (234)..(235): Any amino acid
  MOD_RES (256)..(264): Any amino acid
  MOD_RES (295)..(308): Any amino acid
  MOD_RES (329)..(336): Any amino acid
  MOD_RES (366)..(367): Any amino acid
  MOD_RES (382)..(393): Any amino acid
  MOD_RES (408)..(425): Any amino acid
  MOD_RES (473)..(473): Any amino acid

SEQ ID NO: 420984 - protein, 473 aa, Influenza virus; identical to SEQ ID NO: 419705
  MOD_RES (1)..(3): Any amino acid
  MOD_RES (18)..(85): Any amino acid
  MOD_RES (105)..(113): Any amino acid
  MOD_RES (135)..(159): Any amino acid
  MOD_RES (175)..(177): Any amino acid
  MOD_RES (189)..(192): Any amino acid
  MOD_RES (229)..(240): Any amino acid
  MOD_RES (256)..(265): Any amino acid
  MOD_RES (294)..(317): Any amino acid
  MOD_RES (329)..(337): Any amino acid
  MOD_RES (349)..(354): Any amino acid
  MOD_RES (366)..(368): Any amino acid
  MOD_RES (383)..(393): Any amino acid
  MOD_RES (410)..(432): Any amino acid
  MOD_RES (446)..(447): Any amino acid
  MOD_RES (459)..(473): Any amino acid

SEQ ID NO: 420985 - protein, 471 aa, Influenza virus; identical to SEQ ID NO: 419710
  MOD_RES (20)..(55): Any amino acid
  MOD_RES (67)..(89): Any amino acid
  MOD_RES (128)..(128): Any amino acid
  MOD_RES (173)..(174): Any amino acid
  MOD_RES (210)..(214): Any amino acid
  MOD_RES (250)..(271): Any amino acid
  MOD_RES (286)..(288): Any amino acid
  MOD_RES (308)..(317): Any amino acid
  MOD_RES (331)..(343): Any amino acid
  MOD_RES (360)..(360): Any amino acid
  MOD_RES (386)..(397): Any amino acid
  MOD_RES (416)..(417): Any amino acid
  MOD_RES (437)..(438): Any amino acid

SEQ ID NO: 420986 - protein, 471 aa, Influenza virus; identical to SEQ ID NO: 419711
  MOD_RES (20)..(89): Any amino acid
  MOD_RES (128)..(128): Any amino acid
  MOD_RES (173)..(174): Any amino acid
  MOD_RES (210)..(214): Any amino acid
  MOD_RES (250)..(271): Any amino acid
  MOD_RES (286)..(288): Any amino acid
  MOD_RES (308)..(317): Any amino acid
  MOD_RES (331)..(343): Any amino acid
  MOD_RES (360)..(360): Any amino acid
  MOD_RES (386)..(397): Any amino acid
  MOD_RES (416)..(417): Any amino acid
  MOD_RES (437)..(438): Any amino acid

SEQ ID NO: 420987 - protein, 471 aa, Influenza virus; identical to SEQ ID NO: 419712
  MOD_RES (20)..(89): Any amino acid
  MOD_RES (128)..(128): Any amino acid
  MOD_RES (173)..(174): Any amino acid
  MOD_RES (205)..(214): Any amino acid
  MOD_RES (250)..(271): Any amino acid
  MOD_RES (284)..(288): Any amino acid
  MOD_RES (308)..(317): Any amino acid
  MOD_RES (331)..(343): Any amino acid
  MOD_RES (360)..(361): Any amino acid
  MOD_RES (386)..(397): Any amino acid
  MOD_RES (416)..(417): Any amino acid
  MOD_RES (437)..(438): Any amino acid

SEQ ID NO: 420988 - protein, 471 aa, Influenza virus; identical to SEQ ID NO: 419713
  MOD_RES (1)..(1): Any amino acid
  MOD_RES (20)..(89): Any amino acid
  MOD_RES (123)..(139): Any amino acid
  MOD_RES (173)..(174): Any amino acid
  MOD_RES (207)..(214): Any amino acid
  MOD_RES (243)..(271): Any amino acid
  MOD_RES (284)..(288): Any amino acid
  MOD_RES (308)..(317): Any amino acid
  MOD_RES (331)..(343): Any amino acid
  MOD_RES (360)..(361): Any amino acid
  MOD_RES (383)..(397): Any amino acid
  MOD_RES (416)..(424): Any amino acid
  MOD_RES (436)..(438): Any amino acid
  MOD_RES (466)..(471): Any amino acid

SEQ ID NO: 420989 - protein, 471 aa, Influenza virus; identical to SEQ ID NO: 419714
  MOD_RES (1)..(2): Any amino acid
  MOD_RES (14)..(90): Any amino acid
  MOD_RES (123)..(140): Any amino acid
  MOD_RES (173)..(178): Any amino acid
  MOD_RES (210)..(214): Any amino acid
  MOD_RES (226)..(231): Any amino acid
  MOD_RES (243)..(317): Any amino acid
  MOD_RES (331)..(347): Any amino acid
  MOD_RES (360)..(370): Any amino acid
  MOD_RES (386)..(398): Any amino acid
  MOD_RES (415)..(425): Any amino acid
  MOD_RES (437)..(439): Any amino acid
  MOD_RES (451)..(471): Any amino acid

SEQ ID NO: 420990 - protein, 471 aa, Influenza virus; identical to SEQ ID NO: 419717
  MOD_RES (16)..(20): Any amino acid
  MOD_RES (38)..(61): Any amino acid
  MOD_RES (73)..(82): Any amino acid
  MOD_RES (94)..(95): Any amino acid
  MOD_RES (164)..(168): Any amino acid
  MOD_RES (194)..(194): Any amino acid
  MOD_RES (239)..(267): Any amino acid
  MOD_RES (285)..(286): Any amino acid
  MOD_RES (308)..(317): Any amino acid
  MOD_RES (331)..(333): Any amino acid
  MOD_RES (357)..(358): Any amino acid
  MOD_RES (384)..(400): Any amino acid
  MOD_RES (416)..(416): Any amino acid

SEQ ID NO: 420991 - protein, 471 aa, Influenza virus; identical to SEQ ID NO: 419718
  MOD_RES (16)..(20): Any amino acid
  MOD_RES (38)..(61): Any amino acid
  MOD_RES (73)..(82): Any amino acid
  MOD_RES (94)..(95): Any amino acid
  MOD_RES (161)..(168): Any amino acid
  MOD_RES (194)..(194): Any amino acid
  MOD_RES (239)..(267): Any amino acid
  MOD_RES (285)..(286): Any amino acid
  MOD_RES (308)..(317): Any amino acid
  MOD_RES (331)..(333): Any amino acid
  MOD_RES (357)..(358): Any amino acid
  MOD_RES (384)..(400): Any amino acid
  MOD_RES (416)..(416): Any amino acid
  MOD_RES (471)..(471): Any amino acid

SEQ ID NO: 420992 - protein, 471 aa, Influenza virus; identical to SEQ ID NO: 419719
  MOD_RES (16)..(20): Any amino acid
  MOD_RES (38)..(61): Any amino acid
  MOD_RES (73)..(82): Any amino acid
  MOD_RES (94)..(95): Any amino acid
  MOD_RES (164)..(168): Any amino acid
  MOD_RES (194)..(194): Any amino acid
  MOD_RES (238)..(267): Any amino acid
  MOD_RES (284)..(286): Any amino acid
  MOD_RES (308)..(318): Any amino acid
  MOD_RES (331)..(333): Any amino acid
  MOD_RES (349)..(358): Any amino acid
  MOD_RES (384)..(400): Any amino acid
  MOD_RES (416)..(416): Any amino acid
  MOD_RES (429)..(429): Any amino acid

SEQ ID NO: 420993 - protein, 471 aa, Influenza virus; identical to SEQ ID NO: 419720
  MOD_RES (16)..(20): Any amino acid
  MOD_RES (33)..(61): Any amino acid
  MOD_RES (73)..(82): Any amino acid
  MOD_RES (94)..(95): Any amino acid
  MOD_RES (164)..(168): Any amino acid
  MOD_RES (194)..(194): Any amino acid
  MOD_RES (239)..(267): Any amino acid
  MOD_RES (285)..(286): Any amino acid
  MOD_RES (308)..(318): Any amino acid
  MOD_RES (331)..(334): Any amino acid
  MOD_RES (357)..(358): Any amino acid
  MOD_RES (382)..(416): Any amino acid
  MOD_RES (429)..(431): Any amino acid
  MOD_RES (470)..(471): Any amino acid

SEQ ID NO: 420994 - protein, 471 aa, Influenza virus; identical to SEQ ID NO: 419721
  MOD_RES (12)..(20): Any amino acid
  MOD_RES (38)..(61): Any amino acid
  MOD_RES (73)..(82): Any amino acid
  MOD_RES (94)..(95): Any amino acid
  MOD_RES (110)..(115): Any amino acid
  MOD_RES (127)..(146): Any amino acid
  MOD_RES (164)..(168): Any amino acid
  MOD_RES (182)..(182): Any amino acid
  MOD_RES (194)..(194): Any amino acid
  MOD_RES (239)..(267): Any amino acid
  MOD_RES (279)..(286): Any amino acid
  MOD_RES (307)..(318): Any amino acid
  MOD_RES (331)..(334): Any amino acid
  MOD_RES (357)..(358): Any amino acid
  MOD_RES (383)..(416): Any amino acid
  MOD_RES (428)..(443): Any amino acid
  MOD_RES (455)..(455): Any amino acid

SEQ ID NO: 420995 - protein, 548 aa, Influenza virus; identical to SEQ ID NO: 419725
  MOD_RES (1)..(168): Any amino acid
  MOD_RES (201)..(201): Any amino acid
  MOD_RES (237)..(237): Any amino acid
  MOD_RES (266)..(294): Any amino acid
  MOD_RES (326)..(344): Any amino acid
  MOD_RES (381)..(383): Any amino acid
  MOD_RES (408)..(417): Any amino acid
  MOD_RES (435)..(470): Any amino acid
  MOD_RES (489)..(492): Any amino acid
  MOD_RES (510)..(510): Any amino acid
  MOD_RES (527)..(529): Any amino acid

SEQ ID NO: 420996 - protein, 548 aa, Influenza virus; identical to SEQ ID NO: 419726
  MOD_RES (1)..(168): Any amino acid
  MOD_RES (199)..(201): Any amino acid
  MOD_RES (237)..(237): Any amino acid
  MOD_RES (266)..(294): Any amino acid
  MOD_RES (326)..(344): Any amino acid
  MOD_RES (381)..(383): Any amino acid
  MOD_RES (408)..(417): Any amino acid
  MOD_RES (435)..(470): Any amino acid
  MOD_RES (489)..(495): Any amino acid
  MOD_RES (510)..(510): Any amino acid
  MOD_RES (527)..(529): Any amino acid
  MOD_RES (542)..(548): Any amino acid

SEQ ID NO: 420997 - protein, 548 aa, Influenza virus; identical to SEQ ID NO: 419727
  MOD_RES (1)..(168): Any amino acid
  MOD_RES (201)..(201): Any amino acid
  MOD_RES (237)..(237): Any amino acid
  MOD_RES (266)..(294): Any amino acid
  MOD_RES (326)..(344): Any amino acid
  MOD_RES (381)..(383): Any amino acid
  MOD_RES (408)..(417): Any amino acid
  MOD_RES (435)..(470): Any amino acid
  MOD_RES (489)..(495): Any amino acid
  MOD_RES (510)..(510): Any amino acid
  MOD_RES (527)..(529): Any amino acid
  MOD_RES (542)..(548): Any amino acid

SEQ ID NO: 420998 - protein, 548 aa, Influenza virus; identical to SEQ ID NO: 419728
  MOD_RES (1)..(168): Any amino acid
  MOD_RES (191)..(201): Any amino acid
  MOD_RES (237)..(237): Any amino acid
  MOD_RES (266)..(294): Any amino acid
  MOD_RES (306)..(309): Any amino acid
  MOD_RES (326)..(344): Any amino acid
  MOD_RES (380)..(383): Any amino acid
  MOD_RES (395)..(395): Any amino acid
  MOD_RES (408)..(421): Any amino acid
  MOD_RES (435)..(470): Any amino acid
  MOD_RES (489)..(498): Any amino acid
  MOD_RES (510)..(510): Any amino acid
  MOD_RES (527)..(529): Any amino acid
  MOD_RES (541)..(548): Any amino acid

SEQ ID NO: 420999 - protein, 548 aa, Influenza virus; identical to SEQ ID NO: 419729
  MOD_RES (1)..(169): Any amino acid
  MOD_RES (201)..(203): Any amino acid
  MOD_RES (222)..(225): Any amino acid
  MOD_RES (237)..(242): Any amino acid
  MOD_RES (258)..(294): Any amino acid
  MOD_RES (308)..(344): Any amino acid
  MOD_RES (357)..(368): Any amino acid
  MOD_RES (380)..(383): Any amino acid
  MOD_RES (395)..(395): Any amino acid
  MOD_RES (408)..(515): Any amino acid
  MOD_RES (527)..(529): Any amino acid

SEQ ID NO: 421000 - protein, 470 aa, Influenza virus; identical to SEQ ID NO: 419732
  MOD_RES (16)..(26): Any amino acid
  MOD_RES (40)..(84): Any amino acid
  MOD_RES (211)..(211): Any amino acid
  MOD_RES (260)..(269): Any amino acid
  MOD_RES (286)..(288): Any amino acid
  MOD_RES (310)..(310): Any amino acid
  MOD_RES (359)..(359): Any amino acid
  MOD_RES (392)..(392): Any amino acid

SEQ ID NO: 421001 - protein, 470 aa, Influenza virus; identical to SEQ ID NO: 419733
  MOD_RES (16)..(26): Any amino acid
  MOD_RES (40)..(84): Any amino acid
  MOD_RES (211)..(211): Any amino acid
  MOD_RES (260)..(269): Any amino acid
  MOD_RES (284)..(288): Any amino acid
  MOD_RES (310)..(310): Any amino acid
  MOD_RES (359)..(359): Any amino acid
  MOD_RES (392)..(392): Any amino acid
  MOD_RES (447)..(448): Any amino acid
  MOD_RES (470)..(470): Any amino acid

SEQ ID NO: 421002 - protein, 470 aa, Influenza virus; identical to SEQ ID NO: 419734
  MOD_RES (16)..(26): Any amino acid
  MOD_RES (40)..(84): Any amino acid
  MOD_RES (139)..(149): Any amino acid
  MOD_RES (211)..(211): Any amino acid
  MOD_RES (225)..(225): Any amino acid
  MOD_RES (260)..(269): Any amino acid
  MOD_RES (286)..(288): Any amino acid
  MOD_RES (310)..(310): Any amino acid
  MOD_RES (322)..(323): Any amino acid
  MOD_RES (359)..(359): Any amino acid
  MOD_RES (392)..(392): Any amino acid
  MOD_RES (448)..(454): Any amino acid

SEQ ID NO: 421003 - protein, 470 aa, Influenza virus; identical to SEQ ID NO: 419735
  MOD_RES (14)..(26): Any amino acid
  MOD_RES (38)..(84): Any amino acid
  MOD_RES (140)..(153): Any amino acid
  MOD_RES (174)..(179): Any amino acid
  MOD_RES (194)..(196): Any amino acid
  MOD_RES (208)..(211): Any amino acid
  MOD_RES (225)..(227): Any amino acid
  MOD_RES (260)..(271): Any amino acid
  MOD_RES (283)..(310): Any amino acid
  MOD_RES (322)..(323): Any amino acid
  MOD_RES (335)..(336): Any amino acid
  MOD_RES (358)..(359): Any amino acid
  MOD_RES (392)..(392): Any amino acid
  MOD_RES (404)..(405): Any amino acid
  MOD_RES (418)..(427): Any amino acid
  MOD_RES (448)..(457): Any amino acid
  MOD_RES (470)..(470): Any amino acid

SEQ ID NO: 421004 - protein, 470 aa, Influenza virus; identical to SEQ ID NO: 419736
  MOD_RES (1)..(2): Any amino acid
  MOD_RES (16)..(84): Any amino acid
  MOD_RES (120)..(179): Any amino acid
  MOD_RES (194)..(197): Any amino acid
  MOD_RES (211)..(227): Any amino acid
  MOD_RES (247)..(273): Any amino acid
  MOD_RES (286)..(310): Any amino acid
  MOD_RES (335)..(337): Any amino acid
  MOD_RES (353)..(363): Any amino acid
  MOD_RES (390)..(393): Any amino acid
  MOD_RES (428)..(435): Any amino acid
  MOD_RES (457)..(458): Any amino acid

SEQ ID NO: 421005 - protein, 568 aa, Influenza virus; identical to SEQ ID NO: 419740
  MOD_RES (1)..(15): Any amino acid
  MOD_RES (32)..(39): Any amino acid
  MOD_RES (53)..(110): Any amino acid
  MOD_RES (126)..(168): Any amino acid
  MOD_RES (184)..(203): Any amino acid
  MOD_RES (245)..(248): Any amino acid
  MOD_RES (268)..(286): Any amino acid
  MOD_RES (321)..(321): Any amino acid
  MOD_RES (337)..(337): Any amino acid
  MOD_RES (483)..(486): Any amino acid
  MOD_RES (541)..(551): Any amino acid

SEQ ID NO: 421006 - protein, 568 aa, Influenza virus; identical to SEQ ID NO: 419741
  MOD_RES (1)..(15): Any amino acid
  MOD_RES (32)..(39): Any amino acid
  MOD_RES (53)..(110): Any amino acid
  MOD_RES (125)..(168): Any amino acid
  MOD_RES (184)..(203): Any amino acid
  MOD_RES (245)..(248): Any amino acid
  MOD_RES (268)..(286): Any amino acid
  MOD_RES (321)..(321): Any amino acid
  MOD_RES (337)..(337): Any amino acid
  MOD_RES (397)..(400): Any amino acid
  MOD_RES (422)..(424): Any amino acid
  MOD_RES (462)..(464): Any amino acid
  MOD_RES (483)..(486): Any amino acid
  MOD_RES (541)..(568): Any amino acid

SEQ ID NO: 421007 - protein, 568 aa, Influenza virus; identical to SEQ ID NO: 419742
  MOD_RES (1)..(15): Any amino acid
  MOD_RES (32)..(39): Any amino acid
  MOD_RES (53)..(110): Any amino acid
  MOD_RES (126)..(168): Any amino acid
  MOD_RES (184)..(203): Any amino acid
  MOD_RES (245)..(248): Any amino acid
  MOD_RES (265)..(286): Any amino acid
  MOD_RES (321)..(321): Any amino acid
  MOD_RES (337)..(337): Any amino acid
  MOD_RES (361)..(364): Any amino acid
  MOD_RES (376)..(383): Any amino acid
  MOD_RES (396)..(402): Any amino acid
  MOD_RES (424)..(429): Any amino acid
  MOD_RES (462)..(486): Any amino acid
  MOD_RES (541)..(568): Any amino acid

SEQ ID NO: 421008 - protein, 568 aa, Influenza virus; identical to SEQ ID NO: 419743
  MOD_RES (1)..(15): Any amino acid
  MOD_RES (30)..(39): Any amino acid
  MOD_RES (51)..(114): Any amino acid
  MOD_RES (126)..(168): Any amino acid
  MOD_RES (184)..(203): Any amino acid
  MOD_RES (245)..(248): Any amino acid
  MOD_RES (268)..(286): Any amino acid
  MOD_RES (310)..(321): Any amino acid
  MOD_RES (333)..(348): Any amino acid
  MOD_RES (360)..(365): Any amino acid
  MOD_RES (399)..(404): Any amino acid
  MOD_RES (426)..(430): Any amino acid
  MOD_RES (465)..(486): Any amino acid
  MOD_RES (517)..(517): Any amino acid
  MOD_RES (536)..(568): Any amino acid

SEQ ID NO: 421009 - protein, 568 aa, Influenza virus; identical to SEQ ID NO: 419744
  MOD_RES (1)..(17): Any amino acid
  MOD_RES (32)..(39): Any amino acid
  MOD_RES (51)..(168): Any amino acid
  MOD_RES (184)..(204): Any amino acid
  MOD_RES (245)..(248): Any amino acid
  MOD_RES (268)..(287): Any amino acid
  MOD_RES (306)..(321): Any amino acid
  MOD_RES (333)..(366): Any amino acid
  MOD_RES (397)..(407): Any amino acid
  MOD_RES (423)..(433): Any amino acid
  MOD_RES (471)..(486): Any amino acid
  MOD_RES (524)..(568): Any amino acid

SEQ ID NO: 421010 - protein, 561 aa, Influenza virus; identical to SEQ ID NO: 419749
  MOD_RES (1)..(15): Any amino acid
  MOD_RES (54)..(65): Any amino acid
  MOD_RES (77)..(78): Any amino acid
  MOD_RES (100)..(101): Any amino acid
  MOD_RES (131)..(150): Any amino acid
  MOD_RES (184)..(184): Any amino acid
  MOD_RES (246)..(246): Any amino acid
  MOD_RES (271)..(286): Any amino acid
  MOD_RES (337)..(337): Any amino acid
  MOD_RES (485)..(485): Any amino acid

SEQ ID NO: 421011 - protein, 561 aa, Influenza virus; identical to SEQ ID NO: 419750
  MOD_RES (1)..(15): Any amino acid
  MOD_RES (54)..(65): Any amino acid
  MOD_RES (77)..(78): Any amino acid
  MOD_RES (100)..(101): Any amino acid
  MOD_RES (131)..(150): Any amino acid
  MOD_RES (184)..(184): Any amino acid
  MOD_RES (246)..(246): Any amino acid
  MOD_RES (270)..(286): Any amino acid
  MOD_RES (305)..(309): Any amino acid
  MOD_RES (337)..(337): Any amino acid
  MOD_RES (360)..(368): Any amino acid
  MOD_RES (390)..(400): Any amino acid
  MOD_RES (422)..(429): Any amino acid
  MOD_RES (485)..(485): Any amino acid
  MOD_RES (553)..(561): Any amino acid

SEQ ID NO: 421012 - protein, 561 aa, Influenza virus; identical to SEQ ID NO: 419751
  MOD_RES (1)..(15): Any amino acid
  MOD_RES (52)..(65): Any amino acid
  MOD_RES (77)..(78): Any amino acid
  MOD_RES (100)..(101): Any amino acid
  MOD_RES (131)..(150): Any amino acid
  MOD_RES (184)..(184): Any amino acid
  MOD_RES (231)..(234): Any amino acid
  MOD_RES (246)..(246): Any amino acid
  MOD_RES (271)..(288): Any amino acid
  MOD_RES (310)..(310): Any amino acid
  MOD_RES (337)..(339): Any amino acid
  MOD_RES (361)..(372): Any amino acid
  MOD_RES (399)..(402): Any amino acid
  MOD_RES (424)..(430): Any amino acid
  MOD_RES (465)..(472): Any amino acid
  MOD_RES (485)..(485): Any amino acid

SEQ ID NO: 421013 - protein, 561 aa, Influenza virus; identical to SEQ ID NO: 419752
  MOD_RES (1)..(15): Any amino acid
  MOD_RES (33)..(38): Any amino acid
  MOD_RES (54)..(65): Any amino acid
  MOD_RES (77)..(78): Any amino acid
  MOD_RES (99)..(101): Any amino acid
  MOD_RES (131)..(150): Any amino acid
  MOD_RES (184)..(184): Any amino acid
  MOD_RES (225)..(246): Any amino acid
  MOD_RES (271)..(290): Any amino acid
  MOD_RES (333)..(373): Any amino acid
  MOD_RES (394)..(404): Any amino acid
  MOD_RES (426)..(449): Any amino acid
  MOD_RES (461)..(472): Any amino acid
  MOD_RES (485)..(485): Any amino acid
  MOD_RES (502)..(506): Any amino acid
  MOD_RES (528)..(530): Any amino acid
  MOD_RES (557)..(561): Any amino acid

SEQ ID NO: 421014 - protein, 561 aa, Influenza virus; identical to SEQ ID NO: 419753
  MOD_RES (1)..(17): Any amino acid
  MOD_RES (42)..(42): Any amino acid
  MOD_RES (54)..(65): Any amino acid
  MOD_RES (77)..(78): Any amino acid
  MOD_RES (100)..(101): Any amino acid
  MOD_RES (131)..(151): Any amino acid
  MOD_RES (184)..(184): Any amino acid
  MOD_RES (231)..(246): Any amino acid
  MOD_RES (265)..(321): Any amino acid
  MOD_RES (333)..(374): Any amino acid
  MOD_RES (396)..(450): Any amino acid
  MOD_RES (463)..(472): Any amino acid
  MOD_RES (485)..(485): Any amino acid
  MOD_RES (501)..(506): Any amino acid
  MOD_RES (554)..(561): Any amino acid

SEQ ID NO: 421015 - protein, 471 aa, Influenza virus; identical to SEQ ID NO: 419756
  MOD_RES (18)..(19): Any amino acid
  MOD_RES (50)..(53): Any amino acid
  MOD_RES (73)..(82): Any amino acid
  MOD_RES (308)..(308): Any amino acid
  MOD_RES (332)..(333): Any amino acid
  MOD_RES (389)..(398): Any amino acid
  MOD_RES (416)..(416): Any amino acid

SEQ ID NO: 421016 - protein, 471 aa, Influenza virus; identical to SEQ ID NO: 419757
  MOD_RES (18)..(19): Any amino acid
  MOD_RES (50)..(53): Any amino acid
  MOD_RES (73)..(82): Any amino acid
  MOD_RES (308)..(308): Any amino acid
  MOD_RES (332)..(333): Any amino acid
  MOD_RES (389)..(398): Any amino acid
  MOD_RES (416)..(416): Any amino acid

SEQ ID NO: 421017 - protein, 471 aa, Influenza virus; identical to SEQ ID NO: 419758
  MOD_RES (17)..(19): Any amino acid
  MOD_RES (36)..(38): Any amino acid
  MOD_RES (50)..(53): Any amino acid
  MOD_RES (73)..(82): Any amino acid
  MOD_RES (137)..(153): Any amino acid
  MOD_RES (183)..(183): Any amino acid
  MOD_RES (308)..(308): Any amino acid
  MOD_RES (332)..(334): Any amino acid
  MOD_RES (380)..(398): Any amino acid
  MOD_RES (416)..(416): Any amino acid
  MOD_RES (429)..(443): Any amino acid
  MOD_RES (471)..(471): Any amino acid

SEQ ID NO: 421018 - protein, 471 aa, Influenza virus; identical to SEQ ID NO: 419759
  MOD_RES (1)..(1): Any amino acid
  MOD_RES (15)..(19): Any amino acid
  MOD_RES (50)..(53): Any amino acid
  MOD_RES (65)..(82): Any amino acid
  MOD_RES (137)..(154): Any amino acid
  MOD_RES (228)..(234): Any amino acid
  MOD_RES (308)..(308): Any amino acid
  MOD_RES (332)..(334): Any amino acid
  MOD_RES (346)..(346): Any amino acid
  MOD_RES (389)..(398): Any amino acid
  MOD_RES (411)..(416): Any amino acid
  MOD_RES (429)..(444): Any amino acid
  MOD_RES (465)..(471): Any amino acid

SEQ ID NO: 421019 - protein, 471 aa, Influenza virus; identical to SEQ ID NO: 419760
  MOD_RES (1)..(4): Any amino acid
  MOD_RES (18)..(38): Any amino acid
  MOD_RES (50)..(53): Any amino acid
  MOD_RES (71)..(82): Any amino acid
  MOD_RES (98)..(102): Any amino acid
  MOD_RES (116)..(118): Any amino acid
  MOD_RES (140)..(156): Any amino acid
  MOD_RES (169)..(171): Any amino acid
  MOD_RES (228)..(236): Any amino acid
  MOD_RES (307)..(308): Any amino acid
  MOD_RES (332)..(335): Any amino acid
  MOD_RES (348)..(359): Any amino acid
  MOD_RES (389)..(398): Any amino acid
  MOD_RES (412)..(416): Any amino acid
  MOD_RES (429)..(444): Any amino acid
  MOD_RES (465)..(471): Any amino acid

SEQ ID NO: 421020 - protein, 565 aa, Influenza virus; identical to SEQ ID NO: 419765
  MOD_RES (1)..(14): Any amino acid
  MOD_RES (52)..(52): Any amino acid
  MOD_RES (102)..(234): Any amino acid
  MOD_RES (249)..(255): Any amino acid
  MOD_RES (269)..(308): Any amino acid
  MOD_RES (339)..(340): Any amino acid
  MOD_RES (386)..(431): Any amino acid
  MOD_RES (464)..(467): Any amino acid
  MOD_RES (522)..(523): Any amino acid
  MOD_RES (549)..(551): Any amino acid

SEQ ID NO: 421021 - protein, 565 aa, Influenza virus; identical to SEQ ID NO: 419766
  MOD_RES (1)..(14): Any amino acid
  MOD_RES (52)..(52): Any amino acid
  MOD_RES (102)..(234): Any amino acid
  MOD_RES (249)..(255): Any amino acid
  MOD_RES (269)..(308): Any amino acid
  MOD_RES (339)..(340): Any amino acid
  MOD_RES (352)..(359): Any amino acid
  MOD_RES (386)..(431): Any amino acid
  MOD_RES (464)..(467): Any amino acid
  MOD_RES (522)..(523): Any amino acid
  MOD_RES (549)..(551): Any amino acid
  MOD_RES (564)..(565): Any amino acid

SEQ ID NO: 421022 - protein, 565 aa, Influenza virus; identical to SEQ ID NO: 419767
  MOD_RES (1)..(14): Any amino acid
  MOD_RES (52)..(52): Any amino acid
  MOD_RES (101)..(236): Any amino acid
  MOD_RES (249)..(255): Any amino acid
  MOD_RES (269)..(308): Any amino acid
  MOD_RES (339)..(340): Any amino acid
  MOD_RES (352)..(360): Any amino acid
  MOD_RES (386)..(431): Any amino acid
  MOD_RES (464)..(467): Any amino acid
  MOD_RES (522)..(523): Any amino acid
  MOD_RES (546)..(551): Any amino acid

SEQ ID NO: 421023 - protein, 565 aa, Influenza virus; identical to SEQ ID NO: 419768
  MOD_RES (1)..(14): Any amino acid
  MOD_RES (50)..(52): Any amino acid
  MOD_RES (101)..(236): Any amino acid
  MOD_RES (249)..(255): Any amino acid
  MOD_RES (269)..(308): Any amino acid
  MOD_RES (339)..(340): Any amino acid
  MOD_RES (359)..(365): Any amino acid
  MOD_RES (386)..(431): Any amino acid
  MOD_RES (444)..(448): Any amino acid
  MOD_RES (462)..(467): Any amino acid
  MOD_RES (522)..(523): Any amino acid
  MOD_RES (549)..(551): Any amino acid

SEQ ID NO: 421024 - protein, 565 aa, Influenza virus; identical to SEQ ID NO: 419769
  MOD_RES (1)..(15): Any amino acid
  MOD_RES (51)..(52): Any amino acid
  MOD_RES (102)..(237): Any amino acid
  MOD_RES (249)..(255): Any amino acid
  MOD_RES (269)..(308): Any amino acid
  MOD_RES (324)..(324): Any amino acid
  MOD_RES (339)..(369): Any amino acid
  MOD_RES (382)..(432): Any amino acid
  MOD_RES (447)..(452): Any amino acid
  MOD_RES (464)..(467): Any amino acid
  MOD_RES (521)..(534): Any amino acid
  MOD_RES (549)..(551): Any amino acid
  MOD_RES (564)..(565): Any amino acid

SEQ ID NO: 421025 - protein, 564 aa, Influenza virus; identical to SEQ ID NO: 419772
  MOD_RES (1)..(14): Any amino acid
  MOD_RES (57)..(60): Any amino acid
  MOD_RES (152)..(153): Any amino acid
  MOD_RES (189)..(189): Any amino acid
  MOD_RES (205)..(219): Any amino acid
  MOD_RES (287)..(291): Any amino acid
  MOD_RES (406)..(417): Any amino acid
  MOD_RES (467)..(469): Any amino acid
  MOD_RES (489)..(503): Any amino acid

SEQ ID NO: 421026 - protein, 564 aa, Influenza virus; identical to SEQ ID NO: 419773
  MOD_RES (1)..(14): Any amino acid
  MOD_RES (57)..(60): Any amino acid
  MOD_RES (152)..(153): Any amino acid
  MOD_RES (189)..(189): Any amino acid
  MOD_RES (205)..(219): Any amino acid
  MOD_RES (287)..(291): Any amino acid
  MOD_RES (406)..(417): Any amino acid
  MOD_RES (467)..(469): Any amino acid
  MOD_RES (489)..(503): Any amino acid
  MOD_RES (526)..(532): Any amino acid

SEQ ID NO: 421027 - protein, 564 aa, Influenza virus; identical to SEQ ID NO: 419774
  MOD_RES (1)..(14): Any amino acid
  MOD_RES (26)..(26): Any amino acid
  MOD_RES (57)..(60): Any amino acid
  MOD_RES (152)..(153): Any amino acid
  MOD_RES (174)..(176): Any amino acid
  MOD_RES (189)..(189): Any amino acid
  MOD_RES (205)..(219): Any amino acid
  MOD_RES (246)..(247): Any amino acid
  MOD_RES (281)..(291): Any amino acid
  MOD_RES (359)..(363): Any amino acid
  MOD_RES (406)..(417): Any amino acid
  MOD_RES (442)..(453): Any amino acid
  MOD_RES (467)..(469): Any amino acid
  MOD_RES (489)..(503): Any amino acid
  MOD_RES (525)..(564): Any amino acid

SEQ ID NO: 421028 - protein, 564 aa, Influenza virus; identical to SEQ ID NO: 419775
  MOD_RES (1)..(26): Any amino acid
  MOD_RES (57)..(67): Any amino acid
  MOD_RES (89)..(95): Any amino acid
  MOD_RES (148)..(153): Any amino acid
  MOD_RES (182)..(189): Any amino acid
  MOD_RES (205)..(219): Any amino acid
  MOD_RES (245)..(261): Any amino acid
  MOD_RES (283)..(291): Any amino acid
  MOD_RES (352)..(365): Any amino acid
  MOD_RES (406)..(417): Any amino acid
  MOD_RES (438)..(453): Any amino acid
  MOD_RES (467)..(469): Any amino acid
  MOD_RES (489)..(503): Any amino acid
  MOD_RES (527)..(564): Any amino acid

SEQ ID NO: 421029 - protein, 564 aa, Influenza virus; identical to SEQ ID NO: 419776
  MOD_RES (1)..(26): Any amino acid
  MOD_RES (41)..(44): Any amino acid
  MOD_RES (57)..(69): Any amino acid
  MOD_RES (91)..(102): Any amino acid
  MOD_RES (124)..(135): Any amino acid
  MOD_RES (152)..(153): Any amino acid
  MOD_RES (175)..(193): Any amino acid
  MOD_RES (205)..(219): Any amino acid
  MOD_RES (247)..(269): Any amino acid
  MOD_RES (287)..(291): Any amino acid
  MOD_RES (311)..(314): Any amino acid
  MOD_RES (348)..(366): Any amino acid
  MOD_RES (400)..(417): Any amino acid
  MOD_RES (438)..(454): Any amino acid
  MOD_RES (467)..(469): Any amino acid
  MOD_RES (489)..(503): Any amino acid
  MOD_RES (515)..(564): Any amino acid

SEQ ID NO: 421030 - protein, 567 aa, Influenza virus; identical to SEQ ID NO: 419779
  MOD_RES (1)..(17): Any amino acid
  MOD_RES (63)..(63): Any amino acid
  MOD_RES (86)..(89): Any amino acid
  MOD_RES (138)..(172): Any amino acid
  MOD_RES (200)..(213): Any amino acid
  MOD_RES (225)..(231): Any amino acid
  MOD_RES (249)..(256): Any amino acid
  MOD_RES (289)..(290): Any amino acid
  MOD_RES (341)..(343): Any amino acid
  MOD_RES (468)..(472): Any amino acid
  MOD_RES (504)..(504): Any amino acid
  MOD_RES (564)..(567): Any amino acid

SEQ ID NO: 421031 - protein, 567 aa, Influenza virus; identical to SEQ ID NO: 419780
  MOD_RES (1)..(17): Any amino acid
  MOD_RES (62)..(63): Any amino acid
  MOD_RES (86)..(89): Any amino acid
  MOD_RES (138)..(179): Any amino acid
  MOD_RES (200)..(213): Any amino acid
  MOD_RES (225)..(231): Any amino acid
  MOD_RES (249)..(256): Any amino acid
  MOD_RES (289)..(290): Any amino acid
  MOD_RES (341)..(343): Any amino acid
  MOD_RES (357)..(365): Any amino acid
  MOD_RES (468)..(472): Any amino acid
  MOD_RES (504)..(504): Any amino acid
  MOD_RES (564)..(567): Any amino acid

SEQ ID NO: 421032 - protein, 567 aa, Influenza virus; identical to SEQ ID NO: 419781
  MOD_RES (1)..(17): Any amino acid
  MOD_RES (63)..(63): Any amino acid
  MOD_RES (85)..(89): Any amino acid
  MOD_RES (113)..(122): Any amino acid
  MOD_RES (138)..(179): Any amino acid
  MOD_RES (200)..(213): Any amino acid
  MOD_RES (225)..(231): Any amino acid
  MOD_RES (249)..(256): Any amino acid
  MOD_RES (289)..(290): Any amino acid
  MOD_RES (341)..(343): Any amino acid
  MOD_RES (358)..(365): Any amino acid
  MOD_RES (387)..(390): Any amino acid
  MOD_RES (402)..(408): Any amino acid
  MOD_RES (430)..(430): Any amino acid
  MOD_RES (468)..(472): Any amino acid
  MOD_RES (502)..(504): Any amino acid
  MOD_RES (564)..(567): Any amino acid

SEQ ID NO: 421033 - protein, 567 aa, Influenza virus; identical to SEQ ID NO: 419782
  MOD_RES (1)..(21): Any amino acid
  MOD_RES (63)..(63): Any amino acid
  MOD_RES (85)..(91): Any amino acid
  MOD_RES (113)..(125): Any amino acid
  MOD_RES (138)..(179): Any amino acid
  MOD_RES (200)..(213): Any amino acid
  MOD_RES (225)..(231): Any amino acid
  MOD_RES (244)..(256): Any amino acid
  MOD_RES (268)..(275): Any amino acid
  MOD_RES (289)..(303): Any amino acid
  MOD_RES (324)..(325): Any amino acid
  MOD_RES (338)..(343): Any amino acid
  MOD_RES (360)..(367): Any amino acid
  MOD_RES (387)..(408): Any amino acid
  MOD_RES (430)..(449): Any amino acid
  MOD_RES (468)..(483): Any amino acid
  MOD_RES (504)..(510): Any amino acid
  MOD_RES (557)..(567): Any amino acid

SEQ ID NO: 421034 - protein, 567 aa, Influenza virus; identical to SEQ ID NO: 419783
  MOD_RES (1)..(22): Any amino acid
  MOD_RES (54)..(73): Any amino acid
  MOD_RES (86)..(95): Any amino acid
  MOD_RES (117)..(179): Any amino acid
  MOD_RES (192)..(213): Any amino acid
  MOD_RES (225)..(231): Any amino acid
  MOD_RES (247)..(277): Any amino acid
  MOD_RES (289)..(308): Any amino acid
  MOD_RES (341)..(370): Any amino acid
  MOD_RES (392)..(408): Any amino acid
  MOD_RES (426)..(455): Any amino acid
  MOD_RES (468)..(512): Any amino acid
  MOD_RES (541)..(542): Any amino acid
  MOD_RES (564)..(567): Any amino acid

SEQ ID NO: 421035 - protein, 568 aa, Influenza virus; identical to SEQ ID NO: 418424

SEQ ID NO: 421036 - protein, 568 aa, Influenza virus; identical to SEQ ID NO: 419786
  MOD_RES (1)..(9): Any amino acid
  MOD_RES (23)..(162): Any amino acid
  MOD_RES (184)..(568): Any amino acid

SEQ ID NO: 421037 - protein, 570 aa, Influenza virus; identical to SEQ ID NO: 418426

SEQ ID NO: 421038 - protein, 570 aa, Influenza virus; identical to SEQ ID NO: 419788
  MOD_RES (1)..(6): Any amino acid
  MOD_RES (68)..(75): Any amino acid
  MOD_RES (150)..(151): Any amino acid
  MOD_RES (191)..(195): Any amino acid
  MOD_RES (230)..(266): Any amino acid
  MOD_RES (288)..(308): Any amino acid
  MOD_RES (334)..(336): Any amino acid
  MOD_RES (358)..(399): Any amino acid
  MOD_RES (421)..(518): Any amino acid
  MOD_RES (540)..(570): Any amino acid

SEQ ID NO: 421039 - protein, 570 aa, Influenza virus; identical to SEQ ID NO: 419789
  MOD_RES (1)..(154): Any amino acid
  MOD_RES (176)..(217): Any amino acid
  MOD_RES (239)..(337): Any amino acid
  MOD_RES (366)..(570): Any amino acid

SEQ ID NO: 421040 - protein, 570 aa, Influenza virus; identical to SEQ ID NO: 419790
  MOD_RES (1)..(155): Any amino acid
  MOD_RES (177)..(570): Any amino acid

SEQ ID NO: 421041 - protein, 569 aa, Influenza virus; identical to SEQ ID NO: 419791
  MOD_RES (13)..(15): Any amino acid
  MOD_RES (160)..(160): Any amino acid
  MOD_RES (172)..(173): Any amino acid
  MOD_RES (343)..(343): Any amino acid
  MOD_RES (471)..(471): Any amino acid

SEQ ID NO: 421042 - protein, 569 aa, Influenza virus; identical to SEQ ID NO: 419792
  MOD_RES (1)..(15): Any amino acid
  MOD_RES (79)..(79): Any amino acid
  MOD_RES (127)..(128): Any amino acid
  MOD_RES (160)..(160): Any amino acid
  MOD_RES (172)..(173): Any amino acid
  MOD_RES (329)..(330): Any amino acid
  MOD_RES (352)..(374): Any amino acid
  MOD_RES (403)..(415): Any amino acid
  MOD_RES (471)..(471): Any amino acid

SEQ ID NO: 421043 - protein, 569 aa, Influenza virus; identical to SEQ ID NO: 419793
  MOD_RES (1)..(15): Any amino acid
  MOD_RES (47)..(60): Any amino acid
  MOD_RES (82)..(99): Any amino acid
  MOD_RES (123)..(128): Any amino acid
  MOD_RES (160)..(160): Any amino acid
  MOD_RES (172)..(179): Any amino acid
  MOD_RES (191)..(194): Any amino acid
  MOD_RES (219)..(224): Any amino acid
  MOD_RES (274)..(276): Any amino acid
  MOD_RES (316)..(331): Any amino acid
  MOD_RES (343)..(343): Any amino acid
  MOD_RES (355)..(374): Any amino acid
  MOD_RES (396)..(418): Any amino acid
  MOD_RES (440)..(440): Any amino acid
  MOD_RES (471)..(471): Any amino acid
  MOD_RES (496)..(505): Any amino acid

SEQ ID NO: 421044 - protein, 569 aa, Influenza virus; identical to SEQ ID NO: 419794
  MOD_RES (1)..(15): Any amino acid
  MOD_RES (54)..(60): Any amino acid
  MOD_RES (79)..(101): Any amino acid
  MOD_RES (121)..(130): Any amino acid
  MOD_RES (160)..(160): Any amino acid
  MOD_RES (172)..(179): Any amino acid
  MOD_RES (192)..(194): Any amino acid
  MOD_RES (224)..(236): Any amino acid
  MOD_RES (270)..(277): Any amino acid
  MOD_RES (326)..(343): Any amino acid
  MOD_RES (355)..(380): Any amino acid
  MOD_RES (402)..(444): Any amino acid
  MOD_RES (471)..(471): Any amino acid
  MOD_RES (498)..(522): Any amino acid

SEQ ID NO: 421045 - protein, 569 aa, Influenza virus; identical to SEQ ID NO: 419795
  MOD_RES (1)..(15): Any amino acid
  MOD_RES (48)..(101): Any amino acid
  MOD_RES (123)..(130): Any amino acid
  MOD_RES (157)..(160): Any amino acid
  MOD_RES (172)..(195): Any amino acid
  MOD_RES (220)..(242): Any amino acid
  MOD_RES (270)..(280): Any amino acid
  MOD_RES (303)..(343): Any amino acid
  MOD_RES (355)..(381): Any amino acid
  MOD_RES (396)..(455): Any amino acid
  MOD_RES (471)..(524): Any amino acid
  MOD_RES (546)..(569): Any amino acid

SEQ ID NO: 421046 - protein, 627 aa, Influenza virus; identical to SEQ ID NO: 419797
  MOD_RES (19)..(26): Any amino acid
  MOD_RES (48)..(304): Any amino acid
  MOD_RES (325)..(342): Any amino acid
  MOD_RES (356)..(385): Any amino acid
  MOD_RES (413)..(479): Any amino acid
  MOD_RES (491)..(603): Any amino acid
  MOD_RES (619)..(627): Any amino acid

SEQ ID NO: 421047 - protein, 627 aa, Influenza virus; identical to SEQ ID NO: 419798
  MOD_RES (19)..(304): Any amino acid
  MOD_RES (322)..(387): Any amino acid
  MOD_RES (413)..(479): Any amino acid
  MOD_RES (491)..(609): Any amino acid
  MOD_RES (622)..(627): Any amino acid

SEQ ID NO: 421048 - protein, 627 aa, Influenza virus; identical to SEQ ID NO: 419799
  MOD_RES (1)..(3): Any amino acid
  MOD_RES (19)..(390): Any amino acid
  MOD_RES (413)..(479): Any amino acid
  MOD_RES (491)..(609): Any amino acid

SEQ ID NO: 421049 - protein, 627 aa, Influenza virus; identical to SEQ ID NO: 419800
  MOD_RES (1)..(6): Any amino acid
  MOD_RES (19)..(393): Any amino acid
  MOD_RES (413)..(479): Any amino acid
  MOD_RES (491)..(609): Any amino acid
  MOD_RES (625)..(627): Any amino acid

SEQ ID NO: 421050 - protein, 627 aa, Influenza virus; identical to SEQ ID NO: 419801
  MOD_RES (1)..(393): Any amino acid
  MOD_RES (413)..(479): Any amino acid
  MOD_RES (491)..(609): Any amino acid

SEQ ID NO: 421051 - protein, 599 aa, Influenza virus; identical to SEQ ID NO: 419802
  MOD_RES (20)..(26): Any amino acid
  MOD_RES (62)..(83): Any amino acid
  MOD_RES (95)..(123): Any amino acid
  MOD_RES (147)..(180): Any amino acid
  MOD_RES (193)..(266): Any amino acid
  MOD_RES (278)..(316): Any amino acid
  MOD_RES (330)..(330): Any amino acid
  MOD_RES (343)..(343): Any amino acid
  MOD_RES (402)..(408): Any amino acid
  MOD_RES (430)..(434): Any amino acid
  MOD_RES (473)..(486): Any amino acid
  MOD_RES (506)..(506): Any amino acid
  MOD_RES (526)..(542): Any amino acid
  MOD_RES (594)..(599): Any amino acid

SEQ ID NO: 421052 - protein, 599 aa, Influenza virus; identical to SEQ ID NO: 419803
  MOD_RES (20)..(26): Any amino acid
  MOD_RES (62)..(83): Any amino acid
  MOD_RES (95)..(123): Any amino acid
  MOD_RES (147)..(180): Any amino acid
  MOD_RES (193)..(266): Any amino acid
  MOD_RES (278)..(330): Any amino acid
  MOD_RES (343)..(343): Any amino acid
  MOD_RES (364)..(366): Any amino acid
  MOD_RES (402)..(408): Any amino acid
  MOD_RES (430)..(434): Any amino acid
  MOD_RES (473)..(486): Any amino acid
  MOD_RES (506)..(506): Any amino acid
  MOD_RES (526)..(542): Any amino acid
  MOD_RES (591)..(599): Any amino acid

SEQ ID NO: 421053 - protein, 599 aa, Influenza virus; identical to SEQ ID NO: 419804
  MOD_RES (1)..(3): Any amino acid
  MOD_RES (20)..(26): Any amino acid
  MOD_RES (62)..(83): Any amino acid
  MOD_RES (95)..(123): Any amino acid
  MOD_RES (147)..(266): Any amino acid
  MOD_RES (278)..(330): Any amino acid
  MOD_RES (343)..(343): Any amino acid
  MOD_RES (358)..(379): Any amino acid
  MOD_RES (399)..(408): Any amino acid
  MOD_RES (430)..(434): Any amino acid
  MOD_RES (473)..(486): Any amino acid
  MOD_RES (506)..(506): Any amino acid
  MOD_RES (526)..(542): Any amino acid

SEQ ID NO: 421054 - protein, 599 aa, Influenza virus; identical to SEQ ID NO: 419805
  MOD_RES (1)..(8): Any amino acid
  MOD_RES (20)..(37): Any amino acid
  MOD_RES (58)..(83): Any amino acid
  MOD_RES (95)..(123): Any amino acid
  MOD_RES (147)..(266): Any amino acid
  MOD_RES (278)..(330): Any amino acid
  MOD_RES (343)..(343): Any amino acid
  MOD_RES (367)..(386): Any amino acid
  MOD_RES (399)..(408): Any amino acid
  MOD_RES (430)..(434): Any amino acid
  MOD_RES (450)..(461): Any amino acid
  MOD_RES (473)..(494): Any amino acid
  MOD_RES (506)..(506): Any amino acid
  MOD_RES (526)..(546): Any amino acid

SEQ ID NO: 421055 - protein, 599 aa, Influenza virus; identical to SEQ ID NO: 419806
  MOD_RES (1)..(12): Any amino acid
  MOD_RES (24)..(38): Any amino acid
  MOD_RES (60)..(83): Any amino acid
  MOD_RES (95)..(123): Any amino acid
  MOD_RES (145)..(266): Any amino acid
  MOD_RES (278)..(331): Any amino acid
  MOD_RES (343)..(343): Any amino acid
  MOD_RES (364)..(386): Any amino acid
  MOD_RES (402)..(411): Any amino acid
  MOD_RES (430)..(434): Any amino acid
  MOD_RES (459)..(461): Any amino acid
  MOD_RES (473)..(552): Any amino acid
  MOD_RES (590)..(599): Any amino acid

SEQ ID NO: 421056 - protein, 484 aa, Influenza virus; identical to SEQ ID NO: 419809
  MOD_RES (22)..(111): Any amino acid
  MOD_RES (227)..(233): Any amino acid
  MOD_RES (270)..(282): Any amino acid
  MOD_RES (296)..(301): Any amino acid
  MOD_RES (323)..(325): Any amino acid
  MOD_RES (341)..(360): Any amino acid
  MOD_RES (378)..(382): Any amino acid
  MOD_RES (395)..(409): Any amino acid
  MOD_RES (445)..(447): Any amino acid
  MOD_RES (464)..(468): Any amino acid
  MOD_RES (480)..(484): Any amino acid

SEQ ID NO: 421057 - protein, 484 aa, Influenza virus; identical to SEQ ID NO: 419810
  MOD_RES (1)..(9): Any amino acid
  MOD_RES (22)..(111): Any amino acid
  MOD_RES (223)..(233): Any amino acid
  MOD_RES (259)..(282): Any amino acid
  MOD_RES (296)..(301): Any amino acid
  MOD_RES (323)..(325): Any amino acid
  MOD_RES (341)..(360): Any amino acid
  MOD_RES (378)..(382): Any amino acid
  MOD_RES (395)..(409): Any amino acid
  MOD_RES (445)..(447): Any amino acid
  MOD_RES (464)..(468): Any amino acid

SEQ ID NO: 421058 - protein, 484 aa, Influenza virus; identical to SEQ ID NO: 419811
  MOD_RES (1)..(111): Any amino acid
  MOD_RES (139)..(149): Any amino acid
  MOD_RES (188)..(188): Any amino acid
  MOD_RES (227)..(234): Any amino acid
  MOD_RES (259)..(282): Any amino acid
  MOD_RES (296)..(305): Any amino acid
  MOD_RES (323)..(325): Any amino acid
  MOD_RES (337)..(360): Any amino acid
  MOD_RES (376)..(382): Any amino acid
  MOD_RES (395)..(409): Any amino acid
  MOD_RES (445)..(448): Any amino acid
  MOD_RES (463)..(468): Any amino acid
  MOD_RES (480)..(484): Any amino acid

SEQ ID NO: 421059 - protein, 484 aa, Influenza virus; identical to SEQ ID NO: 419812
  MOD_RES (1)..(111): Any amino acid
  MOD_RES (141)..(149): Any amino acid
  MOD_RES (184)..(188): Any amino acid
  MOD_RES (227)..(234): Any amino acid
  MOD_RES (259)..(282): Any amino acid
  MOD_RES (296)..(308): Any amino acid
  MOD_RES (320)..(325): Any amino acid
  MOD_RES (341)..(360): Any amino acid
  MOD_RES (378)..(383): Any amino acid
  MOD_RES (395)..(409): Any amino acid
  MOD_RES (432)..(448): Any amino acid
  MOD_RES (464)..(484): Any amino acid

SEQ ID NO: 421060 - protein, 484 aa, Influenza virus; identical to SEQ ID NO: 419813
  MOD_RES (1)..(111): Any amino acid
  MOD_RES (127)..(127): Any amino acid
  MOD_RES (149)..(150): Any amino acid
  MOD_RES (173)..(188): Any amino acid
  MOD_RES (200)..(200): Any amino acid
  MOD_RES (222)..(234): Any amino acid
  MOD_RES (250)..(282): Any amino acid
  MOD_RES (296)..(308): Any amino acid
  MOD_RES (323)..(325): Any amino acid
  MOD_RES (337)..(360): Any amino acid
  MOD_RES (372)..(409): Any amino acid
  MOD_RES (442)..(448): Any amino acid
  MOD_RES (464)..(484): Any amino acid

SEQ ID NO: 421061 - protein, 566 aa, Influenza virus; identical to SEQ ID NO: 419818
  MOD_RES (1)..(17): Any amino acid
  MOD_RES (36)..(38): Any amino acid
  MOD_RES (52)..(307): Any amino acid
  MOD_RES (327)..(339): Any amino acid
  MOD_RES (369)..(434): Any amino acid
  MOD_RES (460)..(471): Any amino acid
  MOD_RES (491)..(550): Any amino acid
  MOD_RES (565)..(566): Any amino acid

SEQ ID NO: 421062 - protein, 566 aa, Influenza virus; identical to SEQ ID NO: 419819
  MOD_RES (1)..(17): Any amino acid
  MOD_RES (36)..(38): Any amino acid
  MOD_RES (52)..(307): Any amino acid
  MOD_RES (327)..(339): Any amino acid
  MOD_RES (369)..(434): Any amino acid
  MOD_RES (460)..(471): Any amino acid
  MOD_RES (491)..(550): Any amino acid
  MOD_RES (565)..(566): Any amino acid

SEQ ID NO: 421063 - protein, 566 aa, Influenza virus; identical to SEQ ID NO: 419820
  MOD_RES (1)..(17): Any amino acid
  MOD_RES (36)..(38): Any amino acid
  MOD_RES (52)..(307): Any amino acid
  MOD_RES (327)..(339): Any amino acid
  MOD_RES (369)..(434): Any amino acid
  MOD_RES (460)..(471): Any amino acid
  MOD_RES (491)..(550): Any amino acid
  MOD_RES (564)..(566): Any amino acid

SEQ ID NO: 421064 - protein, 566 aa, Influenza virus; identical to SEQ ID NO: 419821
  MOD_RES (1)..(17): Any amino acid
  MOD_RES (30)..(38): Any amino acid
  MOD_RES (52)..(307): Any amino acid
  MOD_RES (319)..(339): Any amino acid
  MOD_RES (352)..(352): Any amino acid
  MOD_RES (365)..(434): Any amino acid
  MOD_RES (460)..(471): Any amino acid
  MOD_RES (488)..(550): Any amino acid
  MOD_RES (565)..(566): Any amino acid

SEQ ID NO: 421065 - protein, 566 aa, Influenza virus; identical to SEQ ID NO: 419822
  MOD_RES (1)..(19): Any amino acid
  MOD_RES (31)..(38): Any amino acid
  MOD_RES (50)..(307): Any amino acid
  MOD_RES (326)..(339): Any amino acid
  MOD_RES (355)..(434): Any amino acid
  MOD_RES (446)..(447): Any amino acid
  MOD_RES (459)..(471): Any amino acid
  MOD_RES (484)..(550): Any amino acid
  MOD_RES (564)..(566): Any amino acid

SEQ ID NO: 421066 - protein, 475 aa, Influenza virus; identical to SEQ ID NO: 419826
  MOD_RES (1)..(46): Any amino acid
  MOD_RES (58)..(94): Any amino acid
  MOD_RES (126)..(128): Any amino acid
  MOD_RES (144)..(154): Any amino acid
  MOD_RES (195)..(222): Any amino acid
  MOD_RES (235)..(236): Any amino acid
  MOD_RES (249)..(270): Any amino acid
  MOD_RES (287)..(287): Any amino acid
  MOD_RES (307)..(314): Any amino acid
  MOD_RES (329)..(345): Any amino acid
  MOD_RES (357)..(416): Any amino acid
  MOD_RES (433)..(436): Any amino acid
  MOD_RES (456)..(461): Any amino acid

SEQ ID NO: 421067 - protein, 475 aa, Influenza virus; identical to SEQ ID NO: 419827
  MOD_RES (1)..(46): Any amino acid
  MOD_RES (58)..(94): Any amino acid
  MOD_RES (124)..(128): Any amino acid
  MOD_RES (144)..(154): Any amino acid
  MOD_RES (195)..(222): Any amino acid
  MOD_RES (235)..(236): Any amino acid
  MOD_RES (249)..(270): Any amino acid
  MOD_RES (287)..(287): Any amino acid
  MOD_RES (307)..(314): Any amino acid
  MOD_RES (329)..(345): Any amino acid
  MOD_RES (357)..(416): Any amino acid
  MOD_RES (433)..(436): Any amino acid
  MOD_RES (456)..(475): Any amino acid

SEQ ID NO: 421068 - protein, 475 aa, Influenza virus; identical to SEQ ID NO: 419828
  MOD_RES (1)..(46): Any amino acid
  MOD_RES (58)..(94): Any amino acid
  MOD_RES (126)..(131): Any amino acid
  MOD_RES (144)..(154): Any amino acid
  MOD_RES (195)..(222): Any amino acid
  MOD_RES (235)..(236): Any amino acid
  MOD_RES (249)..(270): Any amino acid
  MOD_RES (287)..(287): Any amino acid
  MOD_RES (307)..(314): Any amino acid
  MOD_RES (329)..(345): Any amino acid
  MOD_RES (357)..(416): Any amino acid
  MOD_RES (433)..(436): Any amino acid
  MOD_RES (456)..(475): Any amino acid

SEQ ID NO: 421069 - protein, 475 aa, Influenza virus; identical to SEQ ID NO: 419829
  MOD_RES (1)..(94): Any amino acid
  MOD_RES (125)..(131): Any amino acid
  MOD_RES (144)..(154): Any amino acid
  MOD_RES (195)..(223): Any amino acid
  MOD_RES (235)..(236): Any amino acid
  MOD_RES (249)..(270): Any amino acid
  MOD_RES (287)..(287): Any amino acid
  MOD_RES (302)..(345): Any amino acid
  MOD_RES (357)..(416): Any amino acid
  MOD_RES (433)..(436): Any amino acid
  MOD_RES (454)..(475): Any amino acid

SEQ ID NO: 421070 - protein, 475 aa, Influenza virus; identical to SEQ ID NO: 419830
  MOD_RES (1)..(94): Any amino acid
  MOD_RES (123)..(162): Any amino acid
  MOD_RES (174)..(182): Any amino acid
  MOD_RES (195)..(236): Any amino acid
  MOD_RES (248)..(273): Any amino acid
  MOD_RES (287)..(293): Any amino acid
  MOD_RES (307)..(345): Any amino acid
  MOD_RES (357)..(416): Any amino acid
  MOD_RES (428)..(436): Any amino acid
  MOD_RES (456)..(475): Any amino acid

SEQ ID NO: 421071 - protein, 569 aa, Influenza virus; identical to SEQ ID NO: 419834
  MOD_RES (18)..(21): Any amino acid
  MOD_RES (37)..(38): Any amino acid
  MOD_RES (65)..(67): Any amino acid
  MOD_RES (94)..(94): Any amino acid
  MOD_RES (106)..(161): Any amino acid
  MOD_RES (173)..(183): Any amino acid
  MOD_RES (195)..(259): Any amino acid
  MOD_RES (289)..(294): Any amino acid
  MOD_RES (330)..(341): Any amino acid
  MOD_RES (392)..(418): Any amino acid
  MOD_RES (436)..(437): Any amino acid
  MOD_RES (499)..(501): Any amino acid
  MOD_RES (523)..(527): Any amino acid

SEQ ID NO: 421072 - protein, 569 aa, Influenza virus; identical to SEQ ID NO: 419835
  MOD_RES (14)..(21): Any amino acid
  MOD_RES (37)..(38): Any amino acid
  MOD_RES (64)..(67): Any amino acid
  MOD_RES (94)..(94): Any amino acid
  MOD_RES (106)..(161): Any amino acid
  MOD_RES (173)..(183): Any amino acid
  MOD_RES (195)..(259): Any amino acid
  MOD_RES (289)..(294): Any amino acid
  MOD_RES (330)..(341): Any amino acid
  MOD_RES (392)..(418): Any amino acid
  MOD_RES (436)..(437): Any amino acid
  MOD_RES (463)..(464): Any amino acid
  MOD_RES (499)..(501): Any amino acid
  MOD_RES (523)..(527): Any amino acid
  MOD_RES (566)..(569): Any amino acid

SEQ ID NO: 421073 - protein, 569 aa, Influenza virus; identical to SEQ ID NO: 419836
  MOD_RES (18)..(21): Any amino acid
  MOD_RES (37)..(38): Any amino acid
  MOD_RES (65)..(67): Any amino acid
  MOD_RES (94)..(94): Any amino acid
  MOD_RES (106)..(161): Any amino acid
  MOD_RES (173)..(183): Any amino acid
  MOD_RES (195)..(259): Any amino acid
  MOD_RES (289)..(294): Any amino acid
  MOD_RES (330)..(341): Any amino acid
  MOD_RES (355)..(375): Any amino acid
  MOD_RES (392)..(418): Any amino acid
  MOD_RES (436)..(437): Any amino acid
  MOD_RES (499)..(501): Any amino acid
  MOD_RES (523)..(527): Any amino acid
  MOD_RES (539)..(539): Any amino acid
  MOD_RES (566)..(569): Any amino acid

SEQ ID NO: 421074 - protein, 569 aa, Influenza virus; identical to SEQ ID NO: 419837
  MOD_RES (15)..(21): Any amino acid
  MOD_RES (35)..(41): Any amino acid
  MOD_RES (65)..(67): Any amino acid
  MOD_RES (80)..(80): Any amino acid
  MOD_RES (94)..(94): Any amino acid
  MOD_RES (106)..(183): Any amino acid
  MOD_RES (195)..(259): Any amino acid
  MOD_RES (289)..(294): Any amino acid
  MOD_RES (312)..(314): Any amino acid
  MOD_RES (326)..(341): Any amino acid
  MOD_RES (357)..(418): Any amino acid
  MOD_RES (436)..(437): Any amino acid
  MOD_RES (499)..(501): Any amino acid
  MOD_RES (523)..(528): Any amino acid
  MOD_RES (540)..(543): Any amino acid
  MOD_RES (565)..(569): Any amino acid

SEQ ID NO: 421075 - protein, 569 aa, Influenza virus; identical to SEQ ID NO: 419838
  MOD_RES (1)..(21): Any amino acid
  MOD_RES (35)..(44): Any amino acid
  MOD_RES (64)..(67): Any amino acid
  MOD_RES (80)..(81): Any amino acid
  MOD_RES (94)..(94): Any amino acid
  MOD_RES (106)..(183): Any amino acid
  MOD_RES (195)..(259): Any amino acid
  MOD_RES (289)..(294): Any amino acid
  MOD_RES (317)..(317): Any amino acid
  MOD_RES (330)..(341): Any amino acid
  MOD_RES (355)..(419): Any amino acid
  MOD_RES (431)..(447): Any amino acid
  MOD_RES (499)..(501): Any amino acid
  MOD_RES (523)..(529): Any amino acid
  MOD_RES (541)..(543): Any amino acid
  MOD_RES (565)..(569): Any amino acid

SEQ ID NO: 421076 - protein, 562 aa, Influenza virus; identical to SEQ ID NO: 419842
  MOD_RES (1)..(12): Any amino acid
  MOD_RES (101)..(103): Any amino acid
  MOD_RES (118)..(124): Any amino acid
  MOD_RES (136)..(154): Any amino acid
  MOD_RES (166)..(173): Any amino acid
  MOD_RES (192)..(249): Any amino acid
  MOD_RES (283)..(286): Any amino acid
  MOD_RES (386)..(407): Any amino acid
  MOD_RES (490)..(492): Any amino acid

SEQ ID NO: 421077 - protein, 562 aa, Influenza virus; identical to SEQ ID NO: 419843
  MOD_RES (1)..(12): Any amino acid
  MOD_RES (61)..(62): Any amino acid
  MOD_RES (101)..(103): Any amino acid
  MOD_RES (118)..(124): Any amino acid
  MOD_RES (136)..(154): Any amino acid
  MOD_RES (166)..(173): Any amino acid
  MOD_RES (192)..(249): Any amino acid
  MOD_RES (283)..(286): Any amino acid
  MOD_RES (386)..(407): Any amino acid
  MOD_RES (490)..(492): Any amino acid
  MOD_RES (531)..(532): Any amino acid
  MOD_RES (562)..(562): Any amino acid

SEQ ID NO: 421078 - protein, 562 aa, Influenza virus; identical to SEQ ID NO: 419844
  MOD_RES (1)..(12): Any amino acid
  MOD_RES (71)..(76): Any amino acid
  MOD_RES (101)..(103): Any amino acid
  MOD_RES (118)..(124): Any amino acid
  MOD_RES (136)..(154): Any amino acid
  MOD_RES (166)..(173): Any amino acid
  MOD_RES (189)..(249): Any amino acid
  MOD_RES (278)..(286): Any amino acid
  MOD_RES (348)..(368): Any amino acid
  MOD_RES (386)..(407): Any amino acid
  MOD_RES (490)..(492): Any amino acid
  MOD_RES (548)..(549): Any amino acid

SEQ ID NO: 421079 - protein, 562 aa, Influenza virus; identical to SEQ ID NO: 419845
  MOD_RES (1)..(12): Any amino acid
  MOD_RES (71)..(76): Any amino acid
  MOD_RES (101)..(103): Any amino acid
  MOD_RES (118)..(124): Any amino acid
  MOD_RES (136)..(173): Any amino acid
  MOD_RES (192)..(249): Any amino acid
  MOD_RES (283)..(286): Any amino acid
  MOD_RES (300)..(302): Any amino acid
  MOD_RES (349)..(368): Any amino acid
  MOD_RES (386)..(407): Any amino acid
  MOD_RES (478)..(492): Any amino acid
  MOD_RES (531)..(536): Any amino acid
  MOD_RES (558)..(562): Any amino acid

SEQ ID NO: 421080 - protein, 562 aa, Influenza virus; identical to SEQ ID NO: 419846
  MOD_RES (1)..(13): Any amino acid
  MOD_RES (62)..(63): Any amino acid
  MOD_RES (99)..(124): Any amino acid
  MOD_RES (136)..(173): Any amino acid
  MOD_RES (186)..(249): Any amino acid
  MOD_RES (265)..(267): Any amino acid
  MOD_RES (283)..(286): Any amino acid
  MOD_RES (301)..(307): Any amino acid
  MOD_RES (347)..(374): Any amino acid
  MOD_RES (386)..(407): Any amino acid
  MOD_RES (471)..(492): Any amino acid
  MOD_RES (536)..(536): Any amino acid
  MOD_RES (558)..(562): Any amino acid

SEQ ID NO: 421081 - protein, 469 aa, Influenza virus; identical to SEQ ID NO: 419850
  MOD_RES (16)..(24): Any amino acid
  MOD_RES (43)..(86): Any amino acid
  MOD_RES (126)..(126): Any amino acid
  MOD_RES (208)..(212): Any amino acid
  MOD_RES (262)..(262): Any amino acid
  MOD_RES (303)..(303): Any amino acid
  MOD_RES (358)..(367): Any amino acid
  MOD_RES (386)..(399): Any amino acid

SEQ ID NO: 421082 - protein, 469 aa, Influenza virus; identical to SEQ ID NO: 419851
  MOD_RES (16)..(24): Any amino acid
  MOD_RES (43)..(86): Any amino acid
  MOD_RES (126)..(126): Any amino acid
  MOD_RES (208)..(212): Any amino acid
  MOD_RES (262)..(262): Any amino acid
  MOD_RES (303)..(303): Any amino acid
  MOD_RES (358)..(367): Any amino acid
  MOD_RES (386)..(399): Any amino acid
  MOD_RES (451)..(452): Any amino acid

SEQ ID NO: 421083 - protein, 469 aa, Influenza virus; identical to SEQ ID NO: 419852
  MOD_RES (16)..(24): Any amino acid
  MOD_RES (43)..(86): Any amino acid
  MOD_RES (122)..(126): Any amino acid
  MOD_RES (160)..(161): Any amino acid
  MOD_RES (208)..(212): Any amino acid
  MOD_RES (262)..(262): Any amino acid
  MOD_RES (303)..(303): Any amino acid
  MOD_RES (355)..(367): Any amino acid
  MOD_RES (386)..(399): Any amino acid

SEQ ID NO: 421084 - protein, 469 aa, Influenza virus; identical to SEQ ID NO: 419853
  MOD_RES (1)..(1): Any amino acid
  MOD_RES (16)..(24): Any amino acid
  MOD_RES (43)..(86): Any amino acid
  MOD_RES (126)..(126): Any amino acid
  MOD_RES (164)..(166): Any amino acid
  MOD_RES (183)..(183): Any amino acid
  MOD_RES (205)..(212): Any amino acid
  MOD_RES (245)..(246): Any amino acid
  MOD_RES (262)..(262): Any amino acid
  MOD_RES (301)..(303): Any amino acid
  MOD_RES (356)..(367): Any amino acid
  MOD_RES (379)..(399): Any amino acid
  MOD_RES (412)..(414): Any amino acid
  MOD_RES (434)..(436): Any amino acid
  MOD_RES (450)..(454): Any amino acid

SEQ ID NO: 421085 - protein, 469 aa, Influenza virus; identical to SEQ ID NO: 419854
  MOD_RES (1)..(3): Any amino acid
  MOD_RES (16)..(24): Any amino acid
  MOD_RES (43)..(87): Any amino acid
  MOD_RES (101)..(102): Any amino acid
  MOD_RES (120)..(126): Any amino acid
  MOD_RES (160)..(166): Any amino acid
  MOD_RES (207)..(213): Any amino acid
  MOD_RES (225)..(225): Any amino acid
  MOD_RES (242)..(249): Any amino acid
  MOD_RES (262)..(262): Any amino acid
  MOD_RES (300)..(303): Any amino acid
  MOD_RES (356)..(367): Any amino acid
  MOD_RES (380)..(399): Any amino acid
  MOD_RES (411)..(414): Any amino acid
  MOD_RES (433)..(454): Any amino acid

SEQ ID NO: 421086 - protein, 580 aa, Influenza virus; identical to SEQ ID NO: 419859
  MOD_RES (16)..(29): Any amino acid
  MOD_RES (41)..(57): Any amino acid
  MOD_RES (72)..(86): Any amino acid
  MOD_RES (102)..(133): Any amino acid
  MOD_RES (146)..(200): Any amino acid
  MOD_RES (213)..(273): Any amino acid
  MOD_RES (287)..(291): Any amino acid
  MOD_RES (303)..(307): Any amino acid
  MOD_RES (332)..(340): Any amino acid
  MOD_RES (355)..(356): Any amino acid
  MOD_RES (407)..(414): Any amino acid
  MOD_RES (475)..(480): Any amino acid
  MOD_RES (506)..(539): Any amino acid
  MOD_RES (557)..(562): Any amino acid

SEQ ID NO: 421087 - protein, 580 aa, Influenza virus; identical to SEQ ID NO: 419860
  MOD_RES (1)..(3): Any amino acid
  MOD_RES (16)..(32): Any amino acid
  MOD_RES (51)..(57): Any amino acid
  MOD_RES (72)..(90): Any amino acid
  MOD_RES (102)..(133): Any amino acid
  MOD_RES (146)..(200): Any amino acid
  MOD_RES (213)..(273): Any amino acid
  MOD_RES (287)..(307): Any amino acid
  MOD_RES (332)..(340): Any amino acid
  MOD_RES (355)..(356): Any amino acid
  MOD_RES (407)..(414): Any amino acid
  MOD_RES (475)..(480): Any amino acid
  MOD_RES (506)..(539): Any amino acid
  MOD_RES (556)..(562): Any amino acid

SEQ ID NO: 421088 - protein, 580 aa, Influenza virus; identical to SEQ ID NO: 419861
  MOD_RES (1)..(10): Any amino acid
  MOD_RES (23)..(35): Any amino acid
  MOD_RES (51)..(57): Any amino acid
  MOD_RES (72)..(90): Any amino acid
  MOD_RES (102)..(133): Any amino acid
  MOD_RES (146)..(200): Any amino acid
  MOD_RES (213)..(273): Any amino acid
  MOD_RES (287)..(307): Any amino acid
  MOD_RES (332)..(343): Any amino acid
  MOD_RES (355)..(356): Any amino acid
  MOD_RES (407)..(414): Any amino acid
  MOD_RES (475)..(480): Any amino acid
  MOD_RES (506)..(539): Any amino acid
  MOD_RES (557)..(562): Any amino acid
  MOD_RES (577)..(580): Any amino acid

SEQ ID NO: 421089 - protein, 580 aa, Influenza virus; identical to SEQ ID NO: 419862
  MOD_RES (1)..(10): Any amino acid
  MOD_RES (23)..(35): Any amino acid
  MOD_RES (51)..(57): Any amino acid
  MOD_RES (72)..(90): Any amino acid
  MOD_RES (102)..(133): Any amino acid
  MOD_RES (146)..(200): Any amino acid
  MOD_RES (212)..(273): Any amino acid
  MOD_RES (285)..(307): Any amino acid
  MOD_RES (331)..(343): Any amino acid
  MOD_RES (355)..(365): Any amino acid
  MOD_RES (407)..(414): Any amino acid
  MOD_RES (427)..(429): Any amino acid
  MOD_RES (475)..(480): Any amino acid
  MOD_RES (506)..(539): Any amino acid
  MOD_RES (557)..(562): Any amino acid

SEQ ID NO: 421090 - protein, 580 aa, Influenza virus; identical to SEQ ID NO: 419863
  MOD_RES (1)..(10): Any amino acid
  MOD_RES (23)..(35): Any amino acid
  MOD_RES (49)..(57): Any amino acid
  MOD_RES (69)..(133): Any amino acid
  MOD_RES (145)..(200): Any amino acid
  MOD_RES (213)..(274): Any amino acid
  MOD_RES (286)..(307): Any amino acid
  MOD_RES (320)..(343): Any amino acid
  MOD_RES (355)..(372): Any amino acid
  MOD_RES (402)..(414): Any amino acid
  MOD_RES (426)..(437): Any amino acid
  MOD_RES (449)..(450): Any amino acid
  MOD_RES (471)..(482): Any amino acid
  MOD_RES (494)..(494): Any amino acid
  MOD_RES (506)..(539): Any amino acid
  MOD_RES (557)..(562): Any amino acid
  MOD_RES (579)..(580): Any amino acid

SEQ ID NO: 421091 - protein, 574 aa, Influenza virus; identical to SEQ ID NO: 419869
  MOD_RES (13)..(23): Any amino acid
  MOD_RES (51)..(51): Any amino acid
  MOD_RES (66)..(82): Any amino acid
  MOD_RES (99)..(127): Any amino acid
  MOD_RES (142)..(194): Any amino acid
  MOD_RES (207)..(251): Any amino acid
  MOD_RES (263)..(267): Any amino acid
  MOD_RES (282)..(285): Any amino acid
  MOD_RES (297)..(301): Any amino acid
  MOD_RES (329)..(329): Any amino acid
  MOD_RES (401)..(408): Any amino acid
  MOD_RES (500)..(501): Any amino acid
  MOD_RES (513)..(514): Any amino acid
  MOD_RES (526)..(533): Any amino acid
  MOD_RES (553)..(555): Any amino acid

SEQ ID NO: 421092 - protein, 574 aa, Influenza virus; identical to SEQ ID NO: 419870
  MOD_RES (1)..(1): Any amino acid
  MOD_RES (13)..(26): Any amino acid
  MOD_RES (51)..(51): Any amino acid
  MOD_RES (66)..(84): Any amino acid
  MOD_RES (99)..(127): Any amino acid
  MOD_RES (142)..(194): Any amino acid
  MOD_RES (207)..(251): Any amino acid
  MOD_RES (263)..(267): Any amino acid
  MOD_RES (282)..(301): Any amino acid
  MOD_RES (329)..(329): Any amino acid
  MOD_RES (380)..(380): Any amino acid
  MOD_RES (401)..(408): Any amino acid
  MOD_RES (499)..(501): Any amino acid
  MOD_RES (513)..(514): Any amino acid
  MOD_RES (526)..(533): Any amino acid
  MOD_RES (550)..(555): Any amino acid

SEQ ID NO: 421093 - protein, 574 aa, Influenza virus; identical to SEQ ID NO: 419871
  MOD_RES (1)..(29): Any amino acid
  MOD_RES (51)..(51): Any amino acid
  MOD_RES (66)..(84): Any amino acid
  MOD_RES (99)..(127): Any amino acid
  MOD_RES (142)..(194): Any amino acid
  MOD_RES (206)..(251): Any amino acid
  MOD_RES (263)..(267): Any amino acid
  MOD_RES (282)..(301): Any amino acid
  MOD_RES (329)..(329): Any amino acid
  MOD_RES (380)..(380): Any amino acid
  MOD_RES (401)..(408): Any amino acid
  MOD_RES (421)..(427): Any amino acid
  MOD_RES (500)..(501): Any amino acid
  MOD_RES (513)..(514): Any amino acid
  MOD_RES (526)..(533): Any amino acid
  MOD_RES (553)..(555): Any amino acid

SEQ ID NO: 421094 - protein, 574 aa, Influenza virus; identical to SEQ ID NO: 419872
  MOD_RES (1)..(29): Any amino acid
  MOD_RES (51)..(51): Any amino acid
  MOD_RES (64)..(85): Any amino acid
  MOD_RES (99)..(127): Any amino acid
  MOD_RES (142)..(194): Any amino acid
  MOD_RES (207)..(251): Any amino acid
  MOD_RES (263)..(268): Any amino acid
  MOD_RES (280)..(301): Any amino acid
  MOD_RES (329)..(329): Any amino acid
  MOD_RES (359)..(359): Any amino acid
  MOD_RES (401)..(408): Any amino acid
  MOD_RES (420)..(431): Any amino acid
  MOD_RES (476)..(476): Any amino acid
  MOD_RES (494)..(501): Any amino acid
  MOD_RES (513)..(514): Any amino acid
  MOD_RES (526)..(533): Any amino acid
  MOD_RES (550)..(555): Any amino acid
  MOD_RES (571)..(574): Any amino acid

SEQ ID NO: 421095 - protein, 574 aa, Influenza virus; identical to SEQ ID NO: 419873
  MOD_RES (1)..(29): Any amino acid
  MOD_RES (51)..(85): Any amino acid
  MOD_RES (99)..(194): Any amino acid
  MOD_RES (206)..(251): Any amino acid
  MOD_RES (263)..(270): Any amino acid
  MOD_RES (282)..(301): Any amino acid
  MOD_RES (329)..(329): Any amino acid
  MOD_RES (359)..(367): Any amino acid
  MOD_RES (393)..(444): Any amino acid
  MOD_RES (476)..(481): Any amino acid
  MOD_RES (500)..(501): Any amino acid
  MOD_RES (513)..(514): Any amino acid
  MOD_RES (526)..(534): Any amino acid
  MOD_RES (553)..(555): Any amino acid

SEQ ID NO: 421096 - protein, 486 aa, Influenza virus; identical to SEQ ID NO: 419879
  MOD_RES (17)..(79): Any amino acid
  MOD_RES (92)..(101): Any amino acid
  MOD_RES (134)..(134): Any amino acid
  MOD_RES (151)..(159): Any amino acid
  MOD_RES (205)..(228): Any amino acid
  MOD_RES (257)..(263): Any amino acid
  MOD_RES (277)..(278): Any amino acid
  MOD_RES (317)..(324): Any amino acid
  MOD_RES (340)..(413): Any amino acid
  MOD_RES (442)..(446): Any amino acid

SEQ ID NO: 421097 - protein, 486 aa, Influenza virus; identical to SEQ ID NO: 419880
  MOD_RES (1)..(101): Any amino acid
  MOD_RES (134)..(134): Any amino acid
  MOD_RES (151)..(159): Any amino acid
  MOD_RES (203)..(228): Any amino acid
  MOD_RES (257)..(278): Any amino acid
  MOD_RES (317)..(324): Any amino acid
  MOD_RES (340)..(413): Any amino acid
  MOD_RES (442)..(446): Any amino acid
  MOD_RES (483)..(486): Any amino acid

SEQ ID NO: 421098 - protein, 486 aa, Influenza virus; identical to SEQ ID NO: 419881
  MOD_RES (1)..(110): Any amino acid
  MOD_RES (134)..(134): Any amino acid
  MOD_RES (151)..(159): Any amino acid
  MOD_RES (205)..(228): Any amino acid
  MOD_RES (253)..(278): Any amino acid
  MOD_RES (317)..(324): Any amino acid
  MOD_RES (339)..(413): Any amino acid
  MOD_RES (438)..(446): Any amino acid
  MOD_RES (475)..(486): Any amino acid

SEQ ID NO: 421099 - protein, 486 aa, Influenza virus; identical to SEQ ID NO: 419882
  MOD_RES (1)..(110): Any amino acid
  MOD_RES (134)..(134): Any amino acid
  MOD_RES (146)..(164): Any amino acid
  MOD_RES (187)..(228): Any amino acid
  MOD_RES (255)..(278): Any amino acid
  MOD_RES (317)..(324): Any amino acid
  MOD_RES (339)..(413): Any amino acid
  MOD_RES (427)..(463): Any amino acid
  MOD_RES (475)..(486): Any amino acid

SEQ ID NO: 421100 - protein, 486 aa, Influenza virus; identical to SEQ ID NO: 419883
  MOD_RES (1)..(116): Any amino acid
  MOD_RES (132)..(134): Any amino acid
  MOD_RES (146)..(169): Any amino acid
  MOD_RES (184)..(228): Any amino acid
  MOD_RES (252)..(278): Any amino acid
  MOD_RES (298)..(303): Any amino acid
  MOD_RES (317)..(470): Any amino acid
  MOD_RES (484)..(486): Any amino acid

SEQ ID NO: 421101 - protein, 571 aa, Influenza virus; identical to SEQ ID NO: 419887
  MOD_RES (1)..(18): Any amino acid
  MOD_RES (33)..(46): Any amino acid
  MOD_RES (59)..(76): Any amino acid
  MOD_RES (93)..(109): Any amino acid
  MOD_RES (139)..(141): Any amino acid
  MOD_RES (157)..(177): Any amino acid
  MOD_RES (206)..(236): Any amino acid
  MOD_RES (275)..(317): Any amino acid
  MOD_RES (342)..(343): Any amino acid
  MOD_RES (505)..(505): Any amino acid
  MOD_RES (546)..(549): Any amino acid

SEQ ID NO: 421102 - protein, 571 aa, Influenza virus; identical to SEQ ID NO: 419888
  MOD_RES (1)..(18): Any amino acid
  MOD_RES (33)..(46): Any amino acid
  MOD_RES (59)..(76): Any amino acid
  MOD_RES (93)..(109): Any amino acid
  MOD_RES (139)..(141): Any amino acid
  MOD_RES (157)..(177): Any amino acid
  MOD_RES (206)..(236): Any amino acid
  MOD_RES (275)..(317): Any amino acid
  MOD_RES (342)..(343): Any amino acid
  MOD_RES (355)..(362): Any amino acid
  MOD_RES (437)..(443): Any amino acid
  MOD_RES (505)..(505): Any amino acid
  MOD_RES (544)..(549): Any amino acid

SEQ ID NO: 421103 - protein, 571 aa, Influenza virus; identical to SEQ ID NO: 419889
  MOD_RES (1)..(18): Any amino acid
  MOD_RES (32)..(46): Any amino acid
  MOD_RES (59)..(76): Any amino acid
  MOD_RES (93)..(109): Any amino acid
  MOD_RES (139)..(141): Any amino acid
  MOD_RES (157)..(177): Any amino acid
  MOD_RES (206)..(236): Any amino acid
  MOD_RES (275)..(317): Any amino acid
  MOD_RES (341)..(380): Any amino acid
  MOD_RES (434)..(444): Any amino acid
  MOD_RES (505)..(505): Any amino acid
  MOD_RES (546)..(549): Any amino acid

SEQ ID NO: 421104 - protein, 571 aa, Influenza virus; identical to SEQ ID NO: 419890
  MOD_RES (1)..(18): Any amino acid
  MOD_RES (30)..(46): Any amino acid
  MOD_RES (58)..(76): Any amino acid
  MOD_RES (93)..(109): Any amino acid
  MOD_RES (139)..(141): Any amino acid
  MOD_RES (157)..(177): Any amino acid
  MOD_RES (204)..(236): Any amino acid
  MOD_RES (269)..(317): Any amino acid
  MOD_RES (333)..(381): Any amino acid
  MOD_RES (400)..(412): Any amino acid
  MOD_RES (434)..(447): Any amino acid
  MOD_RES (505)..(505): Any amino acid
  MOD_RES (544)..(549): Any amino acid
  MOD_RES (569)..(571): Any amino acid

SEQ ID NO: 421105 - protein, 571 aa, Influenza virus; identical to SEQ ID NO: 419891
  MOD_RES (1)..(18): Any amino acid
  MOD_RES (33)..(46): Any amino acid
  MOD_RES (59)..(114): Any amino acid
  MOD_RES (139)..(141): Any amino acid
  MOD_RES (153)..(177): Any amino acid
  MOD_RES (189)..(236): Any amino acid
  MOD_RES (265)..(317): Any amino acid
  MOD_RES (330)..(384): Any amino acid
  MOD_RES (404)..(412): Any amino acid
  MOD_RES (436)..(449): Any amino acid
  MOD_RES (478)..(479): Any amino acid
  MOD_RES (501)..(505): Any amino acid
  MOD_RES (552)..(556): Any amino acid
  MOD_RES (568)..(571): Any amino acid

SEQ ID NO: 421106 - protein, 608 aa, Influenza virus; identical to SEQ ID NO: 419899
  MOD_RES (14)..(18): Any amino acid
  MOD_RES (30)..(36): Any amino acid
  MOD_RES (53)..(74): Any amino acid
  MOD_RES (92)..(138): Any amino acid
  MOD_RES (150)..(163): Any amino acid
  MOD_RES (175)..(266): Any amino acid
  MOD_RES (283)..(302): Any amino acid
  MOD_RES (314)..(319): Any amino acid
  MOD_RES (339)..(352): Any amino acid
  MOD_RES (396)..(398): Any amino acid
  MOD_RES (414)..(458): Any amino acid
  MOD_RES (516)..(555): Any amino acid
  MOD_RES (582)..(584): Any amino acid

SEQ ID NO: 421107 - protein, 608 aa, Influenza virus; identical to SEQ ID NO: 419900
  MOD_RES (14)..(18): Any amino acid
  MOD_RES (30)..(36): Any amino acid
  MOD_RES (53)..(74): Any amino acid
  MOD_RES (92)..(163): Any amino acid
  MOD_RES (175)..(266): Any amino acid
  MOD_RES (283)..(309): Any amino acid
  MOD_RES (339)..(360): Any amino acid
  MOD_RES (396)..(398): Any amino acid
  MOD_RES (414)..(458): Any amino acid
  MOD_RES (516)..(555): Any amino acid
  MOD_RES (567)..(584): Any amino acid
  MOD_RES (608)..(608): Any amino acid

SEQ ID NO: 421108 - protein, 608 aa, Influenza virus; identical to SEQ ID NO: 419901
  MOD_RES (1)..(2): Any amino acid
  MOD_RES (14)..(18): Any amino acid
  MOD_RES (30)..(36): Any amino acid
  MOD_RES (53)..(74): Any amino acid
  MOD_RES (91)..(163): Any amino acid
  MOD_RES (175)..(266): Any amino acid
  MOD_RES (283)..(319): Any amino acid
  MOD_RES (339)..(362): Any amino acid
  MOD_RES (375)..(376): Any amino acid
  MOD_RES (396)..(398): Any amino acid
  MOD_RES (414)..(458): Any amino acid
  MOD_RES (470)..(474): Any amino acid
  MOD_RES (516)..(555): Any amino acid
  MOD_RES (567)..(584): Any amino acid
  MOD_RES (600)..(608): Any amino acid

SEQ ID NO: 421109 - protein, 608 aa, Influenza virus; identical to SEQ ID NO: 419902
  MOD_RES (1)..(18): Any amino acid
  MOD_RES (30)..(36): Any amino acid
  MOD_RES (53)..(76): Any amino acid
  MOD_RES (92)..(266): Any amino acid
  MOD_RES (283)..(319): Any amino acid
  MOD_RES (339)..(362): Any amino acid
  MOD_RES (377)..(398): Any amino acid
  MOD_RES (414)..(458): Any amino acid
  MOD_RES (476)..(478): Any amino acid
  MOD_RES (504)..(504): Any amino acid
  MOD_RES (516)..(555): Any amino acid
  MOD_RES (567)..(584): Any amino acid
  MOD_RES (596)..(596): Any amino acid
  MOD_RES (608)..(608): Any amino acid

SEQ ID NO: 421110 - protein, 608 aa, Influenza virus; identical to SEQ ID NO: 419903
  MOD_RES (1)..(18): Any amino acid
  MOD_RES (30)..(39): Any amino acid
  MOD_RES (51)..(80): Any amino acid
  MOD_RES (92)..(267): Any amino acid
  MOD_RES (283)..(319): Any amino acid
  MOD_RES (339)..(366): Any amino acid
  MOD_RES (378)..(398): Any amino acid
  MOD_RES (410)..(458): Any amino acid
  MOD_RES (470)..(478): Any amino acid
  MOD_RES (505)..(555): Any amino acid
  MOD_RES (567)..(584): Any amino acid
  MOD_RES (596)..(596): Any amino acid
  MOD_RES (608)..(608): Any amino acid

SEQ ID NO: 421111 - protein, 599 aa, Influenza virus; identical to SEQ ID NO: 419909
  MOD_RES (14)..(18): Any amino acid
  MOD_RES (57)..(68): Any amino acid
  MOD_RES (92)..(92): Any amino acid
  MOD_RES (104)..(118): Any amino acid
  MOD_RES (130)..(135): Any amino acid
  MOD_RES (147)..(217): Any amino acid
  MOD_RES (232)..(261): Any amino acid
  MOD_RES (279)..(298): Any amino acid
  MOD_RES (336)..(348): Any amino acid
  MOD_RES (431)..(432): Any amino acid
  MOD_RES (507)..(541): Any amino acid

SEQ ID NO: 421112 - protein, 599 aa, Influenza virus; identical to SEQ ID NO: 419910
  MOD_RES (14)..(18): Any amino acid
  MOD_RES (57)..(68): Any amino acid
  MOD_RES (92)..(92): Any amino acid
  MOD_RES (104)..(118): Any amino acid
  MOD_RES (130)..(217): Any amino acid
  MOD_RES (232)..(261): Any amino acid
  MOD_RES (279)..(305): Any amino acid
  MOD_RES (336)..(355): Any amino acid
  MOD_RES (403)..(403): Any amino acid
  MOD_RES (426)..(432): Any amino acid
  MOD_RES (461)..(465): Any amino acid
  MOD_RES (507)..(541): Any amino acid
  MOD_RES (562)..(571): Any amino acid
  MOD_RES (587)..(587): Any amino acid
  MOD_RES (599)..(599): Any amino acid

SEQ ID NO: 421113 - protein, 599 aa, Influenza virus; identical to SEQ ID NO: 419911
  MOD_RES (1)..(2): Any amino acid
  MOD_RES (14)..(18): Any amino acid
  MOD_RES (56)..(68): Any amino acid
  MOD_RES (92)..(92): Any amino acid
  MOD_RES (104)..(118): Any amino acid
  MOD_RES (130)..(217): Any amino acid
  MOD_RES (232)..(261): Any amino acid
  MOD_RES (279)..(308): Any amino acid
  MOD_RES (336)..(355): Any amino acid
  MOD_RES (431)..(432): Any amino acid
  MOD_RES (452)..(469): Any amino acid
  MOD_RES (491)..(494): Any amino acid
  MOD_RES (507)..(541): Any amino acid
  MOD_RES (562)..(571): Any amino acid
  MOD_RES (599)..(599): Any amino acid

SEQ ID NO: 421114 - protein, 599 aa, Influenza virus; identical to SEQ ID NO: 419912
  MOD_RES (1)..(18): Any amino acid
  MOD_RES (57)..(68): Any amino acid
  MOD_RES (80)..(92): Any amino acid
  MOD_RES (104)..(118): Any amino acid
  MOD_RES (130)..(217): Any amino acid
  MOD_RES (231)..(261): Any amino acid
  MOD_RES (279)..(308): Any amino acid
  MOD_RES (324)..(324): Any amino acid
  MOD_RES (336)..(357): Any amino acid
  MOD_RES (431)..(432): Any amino acid
  MOD_RES (453)..(470): Any amino acid
  MOD_RES (492)..(495): Any amino acid
  MOD_RES (507)..(541): Any amino acid
  MOD_RES (599)..(599): Any amino acid

SEQ ID NO: 421115 - protein, 599 aa, Influenza virus; identical to SEQ ID NO: 419913
  MOD_RES (1)..(21): Any amino acid
  MOD_RES (57)..(68): Any amino acid
  MOD_RES (83)..(92): Any amino acid
  MOD_RES (104)..(118): Any amino acid
  MOD_RES (130)..(217): Any amino acid
  MOD_RES (232)..(261): Any amino acid
  MOD_RES (279)..(308): Any amino acid
  MOD_RES (336)..(357): Any amino acid
  MOD_RES (369)..(377): Any amino acid
  MOD_RES (431)..(433): Any amino acid
  MOD_RES (448)..(480): Any amino acid
  MOD_RES (493)..(541): Any amino acid
  MOD_RES (562)..(571): Any amino acid
  MOD_RES (590)..(599): Any amino acid

SEQ ID NO: 421116 - protein, 500 aa, Influenza virus; identical to SEQ ID NO: 419917
  MOD_RES (32)..(41): Any amino acid
  MOD_RES (56)..(74): Any amino acid
  MOD_RES (86)..(118): Any amino acid
  MOD_RES (136)..(137): Any amino acid
  MOD_RES (182)..(182): Any amino acid
  MOD_RES (228)..(241): Any amino acid
  MOD_RES (266)..(271): Any amino acid
  MOD_RES (291)..(292): Any amino acid
  MOD_RES (309)..(310): Any amino acid
  MOD_RES (330)..(336): Any amino acid
  MOD_RES (351)..(372): Any amino acid
  MOD_RES (387)..(388): Any amino acid
  MOD_RES (403)..(417): Any amino acid
  MOD_RES (456)..(457): Any amino acid
  MOD_RES (472)..(472): Any amino acid

SEQ ID NO: 421117 - protein, 500 aa, Influenza virus; identical to SEQ ID NO: 419918
  MOD_RES (1)..(1): Any amino acid
  MOD_RES (22)..(51): Any amino acid
  MOD_RES (63)..(74): Any amino acid
  MOD_RES (86)..(118): Any amino acid
  MOD_RES (136)..(137): Any amino acid
  MOD_RES (182)..(182): Any amino acid
  MOD_RES (228)..(241): Any amino acid
  MOD_RES (254)..(254): Any amino acid
  MOD_RES (266)..(279): Any amino acid
  MOD_RES (291)..(292): Any amino acid
  MOD_RES (309)..(310): Any amino acid
  MOD_RES (330)..(336): Any amino acid
  MOD_RES (351)..(372): Any amino acid
  MOD_RES (385)..(388): Any amino acid
  MOD_RES (403)..(417): Any amino acid
  MOD_RES (456)..(457): Any amino acid
  MOD_RES (472)..(484): Any amino acid
  MOD_RES (496)..(500): Any amino acid

SEQ ID NO: 421118 - protein, 500 aa, Influenza virus; identical to SEQ ID NO: 419919
  MOD_RES (1)..(1): Any amino acid
  MOD_RES (22)..(74): Any amino acid
  MOD_RES (86)..(118): Any amino acid
  MOD_RES (136)..(137): Any amino acid
  MOD_RES (182)..(182): Any amino acid
  MOD_RES (196)..(196): Any amino acid
  MOD_RES (228)..(241): Any amino acid
  MOD_RES (266)..(292): Any amino acid
  MOD_RES (309)..(310): Any amino acid
  MOD_RES (330)..(336): Any amino acid
  MOD_RES (351)..(372): Any amino acid
  MOD_RES (387)..(388): Any amino acid
  MOD_RES (402)..(417): Any amino acid
  MOD_RES (456)..(457): Any amino acid
  MOD_RES (472)..(484): Any amino acid
  MOD_RES (496)..(500): Any amino acid

SEQ ID NO: 421119 - protein, 500 aa, Influenza virus; identical to SEQ ID NO: 419920
  MOD_RES (1)..(5): Any amino acid
  MOD_RES (32)..(74): Any amino acid
  MOD_RES (86)..(118): Any amino acid
  MOD_RES (135)..(137): Any amino acid
  MOD_RES (168)..(168): Any amino acid
  MOD_RES (180)..(182): Any amino acid
  MOD_RES (195)..(197): Any amino acid
  MOD_RES (228)..(241): Any amino acid
  MOD_RES (266)..(292): Any amino acid
  MOD_RES (309)..(310): Any amino acid
  MOD_RES (330)..(336): Any amino acid
  MOD_RES (351)..(372): Any amino acid
  MOD_RES (387)..(388): Any amino acid
  MOD_RES (403)..(417): Any amino acid
  MOD_RES (456)..(457): Any amino acid
  MOD_RES (472)..(484): Any amino acid
  MOD_RES (496)..(500): Any amino acid

SEQ ID NO: 421120 - protein, 500 aa, Influenza virus; identical to SEQ ID NO: 419921
  MOD_RES (1)..(8): Any amino acid
  MOD_RES (21)..(74): Any amino acid
  MOD_RES (86)..(118): Any amino acid
  MOD_RES (136)..(137): Any amino acid
  MOD_RES (182)..(182): Any amino acid
  MOD_RES (194)..(197): Any amino acid
  MOD_RES (220)..(244): Any amino acid
  MOD_RES (266)..(336): Any amino acid
  MOD_RES (351)..(372): Any amino acid
  MOD_RES (384)..(388): Any amino acid
  MOD_RES (400)..(417): Any amino acid
  MOD_RES (449)..(457): Any amino acid
  MOD_RES (469)..(484): Any amino acid
  MOD_RES (496)..(500): Any amino acid

SEQ ID NO: 421121 - protein, 573 aa, Influenza virus; identical to SEQ ID NO: 419925
  MOD_RES (1)..(16): Any amino acid
  MOD_RES (44)..(89): Any amino acid
  MOD_RES (101)..(152): Any amino acid
  MOD_RES (171)..(257): Any amino acid
  MOD_RES (274)..(287): Any amino acid
  MOD_RES (299)..(339): Any amino acid
  MOD_RES (380)..(381): Any amino acid
  MOD_RES (396)..(441): Any amino acid
  MOD_RES (475)..(478): Any amino acid
  MOD_RES (497)..(497): Any amino acid
  MOD_RES (509)..(536): Any amino acid
  MOD_RES (549)..(549): Any amino acid

SEQ ID NO: 421122 - protein, 573 aa, Influenza virus; identical to SEQ ID NO: 419926
  MOD_RES (1)..(16): Any amino acid
  MOD_RES (44)..(89): Any amino acid
  MOD_RES (101)..(152): Any amino acid
  MOD_RES (171)..(257): Any amino acid
  MOD_RES (274)..(287): Any amino acid
  MOD_RES (299)..(344): Any amino acid
  MOD_RES (380)..(381): Any amino acid
  MOD_RES (396)..(441): Any amino acid
  MOD_RES (472)..(478): Any amino acid
  MOD_RES (497)..(497): Any amino acid
  MOD_RES (509)..(536): Any amino acid
  MOD_RES (549)..(549): Any amino acid
  MOD_RES (568)..(573): Any amino acid

SEQ ID NO: 421123 - protein, 573 aa, Influenza virus; identical to SEQ ID NO: 419927
  MOD_RES (1)..(16): Any amino acid
  MOD_RES (44)..(89): Any amino acid
  MOD_RES (101)..(158): Any amino acid
  MOD_RES (171)..(260): Any amino acid
  MOD_RES (274)..(287): Any amino acid
  MOD_RES (299)..(344): Any amino acid
  MOD_RES (357)..(358): Any amino acid
  MOD_RES (380)..(381): Any amino acid
  MOD_RES (396)..(441): Any amino acid
  MOD_RES (475)..(478): Any amino acid
  MOD_RES (497)..(497): Any amino acid
  MOD_RES (509)..(536): Any amino acid
  MOD_RES (549)..(549): Any amino acid
  MOD_RES (570)..(573): Any amino acid

SEQ ID NO: 421124 - protein, 573 aa, Influenza virus; identical to SEQ ID NO: 419928
  MOD_RES (1)..(16): Any amino acid
  MOD_RES (44)..(89): Any amino acid
  MOD_RES (101)..(158): Any amino acid
  MOD_RES (171)..(287): Any amino acid
  MOD_RES (299)..(348): Any amino acid
  MOD_RES (361)..(368): Any amino acid
  MOD_RES (380)..(381): Any amino acid
  MOD_RES (393)..(442): Any amino acid
  MOD_RES (475)..(478): Any amino acid
  MOD_RES (490)..(497): Any amino acid
  MOD_RES (509)..(536): Any amino acid
  MOD_RES (549)..(549): Any amino acid

SEQ ID NO: 421125 - protein, 573 aa, Influenza virus; identical to SEQ ID NO: 419929
  MOD_RES (1)..(19): Any amino acid
  MOD_RES (44)..(89): Any amino acid
  MOD_RES (101)..(158): Any amino acid
  MOD_RES (171)..(348): Any amino acid
  MOD_RES (360)..(368): Any amino acid
  MOD_RES (380)..(381): Any amino acid
  MOD_RES (396)..(443): Any amino acid
  MOD_RES (472)..(478): Any amino acid
  MOD_RES (495)..(497): Any amino acid
  MOD_RES (509)..(536): Any amino acid
  MOD_RES (549)..(549): Any amino acid

SEQ ID NO: 421126 - protein, 471 aa, Influenza virus; identical to SEQ ID NO: 419934
  MOD_RES (1)..(88): Any amino acid
  MOD_RES (113)..(113): Any amino acid
  MOD_RES (126)..(127): Any amino acid
  MOD_RES (142)..(153): Any amino acid
  MOD_RES (199)..(216): Any amino acid
  MOD_RES (235)..(236): Any amino acid
  MOD_RES (248)..(269): Any amino acid
  MOD_RES (283)..(283): Any amino acid
  MOD_RES (315)..(315): Any amino acid
  MOD_RES (334)..(334): Any amino acid
  MOD_RES (346)..(346): Any amino acid
  MOD_RES (358)..(368): Any amino acid
  MOD_RES (383)..(403): Any amino acid
  MOD_RES (416)..(417): Any amino acid
  MOD_RES (436)..(436): Any amino acid
  MOD_RES (471)..(471): Any amino acid

SEQ ID NO: 421127 - protein, 471 aa, Influenza virus; identical to SEQ ID NO: 419935
  MOD_RES (1)..(88): Any amino acid
  MOD_RES (113)..(113): Any amino acid
  MOD_RES (126)..(127): Any amino acid
  MOD_RES (142)..(153): Any amino acid
  MOD_RES (199)..(216): Any amino acid
  MOD_RES (235)..(236): Any amino acid
  MOD_RES (248)..(269): Any amino acid
  MOD_RES (283)..(283): Any amino acid
  MOD_RES (304)..(315): Any amino acid
  MOD_RES (334)..(334): Any amino acid
  MOD_RES (346)..(346): Any amino acid
  MOD_RES (358)..(368): Any amino acid
  MOD_RES (383)..(403): Any amino acid
  MOD_RES (416)..(417): Any amino acid
  MOD_RES (436)..(436): Any amino acid
  MOD_RES (471)..(471): Any amino acid

SEQ ID NO: 421128 - protein, 471 aa, Influenza virus; identical to SEQ ID NO: 419936
  MOD_RES (1)..(88): Any amino acid
  MOD_RES (112)..(114): Any amino acid
  MOD_RES (126)..(130): Any amino acid
  MOD_RES (142)..(153): Any amino acid
  MOD_RES (199)..(216): Any amino acid
  MOD_RES (235)..(236): Any amino acid
  MOD_RES (248)..(269): Any amino acid
  MOD_RES (281)..(287): Any amino acid
  MOD_RES (304)..(315): Any amino acid
  MOD_RES (334)..(334): Any amino acid
  MOD_RES (346)..(346): Any amino acid
  MOD_RES (358)..(368): Any amino acid
  MOD_RES (383)..(403): Any amino acid
  MOD_RES (416)..(417): Any amino acid
  MOD_RES (435)..(436): Any amino acid
  MOD_RES (453)..(456): Any amino acid
  MOD_RES (468)..(471): Any amino acid

SEQ ID NO: 421129 - protein, 471 aa, Influenza virus; identical to SEQ ID NO: 419937
  MOD_RES (1)..(88): Any amino acid
  MOD_RES (101)..(114): Any amino acid
  MOD_RES (126)..(153): Any amino acid
  MOD_RES (199)..(216): Any amino acid
  MOD_RES (235)..(236): Any amino acid
  MOD_RES (248)..(270): Any amino acid
  MOD_RES (282)..(287): Any amino acid
  MOD_RES (302)..(315): Any amino acid
  MOD_RES (334)..(334): Any amino acid
  MOD_RES (346)..(346): Any amino acid
  MOD_RES (358)..(368): Any amino acid
  MOD_RES (383)..(403): Any amino acid
  MOD_RES (416)..(417): Any amino acid
  MOD_RES (429)..(436): Any amino acid
  MOD_RES (448)..(457): Any amino acid
  MOD_RES (471)..(471): Any amino acid

SEQ ID NO: 421130 - protein, 471 aa, Influenza virus; identical to SEQ ID NO: 419938
  MOD_RES (1)..(88): Any amino acid
  MOD_RES (101)..(114): Any amino acid
  MOD_RES (126)..(153): Any amino acid
  MOD_RES (165)..(165): Any amino acid
  MOD_RES (194)..(217): Any amino acid
  MOD_RES (229)..(236): Any amino acid
  MOD_RES (248)..(270): Any amino acid
  MOD_RES (282)..(287): Any amino acid
  MOD_RES (304)..(334): Any amino acid
  MOD_RES (346)..(346): Any amino acid
  MOD_RES (358)..(369): Any amino acid
  MOD_RES (381)..(417): Any amino acid
  MOD_RES (429)..(439): Any amino acid
  MOD_RES (452)..(459): Any amino acid
  MOD_RES (471)..(471): Any amino acid

SEQ ID NO: 421131 - protein, 570 aa, Influenza virus; identical to SEQ ID NO: 419941
  MOD_RES (1)..(14): Any amino acid
  MOD_RES (52)..(250): Any amino acid
  MOD_RES (274)..(277): Any amino acid
  MOD_RES (289)..(307): Any amino acid
  MOD_RES (319)..(329): Any amino acid
  MOD_RES (343)..(344): Any amino acid
  MOD_RES (391)..(431): Any amino acid
  MOD_RES (462)..(471): Any amino acid
  MOD_RES (495)..(527): Any amino acid
  MOD_RES (550)..(554): Any amino acid

SEQ ID NO: 421132 - protein, 570 aa, Influenza virus; identical to SEQ ID NO: 419942
  MOD_RES (1)..(14): Any amino acid
  MOD_RES (52)..(250): Any amino acid
  MOD_RES (274)..(307): Any amino acid
  MOD_RES (319)..(329): Any amino acid
  MOD_RES (343)..(344): Any amino acid
  MOD_RES (391)..(431): Any amino acid
  MOD_RES (462)..(471): Any amino acid
  MOD_RES (490)..(527): Any amino acid
  MOD_RES (547)..(554): Any amino acid
  MOD_RES (566)..(570): Any amino acid

SEQ ID NO: 421133 - protein, 570 aa, Influenza virus; identical to SEQ ID NO: 419943
  MOD_RES (1)..(14): Any amino acid
  MOD_RES (52)..(250): Any amino acid
  MOD_RES (274)..(307): Any amino acid
  MOD_RES (319)..(329): Any amino acid
  MOD_RES (343)..(344): Any amino acid
  MOD_RES (375)..(378): Any amino acid
  MOD_RES (391)..(431): Any amino acid
  MOD_RES (461)..(471): Any amino acid
  MOD_RES (495)..(527): Any amino acid
  MOD_RES (550)..(554): Any amino acid
  MOD_RES (566)..(570): Any amino acid

SEQ ID NO: 421134 - protein, 570 aa, Influenza virus; identical to SEQ ID NO: 419944
  MOD_RES (1)..(14): Any amino acid
  MOD_RES (52)..(250): Any amino acid
  MOD_RES (274)..(307): Any amino acid
  MOD_RES (319)..(329): Any amino acid
  MOD_RES (341)..(344): Any amino acid
  MOD_RES (356)..(378): Any amino acid
  MOD_RES (391)..(431): Any amino acid
  MOD_RES (462)..(471): Any amino acid
  MOD_RES (495)..(527): Any amino acid
  MOD_RES (550)..(554): Any amino acid
  MOD_RES (566)..(570): Any amino acid

SEQ ID NO: 421135 - protein, 570 aa, Influenza virus; identical to SEQ ID NO: 419945
  MOD_RES (1)..(24): Any amino acid
  MOD_RES (52)..(262): Any amino acid
  MOD_RES (274)..(307): Any amino acid
  MOD_RES (319)..(331): Any amino acid
  MOD_RES (343)..(431): Any amino acid
  MOD_RES (445)..(448): Any amino acid
  MOD_RES (461)..(471): Any amino acid
  MOD_RES (495)..(535): Any amino acid
  MOD_RES (550)..(554): Any amino acid
  MOD_RES (566)..(570): Any amino acid

SEQ ID NO: 421136 - protein, 619 aa, Influenza virus; identical to SEQ ID NO: 419948
  MOD_RES (1)..(1): Any amino acid
  MOD_RES (14)..(23): Any amino acid
  MOD_RES (42)..(49): Any amino acid
  MOD_RES (67)..(93): Any amino acid
  MOD_RES (105)..(170): Any amino acid
  MOD_RES (185)..(275): Any amino acid
  MOD_RES (289)..(341): Any amino acid
  MOD_RES (355)..(356): Any amino acid
  MOD_RES (389)..(393): Any amino acid
  MOD_RES (449)..(465): Any amino acid
  MOD_RES (480)..(489): Any amino acid
  MOD_RES (508)..(513): Any amino acid
  MOD_RES (539)..(539): Any amino acid
  MOD_RES (552)..(571): Any amino acid
  MOD_RES (591)..(602): Any amino acid
  MOD_RES (614)..(619): Any amino acid

SEQ ID NO: 421137 - protein, 619 aa, Influenza virus; identical to SEQ ID NO: 419949
  MOD_RES (1)..(1): Any amino acid
  MOD_RES (14)..(30): Any amino acid
  MOD_RES (42)..(49): Any amino acid
  MOD_RES (67)..(93): Any amino acid
  MOD_RES (105)..(171): Any amino acid
  MOD_RES (185)..(275): Any amino acid
  MOD_RES (289)..(341): Any amino acid
  MOD_RES (355)..(356): Any amino acid
  MOD_RES (388)..(399): Any amino acid
  MOD_RES (447)..(465): Any amino acid
  MOD_RES (480)..(489): Any amino acid
  MOD_RES (508)..(513): Any amino acid
  MOD_RES (539)..(539): Any amino acid
  MOD_RES (552)..(571): Any amino acid
  MOD_RES (591)..(602): Any amino acid
  MOD_RES (614)..(619): Any amino acid

SEQ ID NO: 421138 - protein, 619 aa, Influenza virus; identical to SEQ ID NO: 419950
  MOD_RES (1)..(1): Any amino acid
  MOD_RES (14)..(49): Any amino acid
  MOD_RES (67)..(93): Any amino acid
  MOD_RES (105)..(171): Any amino acid
  MOD_RES (185)..(275): Any amino acid
  MOD_RES (289)..(341): Any amino acid
  MOD_RES (355)..(356): Any amino acid
  MOD_RES (368)..(375): Any amino acid
  MOD_RES (387)..(400): Any amino acid
  MOD_RES (449)..(465): Any amino acid
  MOD_RES (480)..(489): Any amino acid
  MOD_RES (504)..(513): Any amino acid
  MOD_RES (537)..(539): Any amino acid
  MOD_RES (552)..(571): Any amino acid
  MOD_RES (591)..(602): Any amino acid
  MOD_RES (614)..(619): Any amino acid

SEQ ID NO: 421139 - protein, 619 aa, Influenza virus; identical to SEQ ID NO: 419951
  MOD_RES (1)..(1): Any amino acid
  MOD_RES (14)..(49): Any amino acid
  MOD_RES (67)..(93): Any amino acid
  MOD_RES (105)..(173): Any amino acid
  MOD_RES (185)..(275): Any amino acid
  MOD_RES (289)..(341): Any amino acid
  MOD_RES (355)..(375): Any amino acid
  MOD_RES (387)..(405): Any amino acid
  MOD_RES (426)..(429): Any amino acid
  MOD_RES (449)..(465): Any amino acid
  MOD_RES (480)..(489): Any amino acid
  MOD_RES (504)..(513): Any amino acid
  MOD_RES (526)..(527): Any amino acid
  MOD_RES (539)..(539): Any amino acid
  MOD_RES (552)..(571): Any amino acid
  MOD_RES (591)..(603): Any amino acid
  MOD_RES (617)..(619): Any amino acid

SEQ ID NO: 421140 - protein, 619 aa, Influenza virus; identical to SEQ ID NO: 419952
  MOD_RES (1)..(1): Any amino acid
  MOD_RES (14)..(49): Any amino acid
  MOD_RES (67)..(276): Any amino acid
  MOD_RES (289)..(341): Any amino acid
  MOD_RES (353)..(375): Any amino acid
  MOD_RES (388)..(406): Any amino acid
  MOD_RES (428)..(432): Any amino acid
  MOD_RES (449)..(465): Any amino acid
  MOD_RES (477)..(489): Any amino acid
  MOD_RES (504)..(513): Any amino acid
  MOD_RES (528)..(539): Any amino acid
  MOD_RES (552)..(571): Any amino acid
  MOD_RES (591)..(608): Any amino acid

SEQ ID NO: 421141 - protein, 573 aa, Influenza virus; identical to SEQ ID NO: 419958
  MOD_RES (18)..(22): Any amino acid
  MOD_RES (62)..(78): Any amino acid
  MOD_RES (98)..(99): Any amino acid
  MOD_RES (111)..(122): Any amino acid
  MOD_RES (134)..(138): Any amino acid
  MOD_RES (150)..(155): Any amino acid
  MOD_RES (175)..(205): Any amino acid
  MOD_RES (219)..(234): Any amino acid
  MOD_RES (247)..(255): Any amino acid
  MOD_RES (279)..(300): Any amino acid
  MOD_RES (315)..(316): Any amino acid
  MOD_RES (568)..(573): Any amino acid

SEQ ID NO: 421142 - protein, 573 aa, Influenza virus; identical to SEQ ID NO: 419959
  MOD_RES (1)..(22): Any amino acid
  MOD_RES (62)..(78): Any amino acid
  MOD_RES (97)..(99): Any amino acid
  MOD_RES (111)..(122): Any amino acid
  MOD_RES (134)..(138): Any amino acid
  MOD_RES (150)..(155): Any amino acid
  MOD_RES (175)..(205): Any amino acid
  MOD_RES (219)..(234): Any amino acid
  MOD_RES (255)..(255): Any amino acid
  MOD_RES (279)..(300): Any amino acid
  MOD_RES (315)..(316): Any amino acid
  MOD_RES (376)..(392): Any amino acid
  MOD_RES (480)..(481): Any amino acid
  MOD_RES (568)..(573): Any amino acid

SEQ ID NO: 421143 - protein, 573 aa, Influenza virus; identical to SEQ ID NO: 419960
  MOD_RES (1)..(22): Any amino acid
  MOD_RES (61)..(78): Any amino acid
  MOD_RES (98)..(99): Any amino acid
  MOD_RES (111)..(122): Any amino acid
  MOD_RES (134)..(138): Any amino acid
  MOD_RES (150)..(155): Any amino acid
  MOD_RES (168)..(205): Any amino acid
  MOD_RES (219)..(234): Any amino acid
  MOD_RES (247)..(255): Any amino acid
  MOD_RES (279)..(300): Any amino acid
  MOD_RES (315)..(316): Any amino acid
  MOD_RES (386)..(392): Any amino acid
  MOD_RES (481)..(482): Any amino acid
  MOD_RES (532)..(536): Any amino acid
  MOD_RES (566)..(573): Any amino acid

SEQ ID NO: 421144 - protein, 573 aa, Influenza virus; identical to SEQ ID NO: 419961
  MOD_RES (1)..(22): Any amino acid
  MOD_RES (34)..(38): Any amino acid
  MOD_RES (62)..(78): Any amino acid
  MOD_RES (97)..(99): Any amino acid
  MOD_RES (111)..(122): Any amino acid
  MOD_RES (134)..(138): Any amino acid
  MOD_RES (150)..(155): Any amino acid
  MOD_RES (175)..(207): Any amino acid
  MOD_RES (219)..(234): Any amino acid
  MOD_RES (247)..(255): Any amino acid
  MOD_RES (279)..(300): Any amino acid
  MOD_RES (315)..(316): Any amino acid
  MOD_RES (342)..(342): Any amino acid
  MOD_RES (356)..(392): Any amino acid
  MOD_RES (445)..(446): Any amino acid
  MOD_RES (480)..(482): Any amino acid
  MOD_RES (532)..(537): Any amino acid
  MOD_RES (565)..(573): Any amino acid

SEQ ID NO: 421145 - protein, 573 aa, Influenza virus; identical to SEQ ID NO: 419962
  MOD_RES (1)..(22): Any amino acid
  MOD_RES (35)..(50): Any amino acid
  MOD_RES (62)..(78): Any amino acid
  MOD_RES (98)..(99): Any amino acid
  MOD_RES (111)..(122): Any amino acid
  MOD_RES (134)..(155): Any amino acid
  MOD_RES (175)..(207): Any amino acid
  MOD_RES (219)..(234): Any amino acid
  MOD_RES (247)..(256): Any amino acid
  MOD_RES (270)..(300): Any amino acid
  MOD_RES (312)..(316): Any amino acid
  MOD_RES (345)..(396): Any amino acid
  MOD_RES (425)..(426): Any amino acid
  MOD_RES (442)..(450): Any amino acid
  MOD_RES (470)..(496): Any amino acid
  MOD_RES (567)..(573): Any amino acid

SEQ ID NO: 421146 - protein, 469 aa, Influenza virus; identical to SEQ ID NO: 419969
  MOD_RES (20)..(58): Any amino acid
  MOD_RES (72)..(83): Any amino acid
  MOD_RES (95)..(95): Any amino acid
  MOD_RES (126)..(126): Any amino acid
  MOD_RES (208)..(210): Any amino acid
  MOD_RES (253)..(258): Any amino acid
  MOD_RES (308)..(311): Any amino acid
  MOD_RES (338)..(338): Any amino acid
  MOD_RES (391)..(397): Any amino acid
  MOD_RES (414)..(414): Any amino acid
  MOD_RES (468)..(469): Any amino acid

SEQ ID NO: 421147 - protein, 469 aa, Influenza virus; identical to SEQ ID NO: 419970
  MOD_RES (1)..(2): Any amino acid
  MOD_RES (18)..(58): Any amino acid
  MOD_RES (72)..(83): Any amino acid
  MOD_RES (95)..(95): Any amino acid
  MOD_RES (126)..(126): Any amino acid
  MOD_RES (208)..(210): Any amino acid
  MOD_RES (253)..(258): Any amino acid
  MOD_RES (308)..(311): Any amino acid
  MOD_RES (338)..(338): Any amino acid
  MOD_RES (391)..(397): Any amino acid
  MOD_RES (414)..(414): Any amino acid
  MOD_RES (468)..(469): Any amino acid

SEQ ID NO: 421148 - protein, 469 aa, Influenza virus; identical to SEQ ID NO: 419971
  MOD_RES (1)..(5): Any amino acid
  MOD_RES (20)..(58): Any amino acid
  MOD_RES (72)..(83): Any amino acid
  MOD_RES (95)..(95): Any amino acid
  MOD_RES (122)..(126): Any amino acid
  MOD_RES (165)..(166): Any amino acid
  MOD_RES (205)..(210): Any amino acid
  MOD_RES (223)..(227): Any amino acid
  MOD_RES (253)..(258): Any amino acid
  MOD_RES (274)..(275): Any amino acid
  MOD_RES (308)..(311): Any amino acid
  MOD_RES (338)..(338): Any amino acid
  MOD_RES (391)..(397): Any amino acid
  MOD_RES (412)..(414): Any amino acid
  MOD_RES (468)..(469): Any amino acid

SEQ ID NO: 421149 - protein, 469 aa, Influenza virus; identical to SEQ ID NO: 419972
  MOD_RES (1)..(7): Any amino acid
  MOD_RES (20)..(58): Any amino acid
  MOD_RES (72)..(83): Any amino acid
  MOD_RES (95)..(102): Any amino acid
  MOD_RES (124)..(126): Any amino acid
  MOD_RES (149)..(149): Any amino acid
  MOD_RES (164)..(188): Any amino acid
  MOD_RES (208)..(227): Any amino acid
  MOD_RES (253)..(258): Any amino acid
  MOD_RES (274)..(287): Any amino acid
  MOD_RES (308)..(311): Any amino acid
  MOD_RES (323)..(323): Any amino acid
  MOD_RES (338)..(338): Any amino acid
  MOD_RES (391)..(397): Any amino acid
  MOD_RES (413)..(414): Any amino acid
  MOD_RES (427)..(430): Any amino acid
  MOD_RES (453)..(455): Any amino acid
  MOD_RES (468)..(469): Any amino acid

SEQ ID NO: 421150 - protein, 469 aa, Influenza virus; identical to SEQ ID NO: 419973
  MOD_RES (1)..(8): Any amino acid
  MOD_RES (20)..(58): Any amino acid
  MOD_RES (72)..(83): Any amino acid
  MOD_RES (95)..(103): Any amino acid
  MOD_RES (126)..(126): Any amino acid
  MOD_RES (164)..(188): Any amino acid
  MOD_RES (203)..(227): Any amino acid
  MOD_RES (249)..(258): Any amino acid
  MOD_RES (273)..(312): Any amino acid
  MOD_RES (338)..(338): Any amino acid
  MOD_RES (369)..(373): Any amino acid
  MOD_RES (391)..(397): Any amino acid
  MOD_RES (414)..(430): Any amino acid
  MOD_RES (454)..(469): Any amino acid

SEQ ID NO: 421151 - protein, 597 aa, Influenza virus; identical to SEQ ID NO: 419978
  MOD_RES (18)..(24): Any amino acid
  MOD_RES (61)..(79): Any amino acid
  MOD_RES (99)..(125): Any amino acid
  MOD_RES (137)..(163): Any amino acid
  MOD_RES (175)..(197): Any amino acid
  MOD_RES (209)..(216): Any amino acid
  MOD_RES (228)..(228): Any amino acid
  MOD_RES (242)..(245): Any amino acid
  MOD_RES (259)..(267): Any amino acid
  MOD_RES (283)..(307): Any amino acid
  MOD_RES (322)..(335): Any amino acid
  MOD_RES (352)..(352): Any amino acid
  MOD_RES (373)..(377): Any amino acid
  MOD_RES (447)..(447): Any amino acid
  MOD_RES (523)..(523): Any amino acid
  MOD_RES (537)..(543): Any amino acid
  MOD_RES (578)..(582): Any amino acid

SEQ ID NO: 421152 - protein, 597 aa, Influenza virus; identical to SEQ ID NO: 419979
  MOD_RES (18)..(24): Any amino acid
  MOD_RES (61)..(79): Any amino acid
  MOD_RES (98)..(125): Any amino acid
  MOD_RES (137)..(163): Any amino acid
  MOD_RES (175)..(197): Any amino acid
  MOD_RES (209)..(216): Any amino acid
  MOD_RES (228)..(228): Any amino acid
  MOD_RES (242)..(245): Any amino acid
  MOD_RES (259)..(267): Any amino acid
  MOD_RES (283)..(307): Any amino acid
  MOD_RES (322)..(335): Any amino acid
  MOD_RES (352)..(352): Any amino acid
  MOD_RES (372)..(383): Any amino acid
  MOD_RES (444)..(447): Any amino acid
  MOD_RES (478)..(481): Any amino acid
  MOD_RES (511)..(511): Any amino acid
  MOD_RES (523)..(523): Any amino acid
  MOD_RES (537)..(543): Any amino acid
  MOD_RES (578)..(582): Any amino acid
  MOD_RES (597)..(597): Any amino acid

SEQ ID NO: 421153 - protein, 597 aa, Influenza virus; identical to SEQ ID NO: 419980
  MOD_RES (18)..(25): Any amino acid
  MOD_RES (61)..(79): Any amino acid
  MOD_RES (99)..(125): Any amino acid
  MOD_RES (137)..(163): Any amino acid
  MOD_RES (175)..(197): Any amino acid
  MOD_RES (209)..(216): Any amino acid
  MOD_RES (228)..(228): Any amino acid
  MOD_RES (242)..(245): Any amino acid
  MOD_RES (259)..(267): Any amino acid
  MOD_RES (283)..(307): Any amino acid
  MOD_RES (322)..(335): Any amino acid
  MOD_RES (352)..(352): Any amino acid
  MOD_RES (381)..(384): Any amino acid
  MOD_RES (406)..(407): Any amino acid
  MOD_RES (447)..(447): Any amino acid
  MOD_RES (475)..(481): Any amino acid
  MOD_RES (510)..(523): Any amino acid
  MOD_RES (537)..(543): Any amino acid
  MOD_RES (578)..(582): Any amino acid
  MOD_RES (595)..(597): Any amino acid

SEQ ID NO: 421154 - protein, 597 aa, Influenza virus; identical to SEQ ID NO: 419981
  MOD_RES (1)..(3): Any amino acid
  MOD_RES (18)..(25): Any amino acid
  MOD_RES (61)..(79): Any amino acid
  MOD_RES (99)..(125): Any amino acid
  MOD_RES (137)..(163): Any amino acid
  MOD_RES (182)..(197): Any amino acid
  MOD_RES (209)..(216): Any amino acid
  MOD_RES (228)..(228): Any amino acid
  MOD_RES (242)..(245): Any amino acid
  MOD_RES (259)..(267): Any amino acid
  MOD_RES (283)..(307): Any amino acid
  MOD_RES (322)..(338): Any amino acid
  MOD_RES (352)..(353): Any amino acid
  MOD_RES (365)..(390): Any amino acid
  MOD_RES (447)..(453): Any amino acid
  MOD_RES (478)..(482): Any amino acid
  MOD_RES (504)..(525): Any amino acid
  MOD_RES (537)..(543): Any amino acid
  MOD_RES (577)..(582): Any amino acid
  MOD_RES (596)..(597): Any amino acid

SEQ ID NO: 421155 - protein, 597 aa, Influenza virus; identical to SEQ ID NO: 419982
  MOD_RES (1)..(29): Any amino acid
  MOD_RES (61)..(79): Any amino acid
  MOD_RES (94)..(125): Any amino acid
  MOD_RES (137)..(163): Any amino acid
  MOD_RES (175)..(216): Any amino acid
  MOD_RES (228)..(228): Any amino acid
  MOD_RES (242)..(245): Any amino acid
  MOD_RES (259)..(267): Any amino acid
  MOD_RES (279)..(307): Any amino acid
  MOD_RES (322)..(340): Any amino acid
  MOD_RES (352)..(353): Any amino acid
  MOD_RES (365)..(420): Any amino acid
  MOD_RES (447)..(453): Any amino acid
  MOD_RES (482)..(482): Any amino acid
  MOD_RES (506)..(525): Any amino acid
  MOD_RES (537)..(543): Any amino acid
  MOD_RES (578)..(582): Any amino acid
  MOD_RES (595)..(597): Any amino acid

SEQ ID NO: 421156 - protein, 515 aa, Influenza virus; identical to SEQ ID NO: 419989
  MOD_RES (1)..(10): Any amino acid
  MOD_RES (38)..(63): Any amino acid
  MOD_RES (79)..(87): Any amino acid
  MOD_RES (113)..(113): Any amino acid
  MOD_RES (127)..(127): Any amino acid
  MOD_RES (149)..(150): Any amino acid
  MOD_RES (198)..(255): Any amino acid
  MOD_RES (308)..(318): Any amino acid
  MOD_RES (401)..(401): Any amino acid
  MOD_RES (418)..(425): Any amino acid
  MOD_RES (458)..(460): Any amino acid
  MOD_RES (478)..(479): Any amino acid

SEQ ID NO: 421157 - protein, 515 aa, Influenza virus; identical to SEQ ID NO: 419990
  MOD_RES (1)..(10): Any amino acid
  MOD_RES (38)..(63): Any amino acid
  MOD_RES (79)..(87): Any amino acid
  MOD_RES (111)..(113): Any amino acid
  MOD_RES (127)..(127): Any amino acid
  MOD_RES (149)..(150): Any amino acid
  MOD_RES (198)..(255): Any amino acid
  MOD_RES (308)..(318): Any amino acid
  MOD_RES (401)..(401): Any amino acid
  MOD_RES (414)..(425): Any amino acid
  MOD_RES (458)..(460): Any amino acid
  MOD_RES (478)..(479): Any amino acid
  MOD_RES (515)..(515): Any amino acid

SEQ ID NO: 421158 - protein, 515 aa, Influenza virus; identical to SEQ ID NO: 419991
  MOD_RES (1)..(10): Any amino acid
  MOD_RES (37)..(63): Any amino acid
  MOD_RES (79)..(87): Any amino acid
  MOD_RES (113)..(113): Any amino acid
  MOD_RES (127)..(127): Any amino acid
  MOD_RES (149)..(150): Any amino acid
  MOD_RES (198)..(255): Any amino acid
  MOD_RES (307)..(318): Any amino acid
  MOD_RES (401)..(401): Any amino acid
  MOD_RES (414)..(425): Any amino acid
  MOD_RES (458)..(460): Any amino acid
  MOD_RES (476)..(479): Any amino acid
  MOD_RES (492)..(492): Any amino acid
  MOD_RES (514)..(515): Any amino acid

SEQ ID NO: 421159 - protein, 515 aa, Influenza virus; identical to SEQ ID NO: 419992
  MOD_RES (1)..(10): Any amino acid
  MOD_RES (38)..(63): Any amino acid
  MOD_RES (79)..(87): Any amino acid
  MOD_RES (113)..(113): Any amino acid
  MOD_RES (125)..(127): Any amino acid
  MOD_RES (149)..(150): Any amino acid
  MOD_RES (196)..(255): Any amino acid
  MOD_RES (269)..(270): Any amino acid
  MOD_RES (308)..(318): Any amino acid
  MOD_RES (364)..(364): Any amino acid
  MOD_RES (400)..(402): Any amino acid
  MOD_RES (418)..(425): Any amino acid
  MOD_RES (449)..(461): Any amino acid
  MOD_RES (478)..(479): Any amino acid
  MOD_RES (496)..(498): Any amino acid

SEQ ID NO: 421160 - protein, 515 aa, Influenza virus; identical to SEQ ID NO: 419993
  MOD_RES (1)..(10): Any amino acid
  MOD_RES (38)..(63): Any amino acid
  MOD_RES (75)..(87): Any amino acid
  MOD_RES (113)..(114): Any amino acid
  MOD_RES (126)..(127): Any amino acid
  MOD_RES (149)..(152): Any amino acid
  MOD_RES (198)..(255): Any amino acid
  MOD_RES (270)..(270): Any amino acid
  MOD_RES (283)..(283): Any amino acid
  MOD_RES (308)..(319): Any amino acid
  MOD_RES (345)..(346): Any amino acid
  MOD_RES (361)..(375): Any amino acid
  MOD_RES (388)..(402): Any amino acid
  MOD_RES (418)..(425): Any amino acid
  MOD_RES (457)..(464): Any amino acid
  MOD_RES (478)..(479): Any amino acid
  MOD_RES (491)..(515): Any amino acid

SEQ ID NO: 421161 - protein, 585 aa, Influenza virus; identical to SEQ ID NO: 419996
  MOD_RES (18)..(23): Any amino acid
  MOD_RES (42)..(42): Any amino acid
  MOD_RES (67)..(91): Any amino acid
  MOD_RES (104)..(144): Any amino acid
  MOD_RES (156)..(161): Any amino acid
  MOD_RES (178)..(241): Any amino acid
  MOD_RES (258)..(261): Any amino acid
  MOD_RES (282)..(334): Any amino acid
  MOD_RES (348)..(349): Any amino acid
  MOD_RES (528)..(536): Any amino acid
  MOD_RES (563)..(568): Any amino acid

SEQ ID NO: 421162 - protein, 585 aa, Influenza virus; identical to SEQ ID NO: 419997
  MOD_RES (18)..(30): Any amino acid
  MOD_RES (42)..(42): Any amino acid
  MOD_RES (67)..(91): Any amino acid
  MOD_RES (103)..(144): Any amino acid
  MOD_RES (156)..(161): Any amino acid
  MOD_RES (178)..(241): Any amino acid
  MOD_RES (258)..(261): Any amino acid
  MOD_RES (282)..(334): Any amino acid
  MOD_RES (348)..(349): Any amino acid
  MOD_RES (369)..(371): Any amino acid
  MOD_RES (435)..(435): Any amino acid
  MOD_RES (528)..(536): Any amino acid
  MOD_RES (563)..(568): Any amino acid
  MOD_RES (584)..(585): Any amino acid

SEQ ID NO: 421163 - protein, 585 aa, Influenza virus; identical to SEQ ID NO: 419998
  MOD_RES (18)..(30): Any amino acid
  MOD_RES (42)..(42): Any amino acid
  MOD_RES (67)..(91): Any amino acid
  MOD_RES (104)..(144): Any amino acid
  MOD_RES (156)..(161): Any amino acid
  MOD_RES (178)..(241): Any amino acid
  MOD_RES (258)..(261): Any amino acid
  MOD_RES (282)..(334): Any amino acid
  MOD_RES (348)..(349): Any amino acid
  MOD_RES (361)..(361): Any amino acid
  MOD_RES (528)..(536): Any amino acid
  MOD_RES (563)..(568): Any amino acid
  MOD_RES (585)..(585): Any amino acid

SEQ ID NO: 421164 - protein, 585 aa, Influenza virus; identical to SEQ ID NO: 419999
  MOD_RES (18)..(30): Any amino acid
  MOD_RES (42)..(42): Any amino acid
  MOD_RES (64)..(91): Any amino acid
  MOD_RES (103)..(144): Any amino acid
  MOD_RES (156)..(161): Any amino acid
  MOD_RES (178)..(241): Any amino acid
  MOD_RES (255)..(261): Any amino acid
  MOD_RES (282)..(349): Any amino acid
  MOD_RES (363)..(363): Any amino acid
  MOD_RES (375)..(378): Any amino acid
  MOD_RES (400)..(400): Any amino acid
  MOD_RES (418)..(418): Any amino acid
  MOD_RES (528)..(536): Any amino acid
  MOD_RES (563)..(568): Any amino acid

SEQ ID NO: 421165 - protein, 585 aa, Influenza virus; identical to SEQ ID NO: 420000
  MOD_RES (1)..(30): Any amino acid
  MOD_RES (42)..(42): Any amino acid
  MOD_RES (65)..(144): Any amino acid
  MOD_RES (156)..(161): Any amino acid
  MOD_RES (174)..(244): Any amino acid
  MOD_RES (256)..(261): Any amino acid
  MOD_RES (281)..(350): Any amino acid
  MOD_RES (363)..(381): Any amino acid
  MOD_RES (393)..(403): Any amino acid
  MOD_RES (424)..(424): Any amino acid
  MOD_RES (452)..(452): Any amino acid
  MOD_RES (482)..(493): Any amino acid
  MOD_RES (528)..(536): Any amino acid
  MOD_RES (563)..(568): Any amino acid
  MOD_RES (585)..(585): Any amino acid

SEQ ID NO: 421166 - protein, 471 aa, Influenza virus; identical to SEQ ID NO: 420004
  MOD_RES (38)..(61): Any amino acid
  MOD_RES (73)..(81): Any amino acid
  MOD_RES (161)..(168): Any amino acid
  MOD_RES (194)..(194): Any amino acid
  MOD_RES (245)..(267): Any amino acid
  MOD_RES (285)..(286): Any amino acid
  MOD_RES (309)..(309): Any amino acid
  MOD_RES (332)..(333): Any amino acid
  MOD_RES (387)..(392): Any amino acid
  MOD_RES (416)..(416): Any amino acid
  MOD_RES (454)..(454): Any amino acid

SEQ ID NO: 421167 - protein, 471 aa, Influenza virus; identical to SEQ ID NO: 420005
  MOD_RES (38)..(61): Any amino acid
  MOD_RES (73)..(81): Any amino acid
  MOD_RES (161)..(168): Any amino acid
  MOD_RES (194)..(194): Any amino acid
  MOD_RES (240)..(267): Any amino acid
  MOD_RES (285)..(286): Any amino acid
  MOD_RES (309)..(309): Any amino acid
  MOD_RES (332)..(333): Any amino acid
  MOD_RES (387)..(392): Any amino acid
  MOD_RES (416)..(416): Any amino acid
  MOD_RES (428)..(429): Any amino acid
  MOD_RES (451)..(454): Any amino acid

SEQ ID NO: 421168 - protein, 471 aa, Influenza virus; identical to SEQ ID NO: 420006
  MOD_RES (38)..(61): Any amino acid
  MOD_RES (73)..(81): Any amino acid
  MOD_RES (157)..(168): Any amino acid
  MOD_RES (194)..(194): Any amino acid
  MOD_RES (245)..(267): Any amino acid
  MOD_RES (285)..(286): Any amino acid
  MOD_RES (309)..(309): Any amino acid
  MOD_RES (332)..(333): Any amino acid
  MOD_RES (387)..(392): Any amino acid
  MOD_RES (416)..(431): Any amino acid
  MOD_RES (453)..(454): Any amino acid
  MOD_RES (469)..(471): Any amino acid

SEQ ID NO: 421169 - protein, 471 aa, Influenza virus; identical to SEQ ID NO: 420007
  MOD_RES (38)..(61): Any amino acid
  MOD_RES (73)..(81): Any amino acid
  MOD_RES (127)..(141): Any amino acid
  MOD_RES (161)..(168): Any amino acid
  MOD_RES (194)..(194): Any amino acid
  MOD_RES (245)..(267): Any amino acid
  MOD_RES (285)..(286): Any amino acid
  MOD_RES (309)..(309): Any amino acid
  MOD_RES (332)..(334): Any amino acid
  MOD_RES (387)..(392): Any amino acid
  MOD_RES (411)..(436): Any amino acid
  MOD_RES (454)..(454): Any amino acid

SEQ ID NO: 421170 - protein, 471 aa, Influenza virus; identical to SEQ ID NO: 420008
  MOD_RES (1)..(5): Any amino acid
  MOD_RES (38)..(61): Any amino acid
  MOD_RES (73)..(82): Any amino acid
  MOD_RES (127)..(142): Any amino acid
  MOD_RES (161)..(171): Any amino acid
  MOD_RES (194)..(197): Any amino acid
  MOD_RES (226)..(227): Any amino acid
  MOD_RES (245)..(286): Any amino acid
  MOD_RES (309)..(309): Any amino acid
  MOD_RES (328)..(346): Any amino acid
  MOD_RES (387)..(392): Any amino acid
  MOD_RES (411)..(471): Any amino acid

SEQ ID NO: 421171 - protein, 567 aa, Influenza virus; identical to SEQ ID NO: 420011
  MOD_RES (1)..(9): Any amino acid
  MOD_RES (180)..(183): Any amino acid
  MOD_RES (325)..(325): Any amino acid
  MOD_RES (417)..(418): Any amino acid

SEQ ID NO: 421172 - protein, 567 aa, Influenza virus; identical to SEQ ID NO: 420012
  MOD_RES (1)..(9): Any amino acid
  MOD_RES (180)..(183): Any amino acid
  MOD_RES (246)..(264): Any amino acid
  MOD_RES (325)..(325): Any amino acid
  MOD_RES (417)..(418): Any amino acid

SEQ ID NO: 421173 - protein, 567 aa, Influenza virus; identical to SEQ ID NO: 420013
  MOD_RES (1)..(9): Any amino acid
  MOD_RES (23)..(23): Any amino acid
  MOD_RES (183)..(183): Any amino acid
  MOD_RES (250)..(268): Any amino acid
  MOD_RES (325)..(325): Any amino acid
  MOD_RES (354)..(380): Any amino acid
  MOD_RES (417)..(418): Any amino acid
  MOD_RES (559)..(567): Any amino acid

SEQ ID NO: 421174 - protein, 567 aa, Influenza virus; identical to SEQ ID NO: 420014
  MOD_RES (1)..(9): Any amino acid
  MOD_RES (21)..(26): Any amino acid
  MOD_RES (67)..(78): Any amino acid
  MOD_RES (100)..(120): Any amino acid
  MOD_RES (180)..(183): Any amino acid
  MOD_RES (254)..(269): Any amino acid
  MOD_RES (325)..(325): Any amino acid
  MOD_RES (356)..(380): Any amino acid
  MOD_RES (417)..(418): Any amino acid
  MOD_RES (441)..(450): Any amino acid
  MOD_RES (491)..(495): Any amino acid
  MOD_RES (533)..(567): Any amino acid

SEQ ID NO: 421175 - protein, 567 aa, Influenza virus; identical to SEQ ID NO: 420015
  MOD_RES (1)..(9): Any amino acid
  MOD_RES (76)..(86): Any amino acid
  MOD_RES (103)..(131): Any amino acid
  MOD_RES (169)..(171): Any amino acid
  MOD_RES (183)..(183): Any amino acid
  MOD_RES (197)..(201): Any amino acid
  MOD_RES (213)..(217): Any amino acid
  MOD_RES (254)..(270): Any amino acid
  MOD_RES (292)..(292): Any amino acid
  MOD_RES (325)..(325): Any amino acid
  MOD_RES (345)..(386): Any amino acid
  MOD_RES (408)..(418): Any amino acid
  MOD_RES (446)..(462): Any amino acid
  MOD_RES (487)..(495): Any amino acid
  MOD_RES (533)..(567): Any amino acid

SEQ ID NO: 421176 - protein, 562 aa, Influenza virus; identical to SEQ ID NO: 420019
  MOD_RES (13)..(77): Any amino acid
  MOD_RES (89)..(246): Any amino acid
  MOD_RES (258)..(339): Any amino acid
  MOD_RES (372)..(425): Any amino acid
  MOD_RES (452)..(471): Any amino acid
  MOD_RES (485)..(521): Any amino acid
  MOD_RES (538)..(562): Any amino acid

SEQ ID NO: 421177 - protein, 562 aa, Influenza virus; identical to SEQ ID NO: 420020
  MOD_RES (1)..(77): Any amino acid
  MOD_RES (89)..(246): Any amino acid
  MOD_RES (258)..(339): Any amino acid
  MOD_RES (372)..(425): Any amino acid
  MOD_RES (452)..(471): Any amino acid
  MOD_RES (485)..(521): Any amino acid
  MOD_RES (537)..(562): Any amino acid

SEQ ID NO: 421178 - protein, 562 aa, Influenza virus; identical to SEQ ID NO: 420021
  MOD_RES (1)..(77): Any amino acid
  MOD_RES (89)..(246): Any amino acid
  MOD_RES (258)..(345): Any amino acid
  MOD_RES (372)..(425): Any amino acid
  MOD_RES (452)..(471): Any amino acid
  MOD_RES (485)..(521): Any amino acid
  MOD_RES (538)..(562): Any amino acid

SEQ ID NO: 421179 - protein, 562 aa, Influenza virus; identical to SEQ ID NO: 420022
  MOD_RES (1)..(77): Any amino acid
  MOD_RES (89)..(246): Any amino acid
  MOD_RES (258)..(347): Any amino acid
  MOD_RES (372)..(425): Any amino acid
  MOD_RES (452)..(471): Any amino acid
  MOD_RES (483)..(521): Any amino acid
  MOD_RES (538)..(562): Any amino acid

SEQ ID NO: 421180 - protein, 562 aa, Influenza virus; identical to SEQ ID NO: 420023
  MOD_RES (1)..(77): Any amino acid
  MOD_RES (89)..(246): Any amino acid
  MOD_RES (258)..(348): Any amino acid
  MOD_RES (362)..(425): Any amino acid
  MOD_RES (452)..(471): Any amino acid
  MOD_RES (483)..(521): Any amino acid
  MOD_RES (538)..(562): Any amino acid

SEQ ID NO: 421181 - protein, 562 aa, Influenza virus; identical to SEQ ID NO: 420019
  MOD_RES (13)..(77): Any amino acid
  MOD_RES (89)..(246): Any amino acid
  MOD_RES (258)..(339): Any amino acid
  MOD_RES (372)..(425): Any amino acid
  MOD_RES (452)..(471): Any amino acid
  MOD_RES (485)..(521): Any amino acid
  MOD_RES (538)..(562): Any amino acid

SEQ ID NO: 421182 - protein, 562 aa, Influenza virus; identical to SEQ ID NO: 420027
  MOD_RES (1)..(77): Any amino acid
  MOD_RES (89)..(246): Any amino acid
  MOD_RES (258)..(340): Any amino acid
  MOD_RES (372)..(425): Any amino acid
  MOD_RES (452)..(471): Any amino acid
  MOD_RES (485)..(521): Any amino acid
  MOD_RES (537)..(562): Any amino acid

SEQ ID NO: 421183 - protein, 562 aa, Influenza virus; identical to SEQ ID NO: 420021
  MOD_RES (1)..(77): Any amino acid
  MOD_RES (89)..(246): Any amino acid
  MOD_RES (258)..(345): Any amino acid
  MOD_RES (372)..(425): Any amino acid
  MOD_RES (452)..(471): Any amino acid
  MOD_RES (485)..(521): Any amino acid
  MOD_RES (538)..(562): Any amino acid

SEQ ID NO: 421184 - protein, 562 aa, Influenza virus; identical to SEQ ID NO: 420022
  MOD_RES (1)..(77): Any amino acid
  MOD_RES (89)..(246): Any amino acid
  MOD_RES (258)..(347): Any amino acid
  MOD_RES (372)..(425): Any amino acid
  MOD_RES (452)..(471): Any amino acid
  MOD_RES (483)..(521): Any amino acid
  MOD_RES (538)..(562): Any amino acid

SEQ ID NO: 421185 - protein, 562 aa, Influenza virus; identical to SEQ ID NO: 420030
  MOD_RES (1)..(77): Any amino acid
  MOD_RES (89)..(246): Any amino acid
  MOD_RES (258)..(350): Any amino acid
  MOD_RES (362)..(425): Any amino acid
  MOD_RES (437)..(437): Any amino acid
  MOD_RES (449)..(471): Any amino acid
  MOD_RES (483)..(521): Any amino acid
  MOD_RES (538)..(562): Any amino acid

SEQ ID NO: 421186 - protein, 473 aa, Influenza virus; identical to SEQ ID NO: 420034
  MOD_RES (1)..(8): Any amino acid
  MOD_RES (20)..(51): Any amino acid
  MOD_RES (65)..(132): Any amino acid
  MOD_RES (145)..(157): Any amino acid
  MOD_RES (173)..(176): Any amino acid
  MOD_RES (195)..(225): Any amino acid
  MOD_RES (237)..(273): Any amino acid
  MOD_RES (287)..(293): Any amino acid
  MOD_RES (306)..(319): Any amino acid
  MOD_RES (333)..(420): Any amino acid
  MOD_RES (436)..(456): Any amino acid
  MOD_RES (468)..(473): Any amino acid

SEQ ID NO: 421187 - protein, 473 aa, Influenza virus; identical to SEQ ID NO: 420035
  MOD_RES (1)..(132): Any amino acid
  MOD_RES (145)..(157): Any amino acid
  MOD_RES (173)..(176): Any amino acid
  MOD_RES (195)..(225): Any amino acid
  MOD_RES (237)..(273): Any amino acid
  MOD_RES (287)..(293): Any amino acid
  MOD_RES (306)..(319): Any amino acid
  MOD_RES (333)..(420): Any amino acid
  MOD_RES (436)..(456): Any amino acid
  MOD_RES (468)..(473): Any amino acid

SEQ ID NO: 421188 - protein, 473 aa, Influenza virus; identical to SEQ ID NO: 420036
  MOD_RES (1)..(132): Any amino acid
  MOD_RES (145)..(157): Any amino acid
  MOD_RES (170)..(176): Any amino acid
  MOD_RES (195)..(225): Any amino acid
  MOD_RES (237)..(273): Any amino acid
  MOD_RES (286)..(293): Any amino acid
  MOD_RES (306)..(319): Any amino acid
  MOD_RES (331)..(420): Any amino acid
  MOD_RES (436)..(456): Any amino acid
  MOD_RES (468)..(473): Any amino acid

SEQ ID NO: 421189 - protein, 473 aa, Influenza virus; identical to SEQ ID NO: 420037
  MOD_RES (1)..(132): Any amino acid
  MOD_RES (145)..(157): Any amino acid
  MOD_RES (169)..(177): Any amino acid
  MOD_RES (195)..(225): Any amino acid
  MOD_RES (237)..(273): Any amino acid
  MOD_RES (286)..(293): Any amino acid
  MOD_RES (305)..(321): Any amino acid
  MOD_RES (333)..(421): Any amino acid
  MOD_RES (436)..(456): Any amino acid
  MOD_RES (468)..(473): Any amino acid

SEQ ID NO: 421190 - protein, 473 aa, Influenza virus; identical to SEQ ID NO: 420038
  MOD_RES (1)..(157): Any amino acid
  MOD_RES (170)..(183): Any amino acid
  MOD_RES (195)..(225): Any amino acid
  MOD_RES (237)..(273): Any amino acid
  MOD_RES (287)..(293): Any amino acid
  MOD_RES (305)..(321): Any amino acid
  MOD_RES (333)..(456): Any amino acid
  MOD_RES (468)..(473): Any amino acid

SEQ ID NO: 421191 - protein, 275 aa, Influenza virus; identical to SEQ ID NO: 420042
  MOD_RES (143)..(145): Any amino acid
  MOD_RES (169)..(169): Any amino acid
  MOD_RES (210)..(235): Any amino acid
  MOD_RES (266)..(275): Any amino acid

SEQ ID NO: 421192 - protein, 275 aa, Influenza virus; identical to SEQ ID NO: 420043
  MOD_RES (1)..(4): Any amino acid
  MOD_RES (51)..(51): Any amino acid
  MOD_RES (143)..(145): Any amino acid
  MOD_RES (169)..(169): Any amino acid
  MOD_RES (210)..(235): Any amino acid
  MOD_RES (254)..(256): Any amino acid

SEQ ID NO: 421193 - protein, 275 aa, Influenza virus; identical to SEQ ID NO: 420044
  MOD_RES (1)..(7): Any amino acid
  MOD_RES (51)..(55): Any amino acid
  MOD_RES (70)..(77): Any amino acid
  MOD_RES (99)..(99): Any amino acid
  MOD_RES (130)..(130): Any amino acid
  MOD_RES (143)..(145): Any amino acid
  MOD_RES (169)..(169): Any amino acid
  MOD_RES (210)..(235): Any amino acid
  MOD_RES (254)..(275): Any amino acid

SEQ ID NO: 421194 - protein, 275 aa, Influenza virus; identical to SEQ ID NO: 420045
  MOD_RES (1)..(22): Any amino acid
  MOD_RES (51)..(87): Any amino acid
  MOD_RES (115)..(118): Any amino acid
  MOD_RES (143)..(152): Any amino acid
  MOD_RES (169)..(169): Any amino acid
  MOD_RES (181)..(193): Any amino acid
  MOD_RES (210)..(235): Any amino acid
  MOD_RES (254)..(275): Any amino acid

SEQ ID NO: 421195 - protein, 275 aa, Influenza virus; identical to SEQ ID NO: 420046
  MOD_RES (1)..(22): Any amino acid
  MOD_RES (60)..(90): Any amino acid
  MOD_RES (130)..(131): Any amino acid
  MOD_RES (143)..(198): Any amino acid
  MOD_RES (210)..(236): Any amino acid
  MOD_RES (249)..(275): Any amino acid

SEQ ID NO: 421196 - protein, 99 aa, Influenza virus; identical to SEQ ID NO: 420049
  MOD_RES (1)..(9): Any amino acid
  MOD_RES (21)..(88): Any amino acid

SEQ ID NO: 421197 - protein, 99 aa, Influenza virus; identical to SEQ ID NO: 420050
  MOD_RES (1)..(88): Any amino acid

SEQ ID NO: 421198 - protein, 527 aa, Influenza virus; identical to SEQ ID NO: 420051
  MOD_RES (33)..(50): Any amino acid
  MOD_RES (67)..(69): Any amino acid
  MOD_RES (116)..(146): Any amino acid
  MOD_RES (304)..(306): Any amino acid
  MOD_RES (328)..(338): Any amino acid
  MOD_RES (366)..(379): Any amino acid
  MOD_RES (393)..(399): Any amino acid
  MOD_RES (421)..(428): Any amino acid
  MOD_RES (445)..(455): Any amino acid
  MOD_RES (480)..(480): Any amino acid
  MOD_RES (497)..(507): Any amino acid

SEQ ID NO: 421199 - protein, 527 aa, Influenza virus; identical to SEQ ID NO: 420052
  MOD_RES (1)..(9): Any amino acid
  MOD_RES (33)..(50): Any amino acid
  MOD_RES (67)..(69): Any amino acid
  MOD_RES (116)..(146): Any amino acid
  MOD_RES (184)..(188): Any amino acid
  MOD_RES (304)..(306): Any amino acid
  MOD_RES (328)..(338): Any amino acid
  MOD_RES (366)..(379): Any amino acid
  MOD_RES (393)..(399): Any amino acid
  MOD_RES (421)..(428): Any amino acid
  MOD_RES (445)..(455): Any amino acid
  MOD_RES (468)..(480): Any amino acid
  MOD_RES (497)..(507): Any amino acid
  MOD_RES (524)..(527): Any amino acid

SEQ ID NO: 421200 - protein, 527 aa, Influenza virus; identical to SEQ ID NO: 420053
  MOD_RES (1)..(9): Any amino acid
  MOD_RES (37)..(50): Any amino acid
  MOD_RES (67)..(69): Any amino acid
  MOD_RES (81)..(89): Any amino acid
  MOD_RES (116)..(146): Any amino acid
  MOD_RES (173)..(191): Any amino acid
  MOD_RES (304)..(306): Any amino acid
  MOD_RES (328)..(338): Any amino acid
  MOD_RES (366)..(379): Any amino acid
  MOD_RES (393)..(399): Any amino acid
  MOD_RES (421)..(428): Any amino acid
  MOD_RES (445)..(455): Any amino acid
  MOD_RES (468)..(480): Any amino acid
  MOD_RES (496)..(507): Any amino acid
  MOD_RES (523)..(527): Any amino acid

SEQ ID NO: 421201 - protein, 527 aa, Influenza virus; identical to SEQ ID NO: 420054
  MOD_RES (1)..(9): Any amino acid
  MOD_RES (33)..(53): Any amino acid
  MOD_RES (67)..(69): Any amino acid
  MOD_RES (81)..(89): Any amino acid
  MOD_RES (109)..(146): Any amino acid
  MOD_RES (163)..(194): Any amino acid
  MOD_RES (218)..(230): Any amino acid
  MOD_RES (264)..(265): Any amino acid
  MOD_RES (304)..(306): Any amino acid
  MOD_RES (328)..(338): Any amino acid
  MOD_RES (366)..(379): Any amino acid
  MOD_RES (392)..(407): Any amino acid
  MOD_RES (421)..(428): Any amino acid
  MOD_RES (444)..(462): Any amino acid
  MOD_RES (474)..(480): Any amino acid
  MOD_RES (497)..(507): Any amino acid
  MOD_RES (524)..(527): Any amino acid

SEQ ID NO: 421202 - protein, 527 aa, Influenza virus; identical to SEQ ID NO: 420055
  MOD_RES (1)..(11): Any amino acid
  MOD_RES (33)..(55): Any amino acid
  MOD_RES (67)..(69): Any amino acid
  MOD_RES (90)..(90): Any amino acid
  MOD_RES (112)..(151): Any amino acid
  MOD_RES (163)..(194): Any amino acid
  MOD_RES (221)..(230): Any amino acid
  MOD_RES (244)..(245): Any amino acid
  MOD_RES (263)..(266): Any amino acid
  MOD_RES (304)..(320): Any amino acid
  MOD_RES (334)..(340): Any amino acid
  MOD_RES (356)..(379): Any amino acid
  MOD_RES (392)..(409): Any amino acid
  MOD_RES (421)..(428): Any amino acid
  MOD_RES (445)..(466): Any amino acid
  MOD_RES (478)..(480): Any amino acid
  MOD_RES (493)..(510): Any amino acid
  MOD_RES (524)..(527): Any amino acid

SEQ ID NO: 421203 - protein, 308 aa, Influenza virus; identical to SEQ ID NO: 420062
  MOD_RES (28)..(44): Any amino acid
  MOD_RES (58)..(74): Any amino acid
  MOD_RES (93)..(123): Any amino acid
  MOD_RES (139)..(183): Any amino acid
  MOD_RES (196)..(222): Any amino acid
  MOD_RES (234)..(262): Any amino acid
  MOD_RES (283)..(283): Any amino acid

SEQ ID NO: 421204 - protein, 308 aa, Influenza virus; identical to SEQ ID NO: 420063
  MOD_RES (1)..(25): Any amino acid
  MOD_RES (37)..(44): Any amino acid
  MOD_RES (68)..(123): Any amino acid
  MOD_RES (139)..(283): Any amino acid
  MOD_RES (307)..(308): Any amino acid

SEQ ID NO: 421205 - protein, 308 aa, Influenza virus; identical to SEQ ID NO: 420064
  MOD_RES (1)..(25): Any amino acid
  MOD_RES (37)..(44): Any amino acid
  MOD_RES (58)..(124): Any amino acid
  MOD_RES (138)..(283): Any amino acid
  MOD_RES (305)..(308): Any amino acid

SEQ ID NO: 421206 - protein, 308 aa, Influenza virus; identical to SEQ ID NO: 420065
  MOD_RES (1)..(25): Any amino acid
  MOD_RES (37)..(44): Any amino acid
  MOD_RES (58)..(125): Any amino acid
  MOD_RES (139)..(308): Any amino acid

SEQ ID NO: 421207 - protein, 308 aa, Influenza virus; identical to SEQ ID NO: 420066
  MOD_RES (1)..(25): Any amino acid
  MOD_RES (37)..(44): Any amino acid
  MOD_RES (58)..(308): Any amino acid

SEQ ID NO: 421208 - protein, 205 aa, Influenza virus; identical to SEQ ID NO: 420070
  MOD_RES (98)..(100): Any amino acid
  MOD_RES (112)..(168): Any amino acid
  MOD_RES (203)..(205): Any amino acid

SEQ ID NO: 421209 - protein, 205 aa, Influenza virus; identical to SEQ ID NO: 420071
  MOD_RES (1)..(13): Any amino acid
  MOD_RES (39)..(81): Any amino acid
  MOD_RES (98)..(168): Any amino acid

SEQ ID NO: 421210 - protein, 205 aa, Influenza virus; identical to SEQ ID NO: 420072
  MOD_RES (1)..(13): Any amino acid
  MOD_RES (36)..(168): Any amino acid
  MOD_RES (203)..(205): Any amino acid

SEQ ID NO: 421211 - protein, 205 aa, Influenza virus; identical to SEQ ID NO: 420073
  MOD_RES (1)..(168): Any amino acid
  MOD_RES (192)..(205): Any amino acid

SEQ ID NO: 421212 - protein, 205 aa, Influenza virus; identical to SEQ ID NO: 420074
  MOD_RES (1)..(180): Any amino acid
  MOD_RES (192)..(205): Any amino acid

SEQ ID NO: 421213 - protein, 734 aa, Influenza virus; identical to SEQ ID NO: 420075
  MOD_RES (27)..(30): Any amino acid
  MOD_RES (58)..(66): Any amino acid
  MOD_RES (86)..(101): Any amino acid
  MOD_RES (141)..(142): Any amino acid
  MOD_RES (159)..(159): Any amino acid
  MOD_RES (209)..(215): Any amino acid
  MOD_RES (227)..(230): Any amino acid
  MOD_RES (254)..(277): Any amino acid
  MOD_RES (315)..(352): Any amino acid
  MOD_RES (364)..(370): Any amino acid
  MOD_RES (387)..(410): Any amino acid
  MOD_RES (428)..(430): Any amino acid
  MOD_RES (451)..(451): Any amino acid
  MOD_RES (468)..(468): Any amino acid
  MOD_RES (535)..(569): Any amino acid
  MOD_RES (619)..(636): Any amino acid
  MOD_RES (728)..(734): Any amino acid

SEQ ID NO: 421214 - protein, 734 aa, Influenza virus; identical to SEQ ID NO: 420076
  MOD_RES (27)..(30): Any amino acid
  MOD_RES (58)..(66): Any amino acid
  MOD_RES (86)..(101): Any amino acid
  MOD_RES (141)..(142): Any amino acid
  MOD_RES (159)..(159): Any amino acid
  MOD_RES (209)..(215): Any amino acid
  MOD_RES (227)..(230): Any amino acid
  MOD_RES (254)..(277): Any amino acid
  MOD_RES (315)..(370): Any amino acid
  MOD_RES (387)..(410): Any amino acid
  MOD_RES (428)..(430): Any amino acid
  MOD_RES (451)..(451): Any amino acid
  MOD_RES (468)..(468): Any amino acid
  MOD_RES (535)..(569): Any amino acid
  MOD_RES (619)..(636): Any amino acid
  MOD_RES (709)..(710): Any amino acid
  MOD_RES (732)..(734): Any amino acid

SEQ ID NO: 421215 - protein, 734 aa, Influenza virus; identical to SEQ ID NO: 420077
  MOD_RES (27)..(30): Any amino acid
  MOD_RES (58)..(66): Any amino acid
  MOD_RES (86)..(101): Any amino acid
  MOD_RES (141)..(146): Any amino acid
  MOD_RES (159)..(159): Any amino acid
  MOD_RES (209)..(215): Any amino acid
  MOD_RES (227)..(230): Any amino acid
  MOD_RES (254)..(277): Any amino acid
  MOD_RES (315)..(370): Any amino acid
  MOD_RES (387)..(410): Any amino acid
  MOD_RES (428)..(430): Any amino acid
  MOD_RES (451)..(451): Any amino acid
  MOD_RES (468)..(468): Any amino acid
  MOD_RES (514)..(518): Any amino acid
  MOD_RES (535)..(569): Any amino acid
  MOD_RES (593)..(594): Any amino acid
  MOD_RES (619)..(636): Any amino acid
  MOD_RES (708)..(710): Any amino acid
  MOD_RES (727)..(734): Any amino acid

SEQ ID NO: 421216 - protein, 734 aa, Influenza virus; identical to SEQ ID NO: 420078
  MOD_RES (27)..(30): Any amino acid
  MOD_RES (58)..(66): Any amino acid
  MOD_RES (86)..(101): Any amino acid
  MOD_RES (135)..(146): Any amino acid
  MOD_RES (159)..(159): Any amino acid
  MOD_RES (183)..(185): Any amino acid
  MOD_RES (209)..(215): Any amino acid
  MOD_RES (227)..(230): Any amino acid
  MOD_RES (249)..(277): Any amino acid
  MOD_RES (289)..(290): Any amino acid
  MOD_RES (315)..(370): Any amino acid
  MOD_RES (384)..(410): Any amino acid
  MOD_RES (428)..(430): Any amino acid
  MOD_RES (451)..(451): Any amino acid
  MOD_RES (468)..(468): Any amino acid
  MOD_RES (511)..(524): Any amino acid
  MOD_RES (543)..(569): Any amino acid
  MOD_RES (581)..(596): Any amino acid
  MOD_RES (619)..(636): Any amino acid
  MOD_RES (693)..(693): Any amino acid
  MOD_RES (708)..(710): Any amino acid

SEQ ID NO: 421217 - protein, 734 aa, Influenza virus; identical to SEQ ID NO: 420079
  MOD_RES (19)..(31): Any amino acid
  MOD_RES (58)..(67): Any amino acid
  MOD_RES (79)..(101): Any amino acid
  MOD_RES (114)..(119): Any amino acid
  MOD_RES (135)..(147): Any amino acid
  MOD_RES (159)..(163): Any amino acid
  MOD_RES (184)..(196): Any amino acid
  MOD_RES (209)..(230): Any amino acid
  MOD_RES (254)..(290): Any amino acid
  MOD_RES (303)..(370): Any amino acid
  MOD_RES (383)..(415): Any amino acid
  MOD_RES (428)..(433): Any amino acid
  MOD_RES (445)..(451): Any amino acid
  MOD_RES (468)..(469): Any amino acid
  MOD_RES (516)..(525): Any amino acid
  MOD_RES (543)..(569): Any amino acid
  MOD_RES (581)..(600): Any amino acid
  MOD_RES (619)..(636): Any amino acid
  MOD_RES (668)..(668): Any amino acid
  MOD_RES (710)..(710): Any amino acid
  MOD_RES (723)..(734): Any amino acid

SEQ ID NO: 421218 - protein, 829 aa, Influenza virus; identical to SEQ ID NO: 420086
  MOD_RES (12)..(14): Any amino acid
  MOD_RES (58)..(61): Any amino acid
  MOD_RES (78)..(78): Any amino acid
  MOD_RES (112)..(115): Any amino acid
  MOD_RES (156)..(159): Any amino acid
  MOD_RES (174)..(184): Any amino acid
  MOD_RES (197)..(217): Any amino acid
  MOD_RES (324)..(335): Any amino acid
  MOD_RES (365)..(391): Any amino acid
  MOD_RES (405)..(405): Any amino acid
  MOD_RES (437)..(440): Any amino acid
  MOD_RES (462)..(464): Any amino acid
  MOD_RES (575)..(594): Any amino acid
  MOD_RES (625)..(626): Any amino acid
  MOD_RES (668)..(684): Any amino acid
  MOD_RES (792)..(792): Any amino acid
  MOD_RES (804)..(806): Any amino acid

SEQ ID NO: 421219 - protein, 829 aa, Influenza virus; identical to SEQ ID NO: 420087
  MOD_RES (12)..(14): Any amino acid
  MOD_RES (27)..(35): Any amino acid
  MOD_RES (57)..(61): Any amino acid
  MOD_RES (78)..(78): Any amino acid
  MOD_RES (112)..(115): Any amino acid
  MOD_RES (156)..(159): Any amino acid
  MOD_RES (174)..(184): Any amino acid
  MOD_RES (197)..(217): Any amino acid
  MOD_RES (229)..(244): Any amino acid
  MOD_RES (274)..(283): Any amino acid
  MOD_RES (324)..(335): Any amino acid
  MOD_RES (357)..(405): Any amino acid
  MOD_RES (418)..(419): Any amino acid
  MOD_RES (437)..(440): Any amino acid
  MOD_RES (462)..(464): Any amino acid
  MOD_RES (504)..(513): Any amino acid
  MOD_RES (546)..(559): Any amino acid
  MOD_RES (575)..(594): Any amino acid
  MOD_RES (625)..(626): Any amino acid
  MOD_RES (642)..(684): Any amino acid
  MOD_RES (714)..(730): Any amino acid
  MOD_RES (787)..(792): Any amino acid
  MOD_RES (804)..(806): Any amino acid
  MOD_RES (828)..(829): Any amino acid

SEQ ID NO: 421220 - protein, 829 aa, Influenza virus; identical to SEQ ID NO: 420088
  MOD_RES (1)..(3): Any amino acid
  MOD_RES (27)..(43): Any amino acid
  MOD_RES (58)..(61): Any amino acid
  MOD_RES (78)..(78): Any amino acid
  MOD_RES (112)..(115): Any amino acid
  MOD_RES (134)..(143): Any amino acid
  MOD_RES (156)..(159): Any amino acid
  MOD_RES (174)..(184): Any amino acid
  MOD_RES (197)..(217): Any amino acid
  MOD_RES (229)..(248): Any amino acid
  MOD_RES (274)..(285): Any amino acid
  MOD_RES (324)..(335): Any amino acid
  MOD_RES (363)..(405): Any amino acid
  MOD_RES (419)..(425): Any amino acid
  MOD_RES (437)..(440): Any amino acid
  MOD_RES (462)..(464): Any amino acid
  MOD_RES (498)..(523): Any amino acid
  MOD_RES (544)..(562): Any amino acid
  MOD_RES (575)..(594): Any amino acid
  MOD_RES (610)..(610): Any amino acid
  MOD_RES (625)..(626): Any amino acid
  MOD_RES (642)..(684): Any amino acid
  MOD_RES (724)..(733): Any amino acid
  MOD_RES (759)..(761): Any amino acid
  MOD_RES (792)..(792): Any amino acid
  MOD_RES (804)..(829): Any amino acid

SEQ ID NO: 421221 - protein, 829 aa, Influenza virus; identical to SEQ ID NO: 420089
  MOD_RES (1)..(8): Any amino acid
  MOD_RES (20)..(45): Any amino acid
  MOD_RES (58)..(61): Any amino acid
  MOD_RES (78)..(78): Any amino acid
  MOD_RES (112)..(115): Any amino acid
  MOD_RES (127)..(143): Any amino acid
  MOD_RES (156)..(162): Any amino acid
  MOD_RES (174)..(217): Any amino acid
  MOD_RES (234)..(248): Any amino acid
  MOD_RES (274)..(286): Any amino acid
  MOD_RES (300)..(311): Any amino acid
  MOD_RES (324)..(335): Any amino acid
  MOD_RES (365)..(405): Any amino acid
  MOD_RES (417)..(440): Any amino acid
  MOD_RES (462)..(465): Any amino acid
  MOD_RES (487)..(523): Any amino acid
  MOD_RES (549)..(563): Any amino acid
  MOD_RES (575)..(602): Any amino acid
  MOD_RES (624)..(626): Any amino acid
  MOD_RES (642)..(703): Any amino acid
  MOD_RES (718)..(733): Any amino acid
  MOD_RES (787)..(829): Any amino acid

SEQ ID NO: 421222 - protein, 829 aa, Influenza virus; identical to SEQ ID NO: 420090
  MOD_RES (1)..(45): Any amino acid
  MOD_RES (58)..(61): Any amino acid
  MOD_RES (75)..(88): Any amino acid
  MOD_RES (112)..(143): Any amino acid
  MOD_RES (155)..(162): Any amino acid
  MOD_RES (174)..(217): Any amino acid
  MOD_RES (231)..(248): Any amino acid
  MOD_RES (262)..(294): Any amino acid
  MOD_RES (307)..(311): Any amino acid
  MOD_RES (324)..(335): Any amino acid
  MOD_RES (351)..(440): Any amino acid
  MOD_RES (453)..(470): Any amino acid
  MOD_RES (482)..(527): Any amino acid
  MOD_RES (544)..(563): Any amino acid
  MOD_RES (575)..(629): Any amino acid
  MOD_RES (642)..(737): Any amino acid
  MOD_RES (756)..(766): Any amino acid
  MOD_RES (787)..(829): Any amino acid

SEQ ID NO: 421223 - protein, 780 aa, Influenza virus; identical to SEQ ID NO: 420097
  MOD_RES (73)..(101): Any amino acid
  MOD_RES (117)..(139): Any amino acid
  MOD_RES (165)..(168): Any amino acid
  MOD_RES (197)..(210): Any amino acid
  MOD_RES (264)..(264): Any amino acid
  MOD_RES (305)..(308): Any amino acid
  MOD_RES (349)..(353): Any amino acid
  MOD_RES (367)..(411): Any amino acid
  MOD_RES (459)..(508): Any amino acid
  MOD_RES (572)..(583): Any amino acid
  MOD_RES (601)..(603): Any amino acid
  MOD_RES (626)..(626): Any amino acid
  MOD_RES (674)..(675): Any amino acid
  MOD_RES (697)..(698): Any amino acid
  MOD_RES (731)..(731): Any amino acid
  MOD_RES (778)..(780): Any amino acid

SEQ ID NO: 421224 - protein, 780 aa, Influenza virus; identical to SEQ ID NO: 420098
  MOD_RES (73)..(101): Any amino acid
  MOD_RES (117)..(139): Any amino acid
  MOD_RES (165)..(168): Any amino acid
  MOD_RES (197)..(210): Any amino acid
  MOD_RES (223)..(223): Any amino acid
  MOD_RES (264)..(264): Any amino acid
  MOD_RES (305)..(308): Any amino acid
  MOD_RES (349)..(353): Any amino acid
  MOD_RES (367)..(411): Any amino acid
  MOD_RES (459)..(508): Any amino acid
  MOD_RES (572)..(583): Any amino acid
  MOD_RES (601)..(603): Any amino acid
  MOD_RES (626)..(626): Any amino acid
  MOD_RES (674)..(675): Any amino acid
  MOD_RES (687)..(698): Any amino acid
  MOD_RES (731)..(731): Any amino acid
  MOD_RES (758)..(759): Any amino acid
  MOD_RES (775)..(780): Any amino acid

SEQ ID NO: 421225 - protein, 780 aa, Influenza virus; identical to SEQ ID NO: 420099
  MOD_RES (17)..(18): Any amino acid
  MOD_RES (73)..(101): Any amino acid
  MOD_RES (117)..(139): Any amino acid
  MOD_RES (165)..(168): Any amino acid
  MOD_RES (197)..(210): Any amino acid
  MOD_RES (262)..(264): Any amino acid
  MOD_RES (305)..(308): Any amino acid
  MOD_RES (349)..(353): Any amino acid
  MOD_RES (367)..(411): Any amino acid
  MOD_RES (434)..(445): Any amino acid
  MOD_RES (459)..(508): Any amino acid
  MOD_RES (523)..(523): Any amino acid
  MOD_RES (571)..(583): Any amino acid
  MOD_RES (599)..(603): Any amino acid
  MOD_RES (626)..(626): Any amino acid
  MOD_RES (674)..(675): Any amino acid
  MOD_RES (687)..(698): Any amino acid
  MOD_RES (730)..(731): Any amino acid
  MOD_RES (745)..(745): Any amino acid
  MOD_RES (775)..(780): Any amino acid

SEQ ID NO: 421226 - protein, 780 aa, Influenza virus; identical to SEQ ID NO: 420100
  MOD_RES (1)..(18): Any amino acid
  MOD_RES (61)..(61): Any amino acid
  MOD_RES (73)..(101): Any amino acid
  MOD_RES (116)..(139): Any amino acid
  MOD_RES (165)..(168): Any amino acid
  MOD_RES (180)..(180): Any amino acid
  MOD_RES (197)..(223): Any amino acid
  MOD_RES (249)..(251): Any amino acid
  MOD_RES (264)..(264): Any amino acid
  MOD_RES (305)..(308): Any amino acid
  MOD_RES (348)..(353): Any amino acid
  MOD_RES (367)..(411): Any amino acid
  MOD_RES (435)..(446): Any amino acid
  MOD_RES (459)..(511): Any amino acid
  MOD_RES (523)..(524): Any amino acid
  MOD_RES (572)..(583): Any amino acid
  MOD_RES (599)..(626): Any amino acid
  MOD_RES (672)..(675): Any amino acid
  MOD_RES (687)..(698): Any amino acid
  MOD_RES (731)..(731): Any amino acid
  MOD_RES (743)..(763): Any amino acid

SEQ ID NO: 421227 - protein, 780 aa, Influenza virus; identical to SEQ ID NO: 420101
  MOD_RES (1)..(19): Any amino acid
  MOD_RES (58)..(139): Any amino acid
  MOD_RES (165)..(168): Any amino acid
  MOD_RES (180)..(185): Any amino acid
  MOD_RES (197)..(227): Any amino acid
  MOD_RES (249)..(251): Any amino acid
  MOD_RES (264)..(267): Any amino acid
  MOD_RES (279)..(280): Any amino acid
  MOD_RES (302)..(308): Any amino acid
  MOD_RES (339)..(355): Any amino acid
  MOD_RES (367)..(411): Any amino acid
  MOD_RES (433)..(446): Any amino acid
  MOD_RES (459)..(511): Any amino acid
  MOD_RES (523)..(526): Any amino acid
  MOD_RES (558)..(586): Any amino acid
  MOD_RES (601)..(629): Any amino acid
  MOD_RES (674)..(675): Any amino acid
  MOD_RES (687)..(698): Any amino acid
  MOD_RES (729)..(732): Any amino acid
  MOD_RES (744)..(766): Any amino acid
  MOD_RES (778)..(780): Any amino acid

SEQ ID NO: 421228 - protein, 8 aa, Influenza virus
MTNQNSTW

SEQ ID NO: 421229 - protein, 8 aa, Influenza virus
FLMQIATL

SEQ ID NO: 421230 - protein, 8 aa, Influenza virus
ETIKNGTY

SEQ ID NO: 421231 - protein, 8 aa, Influenza virus
ITYENNTW

SEQ ID NO: 421232 - protein, 8 aa, Influenza virus
LSAGGHIW

SEQ ID NO: 421233 - protein, 8 aa, Influenza virus
REIHIYYL

SEQ ID NO: 421234 - protein, 8 aa, Influenza virus
ETIRNGTY

SEQ ID NO: 421235 - protein, 8 aa, Influenza virus
REVHMYYL

SEQ ID NO: 421236 - protein, 8 aa, Influenza virus
RMDYYWAV

SEQ ID NO: 421237 - protein, 8 aa, Influenza virus
IMMAGLSF

SEQ ID NO: 421238 - protein, 8 aa, Influenza virus
REVHVYYL

SEQ ID NO: 421239 - protein, 8 aa, Influenza virus
FLAMITYI

SEQ ID NO: 421240 - protein, 8 aa, Influenza virus
REVHIYYL

SEQ ID NO: 421241 - protein, 8 aa, Influenza virus
REVHTYYL

SEQ ID NO: 421242 - protein, 8 aa, Influenza virus
ITYKNNTW

SEQ ID NO: 421243 - protein, 8 aa, Influenza virus
TLIENTYV

SEQ ID NO: 421244 - protein, 8 aa, Influenza virus
LSAGGAIW

SEQ ID NO: 421245 - protein, 8 aa, Influenza virus
VTTVGWSW

SEQ ID NO: 421246 - protein, 8 aa, Influenza virus
RSWMKLYW

SEQ ID NO: 421247 - protein, 8 aa, Influenza virus
LSAGGSIW

SEQ ID NO: 421248 - protein, 8 aa, Influenza virus
ITSLCSIW

SEQ ID NO: 421249 - protein, 8 aa, Influenza virus
ETIVETGY

SEQ ID NO: 421250 - protein, 8 aa, Influenza virus
YQSGTYPV

SEQ ID NO: 421251 - protein, 8 aa, Influenza virus
SMSCFVFV

SEQ ID NO: 421252 - protein, 8 aa, Influenza virus
KSWTKIYW

SEQ ID NO: 421253 - protein, 8 aa, Influenza virus
IMIAGLSF

SEQ ID NO: 421254 - protein, 8 aa, Influenza virus
DVVNFLSM

SEQ ID NO: 421255 - protein, 8 aa, Influenza virus
LSASGDIW

SEQ ID NO: 421256 - protein, 8 aa, Influenza virus
ETILETGY

SEQ ID NO: 421257 - protein, 8 aa, Influenza virus
LSAGGNIW

SEQ ID NO: 421258 - protein, 8 aa, Influenza virus
FLMQITIL

SEQ ID NO: 421259 - protein, 8 aa, Influenza virus
NPRMFLAM

SEQ ID NO: 421260 - protein, 8 aa, Influenza virus
ETIIETGY

SEQ ID NO: 421261 - protein, 8 aa, Influenza virus
FLMQIAVL

SEQ ID NO: 421262 - protein, 8 aa, Influenza virus
VSSEVPGW

SEQ ID NO: 421263 - protein, 8 aa, Influenza virus
LAAAGDIW

SEQ ID NO: 421264 - protein, 8 aa, Influenza virus
YQNSFVPV

SEQ ID NO: 421265 - protein, 8 aa, Influenza virus
YQNNFVPV

SEQ ID NO: 421266 - protein, 8 aa, Influenza virus
IMVAGLSF

SEQ ID NO: 421267 - protein, 8 aa, Influenza virus
SLIWLWLV

SEQ ID NO: 421268 - protein, 8 aa, Influenza virus
FLAPRYAL

SEQ ID NO: 421269 - protein, 8 aa, Influenza virus
LLMSELGV

SEQ ID NO: 421270 - protein, 8 aa, Influenza virus
KSWMKIYW

SEQ ID NO: 421271 - protein, 8 aa, Influenza virus
APRYALEL

SEQ ID NO: 421272 - protein, 8 aa, Influenza virus
VSSEAPGW

SEQ ID NO: 421273 - protein, 8 aa, Influenza virus
YMLERELV

SEQ ID NO: 421274 - protein, 8 aa, Influenza virus
FLMQIAIL

SEQ ID NO: 421275 - protein, 8 aa, Influenza virus
LSAGGDIW

SEQ ID NO: 421276 - protein, 8 aa, Influenza virus
FMYSDFHF

SEQ ID NO: 421277 - protein, 8 aa, Influenza virus
LLMNELGV

SEQ ID NO: 421278 - protein, 8 aa, Influenza virus
SMCSSTEF

SEQ ID NO: 421279 - protein, 8 aa, Influenza virus
RSWMKIYW

SEQ ID NO: 421280 - protein, 8 aa, Influenza virus
FMPYISFA

SEQ ID NO: 421281 - protein, 8 aa, Influenza virus
DTIRNGTY

SEQ ID NO: 421282 - protein, 8 aa, Influenza virus
LLMDALKL

SEQ ID NO: 421283 - protein, 8 aa, Influenza virus
LLADVMGL

SEQ ID NO: 421284 - protein, 8 aa, Influenza virus
MSDSIKSW

SEQ ID NO: 421285 - protein, 8 aa, Influenza virus
LSAGGGIW

SEQ ID NO: 421286 - protein, 8 aa, Influenza virus
CEISGFAI

SEQ ID NO: 421287 - protein, 8 aa, Influenza virus
KLFALSGV

SEQ ID NO: 421288 - protein, 8 aa, Influenza virus
FLLAALLL

SEQ ID NO: 421289 - protein, 8 aa, Influenza virus
YLIRTLTL

SEQ ID NO: 421290 - protein, 8 aa, Influenza virus
WMDYYWGI

SEQ ID NO: 421291 - protein, 8 aa, Influenza virus
YLIRALTL

SEQ ID NO: 421292 - protein, 8 aa, Influenza virus
LLMDSLKL

SEQ ID NO: 421293 - protein, 8 aa, Influenza virus
RPIGISSM

SEQ ID NO: 421294 - protein, 8 aa, Influenza virus
ALANTIEV

SEQ ID NO: 421295 - protein, 8 aa, Influenza virus
RPVGISSM

SEQ ID NO: 421296 - protein, 8 aa, Influenza virus
FLLVALFL

SEQ ID NO: 421297 - protein, 8 aa, Influenza virus
GSYGTGSW

SEQ ID NO: 421298 - protein, 8 aa, Influenza virus
APRYAFEL

SEQ ID NO: 421299 - protein, 8 aa, Influenza virus
VSAGGDIW

SEQ ID NO: 421300 - protein, 8 aa, Influenza virus
IMNTSKPF

SEQ ID NO: 421301 - protein, 8 aa, Influenza virus
FLTMITYI

SEQ ID NO: 421302 - protein, 8 aa, Influenza virus
LSADGDIW

SEQ ID NO: 421303 - protein, 8 aa, Influenza virus
FLAHALKL

SEQ ID NO: 421304 - protein, 8 aa, Influenza virus
FLAFILWA

SEQ ID NO: 421305 - protein, 8 aa, Influenza virus
DVVNFVSM

SEQ ID NO: 421306 - protein, 8 aa, Influenza virus
YLIEDPTA

SEQ ID NO: 421307 - protein, 8 aa, Influenza virus
MQFSSLTV

SEQ ID NO: 421308 - protein, 8 aa, Influenza virus
YLIEDPAA

SEQ ID NO: 421309 - protein, 8 aa, Influenza virus
SPRSRSGF

SEQ ID NO: 421310 - protein, 8 aa, Influenza virus
TMHDRSPF

SEQ ID NO: 421311 - protein, 8 aa, Influenza virus
KPWARNIL

SEQ ID NO: 421312 - protein, 8 aa, Influenza virus
YLIEDPSA

SEQ ID NO: 421313 - protein, 8 aa, Influenza virus
FIFNGAFI

SEQ ID NO: 421314 - protein, 8 aa, Influenza virus
KLFTLSGV

SEQ ID NO: 421315 - protein, 8 aa, Influenza virus
FMQALQLL

SEQ ID NO: 421316 - protein, 8 aa, Influenza virus
MMAGLSFW

SEQ ID NO: 421317 - protein, 8 aa, Influenza virus
MLSTVLGV

SEQ ID NO: 421318 - protein, 8 aa, Influenza virus
FSFGASSF

SEQ ID NO: 421319 - protein, 8 aa, Influenza virus
KPRPRRGL

SEQ ID NO: 421320 - protein, 8 aa, Influenza virus
MEFSWTIL

SEQ ID NO: 421321 - protein, 8 aa, Influenza virus
LAAGGDIW

SEQ ID NO: 421322 - protein, 8 aa, Influenza virus
FLNNTEPL

SEQ ID NO: 421323 - protein, 8 aa, Influenza virus
GTYGTGTW

SEQ ID NO: 421324 - protein, 8 aa, Influenza virus
LTTTVKTW

SEQ ID NO: 421325 - protein, 8 aa, Influenza virus
MEFSWILL

SEQ ID NO: 421326 - protein, 8 aa, Influenza virus
GLNSTLPF

SEQ ID NO: 421327 - protein, 8 aa, Influenza virus
MMMGMFNM

SEQ ID NO: 421328 - protein, 8 aa, Influenza virus
NPRVFLAM

SEQ ID NO: 421329 - protein, 8 aa, Influenza virus
MSNEGSYF

SEQ ID NO: 421330 - protein, 8 aa, Influenza virus
MTDSIKSW

SEQ ID NO: 421331 - protein, 8 aa, Influenza virus
CEVSGFAI

SEQ ID NO: 421332 - protein, 8 aa, Influenza virus
RMDYYWAI

SEQ ID NO: 421333 - protein, 8 aa, Influenza virus
MEFSWTLL

SEQ ID NO: 421334 - protein, 8 aa, Influenza virus
LTTTIRTW

SEQ ID NO: 421335 - protein, 8 aa, Influenza virus
RMDYYWTL

SEQ ID NO: 421336 - protein, 8 aa, Influenza virus
QEIGGVKL

SEQ ID NO: 421337 - protein, 8 aa, Influenza virus
ALNTTLPF

SEQ ID NO: 421338 - protein, 8 aa, Influenza virus
ETTHTGTY

SEQ ID NO: 421339 - protein, 8 aa, Influenza virus
PSDAQAFY

SEQ ID NO: 421340 - protein, 8 aa, Influenza virus
WMCSNSSM

SEQ ID NO: 421341 - protein, 8 aa, Influenza virus
MADSIKSW

SEQ ID NO: 421342 - protein, 8 aa, Influenza virus
VMNTSKPF

SEQ ID NO: 421343 - protein, 8 aa, Influenza virus
FIIREPFV

SEQ ID NO: 421344 - protein, 8 aa, Influenza virus
MVAGLSFW

SEQ ID NO: 421345 - protein, 8 aa, Influenza virus
FLSMEFSL

SEQ ID NO: 421346 - protein, 8 aa, Influenza virus
SELCPSPL

SEQ ID NO: 421347 - protein, 8 aa, Influenza virus
NPRIFLAM

SEQ ID NO: 421348 - protein, 8 aa, Influenza virus
ETSHTGTY

SEQ ID NO: 421349 - protein, 8 aa, Influenza virus
TEIGAPQL

SEQ ID NO: 421350 - protein, 8 aa, Influenza virus
FLQALQLL

SEQ ID NO: 421351 - protein, 8 aa, Influenza virus
KMFDFTKW

SEQ ID NO: 421352 - protein, 8 aa, Influenza virus
SPRLRSGF

SEQ ID NO: 421353 - protein, 8 aa, Influenza virus
LPRRSGAA

SEQ ID NO: 421354 - protein, 8 aa, Influenza virus
FESSGGLL

SEQ ID NO: 421355 - protein, 8 aa, Influenza virus
YLIEDPGA

SEQ ID NO: 421356 - protein, 8 aa, Influenza virus
SLNGISPV

SEQ ID NO: 421357 - protein, 8 aa, Influenza virus
IMIAGLFF

SEQ ID NO: 421358 - protein, 8 aa, Influenza virus
FESNGALL

SEQ ID NO: 421359 - protein, 8 aa, Influenza virus
LLIGISNV

SEQ ID NO: 421360 - protein, 8 aa, Influenza virus
GTYGTGSW

SEQ ID NO: 421361 - protein, 8 aa, Influenza virus
VEWTSNSL

SEQ ID NO: 421362 - protein, 8 aa, Influenza virus
TEVETYVL

SEQ ID NO: 421363 - protein, 8 aa, Influenza virus
KLLPFAAA

SEQ ID NO: 421364 - protein, 8 aa, Influenza virus
ILAIYATV

SEQ ID NO: 421365 - protein, 8 aa, Influenza virus
FLARSALI

SEQ ID NO: 421366 - protein, 8 aa, Influenza virus
GTYGAGSW

SEQ ID NO: 421367 - protein, 8 aa, Influenza virus
MMTHTSQY

SEQ ID NO: 421368 - protein, 8 aa, Influenza virus
YMFESKSM

SEQ ID NO: 421369 - protein, 8 aa, Influenza virus
YLIEDPNA

SEQ ID NO: 421370 - protein, 8 aa, Influenza virus
LTTTIKTW

SEQ ID NO: 421371 - protein, 8 aa, Influenza virus
MMAMRYPI

SEQ ID NO: 421372 - protein, 8 aa, Influenza virus
FESNGAFL

SEQ ID NO: 421373 - protein, 8 aa, Influenza virus
APRGHYRL

SEQ ID NO: 421374 - protein, 8 aa, Influenza virus
IIIAGLSF

SEQ ID NO: 421375 - protein, 8 aa, Influenza virus
SPRSRNGF

SEQ ID NO: 421376 - protein, 8 aa, Influenza virus
SILYFWGV

SEQ ID NO: 421377 - protein, 8 aa, Influenza virus
MEFFWTLL

SEQ ID NO: 421378 - protein, 8 aa, Influenza virus
LLMSTNAY

SEQ ID NO: 421379 - protein, 8 aa, Influenza virus
DVVNYVSM

SEQ ID NO: 421380 - protein, 8 aa, Influenza virus
ISNEGSYF

SEQ ID NO: 421381 - protein, 8 aa, Influenza virus
SLFSSIKK

SEQ ID NO: 421382 - protein, 8 aa, Influenza virus
SQSGRISF

SEQ ID NO: 421383 - protein, 8 aa, Influenza virus
FLVCVSLL

SEQ ID NO: 421384 - protein, 8 aa, Influenza virus
KLYERVRK

SEQ ID NO: 421385 - protein, 8 aa, Influenza virus
KMFDFSKW

SEQ ID NO: 421386 - protein, 8 aa, Influenza virus
IEYNGKSL

SEQ ID NO: 421387 - protein, 8 aa, Influenza virus
ITDTIRSW

SEQ ID NO: 421388 - protein, 8 aa, Influenza virus
AMKHTSQY

SEQ ID NO: 421389 - protein, 8 aa, Influenza virus
GLNTTLPF

SEQ ID NO: 421390 - protein, 8 aa, Influenza virus
ETNHTGTY

SEQ ID NO: 421391 - protein, 8 aa, Influenza virus
YQKCCSLF

SEQ ID NO: 421392 - protein, 8 aa, Influenza virus
KADHRIYW

SEQ ID NO: 421393 - protein, 8 aa, Influenza virus
AINSSMPF

SEQ ID NO: 421394 - protein, 8 aa, Influenza virus
KLLPFASA

SEQ ID NO: 421395 - protein, 8 aa, Influenza virus
FESNGGFL

SEQ ID NO: 421396 - protein, 8 aa, Influenza virus
QEINGIKL

SEQ ID NO: 421397 - protein, 8 aa, Influenza virus
AMDEFQLI

SEQ ID NO: 421398 - protein, 8 aa, Influenza virus
ISFATSCF

SEQ ID NO: 421399 - protein, 8 aa, Influenza virus
FESNGGLL

SEQ ID NO: 421400 - protein, 8 aa, Influenza virus
RMNYYWTL

SEQ ID NO: 421401 - protein, 8 aa, Influenza virus
QEIEGIKL

SEQ ID NO: 421402 - protein, 8 aa, Influenza virus
ILAVYSTV

SEQ ID NO: 421403 - protein, 8 aa, Influenza virus
LMSCPIGV

SEQ ID NO: 421404 - protein, 8 aa, Influenza virus
HEGEGIPL

SEQ ID NO: 421405 - protein, 8 aa, Influenza virus
KQMTRGLF

SEQ ID NO: 421406 - protein, 8 aa, Influenza virus
SVLYFWGV

SEQ ID NO: 421407 - protein, 8 aa, Influenza virus
MQIRGFVY

SEQ ID NO: 421408 - protein, 8 aa, Influenza virus
LMSCPMGV

SEQ ID NO: 421409 - protein, 8 aa, Influenza virus
ITDTVKSW

SEQ ID NO: 421410 - protein, 8 aa, Influenza virus
LLMNELGI

SEQ ID NO: 421411 - protein, 8 aa, Influenza virus
EVILWFSF

SEQ ID NO: 421412 - protein, 8 aa, Influenza virus
LLDPGDTV

SEQ ID NO: 421413 - protein, 8 aa, Influenza virus
RISSSFSF

SEQ ID NO: 421414 - protein, 8 aa, Influenza virus
GTYGSGSW

SEQ ID NO: 421415 - protein, 8 aa, Influenza virus
LLIGVSNV

SEQ ID NO: 421416 - protein, 8 aa, Influenza virus
FMARSALI

SEQ ID NO: 421417 - protein, 8 aa, Influenza virus
FEKEGYSL

SEQ ID NO: 421418 - protein, 8 aa, Influenza virus
MACHSAAF

SEQ ID NO: 421419 - protein, 8 aa, Influenza virus
KMSLLTEV

SEQ ID NO: 421420 - protein, 8 aa, Influenza virus
LLDPNDTV

SEQ ID NO: 421421 - protein, 8 aa, Influenza virus
LLAAIMGL

SEQ ID NO: 421422 - protein, 8 aa, Influenza virus
QEIDGIKL

SEQ ID NO: 421423 - protein, 8 aa, Influenza virus
KLYGSGSK

SEQ ID NO: 421424 - protein, 8 aa, Influenza virus
KMFDFIKW

SEQ ID NO: 421425 - protein, 8 aa, Influenza virus
SLNGVSPV

SEQ ID NO: 421426 - protein, 8 aa, Influenza virus
KMNTQILV

SEQ ID NO: 421427 - protein, 8 aa, Influenza virus
LMSCPVGV

SEQ ID NO: 421428 - protein, 8 aa, Influenza virus
VLWTSNSV

SEQ ID NO: 421429 - protein, 8 aa, Influenza virus
QEIEGVKL

SEQ ID NO: 421430 - protein, 8 aa, Influenza virus
FESDGAFL

SEQ ID NO: 421431 - protein, 8 aa, Influenza virus
RMNYYWTI

SEQ ID NO: 421432 - protein, 8 aa, Influenza virus
SEIKGVKL

SEQ ID NO: 421433 - protein, 8 aa, Influenza virus
APRGHYKL

SEQ ID NO: 421434 - protein, 8 aa, Influenza virus
FEATGNLL

SEQ ID NO: 421435 - protein, 8 aa, Influenza virus
KLYERVKK

SEQ ID NO: 421436 - protein, 8 aa, Influenza virus
MACNSAAF

SEQ ID NO: 421437 - protein, 8 aa, Influenza virus
KLYGSGNK

SEQ ID NO: 421438 - protein, 8 aa, Influenza virus
FTSFFYRY

SEQ ID NO: 421439 - protein, 8 aa, Influenza virus
WMCSNGSY

SEQ ID NO: 421440 - protein, 8 aa, Influenza virus
AMDDFQLI

SEQ ID NO: 421441 - protein, 8 aa, Influenza virus
YQKCCTLF

SEQ ID NO: 421442 - protein, 8 aa, Influenza virus
AQMALQLF

SEQ ID NO: 421443 - protein, 8 aa, Influenza virus
FQNASRHY

SEQ ID NO: 421444 - protein, 8 aa, Influenza virus
AVNSSMPF

SEQ ID NO: 421445 - protein, 8 aa, Influenza virus
KISSSFSF

SEQ ID NO: 421446 - protein, 8 aa, Influenza virus
ILAIYSTV

SEQ ID NO: 421447 - protein, 8 aa, Influenza virus
FEREGYSL

SEQ ID NO: 421448 - protein, 8 aa, Influenza virus
KMNREFEV

SEQ ID NO: 421449 - protein, 8 aa, Influenza virus
AVATTHSW

SEQ ID NO: 421450 - protein, 8 aa, Influenza virus
AINTTLPF

SEQ ID NO: 421451 - protein, 8 aa, Influenza virus
FLLVALLL

SEQ ID NO: 421452 - protein, 8 aa, Influenza virus
SETGAPQL

SEQ ID NO: 421453 - protein, 8 aa, Influenza virus
FLLVALLI

SEQ ID NO: 421454 - protein, 8 aa, Influenza virus
YQRCCNLF

SEQ ID NO: 421455 - protein, 8 aa, Influenza virus
FQLFLVCV

SEQ ID NO: 421456 - protein, 8 aa, Influenza virus
RMKWMMAM

SEQ ID NO: 421457 - protein, 8 aa, Influenza virus
KSYFANLK

SEQ ID NO: 421458 - protein, 8 aa, Influenza virus
WMKIYWSL

SEQ ID NO: 421459 - protein, 8 aa, Influenza virus
EITGFAPF

SEQ ID NO: 421460 - protein, 8 aa, Influenza virus
RMDYYWGI

SEQ ID NO: 421461 - protein, 8 aa, Influenza virus
VSGEVPGW

SEQ ID NO: 421462 - protein, 8 aa, Influenza virus
RLRSGFEM

SEQ ID NO: 421463 - protein, 8 aa, Influenza virus
EVSETQGM

SEQ ID NO: 421464 - protein, 8 aa, Influenza virus
ISFAMSCF

SEQ ID NO: 421465 - protein, 8 aa, Influenza virus
KEWMHVCM

SEQ ID NO: 421466 - protein, 8 aa, Influenza virus
SEQAAEAI

SEQ ID NO: 421467 - protein, 8 aa, Influenza virus
NTASRSGY

SEQ ID NO: 421468 - protein, 8 aa, Influenza virus
ISFAISCF

SEQ ID NO: 421469 - protein, 8 aa, Influenza virus
HLSSVSSF

SEQ ID NO: 421470 - protein, 8 aa, Influenza virus
YERMCNIL

SEQ ID NO: 421471 - protein, 8 aa, Influenza virus
KLYGTGNK

SEQ ID NO: 421472 - protein, 8 aa, Influenza virus
WLKTRPIL

SEQ ID NO: 421473 - protein, 8 aa, Influenza virus
TIISSLPF

SEQ ID NO: 421474 - protein, 8 aa, Influenza virus
QEIEGIRL

SEQ ID NO: 421475 - protein, 8 aa, Influenza virus
KEWMHICM

SEQ ID NO: 421476 - protein, 8 aa, Influenza virus
RLYGSGNK

SEQ ID NO: 421477 - protein, 8 aa, Influenza virus
KLYGSGAK

SEQ ID NO: 421478 - protein, 8 aa, Influenza virus
ILAIYSAV

SEQ ID NO: 421479 - protein, 8 aa, Influenza virus
RYGFVANF

SEQ ID NO: 421480 - protein, 8 aa, Influenza virus
SMTEVMVV

SEQ ID NO: 421481 - protein, 8 aa, Influenza virus
SECRTFFL

SEQ ID NO: 421482 - protein, 8 aa, Influenza virus
LLKHRFEI

SEQ ID NO: 421483 - protein, 8 aa, Influenza virus
KLLQTSQV

SEQ ID NO: 421484 - protein, 8 aa, Influenza virus
MLNPNDTV

SEQ ID NO: 421485 - protein, 8 aa, Influenza virus
SIYWTIVK

SEQ ID NO: 421486 - protein, 8 aa, Influenza virus
EAIRNGTY

SEQ ID NO: 421487 - protein, 8 aa, Influenza virus
FILKDCSV

SEQ ID NO: 421488 - protein, 8 aa, Influenza virus
ETTRNGTY

SEQ ID NO: 421489 - protein, 8 aa, Influenza virus
NEIKGVEL

SEQ ID NO: 421490 - protein, 8 aa, Influenza virus
FVIREPFV

SEQ ID NO: 421491 - protein, 8 aa, Influenza virus
TMKDRSPY

SEQ ID NO: 421492 - protein, 8 aa, Influenza virus
MMIWHSNL

SEQ ID NO: 421493 - protein, 8 aa, Influenza virus
ITDTIKSW

SEQ ID NO: 421494 - protein, 8 aa, Influenza virus
GTFEFTSF

SEQ ID NO: 421495 - protein, 8 aa, Influenza virus
KSHAYISF

SEQ ID NO: 421496 - protein, 8 aa, Influenza virus
KEWMHVCI

SEQ ID NO: 421497 - protein, 8 aa, Influenza virus
GLRISSSF

SEQ ID NO: 421498 - protein, 8 aa, Influenza virus
SIYWTVVK

SEQ ID NO: 421499 - protein, 8 aa, Influenza virus
AECRTFFL

SEQ ID NO: 421500 - protein, 8 aa, Influenza virus
CLVPCFWV

SEQ ID NO: 421501 - protein, 8 aa, Influenza virus
APRGYFKM

SEQ ID NO: 421502 - protein, 8 aa, Influenza virus
SLNDYEEL

SEQ ID NO: 421503 - protein, 8 aa, Influenza virus
QEIEGVRL

SEQ ID NO: 421504 - protein, 8 aa, Influenza virus
RVRSNGNL

SEQ ID NO: 421505 - protein, 8 aa, Influenza virus
LELCPSPL

SEQ ID NO: 421506 - protein, 8 aa, Influenza virus
QELCPSPL

SEQ ID NO: 421507 - protein, 8 aa, Influenza virus
WSGLVAGW

SEQ ID NO: 421508 - protein, 8 aa, Influenza virus
LLASTNAY

SEQ ID NO: 421509 - protein, 8 aa, Influenza virus
ESIRTGTY

SEQ ID NO: 421510 - protein, 8 aa, Influenza virus
SMRWLTLK

SEQ ID NO: 421511 - protein, 8 aa, Influenza virus
KLNRLISK

SEQ ID NO: 421512 - protein, 8 aa, Influenza virus
RANVDDFF

SEQ ID NO: 421513 - protein, 8 aa, Influenza virus
RRFIQNAL

SEQ ID NO: 421514 - protein, 8 aa, Influenza virus
WHDGAEII

SEQ ID NO: 421515 - protein, 8 aa, Influenza virus
KLNGIPPL

SEQ ID NO: 421516 - protein, 8 aa, Influenza virus
FQNTSRHY

SEQ ID NO: 421517 - protein, 8 aa, Influenza virus
YQAKFESV

SEQ ID NO: 421518 - protein, 8 aa, Influenza virus
ITDTLKSW

SEQ ID NO: 421519 - protein, 8 aa, Influenza virus
ALANTIEI

SEQ ID NO: 421520 - protein, 8 aa, Influenza virus
SVYWTIVK

SEQ ID NO: 421521 - protein, 8 aa, Influenza virus
RRLTVLGK

SEQ ID NO: 421522 - protein, 8 aa, Influenza virus
ITDTFKSW

SEQ ID NO: 421523 - protein, 8 aa, Influenza virus
FSFGGFTF

SEQ ID NO: 421524 - protein, 8 aa, Influenza virus
NPRVFLTM

SEQ ID NO: 421525 - protein, 8 aa, Influenza virus
AQRLESVF

SEQ ID NO: 421526 - protein, 8 aa, Influenza virus
ALQLLFEV

SEQ ID NO: 421527 - protein, 8 aa, Influenza virus
FQNASRYY

SEQ ID NO: 421528 - protein, 8 aa, Influenza virus
FSFGGFTF

SEQ ID NO: 421529 - protein, 8 aa, Influenza virus
RIDYYWSV

SEQ ID NO: 421530 - protein, 8 aa, Influenza virus
ESIKNGTY

SEQ ID NO: 421531 - protein, 8 aa, Influenza virus
WMCSNGSM

SEQ ID NO: 421532 - protein, 8 aa, Influenza virus
SLRMKWMM

SEQ ID NO: 421533 - protein, 8 aa, Influenza virus
AINSSRPF

SEQ ID NO: 421534 - protein, 8 aa, Influenza virus
SMKWLTLK

SEQ ID NO: 421535 - protein, 8 aa, Influenza virus
ILLHIVSI

SEQ ID NO: 421536 - protein, 8 aa, Influenza virus
SVYWTVVK

SEQ ID NO: 421537 - protein, 8 aa, Influenza virus
MLNKSLCK

SEQ ID NO: 421538 - protein, 8 aa, Influenza virus
MSNEGSYF

SEQ ID NO: 421539 - protein, 8 aa, Influenza virus
NTYDHSHY

SEQ ID NO: 421540 - protein, 8 aa, Influenza virus
SLCYPGSF

SEQ ID NO: 421541 - protein, 8 aa, Influenza virus
KYIPSNSL

SEQ ID NO: 421542 - protein, 8 aa, Influenza virus
IIYENNTW

SEQ ID NO: 421543 - protein, 8 aa, Influenza virus
FLAPRYSF

SEQ ID NO: 421544 - protein, 8 aa, Influenza virus
ALMEWLKT

SEQ ID NO: 421545 - protein, 8 aa, Influenza virus
HMRKKRGL

SEQ ID NO: 421546 - protein, 8 aa, Influenza virus
YQAKFEAV

SEQ ID NO: 421547 - protein, 8 aa, Influenza virus
YQNVGTYV

SEQ ID NO: 421548 - protein, 8 aa, Influenza virus
MRWLTLKL

SEQ ID NO: 421549 - protein, 8 aa, Influenza virus
YHANNSTV

SEQ ID NO: 421550 - protein, 8 aa, Influenza virus
LQANLCRF

SEQ ID NO: 421551 - protein, 8 aa, Influenza virus
MLKVPNAL

SEQ ID NO: 421552 - protein, 8 aa, Influenza virus
AMTHTSQY

SEQ ID NO: 421553 - protein, 8 aa, Influenza virus
SLVKTTLF

SEQ ID NO: 421554 - protein, 8 aa, Influenza virus
KLYGAGNK

SEQ ID NO: 421555 - protein, 8 aa, Influenza virus
KLYGNGNK

SEQ ID NO: 421556 - protein, 8 aa, Influenza virus
GLFFFCLK

SEQ ID NO: 421557 - protein, 8 aa, Influenza virus
LLVSTNAY

SEQ ID NO: 421558 - protein, 8 aa, Influenza virus
ILLHIASI

SEQ ID NO: 421559 - protein, 8 aa, Influenza virus
KLRSGFEM

SEQ ID NO: 421560 - protein, 8 aa, Influenza virus
MVDGWYGY

SEQ ID NO: 421561 - protein, 8 aa, Influenza virus
FSMSCFVF

SEQ ID NO: 421562 - protein, 8 aa, Influenza virus
YKMNNQIL

SEQ ID NO: 421563 - protein, 8 aa, Influenza virus
LTTTIKPW

SEQ ID NO: 421564 - protein, 8 aa, Influenza virus
FVMREPFI

SEQ ID NO: 421565 - protein, 8 aa, Influenza virus
CEVSGFAV

SEQ ID NO: 421566 - protein, 8 aa, Influenza virus
EAVAVLKY

SEQ ID NO: 421567 - protein, 8 aa, Influenza virus
STASRSGY

SEQ ID NO: 421568 - protein, 8 aa, Influenza virus
FLLIALLL

SEQ ID NO: 421569 - protein, 8 aa, Influenza virus
RSGFEMVW

SEQ ID NO: 421570 - protein, 8 aa, Influenza virus
ILSVYSTV

SEQ ID NO: 421571 - protein, 8 aa, Influenza virus
ITGTIKSW

SEQ ID NO: 421572 - protein, 8 aa, Influenza virus
SIITELPF

SEQ ID NO: 421573 - protein, 8 aa, Influenza virus
SINTRLPF

SEQ ID NO: 421574 - protein, 8 aa, Influenza virus
APRGYYKM

SEQ ID NO: 421575 - protein, 8 aa, Influenza virus
GPRNVPAI

SEQ ID NO: 421576 - protein, 8 aa, Influenza virus
LLFLKIPV

SEQ ID NO: 421577 - protein, 8 aa, Influenza virus
NTYDHAQY

SEQ ID NO: 421578 - protein, 8 aa, Influenza virus
LSMAPIMF

SEQ ID NO: 421579 - protein, 8 aa, Influenza virus
RLSGIPPL

SEQ ID NO: 421580 - protein, 8 aa, Influenza virus
ALAQGALV

SEQ ID NO: 421581 - protein, 8 aa, Influenza virus
NTYDHSRY

SEQ ID NO: 421582 - protein, 8 aa, Influenza virus
SSNYHQSF

SEQ ID NO: 421583 - protein, 8 aa, Influenza virus
KLNRFIEK

SEQ ID NO: 421584 - protein, 8 aa, Influenza virus
NTYDHSTY

SEQ ID NO: 421585 - protein, 8 aa, Influenza virus
RANVNDFF

SEQ ID NO: 421586 - protein, 8 aa, Influenza virus
WSGMIDGW

SEQ ID NO: 421587 - protein, 8 aa, Influenza virus
TETGALQL

SEQ ID NO: 421588 - protein, 8 aa, Influenza virus
ITGDNTKW

SEQ ID NO: 421589 - protein, 8 aa, Influenza virus
RRLSTNAM

SEQ ID NO: 421590 - protein, 8 aa, Influenza virus
FSFNGAFV

SEQ ID NO: 421591 - protein, 8 aa, Influenza virus
MSKEGSYF

SEQ ID NO: 421592 - protein, 8 aa, Influenza virus
ALMEWIKT

SEQ ID NO: 421593 - protein, 8 aa, Influenza virus
WSGLIAGW

SEQ ID NO: 421594 - protein, 8 aa, Influenza virus
TIASSLPF

SEQ ID NO: 421595 - protein, 8 aa, Influenza virus
MVNGWYGY

SEQ ID NO: 421596 - protein, 8 aa, Influenza virus
LLLQIISL

SEQ ID NO: 421597 - protein, 8 aa, Influenza virus
TSNSIVTF

SEQ ID NO: 421598 - protein, 8 aa, Influenza virus
MEHTSQYL

SEQ ID NO: 421599 - protein, 8 aa, Influenza virus
YKMNTQIL

SEQ ID NO: 421600 - protein, 8 aa, Influenza virus
ALASCMGL

SEQ ID NO: 421601 - protein, 8 aa, Influenza virus
QEVEGVKL

SEQ ID NO: 421602 - protein, 8 aa, Influenza virus
LLAPRYAF

SEQ ID NO: 421603 - protein, 8 aa, Influenza virus
WTGMVNGW

SEQ ID NO: 421604 - protein, 8 aa, Influenza virus
SLMQGSTL

SEQ ID NO: 421605 - protein, 8 aa, Influenza virus
QLSSVSSF

SEQ ID NO: 421606 - protein, 8 aa, Influenza virus
VTYTGTSK

SEQ ID NO: 421607 - protein, 8 aa, Influenza virus
YINKTGTF

SEQ ID NO: 421608 - protein, 8 aa, Influenza virus
MECRTFFL

SEQ ID NO: 421609 - protein, 8 aa, Influenza virus
SEQAAEAM

SEQ ID NO: 421610 - protein, 8 aa, Influenza virus
ILLHVASI

SEQ ID NO: 421611 - protein, 8 aa, Influenza virus
LQNASRHY

SEQ ID NO: 421612 - protein, 8 aa, Influenza virus
ISFSISCF

SEQ ID NO: 421613 - protein, 8 aa, Influenza virus
ISFATSCF

SEQ ID NO: 421614 - protein, 8 aa, Influenza virus
YSIDSNYV

SEQ ID NO: 421615 - protein, 8 aa, Influenza virus
ILWVSFSI

SEQ ID NO: 421616 - protein, 8 aa, Influenza virus
MTFYWTMV

SEQ ID NO: 421617 - protein, 8 aa, Influenza virus
ESIRNGTY

SEQ ID NO: 421618 - protein, 8 aa, Influenza virus
NECRFYAL

SEQ ID NO: 421619 - protein, 8 aa, Influenza virus
LLLQITSL

SEQ ID NO: 421620 - protein, 8 aa, Influenza virus
QIIDIWAY

SEQ ID NO: 421621 - protein, 8 aa, Influenza virus
SLRCRICI

SEQ ID NO: 421622 - protein, 8 aa, Influenza virus
VEYNGKSL

SEQ ID NO: 421623 - protein, 8 aa, Influenza virus
KLYGNGAK

SEQ ID NO: 421624 - protein, 8 aa, Influenza virus
SLYASPQL

SEQ ID NO: 421625 - protein, 8 aa, Influenza virus
MLSKSLCK

SEQ ID NO: 421626 - protein, 8 aa, Influenza virus
LLFLKVPV

SEQ ID NO: 421627 - protein, 8 aa, Influenza virus
KLFASSGI

SEQ ID NO: 421628 - protein, 8 aa, Influenza virus
ILVSTNAY

SEQ ID NO: 421629 - protein, 8 aa, Influenza virus
YSIDSSYV

SEQ ID NO: 421630 - protein, 8 aa, Influenza virus
VQNDYTTV

SEQ ID NO: 421631 - protein, 8 aa, Influenza virus
MMMGMFNM

SEQ ID NO: 421632 - protein, 8 aa, Influenza virus
VQSYFQLF

SEQ ID NO: 421633 - protein, 8 aa, Influenza virus
WTGMVDGW

SEQ ID NO: 421634 - protein, 8 aa, Influenza virus
KEWLHVCI

SEQ ID NO: 421635 - protein, 8 aa, Influenza virus
ILWISFAI

SEQ ID NO: 421636 - protein, 8 aa, Influenza virus
RSRIDYYW

SEQ ID NO: 421637 - protein, 8 aa, Influenza virus
FMYSDFHF

SEQ ID NO: 421638 - protein, 8 aa, Influenza virus
FTFNGAFI

SEQ ID NO: 421639 - protein, 8 aa, Influenza virus
NTYDHSQY

SEQ ID NO: 421640 - protein, 8 aa, Influenza virus
FLTQGALL

SEQ ID NO: 421641 - protein, 8 aa, Influenza virus
ILSIYSTV

SEQ ID NO: 421642 - protein, 8 aa, Influenza virus
SVTELWSY

SEQ ID NO: 421643 - protein, 8 aa, Influenza virus
FLFSSIKK

SEQ ID NO: 421644 - protein, 8 aa, Influenza virus
SSFSFGGF

SEQ ID NO: 421645 - protein, 8 aa, Influenza virus
SIISFCGV

SEQ ID NO: 421646 - protein, 8 aa, Influenza virus
GQSGRISF

SEQ ID NO: 421647 - protein, 8 aa, Influenza virus
GQAGRMTF

SEQ ID NO: 421648 - protein, 8 aa, Influenza virus
IEEGINQL

SEQ ID NO: 421649 - protein, 8 aa, Influenza virus
RSGFEMIW

SEQ ID NO: 421650 - protein, 8 aa, Influenza virus
ISFSMSCF

SEQ ID NO: 421651 - protein, 8 aa, Influenza virus
KLANVVRK

SEQ ID NO: 421652 - protein, 8 aa, Influenza virus
MIAGLSFW

SEQ ID NO: 421653 - protein, 8 aa, Influenza virus
FSMSCFVF

SEQ ID NO: 421654 - protein, 8 aa, Influenza virus
FSMELPSF

SEQ ID NO: 421655 - protein, 8 aa, Influenza virus
ILAATVTL

SEQ ID NO: 421656 - protein, 8 aa, Influenza virus
LLLQVTSL

SEQ ID NO: 421657 - protein, 8 aa, Influenza virus
APRYAFEI

SEQ ID NO: 421658 - protein, 8 aa, Influenza virus
TMDYYWGI

SEQ ID NO: 421659 - protein, 8 aa, Influenza virus
FPVGSGSF

SEQ ID NO: 421660 - protein, 8 aa, Influenza virus
NEVGARIL

SEQ ID NO: 421661 - protein, 8 aa, Influenza virus
YQNVETYV

SEQ ID NO: 421662 - protein, 8 aa, Influenza virus
YQKCCNLF

SEQ ID NO: 421663 - protein, 8 aa, Influenza virus
ETVEITGI

SEQ ID NO: 421664 - protein, 8 aa, Influenza virus
CLINDPWV

SEQ ID NO: 421665 - protein, 8 aa, Influenza virus
SQASYKIF

SEQ ID NO: 421666 - protein, 8 aa, Influenza virus
MYSDFHFI

SEQ ID NO: 421667 - protein, 8 aa, Influenza virus
SPHRTLLM

SEQ ID NO: 421668 - protein, 8 aa, Influenza virus
KRMTRGLF

SEQ ID NO: 421669 - protein, 8 aa, Influenza virus
MIAGLFFW

SEQ ID NO: 421670 - protein, 8 aa, Influenza virus
GQSGRVSF

SEQ ID NO: 421671 - protein, 8 aa, Influenza virus
VTDSIKSW

SEQ ID NO: 421672 - protein, 8 aa, Influenza virus
KMKWGMEM

SEQ ID NO: 421673 - protein, 8 aa, Influenza virus
TIVSSLPF

SEQ ID NO: 421674 - protein, 8 aa, Influenza virus
NTYNHTEY

SEQ ID NO: 421675 - protein, 8 aa, Influenza virus
TSNSIAVF

SEQ ID NO: 421676 - protein, 8 aa, Influenza virus
FAMSCFLL

SEQ ID NO: 421677 - protein, 8 aa, Influenza virus
TSNSMVTF

SEQ ID NO: 421678 - protein, 8 aa, Influenza virus
IALCGSPF

SEQ ID NO: 421679 - protein, 8 aa, Influenza virus
RRFVQNAL

SEQ ID NO: 421680 - protein, 8 aa, Influenza virus
MLFVQSYF

SEQ ID NO: 421681 - protein, 8 aa, Influenza virus
FLRVRDQL

SEQ ID NO: 421682 - protein, 8 aa, Influenza virus
VMTHTSQY

SEQ ID NO: 421683 - protein, 8 aa, Influenza virus
WIKTRPIL

SEQ ID NO: 421684 - protein, 8 aa, Influenza virus
MMAMKYPI

SEQ ID NO: 421685 - protein, 8 aa, Influenza virus
KLLQNSQV

SEQ ID NO: 421686 - protein, 8 aa, Influenza virus
VTYTGISK

SEQ ID NO: 421687 - protein, 8 aa, Influenza virus
ILSIYSSV

SEQ ID NO: 421688 - protein, 8 aa, Influenza virus
HQSETYPV

SEQ ID NO: 421689 - protein, 8 aa, Influenza virus
YQARFEAV

SEQ ID NO: 421690 - protein, 8 aa, Influenza virus
RANENDFF

SEQ ID NO: 421691 - protein, 8 aa, Influenza virus
IPHRTLLM

SEQ ID NO: 421692 - protein, 8 aa, Influenza virus
HECRTFFL

SEQ ID NO: 421693 - protein, 8 aa, Influenza virus
TEIKGVKL

SEQ ID NO: 421694 - protein, 8 aa, Influenza virus
ILATTITL

SEQ ID NO: 421695 - protein, 8 aa, Influenza virus
FLTHGSLL

SEQ ID NO: 421696 - protein, 8 aa, Influenza virus
GLKISSSF

SEQ ID NO: 421697 - protein, 8 aa, Influenza virus
YQARFESV

SEQ ID NO: 421698 - protein, 8 aa, Influenza virus
APRGYFKL

SEQ ID NO: 421699 - protein, 8 aa, Influenza virus
ILWISFSI

SEQ ID NO: 421700 - protein, 8 aa, Influenza virus
KLNRLIGK

SEQ ID NO: 421701 - protein, 8 aa, Influenza virus
SYVRLYLW

SEQ ID NO: 421702 - protein, 8 aa, Influenza virus
FTSFFYRY

SEQ ID NO: 421703 - protein, 8 aa, Influenza virus
QMYTPGGK

SEQ ID NO: 421704 - protein, 8 aa, Influenza virus
KEMGNGCF

SEQ ID NO: 421705 - protein, 8 aa, Influenza virus
RMNYHWTL

SEQ ID NO: 421706 - protein, 8 aa, Influenza virus
TSNSIVEF

SEQ ID NO: 421707 - protein, 8 aa, Influenza virus
SLYSSPQL

SEQ ID NO: 421708 - protein, 8 aa, Influenza virus
ELRRQKSL

SEQ ID NO: 421709 - protein, 8 aa, Influenza virus
KLYDRVRL

SEQ ID NO: 421710 - protein, 8 aa, Influenza virus
MIDGWYGY

SEQ ID NO: 421711 - protein, 8 aa, Influenza virus
KYMNVKSL

SEQ ID NO: 421712 - protein, 8 aa, Influenza virus
FSFGASCF

SEQ ID NO: 421713 - protein, 8 aa, Influenza virus
KESLRLAL

SEQ ID NO: 421714 - protein, 8 aa, Influenza virus
VLLSPEEV

SEQ ID NO: 421715 - protein, 8 aa, Influenza virus
YKMNIQIL

SEQ ID NO: 421716 - protein, 8 aa, Influenza virus
VLSCIFCL

SEQ ID NO: 421717 - protein, 8 aa, Influenza virus
KMNREFGV

SEQ ID NO: 421718 - protein, 8 aa, Influenza virus
GLNTILPF

SEQ ID NO: 421719 - protein, 8 aa, Influenza virus
LALSHTAY

SEQ ID NO: 421720 - protein, 8 aa, Influenza virus
LMIWHSNL

SEQ ID NO: 421721 - protein, 8 aa, Influenza virus
RRIENLNK

SEQ ID NO: 421722 - protein, 8 aa, Influenza virus
NPRMFLAM

SEQ ID NO: 421723 - protein, 8 aa, Influenza virus
KLNRLIEK

SEQ ID NO: 421724 - protein, 8 aa, Influenza virus
ILLSPEEV

SEQ ID NO: 421725 - protein, 8 aa, Influenza virus
SEVPGCTM

SEQ ID NO: 421726 - protein, 8 aa, Influenza virus
KPRYLPDL

SEQ ID NO: 421727 - protein, 8 aa, Influenza virus
DVILWISF

SEQ ID NO: 421728 - protein, 8 aa, Influenza virus
VLWISFAI

SEQ ID NO: 421729 - protein, 8 aa, Influenza virus
LLGSAQHV

SEQ ID NO: 421730 - protein, 8 aa, Influenza virus
RPSAPEGM

SEQ ID NO: 421731 - protein, 8 aa, Influenza virus
ISIGSSTY

SEQ ID NO: 421732 - protein, 8 aa, Influenza virus
MEMRRCLL

SEQ ID NO: 421733 - protein, 8 aa, Influenza virus
ISPLAVTW

SEQ ID NO: 421734 - protein, 8 aa, Influenza virus
SSRISFYW

SEQ ID NO: 421735 - protein, 8 aa, Influenza virus
ISFSMSCF

SEQ ID NO: 421736 - protein, 8 aa, Influenza virus
MQALQLLF

SEQ ID NO: 421737 - protein, 8 aa, Influenza virus
KSHAYISF

SEQ ID NO: 421738 - protein, 8 aa, Influenza virus
YEELKHLL

SEQ ID NO: 421739 - protein, 8 aa, Influenza virus
VLNKSLCK

SEQ ID NO: 421740 - protein, 8 aa, Influenza virus
KMNTKILV

SEQ ID NO: 421741 - protein, 8 aa, Influenza virus
TSNSIVVF

SEQ ID NO: 421742 - protein, 8 aa, Influenza virus
HRIYWIRK

SEQ ID NO: 421743 - protein, 8 aa, Influenza virus
RINYYWSV

SEQ ID NO: 421744 - protein, 8 aa, Influenza virus
NTYDHTQY

SEQ ID NO: 421745 - protein, 8 aa, Influenza virus
EVRRRLSV

SEQ ID NO: 421746 - protein, 8 aa, Influenza virus
LIDQSGTY

SEQ ID NO: 421747 - protein, 8 aa, Influenza virus
ILSLYSTV

SEQ ID NO: 421748 - protein, 8 aa, Influenza virus
RRLENLNK

SEQ ID NO: 421749 - protein, 8 aa, Influenza virus
NPAHKSQL

SEQ ID NO: 421750 - protein, 8 aa, Influenza virus
EIILWFSF

SEQ ID NO: 421751 - protein, 8 aa, Influenza virus
SIRWLTLK

SEQ ID NO: 421752 - protein, 8 aa, Influenza virus
NTYDHSKY

SEQ ID NO: 421753 - protein, 8 aa, Influenza virus
APRYGYII

SEQ ID NO: 421754 - protein, 8 aa, Influenza virus
GLNITLPF

SEQ ID NO: 421755 - protein, 8 aa, Influenza virus
ILAFIMWA

SEQ ID NO: 421756 - protein, 8 aa, Influenza virus
QLSTVSSF

SEQ ID NO: 421757 - protein, 8 aa, Influenza virus
IIAGLSFW

SEQ ID NO: 421758 - protein, 8 aa, Influenza virus
RLFDYSRW

SEQ ID NO: 421759 - protein, 8 aa, Influenza virus
SRMQFSSL

SEQ ID NO: 421760 - protein, 8 aa, Influenza virus
FLAPRYAF

SEQ ID NO: 421761 - protein, 8 aa, Influenza virus
TIISNLPF

SEQ ID NO: 421762 - protein, 8 aa, Influenza virus
GQRGRMEF

SEQ ID NO: 421763 - protein, 8 aa, Influenza virus
YQSGTYPV

SEQ ID NO: 421764 - protein, 8 aa, Influenza virus
MLGFVFTL

SEQ ID NO: 421765 - protein, 8 aa, Influenza virus
GTYGKGSW

SEQ ID NO: 421766 - protein, 8 aa, Influenza virus
LVDGWYGY

SEQ ID NO: 421767 - protein, 8 aa, Influenza virus
ISFAMSCF

SEQ ID NO: 421768 - protein, 8 aa, Influenza virus
ALQLLLEV

SEQ ID NO: 421769 - protein, 8 aa, Influenza virus
FIIREPFI

SEQ ID NO: 421770 - protein, 8 aa, Influenza virus
NEIKGLKL

SEQ ID NO: 421771 - protein, 8 aa, Influenza virus
YINRTGTF

SEQ ID NO: 421772 - protein, 8 aa, Influenza virus
LLAFILWA

SEQ ID NO: 421773 - protein, 8 aa, Influenza virus
WTYNAELF

SEQ ID NO: 421774 - protein, 8 aa, Influenza virus
GRMTFYWK

SEQ ID NO: 421775 - protein, 8 aa, Influenza virus
RRIESLNK

SEQ ID NO: 421776 - protein, 8 aa, Influenza virus
SYLECRTF

SEQ ID NO: 421777 - protein, 8 aa, Influenza virus
ASNSIVTF

SEQ ID NO: 421778 - protein, 8 aa, Influenza virus
YEELKHFL

SEQ ID NO: 421779 - protein, 8 aa, Influenza virus
LVDSISSW

SEQ ID NO: 421780 - protein, 8 aa, Influenza virus
FQNTSKHY

SEQ ID NO: 421781 - protein, 8 aa, Influenza virus
RYGPALSI

SEQ ID NO: 421782 - protein, 8 aa, Influenza virus
WTGMIDGW

SEQ ID NO: 421783 - protein, 8 aa, Influenza virus
KTMTITFL

SEQ ID NO: 421784 - protein, 8 aa, Influenza virus
LSSRISFY

SEQ ID NO: 421785 - protein, 8 aa, Influenza virus
ALYGTQSL

SEQ ID NO: 421786 - protein, 8 aa, Influenza virus
MYQKCCTL

SEQ ID NO: 421787 - protein, 8 aa, Influenza virus
SAHHRVYW

SEQ ID NO: 421788 - protein, 8 aa, Influenza virus
SMTEVWSY

SEQ ID NO: 421789 - protein, 8 aa, Influenza virus
NRMQINPV

SEQ ID NO: 421790 - protein, 8 aa, Influenza virus
FSMELPSF

SEQ ID NO: 421791 - protein, 8 aa, Influenza virus
LVDSVVSW

SEQ ID NO: 421792 - protein, 8 aa, Influenza virus
KMEAILVV

SEQ ID NO: 421793 - protein, 8 aa, Influenza virus
TSNSIIVF

SEQ ID NO: 421794 - protein, 8 aa, Influenza virus
MMAMKYPI

SEQ ID NO: 421795 - protein, 8 aa, Influenza virus
ILAFILWA

SEQ ID NO: 421796 - protein, 8 aa, Influenza virus
RRLTTTVK

SEQ ID NO: 421797 - protein, 8 aa, Influenza virus
KSVFNSLY

SEQ ID NO: 421798 - protein, 8 aa, Influenza virus
AQRLENVF

SEQ ID NO: 421799 - protein, 8 aa, Influenza virus
QEMRTFSF

SEQ ID NO: 421800 - protein, 8 aa, Influenza virus
KLNRIIEK

SEQ ID NO: 421801 - protein, 8 aa, Influenza virus
IYIEVLHL

SEQ ID NO: 421802 - protein, 8 aa, Influenza virus
SLLNRLSI

SEQ ID NO: 421803 - protein, 8 aa, Influenza virus
SISCFLLV

SEQ ID NO: 421804 - protein, 8 aa, Influenza virus
TYINNATI

SEQ ID NO: 421805 - protein, 8 aa, Influenza virus
RIRSNGNL

SEQ ID NO: 421806 - protein, 8 aa, Influenza virus
GQSGRIVF

SEQ ID NO: 421807 - protein, 8 aa, Influenza virus
SSMNNQVF

SEQ ID NO: 421808 - protein, 8 aa, Influenza virus
KQASYKIF

SEQ ID NO: 421809 - protein, 8 aa, Influenza virus
YMFESKNM

SEQ ID NO: 421810 - protein, 8 aa, Influenza virus
SQLEGFSA

SEQ ID NO: 421811 - protein, 8 aa, Influenza virus
SRMQFSSL

SEQ ID NO: 421812 - protein, 8 aa, Influenza virus
TIIYSSSM

SEQ ID NO: 421813 - protein, 8 aa, Influenza virus
WEKNCTLI

SEQ ID NO: 421814 - protein, 8 aa, Influenza virus
TETGAPQL

SEQ ID NO: 421815 - protein, 8 aa, Influenza virus
ITETIKSW

SEQ ID NO: 421816 - protein, 8 aa, Influenza virus
FSKWNVTY

SEQ ID NO: 421817 - protein, 8 aa, Influenza virus
IVMGLVFI

SEQ ID NO: 421818 - protein, 8 aa, Influenza virus
RRLTTTIK

SEQ ID NO: 421819 - protein, 8 aa, Influenza virus
MVWDANGW

SEQ ID NO: 421820 - protein, 8 aa, Influenza virus
SEIRTFSF

SEQ ID NO: 421821 - protein, 8 aa, Influenza virus
VTTVTLHF

SEQ ID NO: 421822 - protein, 8 aa, Influenza virus
RELGNGCF

SEQ ID NO: 421823 - protein, 8 aa, Influenza virus
AINSSKPF

SEQ ID NO: 421824 - protein, 8 aa, Influenza virus
QVTDIWAY

SEQ ID NO: 421825 - protein, 8 aa, Influenza virus
KSVFNCLY

SEQ ID NO: 421826 - protein, 8 aa, Influenza virus
ESECQCLY

SEQ ID NO: 421827 - protein, 8 aa, Influenza virus
AQDVIMEV

SEQ ID NO: 421828 - protein, 8 aa, Influenza virus
RRCLLQSL

SEQ ID NO: 421829 - protein, 8 aa, Influenza virus
LLIGISNI

SEQ ID NO: 421830 - protein, 8 aa, Influenza virus
GQFGRINF

SEQ ID NO: 421831 - protein, 8 aa, Influenza virus
HQSGTYPI

SEQ ID NO: 421832 - protein, 8 aa, Influenza virus
DVILWFSF

SEQ ID NO: 421833 - protein, 8 aa, Influenza virus
KPRFLPDL

SEQ ID NO: 421834 - protein, 8 aa, Influenza virus
FLTQGSLL

SEQ ID NO: 421835 - protein, 8 aa, Influenza virus
WMKIYWVL

SEQ ID NO: 421836 - protein, 8 aa, Influenza virus
RMAKCNTK

SEQ ID NO: 421837 - protein, 8 aa, Influenza virus
RMARCNTK

SEQ ID NO: 421838 - protein, 8 aa, Influenza virus
LSIAPIMF

SEQ ID NO: 421839 - protein, 8 aa, Influenza virus
RRLSVNAI

SEQ ID NO: 421840 - protein, 8 aa, Influenza virus
SPYRTLLM

SEQ ID NO: 421841 - protein, 8 aa, Influenza virus
YKMNTRIL

SEQ ID NO: 421842 - protein, 8 aa, Influenza virus
REIGNGCF

SEQ ID NO: 421843 - protein, 8 aa, Influenza virus
ILFASATA

SEQ ID NO: 421844 - protein, 8 aa, Influenza virus
REMTFHGA

SEQ ID NO: 421845 - protein, 8 aa, Influenza virus
ISVGSGSF

SEQ ID NO: 421846 - protein, 8 aa, Influenza virus
GEALRQIL

SEQ ID NO: 421847 - protein, 8 aa, Influenza virus
LEESHPGL

SEQ ID NO: 421848 - protein, 8 aa, Influenza virus
YMFESKSM

SEQ ID NO: 421849 - protein, 8 aa, Influenza virus
RSINWLTK

SEQ ID NO: 421850 - protein, 8 aa, Influenza virus
KYVNNTTI

SEQ ID NO: 421851 - protein, 8 aa, Influenza virus
AIAMGLVF

SEQ ID NO: 421852 - protein, 8 aa, Influenza virus
LLAFVLWA

SEQ ID NO: 421853 - protein, 8 aa, Influenza virus
SLNGISPI

SEQ ID NO: 421854 - protein, 8 aa, Influenza virus
GIKGFSFK

SEQ ID NO: 421855 - protein, 8 aa, Influenza virus
SINTKLPF

SEQ ID NO: 421856 - protein, 8 aa, Influenza virus
FMIIGGFI

SEQ ID NO: 421857 - protein, 8 aa, Influenza virus
WTGLIDGW

SEQ ID NO: 421858 - protein, 8 aa, Influenza virus
LTGGQSFY

SEQ ID NO: 421859 - protein, 8 aa, Influenza virus
NEIKGVKL

SEQ ID NO: 421860 - protein, 8 aa, Influenza virus
AQRLEGVF

SEQ ID NO: 421861 - protein, 8 aa, Influenza virus
KYGPALSI

SEQ ID NO: 421862 - protein, 8 aa, Influenza virus
YQSLRSIL

SEQ ID NO: 421863 - protein, 8 aa, Influenza virus
NTYDHTKY

SEQ ID NO: 421864 - protein, 8 aa, Influenza virus
FQNVSPLW

SEQ ID NO: 421865 - protein, 8 aa, Influenza virus
YQAELLVA

SEQ ID NO: 421866 - protein, 8 aa, Influenza virus
YYNGRSSF

SEQ ID NO: 421867 - protein, 8 aa, Influenza virus
YQSRFEAV

SEQ ID NO: 421868 - protein, 8 aa, Influenza virus
YLLFQDIL

SEQ ID NO: 421869 - protein, 8 aa, Influenza virus
TIHDGTAF

SEQ ID NO: 421870 - protein, 8 aa, Influenza virus
QIIKLLPF

SEQ ID NO: 421871 - protein, 8 aa, Influenza virus
VSFSISCF

SEQ ID NO: 421872 - protein, 8 aa, Influenza virus
LLESDVPV

SEQ ID NO: 421873 - protein, 8 aa, Influenza virus
KEWGNGCF

SEQ ID NO: 421874 - protein, 8 aa, Influenza virus
TECRTFFL

SEQ ID NO: 421875 - protein, 8 aa, Influenza virus
GTHGTGSW

SEQ ID NO: 421876 - protein, 8 aa, Influenza virus
RRLSANAI

SEQ ID NO: 421877 - protein, 8 aa, Influenza virus
RPVAKAGF

SEQ ID NO: 421878 - protein, 8 aa, Influenza virus
SSWHILSK

SEQ ID NO: 421879 - protein, 8 aa, Influenza virus
GLSSRISF

SEQ ID NO: 421880 - protein, 8 aa, Influenza virus
LLAVIMGL

SEQ ID NO: 421881 - protein, 8 aa, Influenza virus
LEQSGLPV

SEQ ID NO: 421882 - protein, 8 aa, Influenza virus
AEIEDLIF

SEQ ID NO: 421883 - protein, 8 aa, Influenza virus
NLIAPWYA

SEQ ID NO: 421884 - protein, 8 aa, Influenza virus
KSVFNNLY

SEQ ID NO: 421885 - protein, 8 aa, Influenza virus
VYMNTALL

SEQ ID NO: 421886 - protein, 8 aa, Influenza virus
SMTEIWSY

SEQ ID NO: 421887 - protein, 8 aa, Influenza virus
ELSSMGVY

SEQ ID NO: 421888 - protein, 8 aa, Influenza virus
CSIWFSHY

SEQ ID NO: 421889 - protein, 8 aa, Influenza virus
FTFNGSFI

SEQ ID NO: 421890 - protein, 8 aa, Influenza virus
LECRTFFL

SEQ ID NO: 421891 - protein, 8 aa, Influenza virus
LSVAPIMF

SEQ ID NO: 421892 - protein, 8 aa, Influenza virus
RANINDFF

SEQ ID NO: 421893 - protein, 8 aa, Influenza virus
SRLNWLTK

SEQ ID NO: 421894 - protein, 8 aa, Influenza virus
TMTHTSQY

SEQ ID NO: 421895 - protein, 8 aa, Influenza virus
FLRVRDQM

SEQ ID NO: 421896 - protein, 8 aa, Influenza virus
THSWVPIL

SEQ ID NO: 421897 - protein, 8 aa, Influenza virus
TLASTNAY

SEQ ID NO: 421898 - protein, 8 aa, Influenza virus
KTFQNIEK

SEQ ID NO: 421899 - protein, 8 aa, Influenza virus
LECKTFFL

SEQ ID NO: 421900 - protein, 8 aa, Influenza virus
SSKYHQSF

SEQ ID NO: 421901 - protein, 8 aa, Influenza virus
ASSLVLLF

SEQ ID NO: 421902 - protein, 8 aa, Influenza virus
MQFSSLTV

SEQ ID NO: 421903 - protein, 8 aa, Influenza virus
ITYSSSLM

SEQ ID NO: 421904 - protein, 8 aa, Influenza virus
ITYGACPK

SEQ ID NO: 421905 - protein, 8 aa, Influenza virus
LLAFMLWA

SEQ ID NO: 421906 - protein, 8 aa, Influenza virus
SPLTKGML

SEQ ID NO: 421907 - protein, 8 aa, Influenza virus
FIKWNVTY

SEQ ID NO: 421908 - protein, 8 aa, Influenza virus
SHYREEAL

SEQ ID NO: 421909 - protein, 8 aa, Influenza virus
MYQKCCSL

SEQ ID NO: 421910 - protein, 8 aa, Influenza virus
KIVTTVGW

SEQ ID NO: 421911 - protein, 8 aa, Influenza virus
MVWDPNGW

SEQ ID NO: 421912 - protein, 8 aa, Influenza virus
NEVGAKIL

SEQ ID NO: 421913 - protein, 8 aa, Influenza virus
RYAFELVF

SEQ ID NO: 421914 - protein, 8 aa, Influenza virus
KLYWHLMR

SEQ ID NO: 421915 - protein, 8 aa, Influenza virus
YSTVASSF

SEQ ID NO: 421916 - protein, 8 aa, Influenza virus
YIIRALTL

SEQ ID NO: 421917 - protein, 8 aa, Influenza virus
ESIRNNTY

SEQ ID NO: 421918 - protein, 8 aa, Influenza virus
WILWISFA

SEQ ID NO: 421919 - protein, 8 aa, Influenza virus
RRIENLNR

SEQ ID NO: 421920 - protein, 8 aa, Influenza virus
SVQRSLPF

SEQ ID NO: 421921 - protein, 8 aa, Influenza virus
EVNSWHIF

SEQ ID NO: 421922 - protein, 8 aa, Influenza virus
SLYASSQL

SEQ ID NO: 421923 - protein, 8 aa, Influenza virus
AMTEVWSY

SEQ ID NO: 421924 - protein, 8 aa, Influenza virus
ILWFSFGA

SEQ ID NO: 421925 - protein, 8 aa, Influenza virus
HLKFKADL

SEQ ID NO: 421926 - protein, 8 aa, Influenza virus
MMAMRYPI

SEQ ID NO: 421927 - protein, 8 aa, Influenza virus
ETEQTKLY

SEQ ID NO: 421928 - protein, 8 aa, Influenza virus
IFMARSAL

SEQ ID NO: 421929 - protein, 8 aa, Influenza virus
TTNSIVVF

SEQ ID NO: 421930 - protein, 8 aa, Influenza virus
RRMVQAMR

SEQ ID NO: 421931 - protein, 8 aa, Influenza virus
GMLGFVFT

SEQ ID NO: 421932 - protein, 8 aa, Influenza virus
VLWTSNSI

SEQ ID NO: 421933 - protein, 8 aa, Influenza virus
QVIKLLPF

SEQ ID NO: 421934 - protein, 8 aa, Influenza virus
RRLSTNAI

SEQ ID NO: 421935 - protein, 8 aa, Influenza virus
YQAELLIA

SEQ ID NO: 421936 - protein, 8 aa, Influenza virus
MIIGGFIF

SEQ ID NO: 421937 - protein, 8 aa, Influenza virus
IIYSSSMM

SEQ ID NO: 421938 - protein, 8 aa, Influenza virus
SPLTKGIL

SEQ ID NO: 421939 - protein, 8 aa, Influenza virus
VLASTTAK

SEQ ID NO: 421940 - protein, 8 aa, Influenza virus
IMKTEKTF

SEQ ID NO: 421941 - protein, 8 aa, Influenza virus
KYIKSDQL

SEQ ID NO: 421942 - protein, 8 aa, Influenza virus
LVDSIVSW

SEQ ID NO: 421943 - protein, 8 aa, Influenza virus
RRLTTTIR

SEQ ID NO: 421944 - protein, 8 aa, Influenza virus
CLYKLSQF

SEQ ID NO: 421945 - protein, 8 aa, Influenza virus
YKMNTKIL

SEQ ID NO: 421946 - protein, 8 aa, Influenza virus
KYIPSRSL

SEQ ID NO: 421947 - protein, 8 aa, Influenza virus
RLLQSSQV

SEQ ID NO: 421948 - protein, 8 aa, Influenza virus
AMITYITK

SEQ ID NO: 421949 - protein, 8 aa, Influenza virus
LIIGISNV

SEQ ID NO: 421950 - protein, 8 aa, Influenza virus
KRLTILGK

SEQ ID NO: 421951 - protein, 8 aa, Influenza virus
GTCGTGSW

SEQ ID NO: 421952 - protein, 8 aa, Influenza virus
ILATTVTL

SEQ ID NO: 421953 - protein, 8 aa, Influenza virus
NTYNHTQY

SEQ ID NO: 421954 - protein, 8 aa, Influenza virus
FTKWNVTY

SEQ ID NO: 421955 - protein, 8 aa, Influenza virus
HQSGTYPV

SEQ ID NO: 421956 - protein, 8 aa, Influenza virus
TYINNTTI

SEQ ID NO: 421957 - protein, 8 aa, Influenza virus
LIDGWYGY

SEQ ID NO: 421958 - protein, 8 aa, Influenza virus
RLFDYSKW

SEQ ID NO: 421959 - protein, 8 aa, Influenza virus
KLHERVRK

SEQ ID NO: 421960 - protein, 8 aa, Influenza virus
RINMINSK

SEQ ID NO: 421961 - protein, 8 aa, Influenza virus
YQSIRSIL

SEQ ID NO: 421962 - protein, 8 aa, Influenza virus
STGAQSFY

SEQ ID NO: 421963 - protein, 8 aa, Influenza virus
MTFYWTIV

SEQ ID NO: 421964 - protein, 8 aa, Influenza virus
RINTINSK

SEQ ID NO: 421965 - protein, 8 aa, Influenza virus
FPMGTAPV

SEQ ID NO: 421966 - protein, 8 aa, Influenza virus
SQYICSPV

SEQ ID NO: 421967 - protein, 8 aa, Influenza virus
KINNIIEK

SEQ ID NO: 421968 - protein, 8 aa, Influenza virus
TELPFQNL

SEQ ID NO: 421969 - protein, 8 aa, Influenza virus
KIITIDSV

SEQ ID NO: 421970 - protein, 8 aa, Influenza virus
MRWLTLKL

SEQ ID NO: 421971 - protein, 8 aa, Influenza virus
QIRGFVHF

SEQ ID NO: 421972 - protein, 8 aa, Influenza virus
KLSQMSKK

SEQ ID NO: 421973 - protein, 8 aa, Influenza virus
KIMESGGV

SEQ ID NO: 421974 - protein, 8 aa, Influenza virus
HQSETYPV

SEQ ID NO: 421975 - protein, 8 aa, Influenza virus
SVLYFWGI

SEQ ID NO: 421976 - protein, 8 aa, Influenza virus
LLDNLQAY

SEQ ID NO: 421977 - protein, 8 aa, Influenza virus
LSVPEWSY

SEQ ID NO: 421978 - protein, 8 aa, Influenza virus
KMNAQFEA

SEQ ID NO: 421979 - protein, 8 aa, Influenza virus
CVSHNGTW

SEQ ID NO: 421980 - protein, 8 aa, Influenza virus
YMFESKRM

SEQ ID NO: 421981 - protein, 8 aa, Influenza virus
SSFEQITF

SEQ ID NO: 421982 - protein, 8 aa, Influenza virus
ISNEGSYF

SEQ ID NO: 421983 - protein, 8 aa, Influenza virus
TINSPLPF

SEQ ID NO: 421984 - protein, 8 aa, Influenza virus
YEELKLLL

SEQ ID NO: 421985 - protein, 8 aa, Influenza virus
IQFTSVGK

SEQ ID NO: 421986 - protein, 8 aa, Influenza virus
FQQMRDVL

SEQ ID NO: 421987 - protein, 8 aa, Influenza virus
ISLCSIWF

SEQ ID NO: 421988 - protein, 8 aa, Influenza virus
LLAVVMGL

SEQ ID NO: 421989 - protein, 8 aa, Influenza virus
AVNSSKPF

SEQ ID NO: 421990 - protein, 8 aa, Influenza virus
YLEEHPSA

SEQ ID NO: 421991 - protein, 8 aa, Influenza virus
AEIEDLTF

SEQ ID NO: 421992 - protein, 8 aa, Influenza virus
TINDRSPF

SEQ ID NO: 421993 - protein, 8 aa, Influenza virus
KLSSMGVY

SEQ ID NO: 421994 - protein, 8 aa, Influenza virus
MYQRCCNL

SEQ ID NO: 421995 - protein, 8 aa, Influenza virus
SLSLAIMV

SEQ ID NO: 421996 - protein, 8 aa, Influenza virus
RLGYETFK

SEQ ID NO: 421997 - protein, 8 aa, Influenza virus
IMIWHSNL

SEQ ID NO: 421998 - protein, 8 aa, Influenza virus
RSLFSSIK

SEQ ID NO: 421999 - protein, 8 aa, Influenza virus
MLNLYDRV

SEQ ID NO: 422000 - protein, 8 aa, Influenza virus
AIAMGFVF

SEQ ID NO: 422001 - protein, 8 aa, Influenza virus
LLAIAIGL

SEQ ID NO: 422002 - protein, 8 aa, Influenza virus
VVMGLVFI

SEQ ID NO: 422003 - protein, 8 aa, Influenza virus
RLGPSFYA

SEQ ID NO: 422004 - protein, 8 aa, Influenza virus
FTWNGVKV

SEQ ID NO: 422005 - protein, 8 aa, Influenza virus
ILVIYATV

SEQ ID NO: 422006 - protein, 8 aa, Influenza virus
AMQNIIQI

SEQ ID NO: 422007 - protein, 8 aa, Influenza virus
AMTEIWSY

SEQ ID NO: 422008 - protein, 8 aa, Influenza virus
AMDHTSQY

SEQ ID NO: 422009 - protein, 8 aa, Influenza virus
SSFEQITF

SEQ ID NO: 422010 - protein, 8 aa, Influenza virus
KLKREMTF

SEQ ID NO: 422011 - protein, 8 aa, Influenza virus
RMTFYWAI

SEQ ID NO: 422012 - protein, 8 aa, Influenza virus
NECRTFFL

SEQ ID NO: 422013 - protein, 8 aa, Influenza virus
QTYRNTRK

SEQ ID NO: 422014 - protein, 8 aa, Influenza virus
ISVESSTY

SEQ ID NO: 422015 - protein, 8 aa, Influenza virus
KSLFSSIK

SEQ ID NO: 422016 - protein, 8 aa, Influenza virus
FLWCKIVT

SEQ ID NO: 422017 - protein, 8 aa, Influenza virus
SLGDCSFA

SEQ ID NO: 422018 - protein, 8 aa, Influenza virus
ESVKNGTY

SEQ ID NO: 422019 - protein, 8 aa, Influenza virus
LSFQVDCF

SEQ ID NO: 422020 - protein, 8 aa, Influenza virus
FIAPRYAF

SEQ ID NO: 422021 - protein, 8 aa, Influenza virus
KRLTVLGK

SEQ ID NO: 422022 - protein, 8 aa, Influenza virus
KLKREITF

SEQ ID NO: 422023 - protein, 8 aa, Influenza virus
SSNYQQSF

SEQ ID NO: 422024 - protein, 8 aa, Influenza virus
TSNSIVAF

SEQ ID NO: 422025 - protein, 8 aa, Influenza virus
MMIWHSNL

SEQ ID NO: 422026 - protein, 8 aa, Influenza virus
CLVPCFWL

SEQ ID NO: 422027 - protein, 8 aa, Influenza virus
MYQKCCNL

SEQ ID NO: 422028 - protein, 8 aa, Influenza virus
SMVTFCGL

SEQ ID NO: 422029 - protein, 8 aa, Influenza virus
LLAVIVGL

SEQ ID NO: 422030 - protein, 8 aa, Influenza virus
ILFIREGK

SEQ ID NO: 422031 - protein, 8 aa, Influenza virus
LVHQSGTY

SEQ ID NO: 422032 - protein, 8 aa, Influenza virus
RVRSDGNL

SEQ ID NO: 422033 - protein, 8 aa, Influenza virus
IEMTDSEM

SEQ ID NO: 422034 - protein, 8 aa, Influenza virus
KYHWNLAL

SEQ ID NO: 422035 - protein, 8 aa, Influenza virus
TSNSIIAF

SEQ ID NO: 422036 - protein, 8 aa, Influenza virus
SIHWTIVK

SEQ ID NO: 422037 - protein, 8 aa, Influenza virus
VYINTALL

SEQ ID NO: 422038 - protein, 8 aa, Influenza virus
YEAIEECL

SEQ ID NO: 422039 - protein, 8 aa, Influenza virus
LTLNTMTK

SEQ ID NO: 422040 - protein, 8 aa, Influenza virus
YESIEECL

SEQ ID NO: 422041 - protein, 8 aa, Influenza virus
SLIMRTVI

SEQ ID NO: 422042 - protein, 8 aa, Influenza virus
MTFYWAIV

SEQ ID NO: 422043 - protein, 8 aa, Influenza virus
FYRNLVWF

SEQ ID NO: 422044 - protein, 8 aa, Influenza virus
IQAGVNRF

SEQ ID NO: 422045 - protein, 8 aa, Influenza virus
RLAKCNTK

SEQ ID NO: 422046 - protein, 8 aa, Influenza virus
LLAIAMGL

SEQ ID NO: 422047 - protein, 8 aa, Influenza virus
LIHQSGTY

SEQ ID NO: 422048 - protein, 8 aa, Influenza virus
ISFSISCF

SEQ ID NO: 422049 - protein, 8 aa, Influenza virus
FYRNLAWF

SEQ ID NO: 422050 - protein, 8 aa, Influenza virus
RLRMATGL

SEQ ID NO: 422051 - protein, 8 aa, Influenza virus
RRMIQLIV

SEQ ID NO: 422052 - protein, 8 aa, Influenza virus
KMNNQILI

SEQ ID NO: 422053 - protein, 8 aa, Influenza virus
ASIRNNSY

SEQ ID NO: 422054 - protein, 8 aa, Influenza virus
VMGQASYK

SEQ ID NO: 422055 - protein, 8 aa, Influenza virus
SINWLTKK

SEQ ID NO: 422056 - protein, 8 aa, Influenza virus
LEALMEWL

SEQ ID NO: 422057 - protein, 8 aa, Influenza virus
SEKVNTLL

SEQ ID NO: 422058 - protein, 8 aa, Influenza virus
ILNPNDTV

SEQ ID NO: 422059 - protein, 8 aa, Influenza virus
RMTFYWTI

SEQ ID NO: 422060 - protein, 8 aa, Influenza virus
YLCAGIPT

SEQ ID NO: 422061 - protein, 8 aa, Influenza virus
ASIRNSTY

SEQ ID NO: 422062 - protein, 8 aa, Influenza virus
LIAPRGYF

SEQ ID NO: 422063 - protein, 8 aa, Influenza virus
LLENDVPV

SEQ ID NO: 422064 - protein, 8 aa, Influenza virus
GQSGRIEF

SEQ ID NO: 422065 - protein, 8 aa, Influenza virus
LIAPWYAF

SEQ ID NO: 422066 - protein, 8 aa, Influenza virus
HPRGLLEV

SEQ ID NO: 422067 - protein, 8 aa, Influenza virus
VYIEVLHL

SEQ ID NO: 422068 - protein, 8 aa, Influenza virus
LPQSGRIV

SEQ ID NO: 422069 - protein, 8 aa, Influenza virus
LTVEVPYV

SEQ ID NO: 422070 - protein, 8 aa, Influenza virus
FSFGASSF

SEQ ID NO: 422071 - protein, 8 aa, Influenza virus
RSSFYAEM

SEQ ID NO: 422072 - protein, 8 aa, Influenza virus
YLLKGESY

SEQ ID NO: 422073 - protein, 8 aa, Influenza virus
WTYNAELF

SEQ ID NO: 422074 - protein, 8 aa, Influenza virus
GVKGFSFK

SEQ ID NO: 422075 - protein, 8 aa, Influenza virus
TSLTSLPF

SEQ ID NO: 422076 - protein, 8 aa, Influenza virus
KRYERVKM

SEQ ID NO: 422077 - protein, 8 aa, Influenza virus
GIFFVEHK

SEQ ID NO: 422078 - protein, 8 aa, Influenza virus
STKSTVLK

SEQ ID NO: 422079 - protein, 8 aa, Influenza virus
YQILVIYA

SEQ ID NO: 422080 - protein, 8 aa, Influenza virus
LEPGTFDL

SEQ ID NO: 422081 - protein, 8 aa, Influenza virus
KINSWHIF

SEQ ID NO: 422082 - protein, 8 aa, Influenza virus
ILSFIMWA

SEQ ID NO: 422083 - protein, 8 aa, Influenza virus
YRTLMSVK

SEQ ID NO: 422084 - protein, 8 aa, Influenza virus
YMFESKNM

SEQ ID NO: 422085 - protein, 8 aa, Influenza virus
LLENGVPV

SEQ ID NO: 422086 - protein, 8 aa, Influenza virus
QLLRHFQK

SEQ ID NO: 422087 - protein, 8 aa, Influenza virus
FTKWNVTY

SEQ ID NO: 422088 - protein, 8 aa, Influenza virus
KMNTQILI

SEQ ID NO: 422089 - protein, 8 aa, Influenza virus
FESNGAFI

SEQ ID NO: 422090 - protein, 8 aa, Influenza virus
QRFEMFPK

SEQ ID NO: 422091 - protein, 8 aa, Influenza virus
KRLTIIGK

SEQ ID NO: 422092 - protein, 8 aa, Influenza virus
CFQPCFYI

SEQ ID NO: 422093 - protein, 8 aa, Influenza virus
RMDYYWTL

SEQ ID NO: 422094 - protein, 8 aa, Influenza virus
LQNTSKHY

SEQ ID NO: 422095 - protein, 8 aa, Influenza virus
TSNQDSFY

SEQ ID NO: 422096 - protein, 8 aa, Influenza virus
VLINTYQW

SEQ ID NO: 422097 - protein, 8 aa, Influenza virus
REITFHGA

SEQ ID NO: 422098 - protein, 8 aa, Influenza virus
FLAPRYGY

SEQ ID NO: 422099 - protein, 8 aa, Influenza virus
FVQSYFQL

SEQ ID NO: 422100 - protein, 8 aa, Influenza virus
RLRSGFEM

SEQ ID NO: 422101 - protein, 8 aa, Influenza virus
WMCLNGSM

SEQ ID NO: 422102 - protein, 8 aa, Influenza virus
ESVLINTY

SEQ ID NO: 422103 - protein, 8 aa, Influenza virus
SIKTKLPF

SEQ ID NO: 422104 - protein, 8 aa, Influenza virus
KLSNMGVY

SEQ ID NO: 422105 - protein, 8 aa, Influenza virus
FQQMRDIL

SEQ ID NO: 422106 - protein, 8 aa, Influenza virus
TIHDRSPF

SEQ ID NO: 422107 - protein, 8 aa, Influenza virus
SLNGVSPI

SEQ ID NO: 422108 - protein, 8 aa, Influenza virus
NPRIFLAM

SEQ ID NO: 422109 - protein, 8 aa, Influenza virus
RTLDYHDF

SEQ ID NO: 422110 - protein, 8 aa, Influenza virus
TSSSSTVF

SEQ ID NO: 422111 - protein, 8 aa, Influenza virus
SHNGTWAV

SEQ ID NO: 422112 - protein, 8 aa, Influenza virus
ALAQGTLL

SEQ ID NO: 422113 - protein, 8 aa, Influenza virus
WVLLNASW

SEQ ID NO: 422114 - protein, 8 aa, Influenza virus
VINTSKPF

SEQ ID NO: 422115 - protein, 8 aa, Influenza virus
APSRVSKL

SEQ ID NO: 422116 - protein, 8 aa, Influenza virus
RLNINSVK

SEQ ID NO: 422117 - protein, 8 aa, Influenza virus
KLNNVIDK

SEQ ID NO: 422118 - protein, 8 aa, Influenza virus
ISFAISCF

SEQ ID NO: 422119 - protein, 8 aa, Influenza virus
LMLATGMK

SEQ ID NO: 422120 - protein, 8 aa, Influenza virus
FYRNLIWF

SEQ ID NO: 422121 - protein, 8 aa, Influenza virus
IPSRSLKL

SEQ ID NO: 422122 - protein, 8 aa, Influenza virus
CEVSSWHI

SEQ ID NO: 422123 - protein, 8 aa, Influenza virus
IMASQGTK

SEQ ID NO: 422124 - protein, 8 aa, Influenza virus
TILETGYV

SEQ ID NO: 422125 - protein, 8 aa, Influenza virus
LLTEVETL

SEQ ID NO: 422126 - protein, 8 aa, Influenza virus
SLLNRLSI

SEQ ID NO: 422127 - protein, 8 aa, Influenza virus
SVKNGTYY

SEQ ID NO: 422128 - protein, 8 aa, Influenza virus
GVKGFSYK

SEQ ID NO: 422129 - protein, 8 aa, Influenza virus
IPKRNRSI

SEQ ID NO: 422130 - protein, 8 aa, Influenza virus
MRTPIAFL

SEQ ID NO: 422131 - protein, 8 aa, Influenza virus
FIQALQLL

SEQ ID NO: 422132 - protein, 8 aa, Influenza virus
VSVGSGSF

SEQ ID NO: 422133 - protein, 8 aa, Influenza virus
KVNTLTEK

SEQ ID NO: 422134 - protein, 8 aa, Influenza virus
CQMEKIVL

SEQ ID NO: 422135 - protein, 8 aa, Influenza virus
SYNYHQSF

SEQ ID NO: 422136 - protein, 8 aa, Influenza virus
QEIRAFSF

SEQ ID NO: 422137 - protein, 8 aa, Influenza virus
NPVHKSQL

SEQ ID NO: 422138 - protein, 8 aa, Influenza virus
IISLCSIW

SEQ ID NO: 422139 - protein, 8 aa, Influenza virus
WMACHSAA

SEQ ID NO: 422140 - protein, 8 aa, Influenza virus
NTDLEALM

SEQ ID NO: 422141 - protein, 8 aa, Influenza virus
SLCYPGNF

SEQ ID NO: 422142 - protein, 8 aa, Influenza virus
TIIETGYV

SEQ ID NO: 422143 - protein, 8 aa, Influenza virus
LSMAPIMF

SEQ ID NO: 422144 - protein, 8 aa, Influenza virus
KLNRLIDK

SEQ ID NO: 422145 - protein, 8 aa, Influenza virus
CSIWFSHY

SEQ ID NO: 422146 - protein, 8 aa, Influenza virus
GESYGRII

SEQ ID NO: 422147 - protein, 8 aa, Influenza virus
ASSGTLEF

SEQ ID NO: 422148 - protein, 8 aa, Influenza virus
MLLASTNA

SEQ ID NO: 422149 - protein, 8 aa, Influenza virus
TLSTIALL

SEQ ID NO: 422150 - protein, 8 aa, Influenza virus
CLYASPQL

SEQ ID NO: 422151 - protein, 8 aa, Influenza virus
ITYSSSMM

SEQ ID NO: 422152 - protein, 8 aa, Influenza virus
DAYAVIHY

SEQ ID NO: 422153 - protein, 8 aa, Influenza virus
TENPVICL

SEQ ID NO: 422154 - protein, 8 aa, Influenza virus
WVLWISFA

SEQ ID NO: 422155 - protein, 8 aa, Influenza virus
AYTKVMYF

SEQ ID NO: 422156 - protein, 8 aa, Influenza virus
RRAEIIKM

SEQ ID NO: 422157 - protein, 8 aa, Influenza virus
YRYTYRCH

SEQ ID NO: 422158 - protein, 8 aa, Influenza virus
FESNGNLI

SEQ ID NO: 422159 - protein, 8 aa, Influenza virus
MRFTYSGI

SEQ ID NO: 422160 - protein, 8 aa, Influenza virus
MLNLYERV

SEQ ID NO: 422161 - protein, 8 aa, Influenza virus
CEVNSWHI

SEQ ID NO: 422162 - protein, 8 aa, Influenza virus
VTLSSGYK

SEQ ID NO: 422163 - protein, 8 aa, Influenza virus
TEYRQEAL

SEQ ID NO: 422164 - protein, 8 aa, Influenza virus
RRSGGISK

SEQ ID NO: 422165 - protein, 8 aa, Influenza virus
KIIHISPL

SEQ ID NO: 422166 - protein, 8 aa, Influenza virus
RRIDFHWL

SEQ ID NO: 422167 - protein, 8 aa, Influenza virus
KTGGPIYK

SEQ ID NO: 422168 - protein, 8 aa, Influenza virus
HQSGTYPV

SEQ ID NO: 422169 - protein, 8 aa, Influenza virus
MSLNISLY

SEQ ID NO: 422170 - protein, 8 aa, Influenza virus
ISVGSSTY

SEQ ID NO: 422171 - protein, 8 aa, Influenza virus
YLMLSKSL

SEQ ID NO: 422172 - protein, 8 aa, Influenza virus
GLCYPGSF

SEQ ID NO: 422173 - protein, 8 aa, Influenza virus
FIAPENAY

SEQ ID NO: 422174 - protein, 8 aa, Influenza virus
FLAPRYAL

SEQ ID NO: 422175 - protein, 8 aa, Influenza virus
TINDRTAF

SEQ ID NO: 422176 - protein, 8 aa, Influenza virus
YSGSFMDY

SEQ ID NO: 422177 - protein, 8 aa, Influenza virus
SARHIEEW

SEQ ID NO: 422178 - protein, 8 aa, Influenza virus
RAYVDGFK

SEQ ID NO: 422179 - protein, 8 aa, Influenza virus
IINNYYNK

SEQ ID NO: 422180 - protein, 8 aa, Influenza virus
LWQCYYLL

SEQ ID NO: 422181 - protein, 8 aa, Influenza virus
FALSGVAV

SEQ ID NO: 422182 - protein, 8 aa, Influenza virus
LLAIVMGL

SEQ ID NO: 422183 - protein, 8 aa, Influenza virus
FESNGGLI

SEQ ID NO: 422184 - protein, 8 aa, Influenza virus
APNRVSKL

SEQ ID NO: 422185 - protein, 8 aa, Influenza virus
APNRASFF

SEQ ID NO: 422186 - protein, 8 aa, Influenza virus
ALRMKWMM

SEQ ID NO: 422187 - protein, 8 aa, Influenza virus
GIFSVESK

SEQ ID NO: 422188 - protein, 8 aa, Influenza virus
VSLGAISF

SEQ ID NO: 422189 - protein, 8 aa, Influenza virus
TSNQGSFY

SEQ ID NO: 422190 - protein, 8 aa, Influenza virus
YQAKFESI

SEQ ID NO: 422191 - protein, 8 aa, Influenza virus
SEETYKIL

SEQ ID NO: 422192 - protein, 8 aa, Influenza virus
SMSDIEAM

SEQ ID NO: 422193 - protein, 8 aa, Influenza virus
LELGDCSI

SEQ ID NO: 422194 - protein, 8 aa, Influenza virus
KEAQDVIM

SEQ ID NO: 422195 - protein, 8 aa, Influenza virus
FESNGNFI

SEQ ID NO: 422196 - protein, 8 aa, Influenza virus
SRSGFEVL

SEQ ID NO: 422197 - protein, 8 aa, Influenza virus
KVNSIINK

SEQ ID NO: 422198 - protein, 8 aa, Influenza virus
VSPLAVTW

SEQ ID NO: 422199 - protein, 8 aa, Influenza virus
YMFESKKM

SEQ ID NO: 422200 - protein, 8 aa, Influenza virus
MARSALIL

SEQ ID NO: 422201 - protein, 8 aa, Influenza virus
RTSISCLY

SEQ ID NO: 422202 - protein, 8 aa, Influenza virus
RSMRWLTL

SEQ ID NO: 422203 - protein, 8 aa, Influenza virus
NTYDHSHY

SEQ ID NO: 422204 - protein, 8 aa, Influenza virus
RIMINPVK

SEQ ID NO: 422205 - protein, 8 aa, Influenza virus
ALLNRLSI

SEQ ID NO: 422206 - protein, 8 aa, Influenza virus
DSEMLNLY

SEQ ID NO: 422207 - protein, 8 aa, Influenza virus
AIVMGLVF

SEQ ID NO: 422208 - protein, 8 aa, Influenza virus
GQFGRIDF

SEQ ID NO: 422209 - protein, 8 aa, Influenza virus
LMEQNVPV

SEQ ID NO: 422210 - protein, 8 aa, Influenza virus
TLSTIALI

SEQ ID NO: 422211 - protein, 8 aa, Influenza virus
RSMKWLTL

SEQ ID NO: 422212 - protein, 8 aa, Influenza virus
KLYWHLMH

SEQ ID NO: 422213 - protein, 8 aa, Influenza virus
KTMTITFL

SEQ ID NO: 422214 - protein, 8 aa, Influenza virus
LRFLFSSI

SEQ ID NO: 422215 - protein, 8 aa, Influenza virus
KTNQQFEM

SEQ ID NO: 422216 - protein, 8 aa, Influenza virus
AYTKVLYF

SEQ ID NO: 422217 - protein, 8 aa, Influenza virus
MLLIVQAL

SEQ ID NO: 422218 - protein, 8 aa, Influenza virus
AINKITNK

SEQ ID NO: 422219 - protein, 8 aa, Influenza virus
APRGHYKI

SEQ ID NO: 422220 - protein, 8 aa, Influenza virus
THMEVCFM

SEQ ID NO: 422221 - protein, 8 aa, Influenza virus
MTNVQNNY

SEQ ID NO: 422222 - protein, 8 aa, Influenza virus
SIKTKLPF

SEQ ID NO: 422223 - protein, 8 aa, Influenza virus
FQNICKPY

SEQ ID NO: 422224 - protein, 8 aa, Influenza virus
VSLGAVSF

SEQ ID NO: 422225 - protein, 8 aa, Influenza virus
SWFNSFLI

SEQ ID NO: 422226 - protein, 8 aa, Influenza virus
TVVENTYV

SEQ ID NO: 422227 - protein, 8 aa, Influenza virus
KMKAILVV

SEQ ID NO: 422228 - protein, 8 aa, Influenza virus
KSHGRILK

SEQ ID NO: 422229 - protein, 8 aa, Influenza virus
TPHRTLLM

SEQ ID NO: 422230 - protein, 8 aa, Influenza virus
SRYGYEML

SEQ ID NO: 422231 - protein, 8 aa, Influenza virus
YLEEHPNA

SEQ ID NO: 422232 - protein, 8 aa, Influenza virus
SIQPTFSV

SEQ ID NO: 422233 - protein, 8 aa, Influenza virus
SEKVDTLL

SEQ ID NO: 422234 - protein, 8 aa, Influenza virus
YVKQGSLM

SEQ ID NO: 422235 - protein, 8 aa, Influenza virus
SSTYHNSF

SEQ ID NO: 422236 - protein, 8 aa, Influenza virus
STGGQSFY

SEQ ID NO: 422237 - protein, 8 aa, Influenza virus
SSFYSEMK

SEQ ID NO: 422238 - protein, 8 aa, Influenza virus
GYICSGFF

SEQ ID NO: 422239 - protein, 8 aa, Influenza virus
TFLARSAL

SEQ ID NO: 422240 - protein, 8 aa, Influenza virus
MMIWHSNL

SEQ ID NO: 422241 - protein, 8 aa, Influenza virus
YNKVRLQL

SEQ ID NO: 422242 - protein, 8 aa, Influenza virus
APSRVTKL

SEQ ID NO: 422243 - protein, 8 aa, Influenza virus
WMKLYWHL

SEQ ID NO: 422244 - protein, 8 aa, Influenza virus
MLNPNDTI

SEQ ID NO: 422245 - protein, 8 aa, Influenza virus
ALAQGALL

SEQ ID NO: 422246 - protein, 8 aa, Influenza virus
ESVRNGTY

SEQ ID NO: 422247 - protein, 8 aa, Influenza virus
RPRVNGQS

SEQ ID NO: 422248 - protein, 8 aa, Influenza virus
RLGSSFYA

SEQ ID NO: 422249 - protein, 8 aa, Influenza virus
RLLQNSQV

SEQ ID NO: 422250 - protein, 8 aa, Influenza virus
IESNGNLI

SEQ ID NO: 422251 - protein, 8 aa, Influenza virus
SQYLCTGV

SEQ ID NO: 422252 - protein, 8 aa, Influenza virus
RECFNPCF

SEQ ID NO: 422253 - protein, 8 aa, Influenza virus
GTCWEQLY

SEQ ID NO: 422254 - protein, 8 aa, Influenza virus
RMNYHWTL

SEQ ID NO: 422255 - protein, 8 aa, Influenza virus
FESTGNLI

SEQ ID NO: 422256 - protein, 8 aa, Influenza virus
SYRCMFCI

SEQ ID NO: 422257 - protein, 8 aa, Influenza virus
KSHGRVLK

SEQ ID NO: 422258 - protein, 8 aa, Influenza virus
RLNNVIDK

SEQ ID NO: 422259 - protein, 8 aa, Influenza virus
LLFLEVPA

SEQ ID NO: 422260 - protein, 8 aa, Influenza virus
VQNNYTTV

SEQ ID NO: 422261 - protein, 8 aa, Influenza virus
AVVMGLVF

SEQ ID NO: 422262 - protein, 8 aa, Influenza virus
SISSRSGF

SEQ ID NO: 422263 - protein, 8 aa, Influenza virus
KLIDNEFT

SEQ ID NO: 422264 - protein, 8 aa, Influenza virus
LVAPRGYF

SEQ ID NO: 422265 - protein, 8 aa, Influenza virus
YMNVKSLK

SEQ ID NO: 422266 - protein, 8 aa, Influenza virus
IPSNSLKL

SEQ ID NO: 422267 - protein, 8 aa, Influenza virus
ILWFSLGA

SEQ ID NO: 422268 - protein, 8 aa, Influenza virus
LLENNVPV

SEQ ID NO: 422269 - protein, 8 aa, Influenza virus
EVRRRLSA

SEQ ID NO: 422270 - protein, 8 aa, Influenza virus
FEANGNLI

SEQ ID NO: 422271 - protein, 8 aa, Influenza virus
TIHDRTAF

SEQ ID NO: 422272 - protein, 8 aa, Influenza virus
MRTFSFQL

SEQ ID NO: 422273 - protein, 8 aa, Influenza virus
NTYDHSTY

SEQ ID NO: 422274 - protein, 8 aa, Influenza virus
MSLNISLY

SEQ ID NO: 422275 - protein, 8 aa, Influenza virus
RYIPSGSL

SEQ ID NO: 422276 - protein, 8 aa, Influenza virus
RLRGIPPL

SEQ ID NO: 422277 - protein, 8 aa, Influenza virus
SADHRVYW

SEQ ID NO: 422278 - protein, 8 aa, Influenza virus
GMMDGWYG

SEQ ID NO: 422279 - protein, 8 aa, Influenza virus
QESECQCL

SEQ ID NO: 422280 - protein, 8 aa, Influenza virus
RLFDYSGW

SEQ ID NO: 422281 - protein, 8 aa, Influenza virus
TIIYSSSM

SEQ ID NO: 422282 - protein, 8 aa, Influenza virus
KIYWHLMH

SEQ ID NO: 422283 - protein, 8 aa, Influenza virus
YQNNFVPV

SEQ ID NO: 422284 - protein, 8 aa, Influenza virus
KIIAIGSV

SEQ ID NO: 422285 - protein, 8 aa, Influenza virus
FFRRLNWL

SEQ ID NO: 422286 - protein, 8 aa, Influenza virus
RRQKRGLF

SEQ ID NO: 422287 - protein, 8 aa, Influenza virus
VLNLLIGV

SEQ ID NO: 422288 - protein, 8 aa, Influenza virus
VVYAELLV

SEQ ID NO: 422289 - protein, 8 aa, Influenza virus
RTLDFHDF

SEQ ID NO: 422290 - protein, 8 aa, Influenza virus
TANSIIVF

SEQ ID NO: 422291 - protein, 8 aa, Influenza virus
VLVNTYQW

SEQ ID NO: 422292 - protein, 8 aa, Influenza virus
EIITIGSI

SEQ ID NO: 422293 - protein, 8 aa, Influenza virus
SRYSGFVR

SEQ ID NO: 422294 - protein, 8 aa, Influenza virus
IENGWQGL

SEQ ID NO: 422295 - protein, 8 aa, Influenza virus
SERVDTLL

SEQ ID NO: 422296 - protein, 8 aa, Influenza virus
RLNINPVK

SEQ ID NO: 422297 - protein, 8 aa, Influenza virus
YQNNFVPV

SEQ ID NO: 422298 - protein, 8 aa, Influenza virus
DSIRNGTY

SEQ ID NO: 422299 - protein, 8 aa, Influenza virus
RLIEKTNK

SEQ ID NO: 422300 - protein, 8 aa, Influenza virus
KRLGNLNK

SEQ ID NO: 422301 - protein, 8 aa, Influenza virus
FHLGTRQV

SEQ ID NO: 422302 - protein, 8 aa, Influenza virus
AYTKIMYF

SEQ ID NO: 422303 - protein, 8 aa, Influenza virus
LLAPRYGY

SEQ ID NO: 422304 - protein, 8 aa, Influenza virus
RSGYSGSF

SEQ ID NO: 422305 - protein, 8 aa, Influenza virus
LTVPEWSY

SEQ ID NO: 422306 - protein, 8 aa, Influenza virus
CYQRSKFL

SEQ ID NO: 422307 - protein, 8 aa, Influenza virus
ESIRDNTY

SEQ ID NO: 422308 - protein, 8 aa, Influenza virus
MQFSSLTV

SEQ ID NO: 422309 - protein, 8 aa, Influenza virus
FVYFVEAL

SEQ ID NO: 422310 - protein, 8 aa, Influenza virus
KRMENGFL

SEQ ID NO: 422311 - protein, 8 aa, Influenza virus
RIRDNMTK

SEQ ID NO: 422312 - protein, 8 aa, Influenza virus
NFMPYISF

SEQ ID NO: 422313 - protein, 8 aa, Influenza virus
RRLSANAV

SEQ ID NO: 422314 - protein, 8 aa, Influenza virus
KMNTQFEA

SEQ ID NO: 422315 - protein, 8 aa, Influenza virus
ISNQGSFY

SEQ ID NO: 422316 - protein, 8 aa, Influenza virus
KVNSVVEK

SEQ ID NO: 422317 - protein, 8 aa, Influenza virus
CHDGTNWL

SEQ ID NO: 422318 - protein, 8 aa, Influenza virus
FVIREPFI

SEQ ID NO: 422319 - protein, 8 aa, Influenza virus
MISKSRTK

SEQ ID NO: 422320 - protein, 8 aa, Influenza virus
AMEHTSQY

SEQ ID NO: 422321 - protein, 8 aa, Influenza virus
IENGWEGL

SEQ ID NO: 422322 - protein, 8 aa, Influenza virus
VMVGLILA

SEQ ID NO: 422323 - protein, 8 aa, Influenza virus
YEELREHL

SEQ ID NO: 422324 - protein, 8 aa, Influenza virus
ILTIYSTV

SEQ ID NO: 422325 - protein, 8 aa, Influenza virus
DVNPTLLF

SEQ ID NO: 422326 - protein, 8 aa, Influenza virus
GIFSVEHK

SEQ ID NO: 422327 - protein, 8 aa, Influenza virus
WMKIYWHL

SEQ ID NO: 422328 - protein, 8 aa, Influenza virus
TSSSSTVF

SEQ ID NO: 422329 - protein, 8 aa, Influenza virus
NPRPNDPV

SEQ ID NO: 422330 - protein, 8 aa, Influenza virus
FIAEQFTW

SEQ ID NO: 422331 - protein, 8 aa, Influenza virus
KLTVTHSV

SEQ ID NO: 422332 - protein, 8 aa, Influenza virus
SEGAYKIL

SEQ ID NO: 422333 - protein, 8 aa, Influenza virus
VLSIIALL

SEQ ID NO: 422334 - protein, 8 aa, Influenza virus
FESTGNFI

SEQ ID NO: 422335 - protein, 8 aa, Influenza virus
AYTKILYF

SEQ ID NO: 422336 - protein, 8 aa, Influenza virus
ILANNGRF

SEQ ID NO: 422337 - protein, 8 aa, Influenza virus
VSFSISCF

SEQ ID NO: 422338 - protein, 8 aa, Influenza virus
ALNEITTK

SEQ ID NO: 422339 - protein, 8 aa, Influenza virus
FVYFVETL

SEQ ID NO: 422340 - protein, 8 aa, Influenza virus
SGSFVDYW

SEQ ID NO: 422341 - protein, 8 aa, Influenza virus
RGFAPFSK

SEQ ID NO: 422342 - protein, 8 aa, Influenza virus
CHSGICPV

SEQ ID NO: 422343 - protein, 8 aa, Influenza virus
WMGRTISM

SEQ ID NO: 422344 - protein, 8 aa, Influenza virus
FPIGTAPI

SEQ ID NO: 422345 - protein, 8 aa, Influenza virus
KYIKSGQL

SEQ ID NO: 422346 - protein, 8 aa, Influenza virus
FQIQGVKL

SEQ ID NO: 422347 - protein, 8 aa, Influenza virus
SSKYQQAF

SEQ ID NO: 422348 - protein, 8 aa, Influenza virus
KVNSVIEK

SEQ ID NO: 422349 - protein, 8 aa, Influenza virus
SSLPLCPF

SEQ ID NO: 422350 - protein, 8 aa, Influenza virus
FEATGNLI

SEQ ID NO: 422351 - protein, 8 aa, Influenza virus
SADHRIYW

SEQ ID NO: 422352 - protein, 8 aa, Influenza virus
CHDGASWL

SEQ ID NO: 422353 - protein, 8 aa, Influenza virus
GLFENSCL

SEQ ID NO: 422354 - protein, 8 aa, Influenza virus
GIFSVENK

SEQ ID NO: 422355 - protein, 8 aa, Influenza virus
KGFAPFSK

SEQ ID NO: 422356 - protein, 8 aa, Influenza virus
RALVSWEM

SEQ ID NO: 422357 - protein, 8 aa, Influenza virus
LLKERGFF

SEQ ID NO: 422358 - protein, 8 aa, Influenza virus
YEELREQL

SEQ ID NO: 422359 - protein, 8 aa, Influenza virus
WRSGFEII

SEQ ID NO: 422360 - protein, 8 aa, Influenza virus
SMSDIEAM

SEQ ID NO: 422361 - protein, 8 aa, Influenza virus
SGAFVDYW

SEQ ID NO: 422362 - protein, 8 aa, Influenza virus
VILLNPFV

SEQ ID NO: 422363 - protein, 8 aa, Influenza virus
KITGFAPF

SEQ ID NO: 422364 - protein, 8 aa, Influenza virus
NPRVFLAM

SEQ ID NO: 422365 - protein, 8 aa, Influenza virus
KYIPSGSL

SEQ ID NO: 422366 - protein, 8 aa, Influenza virus
KMKAIIVV

SEQ ID NO: 422367 - protein, 8 aa, Influenza virus
QIAGFAPF

SEQ ID NO: 422368 - protein, 8 aa, Influenza virus
ALLLAFML

SEQ ID NO: 422369 - protein, 8 aa, Influenza virus
TQYRAESL

SEQ ID NO: 422370 - protein, 8 aa, Influenza virus
RINMLADW

SEQ ID NO: 422371 - protein, 8 aa, Influenza virus
TTHSWTPK

SEQ ID NO: 422372 - protein, 8 aa, Influenza virus
ILFVKEGK

SEQ ID NO: 422373 - protein, 8 aa, Influenza virus
GESHGRTI

SEQ ID NO: 422374 - protein, 8 aa, Influenza virus
TPLGSPPM

SEQ ID NO: 422375 - protein, 8 aa, Influenza virus
RRIDFNWL

SEQ ID NO: 422376 - protein, 8 aa, Influenza virus
ALAQGVLL

SEQ ID NO: 422377 - protein, 8 aa, Influenza virus
ILGFVFTL

SEQ ID NO: 422378 - protein, 8 aa, Influenza virus
LSIAPIMF

SEQ ID NO: 422379 - protein, 8 aa, Influenza virus
SVRNGTYK

SEQ ID NO: 422380 - protein, 8 aa, Influenza virus
FIAPEYAY

SEQ ID NO: 422381 - protein, 8 aa, Influenza virus
SVFNCLYA

SEQ ID NO: 422382 - protein, 8 aa, Influenza virus
CINRCFYV

SEQ ID NO: 422383 - protein, 8 aa, Influenza virus
TLVSTSSW

SEQ ID NO: 422384 - protein, 8 aa, Influenza virus
IMKIRPIL

SEQ ID NO: 422385 - protein, 8 aa, Influenza virus
YESTQAAI

SEQ ID NO: 422386 - protein, 8 aa, Influenza virus
IESEFSEI

SEQ ID NO: 422387 - protein, 8 aa, Influenza virus
TSLTSLPF

SEQ ID NO: 422388 - protein, 8 aa, Influenza virus
LLLVVQAL

SEQ ID NO: 422389 - protein, 8 aa, Influenza virus
RPVIKIDM

SEQ ID NO: 422390 - protein, 8 aa, Influenza virus
KTFQNIDK

SEQ ID NO: 422391 - protein, 8 aa, Influenza virus
KLYRKLKR

SEQ ID NO: 422392 - protein, 8 aa, Influenza virus
SINECRTF

SEQ ID NO: 422393 - protein, 8 aa, Influenza virus
GESHCRII

SEQ ID NO: 422394 - protein, 8 aa, Influenza virus
TKRIRLAI

SEQ ID NO: 422395 - protein, 8 aa, Influenza virus
ASSGSLEF

SEQ ID NO: 422396 - protein, 8 aa, Influenza virus
LIHQSETY

SEQ ID NO: 422397 - protein, 8 aa, Influenza virus
NTYNHTEY

SEQ ID NO: 422398 - protein, 8 aa, Influenza virus
YNKVRMQL

SEQ ID NO: 422399 - protein, 8 aa, Influenza virus
AMASQGTK

SEQ ID NO: 422400 - protein, 8 aa, Influenza virus
SQRGRIDY

SEQ ID NO: 422401 - protein, 8 aa, Influenza virus
ILSVVSLL

SEQ ID NO: 422402 - protein, 8 aa, Influenza virus
MMIWHSNL

SEQ ID NO: 422403 - protein, 8 aa, Influenza virus
MSGYSGIF

SEQ ID NO: 422404 - protein, 8 aa, Influenza virus
EVKRRLSA

SEQ ID NO: 422405 - protein, 8 aa, Influenza virus
LIAPRGHY

SEQ ID NO: 422406 - protein, 8 aa, Influenza virus
FEFIAEEF

SEQ ID NO: 422407 - protein, 8 aa, Influenza virus
GESHGRII

SEQ ID NO: 422408 - protein, 8 aa, Influenza virus
RLSINPVK

SEQ ID NO: 422409 - protein, 8 aa, Influenza virus
SVKNGTYK

SEQ ID NO: 422410 - protein, 8 aa, Influenza virus
ASNSIVTF

SEQ ID NO: 422411 - protein, 8 aa, Influenza virus
LLQSLQQI

SEQ ID NO: 422412 - protein, 8 aa, Influenza virus
STGGQAFY

SEQ ID NO: 422413 - protein, 8 aa, Influenza virus
GQGDIVLV

SEQ ID NO: 422414 - protein, 8 aa, Influenza virus
LRDNAMIL

SEQ ID NO: 422415 - protein, 8 aa, Influenza virus
VLGLSMVK

SEQ ID NO: 422416 - protein, 8 aa, Influenza virus
RSGFEVLF

SEQ ID NO: 422417 - protein, 8 aa, Influenza virus
AQRLEDVF

SEQ ID NO: 422418 - protein, 8 aa, Influenza virus
TKRIRMAI

SEQ ID NO: 422419 - protein, 8 aa, Influenza virus
ISLGDCSF

SEQ ID NO: 422420 - protein, 8 aa, Influenza virus
LSSPPTVY

SEQ ID NO: 422421 - protein, 8 aa, Influenza virus
RMNYYWTL

SEQ ID NO: 422422 - protein, 8 aa, Influenza virus
KYVNIKSL

SEQ ID NO: 422423 - protein, 8 aa, Influenza virus
KYVNVRSL

SEQ ID NO: 422424 - protein, 8 aa, Influenza virus
IMRTVIAL

SEQ ID NO: 422425 - protein, 8 aa, Influenza virus
YQILAIYA

SEQ ID NO: 422426 - protein, 8 aa, Influenza virus
TKRLRMAI

SEQ ID NO: 422427 - protein, 8 aa, Influenza virus
SPSECRTF

SEQ ID NO: 422428 - protein, 8 aa, Influenza virus
DIILWISF

SEQ ID NO: 422429 - protein, 8 aa, Influenza virus
CHDGNAWL

SEQ ID NO: 422430 - protein, 8 aa, Influenza virus
VSFHLGTK

SEQ ID NO: 422431 - protein, 8 aa, Influenza virus
KTNTQFEL

SEQ ID NO: 422432 - protein, 8 aa, Influenza virus
LRMARGLR

SEQ ID NO: 422433 - protein, 8 aa, Influenza virus
YQARFEAV

SEQ ID NO: 422434 - protein, 8 aa, Influenza virus
FYRSINWL

SEQ ID NO: 422435 - protein, 8 aa, Influenza virus
LLKERGFF

SEQ ID NO: 422436 - protein, 8 aa, Influenza virus
LRMATGLR

SEQ ID NO: 422437 - protein, 8 aa, Influenza virus
KVNSIIEK

SEQ ID NO: 422438 - protein, 8 aa, Influenza virus
LLLATGMK

SEQ ID NO: 422439 - protein, 8 aa, Influenza virus
ILFIKEGK

SEQ ID NO: 422440 - protein, 8 aa, Influenza virus
NTDLEVLM

SEQ ID NO: 422441 - protein, 8 aa, Influenza virus
RVARCNTK

SEQ ID NO: 422442 - protein, 8 aa, Influenza virus
LSSPPTVY

SEQ ID NO: 422443 - protein, 8 aa, Influenza virus
RTREILTK

SEQ ID NO: 422444 - protein, 8 aa, Influenza virus
SSKYQQSF

SEQ ID NO: 422445 - protein, 8 aa, Influenza virus
RTFQNIDK

SEQ ID NO: 422446 - protein, 8 aa, Influenza virus
KIITIGAV

SEQ ID NO: 422447 - protein, 8 aa, Influenza virus
LILGDCSV

SEQ ID NO: 422448 - protein, 8 aa, Influenza virus
KIITIGSM

SEQ ID NO: 422449 - protein, 8 aa, Influenza virus
ESEMNKLY

SEQ ID NO: 422450 - protein, 8 aa, Influenza virus
FTLSGVAI

SEQ ID NO: 422451 - protein, 8 aa, Influenza virus
TQDAMTEV

SEQ ID NO: 422452 - protein, 8 aa, Influenza virus
TQFTVVGK

SEQ ID NO: 422453 - protein, 8 aa, Influenza virus
LTHQSGTY

SEQ ID NO: 422454 - protein, 8 aa, Influenza virus
RMTFYWTM

SEQ ID NO: 422455 - protein, 8 aa, Influenza virus
KLILATGL

SEQ ID NO: 422456 - protein, 8 aa, Influenza virus
KLNRSEIK

SEQ ID NO: 422457 - protein, 8 aa, Influenza virus
FIAPEYAY

SEQ ID NO: 422458 - protein, 8 aa, Influenza virus
YQNSFVPV

SEQ ID NO: 422459 - protein, 8 aa, Influenza virus
NLYDRVRK

SEQ ID NO: 422460 - protein, 8 aa, Influenza virus
VIASTTAK

SEQ ID NO: 422461 - protein, 8 aa, Influenza virus
SPKLRSGF

SEQ ID NO: 422462 - protein, 8 aa, Influenza virus
FIAPEYAF

SEQ ID NO: 422463 - protein, 8 aa, Influenza virus
AIMMAGIF

SEQ ID NO: 422464 - protein, 8 aa, Influenza virus
RTLMSCPM

SEQ ID NO: 422465 - protein, 8 aa, Influenza virus
ILVTREPY

SEQ ID NO: 422466 - protein, 8 aa, Influenza virus
ALSNRFQI

SEQ ID NO: 422467 - protein, 8 aa, Influenza virus
TQYRTESL

SEQ ID NO: 422468 - protein, 8 aa, Influenza virus
FQIQGIKL

SEQ ID NO: 422469 - protein, 8 aa, Influenza virus
LLLIAQAL

SEQ ID NO: 422470 - protein, 8 aa, Influenza virus
QVIKLLPF

SEQ ID NO: 422471 - protein, 8 aa, Influenza virus
KLNRTEIK

SEQ ID NO: 422472 - protein, 8 aa, Influenza virus
CHDGTSWL

SEQ ID NO: 422473 - protein, 8 aa, Influenza virus
RIDYFWSI

SEQ ID NO: 422474 - protein, 8 aa, Influenza virus
RGFFPFHK

SEQ ID NO: 422475 - protein, 8 aa, Influenza virus
TTHSWIPK

SEQ ID NO: 422476 - protein, 8 aa, Influenza virus
GVKGFAFK

SEQ ID NO: 422477 - protein, 8 aa, Influenza virus
RINMISDK

SEQ ID NO: 422478 - protein, 8 aa, Influenza virus
FEATGNLL

SEQ ID NO: 422479 - protein, 8 aa, Influenza virus
WMGRTISK

SEQ ID NO: 422480 - protein, 8 aa, Influenza virus
GENSGVLV

SEQ ID NO: 422481 - protein, 8 aa, Influenza virus
QEIRTFSF

SEQ ID NO: 422482 - protein, 8 aa, Influenza virus
WSGYSGSF

SEQ ID NO: 422483 - protein, 8 aa, Influenza virus
IISPDLSY

SEQ ID NO: 422484 - protein, 8 aa, Influenza virus
KGFFPFHK

SEQ ID NO: 422485 - protein, 8 aa, Influenza virus
VPVGSGSF

SEQ ID NO: 422486 - protein, 8 aa, Influenza virus
QTYRNNRK

SEQ ID NO: 422487 - protein, 8 aa, Influenza virus
TQYREEAL

SEQ ID NO: 422488 - protein, 8 aa, Influenza virus
GQSGRINF

SEQ ID NO: 422489 - protein, 8 aa, Influenza virus
SLVGVDPF

SEQ ID NO: 422490 - protein, 8 aa, Influenza virus
KVNSIIGK

SEQ ID NO: 422491 - protein, 8 aa, Influenza virus
RALMSVPM

SEQ ID NO: 422492 - protein, 8 aa, Influenza virus
KMNTQFTA

SEQ ID NO: 422493 - protein, 8 aa, Influenza virus
CFLLVALF

SEQ ID NO: 422494 - protein, 8 aa, Influenza virus
GSHGVKGW

SEQ ID NO: 422495 - protein, 8 aa, Influenza virus
RSRNGFEM

SEQ ID NO: 422496 - protein, 8 aa, Influenza virus
NLYGFIVK

SEQ ID NO: 422497 - protein, 8 aa, Influenza virus
APPKQSRM

SEQ ID NO: 422498 - protein, 8 aa, Influenza virus
YLEENPSA

SEQ ID NO: 422499 - protein, 8 aa, Influenza virus
FQIQGIKL

SEQ ID NO: 422500 - protein, 8 aa, Influenza virus
IEERINHL

SEQ ID NO: 422501 - protein, 8 aa, Influenza virus
AINGVTNK

SEQ ID NO: 422502 - protein, 8 aa, Influenza virus
TIHDRTTF

SEQ ID NO: 422503 - protein, 8 aa, Influenza virus
KRIENLNK

SEQ ID NO: 422504 - protein, 8 aa, Influenza virus
FQIQGVRL

SEQ ID NO: 422505 - protein, 8 aa, Influenza virus
MQALQLLL

SEQ ID NO: 422506 - protein, 8 aa, Influenza virus
SGFAIFSK

SEQ ID NO: 422507 - protein, 8 aa, Influenza virus
FAISCFLI

SEQ ID NO: 422508 - protein, 8 aa, Influenza virus
VTLTMGYK

SEQ ID NO: 422509 - protein, 8 aa, Influenza virus
CTIPCFWV

SEQ ID NO: 422510 - protein, 8 aa, Influenza virus
KTWAGNIL

SEQ ID NO: 422511 - protein, 8 aa, Influenza virus
TLHFKQHK

SEQ ID NO: 422512 - protein, 8 aa, Influenza virus
SLGASCFL

SEQ ID NO: 422513 - protein, 8 aa, Influenza virus
RSRSGFEM

SEQ ID NO: 422514 - protein, 8 aa, Influenza virus
TPYRTLLM

SEQ ID NO: 422515 - protein, 8 aa, Influenza virus
RMGKCNTK

SEQ ID NO: 422516 - protein, 8 aa, Influenza virus
SIHSRGLF

SEQ ID NO: 422517 - protein, 8 aa, Influenza virus
NMRWLTLK

SEQ ID NO: 422518 - protein, 8 aa, Influenza virus
YGIKGFSY

SEQ ID NO: 422519 - protein, 8 aa, Influenza virus
YSGAFMDY

SEQ ID NO: 422520 - protein, 8 aa, Influenza virus
YQNSFVPV

SEQ ID NO: 422521 - protein, 8 aa, Influenza virus
SRSGFEIL

SEQ ID NO: 422522 - protein, 8 aa, Influenza virus
CHDGISWL

SEQ ID NO: 422523 - protein, 8 aa, Influenza virus
IQFTAVGK

SEQ ID NO: 422524 - protein, 8 aa, Influenza virus
WFRNILSI

SEQ ID NO: 422525 - protein, 8 aa, Influenza virus
WSGYSGAF

SEQ ID NO: 422526 - protein, 8 aa, Influenza virus
KISSSFSF

SEQ ID NO: 422527 - protein, 8 aa, Influenza virus
AVIHYGGM

SEQ ID NO: 422528 - protein, 8 aa, Influenza virus
DSEMNNLY

SEQ ID NO: 422529 - protein, 8 aa, Influenza virus
RYVKQSSL

SEQ ID NO: 422530 - protein, 8 aa, Influenza virus
WEMGLAPS

SEQ ID NO: 422531 - protein, 8 aa, Influenza virus
GSQGVKGW

SEQ ID NO: 422532 - protein, 8 aa, Influenza virus
AINLYASK

SEQ ID NO: 422533 - protein, 8 aa, Influenza virus
FIAEDFQW

SEQ ID NO: 422534 - protein, 8 aa, Influenza virus
SRSGYEVL

SEQ ID NO: 422535 - protein, 8 aa, Influenza virus
LSSVSSFK

SEQ ID NO: 422536 - protein, 8 aa, Influenza virus
ASIRNNTY

SEQ ID NO: 422537 - protein, 8 aa, Influenza virus
ASSGTVEF

SEQ ID NO: 422538 - protein, 8 aa, Influenza virus
TETKAPQL

SEQ ID NO: 422539 - protein, 8 aa, Influenza virus
KRMGVQMH

SEQ ID NO: 422540 - protein, 8 aa, Influenza virus
GLQMQRFK

SEQ ID NO: 422541 - protein, 8 aa, Influenza virus
ALLIAFVL

SEQ ID NO: 422542 - protein, 8 aa, Influenza virus
NQASYRIF

SEQ ID NO: 422543 - protein, 8 aa, Influenza virus
LRLAIGLR

SEQ ID NO: 422544 - protein, 8 aa, Influenza virus
YSTVASSF

SEQ ID NO: 422545 - protein, 8 aa, Influenza virus
WIRFNSNL

SEQ ID NO: 422546 - protein, 8 aa, Influenza virus
TTHSWVPK

SEQ ID NO: 422547 - protein, 8 aa, Influenza virus
IEERINQL

SEQ ID NO: 422548 - protein, 8 aa, Influenza virus
HIQTRRSF

SEQ ID NO: 422549 - protein, 8 aa, Influenza virus
KSVFNSLY

SEQ ID NO: 422550 - protein, 8 aa, Influenza virus
RMKWMMAM

SEQ ID NO: 422551 - protein, 8 aa, Influenza virus
EEMLTGNL

SEQ ID NO: 422552 - protein, 8 aa, Influenza virus
CHNGICPV

SEQ ID NO: 422553 - protein, 8 aa, Influenza virus
KLLQNSQI

SEQ ID NO: 422554 - protein, 8 aa, Influenza virus
LVDSIGSW

SEQ ID NO: 422555 - protein, 8 aa, Influenza virus
RSIRWLTL

SEQ ID NO: 422556 - protein, 8 aa, Influenza virus
ITYSSSLM

SEQ ID NO: 422557 - protein, 8 aa, Influenza virus
IESEFNEI

SEQ ID NO: 422558 - protein, 8 aa, Influenza virus
SIASRSGY

SEQ ID NO: 422559 - protein, 8 aa, Influenza virus
GMFNMLST

SEQ ID NO: 422560 - protein, 8 aa, Influenza virus
SLPDGAQI

SEQ ID NO: 422561 - protein, 8 aa, Influenza virus
MISKCRTK

SEQ ID NO: 422562 - protein, 8 aa, Influenza virus
MARLGRGY

SEQ ID NO: 422563 - protein, 8 aa, Influenza virus
SVKLSSGY

SEQ ID NO: 422564 - protein, 8 aa, Influenza virus
NRFYRTCK

SEQ ID NO: 422565 - protein, 8 aa, Influenza virus
RPRRGLFG

SEQ ID NO: 422566 - protein, 8 aa, Influenza virus
NRIQINPV

SEQ ID NO: 422567 - protein, 8 aa, Influenza virus
RVRDNMTK

SEQ ID NO: 422568 - protein, 8 aa, Influenza virus
LMIWHSNL

SEQ ID NO: 422569 - protein, 8 aa, Influenza virus
CSNGSCRF

SEQ ID NO: 422570 - protein, 8 aa, Influenza virus
MSKKKSYI

SEQ ID NO: 422571 - protein, 8 aa, Influenza virus
LRLALGLR

SEQ ID NO: 422572 - protein, 8 aa, Influenza virus
RAFSFQLI

SEQ ID NO: 422573 - protein, 8 aa, Influenza virus
KRLENLNK

SEQ ID NO: 422574 - protein, 8 aa, Influenza virus
AIAMGLIF

SEQ ID NO: 422575 - protein, 8 aa, Influenza virus
ILAFIMWT

SEQ ID NO: 422576 - protein, 8 aa, Influenza virus
SVSSRSGF

SEQ ID NO: 422577 - protein, 8 aa, Influenza virus
GIFGPVHF

SEQ ID NO: 422578 - protein, 8 aa, Influenza virus
FAISCFLL

SEQ ID NO: 422579 - protein, 8 aa, Influenza virus
FIAPENAY

SEQ ID NO: 422580 - protein, 8 aa, Influenza virus
FNMLSTVL

SEQ ID NO: 422581 - protein, 8 aa, Influenza virus
KIAHISPL

SEQ ID NO: 422582 - protein, 8 aa, Influenza virus
ALSQGTTL

SEQ ID NO: 422583 - protein, 8 aa, Influenza virus
VPKRNRSI

SEQ ID NO: 422584 - protein, 8 aa, Influenza virus
ALLNRLNI

SEQ ID NO: 422585 - protein, 8 aa, Influenza virus
NTKGRYVL

SEQ ID NO: 422586 - protein, 8 aa, Influenza virus
KINNIIDK

SEQ ID NO: 422587 - protein, 8 aa, Influenza virus
RIDYYWSI

SEQ ID NO: 422588 - protein, 8 aa, Influenza virus
CSNNTTNY

SEQ ID NO: 422589 - protein, 8 aa, Influenza virus
ATTVTLHF

SEQ ID NO: 422590 - protein, 8 aa, Influenza virus
CHDGSSWL

SEQ ID NO: 422591 - protein, 8 aa, Influenza virus
FVALILGF

SEQ ID NO: 422592 - protein, 8 aa, Influenza virus
ALSVLNLL

SEQ ID NO: 422593 - protein, 8 aa, Influenza virus
AILPLTSI

SEQ ID NO: 422594 - protein, 8 aa, Influenza virus
AVLKYNGV

SEQ ID NO: 422595 - protein, 8 aa, Influenza virus
MLKIHNAG

SEQ ID NO: 422596 - protein, 8 aa, Influenza virus
LVAPRGHY

SEQ ID NO: 422597 - protein, 8 aa, Influenza virus
KLFERVRR

SEQ ID NO: 422598 - protein, 8 aa, Influenza virus
CHDGRAWL

SEQ ID NO: 422599 - protein, 8 aa, Influenza virus
GPSNAQAF

SEQ ID NO: 422600 - protein, 8 aa, Influenza virus
GYSGIFSI

SEQ ID NO: 422601 - protein, 8 aa, Influenza virus
MSIGVTVI

SEQ ID NO: 422602 - protein, 8 aa, Influenza virus
ALSILNLL

SEQ ID NO: 422603 - protein, 8 aa, Influenza virus
TIALIIGV

SEQ ID NO: 422604 - protein, 8 aa, Influenza virus
WMACNSAA

SEQ ID NO: 422605 - protein, 8 aa, Influenza virus
QAFYKILK

SEQ ID NO: 422606 - protein, 8 aa, Influenza virus
KYVNVKSL

SEQ ID NO: 422607 - protein, 8 aa, Influenza virus
NSDLEALM

SEQ ID NO: 422608 - protein, 8 aa, Influenza virus
AMMSRARI

SEQ ID NO: 422609 - protein, 8 aa, Influenza virus
RPRVRNQS

SEQ ID NO: 422610 - protein, 8 aa, Influenza virus
AISTTFPY

SEQ ID NO: 422611 - protein, 8 aa, Influenza virus
KLYERVRR

SEQ ID NO: 422612 - protein, 8 aa, Influenza virus
ESVLVNTY

SEQ ID NO: 422613 - protein, 8 aa, Influenza virus
GPAECRTF

SEQ ID NO: 422614 - protein, 8 aa, Influenza virus
SQYREEAL

SEQ ID NO: 422615 - protein, 8 aa, Influenza virus
AMEDFQLI

SEQ ID NO: 422616 - protein, 8 aa, Influenza virus
GQGDVVLV

SEQ ID NO: 422617 - protein, 8 aa, Influenza virus
ALFLAFIL

SEQ ID NO: 422618 - protein, 8 aa, Influenza virus
WFRNILSM

SEQ ID NO: 422619 - protein, 8 aa, Influenza virus
QIRGFVYF

SEQ ID NO: 422620 - protein, 8 aa, Influenza virus
QLIPMISK

SEQ ID NO: 422621 - protein, 8 aa, Influenza virus
LLLIVQAL

SEQ ID NO: 422622 - protein, 8 aa, Influenza virus
IPSGSLKL

SEQ ID NO: 422623 - protein, 8 aa, Influenza virus
TIHDRSPY

SEQ ID NO: 422624 - protein, 8 aa, Influenza virus
FEVMNHEF

SEQ ID NO: 422625 - protein, 8 aa, Influenza virus
SGSFIDYW

SEQ ID NO: 422626 - protein, 8 aa, Influenza virus
NLVAPWYA

SEQ ID NO: 422627 - protein, 8 aa, Influenza virus
SIASRSGY

SEQ ID NO: 422628 - protein, 8 aa, Influenza virus
MMAMRYPI

SEQ ID NO: 422629 - protein, 8 aa, Influenza virus
LIAPWYAY

SEQ ID NO: 422630 - protein, 8 aa, Influenza virus
RRLIQLIV

SEQ ID NO: 422631 - protein, 8 aa, Influenza virus
RRSGGIGK

SEQ ID NO: 422632 - protein, 8 aa, Influenza virus
YQSRFEAV

SEQ ID NO: 422633 - protein, 8 aa, Influenza virus
ETSHTGTY

SEQ ID NO: 422634 - protein, 8 aa, Influenza virus
KEIGNGCF

SEQ ID NO: 422635 - protein, 8 aa, Influenza virus
IEGGWTGL

SEQ ID NO: 422636 - protein, 8 aa, Influenza virus
GIFSVEGK

SEQ ID NO: 422637 - protein, 8 aa, Influenza virus
RTSISCLY

SEQ ID NO: 422638 - protein, 8 aa, Influenza virus
SILNLGQK

SEQ ID NO: 422639 - protein, 8 aa, Influenza virus
DIILWFSF

SEQ ID NO: 422640 - protein, 8 aa, Influenza virus
FSFGASCF

SEQ ID NO: 422641 - protein, 8 aa, Influenza virus
SVQRNLPF

SEQ ID NO: 422642 - protein, 8 aa, Influenza virus
ALSVVSLL

SEQ ID NO: 422643 - protein, 8 aa, Influenza virus
FQNVSPIW

SEQ ID NO: 422644 - protein, 8 aa, Influenza virus
VTNGTMVK

SEQ ID NO: 422645 - protein, 8 aa, Influenza virus
GPRNVPQI

SEQ ID NO: 422646 - protein, 8 aa, Influenza virus
LIDSISSW

SEQ ID NO: 422647 - protein, 8 aa, Influenza virus
KLYKKLKR

SEQ ID NO: 422648 - protein, 8 aa, Influenza virus
KIIKWEPL

SEQ ID NO: 422649 - protein, 8 aa, Influenza virus
RLGNLNKK

SEQ ID NO: 422650 - protein, 8 aa, Influenza virus
LVAPWYAY

SEQ ID NO: 422651 - protein, 8 aa, Influenza virus
GLVFFCLK

SEQ ID NO: 422652 - protein, 8 aa, Influenza virus
RRMEFSWT

SEQ ID NO: 422653 - protein, 8 aa, Influenza virus
KINSIIDK

SEQ ID NO: 422654 - protein, 8 aa, Influenza virus
YQEVGTYV

SEQ ID NO: 422655 - protein, 8 aa, Influenza virus
YEELKEQL

SEQ ID NO: 422656 - protein, 8 aa, Influenza virus
SGAFIDYW

SEQ ID NO: 422657 - protein, 8 aa, Influenza virus
KINNIVDK

SEQ ID NO: 422658 - protein, 8 aa, Influenza virus
KTNQQFEL

SEQ ID NO: 422659 - protein, 8 aa, Influenza virus
NLHAYISF

SEQ ID NO: 422660 - protein, 8 aa, Influenza virus
RMQINPVK

SEQ ID NO: 422661 - protein, 8 aa, Influenza virus
FHLGTKQV

SEQ ID NO: 422662 - protein, 8 aa, Influenza virus
IFLARSAL

SEQ ID NO: 422663 - protein, 8 aa, Influenza virus
KLSSMGIY

SEQ ID NO: 422664 - protein, 8 aa, Influenza virus
NLYGFIIK

SEQ ID NO: 422665 - protein, 8 aa, Influenza virus
ASAVIWYK

SEQ ID NO: 422666 - protein, 8 aa, Influenza virus
TVKDRSPY

SEQ ID NO: 422667 - protein, 8 aa, Influenza virus
LVRKTRFL

SEQ ID NO: 422668 - protein, 8 aa, Influenza virus
CVYRDNWK

SEQ ID NO: 422669 - protein, 8 aa, Influenza virus
WMGRTVSK

SEQ ID NO: 422670 - protein, 8 aa, Influenza virus
ILANNGKF

SEQ ID NO: 422671 - protein, 8 aa, Influenza virus
VYINTAML

SEQ ID NO: 422672 - protein, 8 aa, Influenza virus
MIWDPDGW

SEQ ID NO: 422673 - protein, 8 aa, Influenza virus
TIALFIGV

SEQ ID NO: 422674 - protein, 8 aa, Influenza virus
YQVGYLCA

SEQ ID NO: 422675 - protein, 8 aa, Influenza virus
WMKIYWYL

SEQ ID NO: 422676 - protein, 8 aa, Influenza virus
SITEVWSY

SEQ ID NO: 422677 - protein, 8 aa, Influenza virus
GRMTFYWA

SEQ ID NO: 422678 - protein, 8 aa, Influenza virus
WMKIYWYL

SEQ ID NO: 422679 - protein, 8 aa, Influenza virus
SIPEWSYI

SEQ ID NO: 422680 - protein, 8 aa, Influenza virus
RARIKTRL

SEQ ID NO: 422681 - protein, 8 aa, Influenza virus
LVAPWYAY

SEQ ID NO: 422682 - protein, 8 aa, Influenza virus
NRLNINPV

SEQ ID NO: 422683 - protein, 8 aa, Influenza virus
KSWKGNIM

SEQ ID NO: 422684 - protein, 8 aa, Influenza virus
IEGGWSGL

SEQ ID NO: 422685 - protein, 8 aa, Influenza virus
SSMGVYQI

SEQ ID NO: 422686 - protein, 8 aa, Influenza virus
FAMSCFLL

SEQ ID NO: 422687 - protein, 8 aa, Influenza virus
REQLSQKF

SEQ ID NO: 422688 - protein, 8 aa, Influenza virus
LANTIEIF

SEQ ID NO: 422689 - protein, 8 aa, Influenza virus
KILKWEPL

SEQ ID NO: 422690 - protein, 8 aa, Influenza virus
APSRVSKF

SEQ ID NO: 422691 - protein, 8 aa, Influenza virus
IEGGWPGL

SEQ ID NO: 422692 - protein, 8 aa, Influenza virus
KSFSRTQL

SEQ ID NO: 422693 - protein, 8 aa, Influenza virus
TSNRGSFY

SEQ ID NO: 422694 - protein, 8 aa, Influenza virus
KINSWHIF

SEQ ID NO: 422695 - protein, 8 aa, Influenza virus
ALFVYSLR

SEQ ID NO: 422696 - protein, 8 aa, Influenza virus
NPRVFLTM

SEQ ID NO: 422697 - protein, 8 aa, Influenza virus
VLWTSNSM

SEQ ID NO: 422698 - protein, 8 aa, Influenza virus
WMACHSAA

SEQ ID NO: 422699 - protein, 8 aa, Influenza virus
MELRRCLL

SEQ ID NO: 422700 - protein, 8 aa, Influenza virus
LANTIEVF

SEQ ID NO: 422701 - protein, 8 aa, Influenza virus
RLCTINSW

SEQ ID NO: 422702 - protein, 8 aa, Influenza virus
TRDSVTEL

SEQ ID NO: 422703 - protein, 8 aa, Influenza virus
NILSIAPI

SEQ ID NO: 422704 - protein, 8 aa, Influenza virus
ETNKFAAI

SEQ ID NO: 422705 - protein, 8 aa, Influenza virus
GLTNIPSI

SEQ ID NO: 422706 - protein, 8 aa, Influenza virus
NRCYQFAL

SEQ ID NO: 422707 - protein, 8 aa, Influenza virus
KIMESGEI

SEQ ID NO: 422708 - protein, 8 aa, Influenza virus
LRLAVGLR

SEQ ID NO: 422709 - protein, 8 aa, Influenza virus
FFRHMVWL

SEQ ID NO: 422710 - protein, 8 aa, Influenza virus
AINEITTK

SEQ ID NO: 422711 - protein, 8 aa, Influenza virus
LLGINMSK

SEQ ID NO: 422712 - protein, 8 aa, Influenza virus
WLGRTISI

SEQ ID NO: 422713 - protein, 8 aa, Influenza virus
AATVTLHF

SEQ ID NO: 422714 - protein, 8 aa, Influenza virus
KMTITFLI

SEQ ID NO: 422715 - protein, 8 aa, Influenza virus
FIMWTCQK

SEQ ID NO: 422716 - protein, 8 aa, Influenza virus
RLNPMHQL

SEQ ID NO: 422717 - protein, 8 aa, Influenza virus
NRLSINPV

SEQ ID NO: 422718 - protein, 8 aa, Influenza virus
ALSQGTTI

SEQ ID NO: 422719 - protein, 8 aa, Influenza virus
ETNKFASI

SEQ ID NO: 422720 - protein, 8 aa, Influenza virus
FMYSDFHF

SEQ ID NO: 422721 - protein, 8 aa, Influenza virus
NLYERVRK

SEQ ID NO: 422722 - protein, 8 aa, Influenza virus
RADVNDFF

SEQ ID NO: 422723 - protein, 8 aa, Influenza virus
GTFGPVHF

SEQ ID NO: 422724 - protein, 8 aa, Influenza virus
AVRGDLNF

SEQ ID NO: 422725 - protein, 8 aa, Influenza virus
VMEHTSQY

SEQ ID NO: 422726 - protein, 8 aa, Influenza virus
QEELLVAM

SEQ ID NO: 422727 - protein, 8 aa, Influenza virus
IVMCGVNY

SEQ ID NO: 422728 - protein, 8 aa, Influenza virus
GESHGKII

SEQ ID NO: 422729 - protein, 8 aa, Influenza virus
TTITLHFK

SEQ ID NO: 422730 - protein, 8 aa, Influenza virus
KYISSGSL

SEQ ID NO: 422731 - protein, 8 aa, Influenza virus
CHNGVCPV

SEQ ID NO: 422732 - protein, 8 aa, Influenza virus
SIHECRTF

SEQ ID NO: 422733 - protein, 8 aa, Influenza virus
TSLCSIWF

SEQ ID NO: 422734 - protein, 8 aa, Influenza virus
ARLGRGYM

SEQ ID NO: 422735 - protein, 8 aa, Influenza virus
LEFKADLI

SEQ ID NO: 422736 - protein, 8 aa, Influenza virus
MSIGITVI

SEQ ID NO: 422737 - protein, 8 aa, Influenza virus
YAFGNCPM

SEQ ID NO: 422738 - protein, 8 aa, Influenza virus
WMGRTINK

SEQ ID NO: 422739 - protein, 8 aa, Influenza virus
CQNGVCPV

SEQ ID NO: 422740 - protein, 8 aa, Influenza virus
GPRNVPQV

SEQ ID NO: 422741 - protein, 8 aa, Influenza virus
SSLPLCPF

SEQ ID NO: 422742 - protein, 8 aa, Influenza virus
LEFIAEEF

SEQ ID NO: 422743 - protein, 8 aa, Influenza virus
NRIMINPV

SEQ ID NO: 422744 - protein, 8 aa, Influenza virus
VEQRINML

SEQ ID NO: 422745 - protein, 8 aa, Influenza virus
CSNDTINY

SEQ ID NO: 422746 - protein, 8 aa, Influenza virus
AELAEKAM

SEQ ID NO: 422747 - protein, 8 aa, Influenza virus
GLMGRTRI

SEQ ID NO: 422748 - protein, 8 aa, Influenza virus
SLVGIDPF

SEQ ID NO: 422749 - protein, 8 aa, Influenza virus
GLIAPNRV

SEQ ID NO: 422750 - protein, 8 aa, Influenza virus
LYKNTNTL

SEQ ID NO: 422751 - protein, 8 aa, Influenza virus
SSFYAEMK

SEQ ID NO: 422752 - protein, 8 aa, Influenza virus
KRLTTTIK

SEQ ID NO: 422753 - protein, 8 aa, Influenza virus
SFFYRYGF

SEQ ID NO: 422754 - protein, 8 aa, Influenza virus
SVFNSLYA

SEQ ID NO: 422755 - protein, 8 aa, Influenza virus
FLAPRYSF

SEQ ID NO: 422756 - protein, 8 aa, Influenza virus
GRLMDFLK

SEQ ID NO: 422757 - protein, 8 aa, Influenza virus
FYRNVVWL

SEQ ID NO: 422758 - protein, 8 aa, Influenza virus
ATVTLHFK

SEQ ID NO: 422759 - protein, 8 aa, Influenza virus
GPSFYAEM

SEQ ID NO: 422760 - protein, 8 aa, Influenza virus
LVLGLSMV

SEQ ID NO: 422761 - protein, 8 aa, Influenza virus
WSGYSGVF

SEQ ID NO: 422762 - protein, 8 aa, Influenza virus
SARSALIL

SEQ ID NO: 422763 - protein, 8 aa, Influenza virus
KIITIGSV

SEQ ID NO: 422764 - protein, 8 aa, Influenza virus
WLGRTISK

SEQ ID NO: 422765 - protein, 8 aa, Influenza virus
KELGNGCF

SEQ ID NO: 422766 - protein, 8 aa, Influenza virus
ALTGGQSF

SEQ ID NO: 422767 - protein, 8 aa, Influenza virus
KLSSMGVY

SEQ ID NO: 422768 - protein, 8 aa, Influenza virus
FIAEEFQW

SEQ ID NO: 422769 - protein, 8 aa, Influenza virus
YLMLNKSL

SEQ ID NO: 422770 - protein, 8 aa, Influenza virus
APACDLHL

SEQ ID NO: 422771 - protein, 8 aa, Influenza virus
KMLLIVQA

SEQ ID NO: 422772 - protein, 8 aa, Influenza virus
GTQGVKGW

SEQ ID NO: 422773 - protein, 8 aa, Influenza virus
MIWDANGW

SEQ ID NO: 422774 - protein, 8 aa, Influenza virus
WFRNVLSI

SEQ ID NO: 422775 - protein, 8 aa, Influenza virus
SSVKNGTY

SEQ ID NO: 422776 - protein, 8 aa, Influenza virus
RPWVRGQS

SEQ ID NO: 422777 - protein, 8 aa, Influenza virus
RPAIEIDM

SEQ ID NO: 422778 - protein, 8 aa, Influenza virus
TIALLIGV

SEQ ID NO: 422779 - protein, 8 aa, Influenza virus
YSIDSGYV

SEQ ID NO: 422780 - protein, 8 aa, Influenza virus
EMSNEGSY

SEQ ID NO: 422781 - protein, 8 aa, Influenza virus
YNAELFVL

SEQ ID NO: 422782 - protein, 8 aa, Influenza virus
FEMIDNEF

SEQ ID NO: 422783 - protein, 8 aa, Influenza virus
MSLNISLY

SEQ ID NO: 422784 - protein, 8 aa, Influenza virus
NEIRTFSF

SEQ ID NO: 422785 - protein, 8 aa, Influenza virus
VVSPDLSY

SEQ ID NO: 422786 - protein, 8 aa, Influenza virus
MSNNSTEK

SEQ ID NO: 422787 - protein, 8 aa, Influenza virus
NMRCTSCI

SEQ ID NO: 422788 - protein, 8 aa, Influenza virus
NYARLYIW

SEQ ID NO: 422789 - protein, 8 aa, Influenza virus
ALLLAFVL

SEQ ID NO: 422790 - protein, 8 aa, Influenza virus
YQAKFEAV

SEQ ID NO: 422791 - protein, 8 aa, Influenza virus
RESTQKAI

SEQ ID NO: 422792 - protein, 8 aa, Influenza virus
GEKANVLI

SEQ ID NO: 422793 - protein, 8 aa, Influenza virus
ILNLGQRK

SEQ ID NO: 422794 - protein, 8 aa, Influenza virus
ILAIYSTA

SEQ ID NO: 422795 - protein, 8 aa, Influenza virus
IYSSSMMW

SEQ ID NO: 422796 - protein, 8 aa, Influenza virus
LQDTTWDV

SEQ ID NO: 422797 - protein, 8 aa, Influenza virus
YGIKGFSF

SEQ ID NO: 422798 - protein, 8 aa, Influenza virus
IIFVKEGK

SEQ ID NO: 422799 - protein, 8 aa, Influenza virus
WMGTTISK

SEQ ID NO: 422800 - protein, 8 aa, Influenza virus
GTFEFTSF

SEQ ID NO: 422801 - protein, 8 aa, Influenza virus
SFYRNLLW

SEQ ID NO: 422802 - protein, 8 aa, Influenza virus
FQNVSPVW

SEQ ID NO: 422803 - protein, 8 aa, Influenza virus
LYKNANTL

SEQ ID NO: 422804 - protein, 8 aa, Influenza virus
TSNSMVTF

SEQ ID NO: 422805 - protein, 8 aa, Influenza virus
KLSNMGIY

SEQ ID NO: 422806 - protein, 8 aa, Influenza virus
MARSALIL

SEQ ID NO: 422807 - protein, 8 aa, Influenza virus
RSGYSGVF

SEQ ID NO: 422808 - protein, 8 aa, Influenza virus
GVNDRNFW

SEQ ID NO: 422809 - protein, 8 aa, Influenza virus
FHLATKQV

SEQ ID NO: 422810 - protein, 8 aa, Influenza virus
IPSWAGNI

SEQ ID NO: 422811 - protein, 8 aa, Influenza virus
LIAPRGYY

SEQ ID NO: 422812 - protein, 8 aa, Influenza virus
ITVWSSKY

SEQ ID NO: 422813 - protein, 8 aa, Influenza virus
FYRSLLWI

SEQ ID NO: 422814 - protein, 8 aa, Influenza virus
RRKRRGLF

SEQ ID NO: 422815 - protein, 8 aa, Influenza virus
GMRNVPEK

SEQ ID NO: 422816 - protein, 8 aa, Influenza virus
SGSFMDYW

SEQ ID NO: 422817 - protein, 8 aa, Influenza virus
LSSRISFY

SEQ ID NO: 422818 - protein, 8 aa, Influenza virus
YQRTRALV

SEQ ID NO: 422819 - protein, 8 aa, Influenza virus
IMRTVIAL

SEQ ID NO: 422820 - protein, 8 aa, Influenza virus
QGWMDYYW

SEQ ID NO: 422821 - protein, 8 aa, Influenza virus
YSIDSSYI

SEQ ID NO: 422822 - protein, 8 aa, Influenza virus
SSKYRQSF

SEQ ID NO: 422823 - protein, 8 aa, Influenza virus
KMNIQILI

SEQ ID NO: 422824 - protein, 8 aa, Influenza virus
RMEFFWTL

SEQ ID NO: 422825 - protein, 8 aa, Influenza virus
KYGNGAWI

SEQ ID NO: 422826 - protein, 8 aa, Influenza virus
QELGDAPF

SEQ ID NO: 422827 - protein, 8 aa, Influenza virus
TVKDRSPF

SEQ ID NO: 422828 - protein, 8 aa, Influenza virus
VYVNTALL

SEQ ID NO: 422829 - protein, 8 aa, Influenza virus
NLLENLQA

SEQ ID NO: 422830 - protein, 8 aa, Influenza virus
ISNQGSFY

SEQ ID NO: 422831 - protein, 8 aa, Influenza virus
FFKRLNWL

SEQ ID NO: 422832 - protein, 8 aa, Influenza virus
RINYYWTL

SEQ ID NO: 422833 - protein, 8 aa, Influenza virus
KLEENTSY

SEQ ID NO: 422834 - protein, 8 aa, Influenza virus
MRINNETI

SEQ ID NO: 422835 - protein, 8 aa, Influenza virus
VYVEVLHL

SEQ ID NO: 422836 - protein, 8 aa, Influenza virus
FSNAASYK

SEQ ID NO: 422837 - protein, 8 aa, Influenza virus
KYGNGVWI

SEQ ID NO: 422838 - protein, 8 aa, Influenza virus
RYGNGVWI

SEQ ID NO: 422839 - protein, 8 aa, Influenza virus
SSKANQVF

SEQ ID NO: 422840 - protein, 8 aa, Influenza virus
VMGARPQV

SEQ ID NO: 422841 - protein, 8 aa, Influenza virus
YMFESKRM

SEQ ID NO: 422842 - protein, 8 aa, Influenza virus
FKSTQAAI

SEQ ID NO: 422843 - protein, 8 aa, Influenza virus
SRSGFEML

SEQ ID NO: 422844 - protein, 8 aa, Influenza virus
NHAVHYCI

SEQ ID NO: 422845 - protein, 8 aa, Influenza virus
KIIHISPL

SEQ ID NO: 422846 - protein, 8 aa, Influenza virus
NQEELRSL

SEQ ID NO: 422847 - protein, 8 aa, Influenza virus
AIGKITNK

SEQ ID NO: 422848 - protein, 8 aa, Influenza virus
RPKVNGQA

SEQ ID NO: 422849 - protein, 8 aa, Influenza virus
RLFERVRR

SEQ ID NO: 422850 - protein, 8 aa, Influenza virus
RINMINDK

SEQ ID NO: 422851 - protein, 8 aa, Influenza virus
SRSGYEIL

SEQ ID NO: 422852 - protein, 8 aa, Influenza virus
ALNNRFQI

SEQ ID NO: 422853 - protein, 8 aa, Influenza virus
YSGSFIDY

SEQ ID NO: 422854 - protein, 8 aa, Influenza virus
IMMAGLSF

SEQ ID NO: 422855 - protein, 8 aa, Influenza virus
TPKRNRSI

SEQ ID NO: 422856 - protein, 8 aa, Influenza virus
NRIKINPV

SEQ ID NO: 422857 - protein, 8 aa, Influenza virus
KLSSMGIY

SEQ ID NO: 422858 - protein, 8 aa, Influenza virus
SHYVCSGL

SEQ ID NO: 422859 - protein, 8 aa, Influenza virus
SRAGYEML

SEQ ID NO: 422860 - protein, 8 aa, Influenza virus
GLIAPSRV

SEQ ID NO: 422861 - protein, 8 aa, Influenza virus
SKMQFSSL

SEQ ID NO: 422862 - protein, 8 aa, Influenza virus
MEFSWTIL

SEQ ID NO: 422863 - protein, 8 aa, Influenza virus
KRMQDGFL

SEQ ID NO: 422864 - protein, 8 aa, Influenza virus
KRFADQEL

SEQ ID NO: 422865 - protein, 8 aa, Influenza virus
SMDSRSGY

SEQ ID NO: 422866 - protein, 8 aa, Influenza virus
RVRDNITK

SEQ ID NO: 422867 - protein, 8 aa, Influenza virus
ATNLYVNK

SEQ ID NO: 422868 - protein, 8 aa, Influenza virus
TIISNLPF

SEQ ID NO: 422869 - protein, 8 aa, Influenza virus
LAASIMGF

SEQ ID NO: 422870 - protein, 8 aa, Influenza virus
VISPDLSY

SEQ ID NO: 422871 - protein, 8 aa, Influenza virus
CHNGTCAV

SEQ ID NO: 422872 - protein, 8 aa, Influenza virus
NTYNHTQY

SEQ ID NO: 422873 - protein, 8 aa, Influenza virus
KINMINDK

SEQ ID NO: 422874 - protein, 8 aa, Influenza virus
RTHQYSEK

SEQ ID NO: 422875 - protein, 8 aa, Influenza virus
ITVGSSNY

SEQ ID NO: 422876 - protein, 8 aa, Influenza virus
KRIRLFDY

SEQ ID NO: 422877 - protein, 8 aa, Influenza virus
GYSGAFTI

SEQ ID NO: 422878 - protein, 8 aa, Influenza virus
FESDGAFL

SEQ ID NO: 422879 - protein, 8 aa, Influenza virus
SSFQVDCF

SEQ ID NO: 422880 - protein, 8 aa, Influenza virus
SVFNNLYA

SEQ ID NO: 422881 - protein, 8 aa, Influenza virus
GIITDTFK

SEQ ID NO: 422882 - protein, 8 aa, Influenza virus
APDRASFL

SEQ ID NO: 422883 - protein, 8 aa, Influenza virus
SGAFMDYW

SEQ ID NO: 422884 - protein, 8 aa, Influenza virus
ISMEDYSI

SEQ ID NO: 422885 - protein, 8 aa, Influenza virus
FQIQGVRL

SEQ ID NO: 422886 - protein, 8 aa, Influenza virus
LVRKTRFL

SEQ ID NO: 422887 - protein, 8 aa, Influenza virus
LVLATGLK

SEQ ID NO: 422888 - protein, 8 aa, Influenza virus
LAASIMGF

SEQ ID NO: 422889 - protein, 8 aa, Influenza virus
GMRNIPEK

SEQ ID NO: 422890 - protein, 8 aa, Influenza virus
SLCLAILV

SEQ ID NO: 422891 - protein, 8 aa, Influenza virus
KYIKQGSL

SEQ ID NO: 422892 - protein, 8 aa, Influenza virus
IIKGRSHL

SEQ ID NO: 422893 - protein, 8 aa, Influenza virus
KIHTRGLF

SEQ ID NO: 422894 - protein, 8 aa, Influenza virus
ELRFVFSI

SEQ ID NO: 422895 - protein, 8 aa, Influenza virus
STASRSGY

SEQ ID NO: 422896 - protein, 8 aa, Influenza virus
FLAPRYAF

SEQ ID NO: 422897 - protein, 8 aa, Influenza virus
GMRNIPGK

SEQ ID NO: 422898 - protein, 8 aa, Influenza virus
FSRLNWLY

SEQ ID NO: 422899 - protein, 8 aa, Influenza virus
MQIRGFVH

SEQ ID NO: 422900 - protein, 8 aa, Influenza virus
SPRLRSGF

SEQ ID NO: 422901 - protein, 8 aa, Influenza virus
SGFAVVSK

SEQ ID NO: 422902 - protein, 8 aa, Influenza virus
TLVTTSSW

SEQ ID NO: 422903 - protein, 8 aa, Influenza virus
SISNDKPF

SEQ ID NO: 422904 - protein, 8 aa, Influenza virus
RRIWRQAN

SEQ ID NO: 422905 - protein, 8 aa, Influenza virus
LLFLKIPA

SEQ ID NO: 422906 - protein, 8 aa, Influenza virus
ARSALILR

SEQ ID NO: 422907 - protein, 8 aa, Influenza virus
FQRSKFLL

SEQ ID NO: 422908 - protein, 8 aa, Influenza virus
MIWDPNGW

SEQ ID NO: 422909 - protein, 8 aa, Influenza virus
LTLKSGQF

SEQ ID NO: 422910 - protein, 8 aa, Influenza virus
FSFNGEEM

SEQ ID NO: 422911 - protein, 8 aa, Influenza virus
RISSSFSF

SEQ ID NO: 422912 - protein, 8 aa, Influenza virus
TQIIVILV

SEQ ID NO: 422913 - protein, 8 aa, Influenza virus
SGFAIISK

SEQ ID NO: 422914 - protein, 8 aa, Influenza virus
RSLIQFPI

SEQ ID NO: 422915 - protein, 8 aa, Influenza virus
GYKDWFLW

SEQ ID NO: 422916 - protein, 8 aa, Influenza virus
TILETRYV

SEQ ID NO: 422917 - protein, 8 aa, Influenza virus
KWWVWLWL

SEQ ID NO: 422918 - protein, 8 aa, Influenza virus
SVKLFSGY

SEQ ID NO: 422919 - protein, 8 aa, Influenza virus
FYRNLLWI

SEQ ID NO: 422920 - protein, 8 aa, Influenza virus
YVKQGSLM

SEQ ID NO: 422921 - protein, 8 aa, Influenza virus
DIILWVSF

SEQ ID NO: 422922 - protein, 8 aa, Influenza virus
ILAIYSAA

SEQ ID NO: 422923 - protein, 8 aa, Influenza virus
SSKCQQSF

SEQ ID NO: 422924 - protein, 8 aa, Influenza virus
SYNAELLI

SEQ ID NO: 422925 - protein, 8 aa, Influenza virus
RRLVQLIV

SEQ ID NO: 422926 - protein, 8 aa, Influenza virus
IMKTGGTL

SEQ ID NO: 422927 - protein, 8 aa, Influenza virus
IIIAIGSV

SEQ ID NO: 422928 - protein, 8 aa, Influenza virus
VLVTREPY

SEQ ID NO: 422929 - protein, 8 aa, Influenza virus
QTIINNYY

SEQ ID NO: 422930 - protein, 8 aa, Influenza virus
TGFASFSK

SEQ ID NO: 422931 - protein, 8 aa, Influenza virus
ISVGSGSF

SEQ ID NO: 422932 - protein, 8 aa, Influenza virus
FYRNLLWL

SEQ ID NO: 422933 - protein, 8 aa, Influenza virus
VQNNYTTI

SEQ ID NO: 422934 - protein, 8 aa, Influenza virus
VLEAMAFL

SEQ ID NO: 422935 - protein, 8 aa, Influenza virus
WFRNVLSV

SEQ ID NO: 422936 - protein, 8 aa, Influenza virus
SLQCTICI

SEQ ID NO: 422937 - protein, 8 aa, Influenza virus
GQAGRIDF

SEQ ID NO: 422938 - protein, 8 aa, Influenza virus
DVCYPGGF

SEQ ID NO: 422939 - protein, 8 aa, Influenza virus
FLTHALRF

SEQ ID NO: 422940 - protein, 8 aa, Influenza virus
RPWMRISN

SEQ ID NO: 422941 - protein, 8 aa, Influenza virus
KILCTSAI

SEQ ID NO: 422942 - protein, 8 aa, Influenza virus
GRLIDFLK

SEQ ID NO: 422943 - protein, 8 aa, Influenza virus
FESNGAFL

SEQ ID NO: 422944 - protein, 8 aa, Influenza virus
GMKNVPEK

SEQ ID NO: 422945 - protein, 8 aa, Influenza virus
ATIRNGTY

SEQ ID NO: 422946 - protein, 8 aa, Influenza virus
LHIPEVCL

SEQ ID NO: 422947 - protein, 8 aa, Influenza virus
NEHSNGTI

SEQ ID NO: 422948 - protein, 8 aa, Influenza virus
SRNGFEML

SEQ ID NO: 422949 - protein, 8 aa, Influenza virus
SLLQSAIL

SEQ ID NO: 422950 - protein, 8 aa, Influenza virus
RTFSFQLI

SEQ ID NO: 422951 - protein, 8 aa, Influenza virus
FSFNGAFI

SEQ ID NO: 422952 - protein, 8 aa, Influenza virus
SEGIYKIL

SEQ ID NO: 422953 - protein, 8 aa, Influenza virus
IYNRMGTI

SEQ ID NO: 422954 - protein, 8 aa, Influenza virus
SVQPTFSV

SEQ ID NO: 422955 - protein, 8 aa, Influenza virus
FSSAASYK

SEQ ID NO: 422956 - protein, 8 aa, Influenza virus
FESNGALL

SEQ ID NO: 422957 - protein, 8 aa, Influenza virus
SLMQGSTL

SEQ ID NO: 422958 - protein, 8 aa, Influenza virus
YAFGNCPM

SEQ ID NO: 422959 - protein, 8 aa, Influenza virus
ISIGSSTY

SEQ ID NO: 422960 - protein, 8 aa, Influenza virus
CVNRCFYV

SEQ ID NO: 422961 - protein, 8 aa, Influenza virus
GTFDTVQV

SEQ ID NO: 422962 - protein, 8 aa, Influenza virus
LPLPLCPF

SEQ ID NO: 422963 - protein, 8 aa, Influenza virus
KVNNMVDK

SEQ ID NO: 422964 - protein, 8 aa, Influenza virus
SYFQLFLV

SEQ ID NO: 422965 - protein, 8 aa, Influenza virus
ERFEIFPK

SEQ ID NO: 422966 - protein, 8 aa, Influenza virus
ISNQGSFY

SEQ ID NO: 422967 - protein, 8 aa, Influenza virus
SSMPFHNI

SEQ ID NO: 422968 - protein, 8 aa, Influenza virus
SFYAELRW

SEQ ID NO: 422969 - protein, 8 aa, Influenza virus
RTFSFQFI

SEQ ID NO: 422970 - protein, 8 aa, Influenza virus
VISSDLSY

SEQ ID NO: 422971 - protein, 8 aa, Influenza virus
SSRHCSKY

SEQ ID NO: 422972 - protein, 8 aa, Influenza virus
SPLPLCPF

SEQ ID NO: 422973 - protein, 8 aa, Influenza virus
YMGECPEY

SEQ ID NO: 422974 - protein, 8 aa, Influenza virus
LSVPEWSY

SEQ ID NO: 422975 - protein, 8 aa, Influenza virus
GRINFHWL

SEQ ID NO: 422976 - protein, 8 aa, Influenza virus
RTNQQFEL

SEQ ID NO: 422977 - protein, 8 aa, Influenza virus
EIKCQTPL

SEQ ID NO: 422978 - protein, 8 aa, Influenza virus
WLGRTTSK

SEQ ID NO: 422979 - protein, 8 aa, Influenza virus
YIIERPSA

SEQ ID NO: 422980 - protein, 8 aa, Influenza virus
KIRTRGLF

SEQ ID NO: 422981 - protein, 8 aa, Influenza virus
FLAPRYSF

SEQ ID NO: 422982 - protein, 8 aa, Influenza virus
IMIWHSNL

SEQ ID NO: 422983 - protein, 8 aa, Influenza virus
KLLLITQA

SEQ ID NO: 422984 - protein, 8 aa, Influenza virus
SSRSGFEM

SEQ ID NO: 422985 - protein, 8 aa, Influenza virus
MRISNETI

SEQ ID NO: 422986 - protein, 8 aa, Influenza virus
GPSECRTF

SEQ ID NO: 422987 - protein, 8 aa, Influenza virus
SEGTYKIL

SEQ ID NO: 422988 - protein, 8 aa, Influenza virus
GTFGPVHF

SEQ ID NO: 422989 - protein, 8 aa, Influenza virus
VTNVQNDY

SEQ ID NO: 422990 - protein, 8 aa, Influenza virus
IWSYNAEF

SEQ ID NO: 422991 - protein, 8 aa, Influenza virus
KMNTRILI

SEQ ID NO: 422992 - protein, 8 aa, Influenza virus
LLAPKYGY

SEQ ID NO: 422993 - protein, 8 aa, Influenza virus
MSKEGSYF

SEQ ID NO: 422994 - protein, 8 aa, Influenza virus
SLLNDKHF

SEQ ID NO: 422995 - protein, 8 aa, Influenza virus
RTFSFQFI

SEQ ID NO: 422996 - protein, 8 aa, Influenza virus
FEGTYKIL

SEQ ID NO: 422997 - protein, 8 aa, Influenza virus
EIEDLIFM

SEQ ID NO: 422998 - protein, 8 aa, Influenza virus
MELPSFGV

SEQ ID NO: 422999 - protein, 8 aa, Influenza virus
LRLATGLR

SEQ ID NO: 423000 - protein, 8 aa, Influenza virus
VSWASNSI

SEQ ID NO: 423001 - protein, 8 aa, Influenza virus
QITDIWAY

SEQ ID NO: 423002 - protein, 8 aa, Influenza virus
RIQINPVK

SEQ ID NO: 423003 - protein, 8 aa, Influenza virus
RRDQRALK

SEQ ID NO: 423004 - protein, 8 aa, Influenza virus
CMRPCFWV

SEQ ID NO: 423005 - protein, 8 aa, Influenza virus
FSRLNWLY

SEQ ID NO: 423006 - protein, 8 aa, Influenza virus
SSDDFALI

SEQ ID NO: 423007 - protein, 8 aa, Influenza virus
WMKIYWDL

SEQ ID NO: 423008 - protein, 8 aa, Influenza virus
VPASRYLI

SEQ ID NO: 423009 - protein, 8 aa, Influenza virus
LLIAFVLW

SEQ ID NO: 423010 - protein, 8 aa, Influenza virus
TIHDRAAF

SEQ ID NO: 423011 - protein, 8 aa, Influenza virus
LEECSCYM

SEQ ID NO: 423012 - protein, 8 aa, Influenza virus
GPSDAQAF

SEQ ID NO: 423013 - protein, 8 aa, Influenza virus
KRLGSWSW

SEQ ID NO: 423014 - protein, 8 aa, Influenza virus
LRSGFEML

SEQ ID NO: 423015 - protein, 8 aa, Influenza virus
VLVGLILA

SEQ ID NO: 423016 - protein, 8 aa, Influenza virus
FSLGASCF

SEQ ID NO: 423017 - protein, 8 aa, Influenza virus
VSLGAVSF

SEQ ID NO: 423018 - protein, 8 aa, Influenza virus
SILANNGK

SEQ ID NO: 423019 - protein, 8 aa, Influenza virus
HNVHRNAI

SEQ ID NO: 423020 - protein, 8 aa, Influenza virus
KMNTRFEA

SEQ ID NO: 423021 - protein, 8 aa, Influenza virus
GRNSFFSR

SEQ ID NO: 423022 - protein, 8 aa, Influenza virus
RRFIQNAL

SEQ ID NO: 423023 - protein, 8 aa, Influenza virus
GLILSNPK

SEQ ID NO: 423024 - protein, 8 aa, Influenza virus
GMCYPGFV

SEQ ID NO: 423025 - protein, 8 aa, Influenza virus
GVKGFGFK

SEQ ID NO: 423026 - protein, 8 aa, Influenza virus
STSSRSGF

SEQ ID NO: 423027 - protein, 8 aa, Influenza virus
FSISCFLL

SEQ ID NO: 423028 - protein, 8 aa, Influenza virus
SLQQIESI

SEQ ID NO: 423029 - protein, 8 aa, Influenza virus
NQPAATAL

SEQ ID NO: 423030 - protein, 8 aa, Influenza virus
LTKGMLGF

SEQ ID NO: 423031 - protein, 8 aa, Influenza virus
YQRSKFLL

SEQ ID NO: 423032 - protein, 8 aa, Influenza virus
GWYGYHHI

SEQ ID NO: 423033 - protein, 8 aa, Influenza virus
SSMGIYQI

SEQ ID NO: 423034 - protein, 8 aa, Influenza virus
VLAIYSCI

SEQ ID NO: 423035 - protein, 8 aa, Influenza virus
TSNSIVAF

SEQ ID NO: 423036 - protein, 8 aa, Influenza virus
CRFEGWIV

SEQ ID NO: 423037 - protein, 8 aa, Influenza virus
IQNEDIPI

SEQ ID NO: 423038 - protein, 8 aa, Influenza virus
TTIRTWAK

SEQ ID NO: 423039 - protein, 8 aa, Influenza virus
LLIGIGNL

SEQ ID NO: 423040 - protein, 8 aa, Influenza virus
KLLLIAQA

SEQ ID NO: 423041 - protein, 8 aa, Influenza virus
GQRGRIDF

SEQ ID NO: 423042 - protein, 8 aa, Influenza virus
NLYDRVRL

SEQ ID NO: 423043 - protein, 8 aa, Influenza virus
AGFAPFSK

SEQ ID NO: 423044 - protein, 8 aa, Influenza virus
NLYDKVRL

SEQ ID NO: 423045 - protein, 8 aa, Influenza virus
AAFMFWAM

SEQ ID NO: 423046 - protein, 8 aa, Influenza virus
YVNVRSLK

SEQ ID NO: 423047 - protein, 8 aa, Influenza virus
RISFYWTI

SEQ ID NO: 423048 - protein, 8 aa, Influenza virus
FYKNLLWL

SEQ ID NO: 423049 - protein, 8 aa, Influenza virus
TQFTAVGK

SEQ ID NO: 423050 - protein, 8 aa, Influenza virus
ILWISFAM

SEQ ID NO: 423051 - protein, 8 aa, Influenza virus
KIVHISPL

SEQ ID NO: 423052 - protein, 8 aa, Influenza virus
CIASSTVM

SEQ ID NO: 423053 - protein, 8 aa, Influenza virus
YLMLSKSL

SEQ ID NO: 423054 - protein, 8 aa, Influenza virus
NQNPRVFL

SEQ ID NO: 423055 - protein, 8 aa, Influenza virus
MARLGKGY

SEQ ID NO: 423056 - protein, 8 aa, Influenza virus
SFFRNVIW

SEQ ID NO: 423057 - protein, 8 aa, Influenza virus
SGFAIVSK

SEQ ID NO: 423058 - protein, 8 aa, Influenza virus
ASSGTLEF

SEQ ID NO: 423059 - protein, 8 aa, Influenza virus
NIVRRAAV

SEQ ID NO: 423060 - protein, 8 aa, Influenza virus
LGMQNGSY

SEQ ID NO: 423061 - protein, 8 aa, Influenza virus
DLNYQIGY

SEQ ID NO: 423062 - protein, 8 aa, Influenza virus
TYVNNTTI

SEQ ID NO: 423063 - protein, 8 aa, Influenza virus
SQIIINNY

SEQ ID NO: 423064 - protein, 8 aa, Influenza virus
LIVPEWSY

SEQ ID NO: 423065 - protein, 8 aa, Influenza virus
APLNRLNI

SEQ ID NO: 423066 - protein, 8 aa, Influenza virus
SISECRTF

SEQ ID NO: 423067 - protein, 8 aa, Influenza virus
SLGAVSFW

SEQ ID NO: 423068 - protein, 8 aa, Influenza virus
LLFLKVPA

SEQ ID NO: 423069 - protein, 8 aa, Influenza virus
LRMVTGLR

SEQ ID NO: 423070 - protein, 8 aa, Influenza virus
GVFSVEGK

SEQ ID NO: 423071 - protein, 8 aa, Influenza virus
IQAGVDRF

SEQ ID NO: 423072 - protein, 8 aa, Influenza virus
SPKLRSGF

SEQ ID NO: 423073 - protein, 8 aa, Influenza virus
MIAELAEK

SEQ ID NO: 423074 - protein, 8 aa, Influenza virus
CYGHNQKI

SEQ ID NO: 423075 - protein, 8 aa, Influenza virus
ITVWSSKY

SEQ ID NO: 423076 - protein, 8 aa, Influenza virus
TIISSLPF

SEQ ID NO: 423077 - protein, 8 aa, Influenza virus
KVNNIIDK

SEQ ID NO: 423078 - protein, 8 aa, Influenza virus
KEVGNGCF

SEQ ID NO: 423079 - protein, 8 aa, Influenza virus
ASVPASRY

SEQ ID NO: 423080 - protein, 8 aa, Influenza virus
LANTIEVF

SEQ ID NO: 423081 - protein, 8 aa, Influenza virus
LILKDCSV

SEQ ID NO: 423082 - protein, 8 aa, Influenza virus
FPVGTAPV

SEQ ID NO: 423083 - protein, 8 aa, Influenza virus
DQLGNILL

SEQ ID NO: 423084 - protein, 8 aa, Influenza virus
LLFQDILM

SEQ ID NO: 423085 - protein, 8 aa, Influenza virus
VLLNASWF

SEQ ID NO: 423086 - protein, 8 aa, Influenza virus
MQINPVKL

SEQ ID NO: 423087 - protein, 8 aa, Influenza virus
KRMQDGFM

SEQ ID NO: 423088 - protein, 8 aa, Influenza virus
QESSCVCI

SEQ ID NO: 423089 - protein, 8 aa, Influenza virus
SVQPAFSV

SEQ ID NO: 423090 - protein, 8 aa, Influenza virus
ITVTLHFK

SEQ ID NO: 423091 - protein, 8 aa, Influenza virus
TRWMKIIR

SEQ ID NO: 423092 - protein, 8 aa, Influenza virus
GRLIQNSM

SEQ ID NO: 423093 - protein, 8 aa, Influenza virus
STEFLGQW

SEQ ID NO: 423094 - protein, 8 aa, Influenza virus
FITEEFQW

SEQ ID NO: 423095 - protein, 8 aa, Influenza virus
KTNKQFEL

SEQ ID NO: 423096 - protein, 8 aa, Influenza virus
RSGYETFK

SEQ ID NO: 423097 - protein, 8 aa, Influenza virus
RGYKMNTK

SEQ ID NO: 423098 - protein, 8 aa, Influenza virus
KLLLIVQA

SEQ ID NO: 423099 - protein, 8 aa, Influenza virus
KSFSRTEL

SEQ ID NO: 423100 - protein, 8 aa, Influenza virus
FEVVNHEF

SEQ ID NO: 423101 - protein, 8 aa, Influenza virus
FHNIHPLA

SEQ ID NO: 423102 - protein, 8 aa, Influenza virus
AMRAVGTH

SEQ ID NO: 423103 - protein, 8 aa, Influenza virus
YSGSFVDY

SEQ ID NO: 423104 - protein, 8 aa, Influenza virus
LSVAPIMF

SEQ ID NO: 423105 - protein, 8 aa, Influenza virus
ITQRTIGK

SEQ ID NO: 423106 - protein, 8 aa, Influenza virus
ALLLAFIL

SEQ ID NO: 423107 - protein, 8 aa, Influenza virus
YMFESKKM

SEQ ID NO: 423108 - protein, 8 aa, Influenza virus
VLLENQKI

SEQ ID NO: 423109 - protein, 8 aa, Influenza virus
RRFVQNAL

SEQ ID NO: 423110 - protein, 8 aa, Influenza virus
RSNAPSGI

SEQ ID NO: 423111 - protein, 8 aa, Influenza virus
FLLMDSLK

SEQ ID NO: 423112 - protein, 8 aa, Influenza virus
ILNLGQKK

SEQ ID NO: 423113 - protein, 8 aa, Influenza virus
KVPEWSYI

SEQ ID NO: 423114 - protein, 8 aa, Influenza virus
FEAVGREF

SEQ ID NO: 423115 - protein, 8 aa, Influenza virus
SMAPIMFS

SEQ ID NO: 423116 - protein, 8 aa, Influenza virus
ELRSRYWA

SEQ ID NO: 423117 - protein, 8 aa, Influenza virus
TSGSIISF

SEQ ID NO: 423118 - protein, 8 aa, Influenza virus
MDYYWAVL

SEQ ID NO: 423119 - protein, 8 aa, Influenza virus
STASRSGY

SEQ ID NO: 423120 - protein, 8 aa, Influenza virus
FSLTDPRF

SEQ ID NO: 423121 - protein, 8 aa, Influenza virus
KMKWGMEL

SEQ ID NO: 423122 - protein, 8 aa, Influenza virus
GINKVCTK

SEQ ID NO: 423123 - protein, 8 aa, Influenza virus
TLLAKSVF

SEQ ID NO: 423124 - protein, 8 aa, Influenza virus
MTIGSVSL

SEQ ID NO: 423125 - protein, 8 aa, Influenza virus
TTHDRTAF

SEQ ID NO: 423126 - protein, 8 aa, Influenza virus
GVLHLILW

SEQ ID NO: 423127 - protein, 8 aa, Influenza virus
SLYASSQL

SEQ ID NO: 423128 - protein, 8 aa, Influenza virus
FLAPRYGY

SEQ ID NO: 423129 - protein, 8 aa, Influenza virus
RVRDNVTK

SEQ ID NO: 423130 - protein, 8 aa, Influenza virus
AISTTFPY

SEQ ID NO: 423131 - protein, 8 aa, Influenza virus
MSGYSGIF

SEQ ID NO: 423132 - protein, 8 aa, Influenza virus
ELWQCYYL

SEQ ID NO: 423133 - protein, 8 aa, Influenza virus
VETYVLSI

SEQ ID NO: 423134 - protein, 8 aa, Influenza virus
MLNASCAA

SEQ ID NO: 423135 - protein, 8 aa, Influenza virus
RMNYHWTL

SEQ ID NO: 423136 - protein, 8 aa, Influenza virus
ISVESSTY

SEQ ID NO: 423137 - protein, 8 aa, Influenza virus
YEELKHLM

SEQ ID NO: 423138 - protein, 8 aa, Influenza virus
RAIATPGM

SEQ ID NO: 423139 - protein, 8 aa, Influenza virus
FYRNLVWI

SEQ ID NO: 423140 - protein, 8 aa, Influenza virus
FHNVHPLA

SEQ ID NO: 423141 - protein, 8 aa, Influenza virus
KLNRNEIK

SEQ ID NO: 423142 - protein, 8 aa, Influenza virus
AVKLSSGY

SEQ ID NO: 423143 - protein, 8 aa, Influenza virus
KIKKIRPL

SEQ ID NO: 423144 - protein, 8 aa, Influenza virus
SFYAEMEW

SEQ ID NO: 423145 - protein, 8 aa, Influenza virus
KVNNIVDK

SEQ ID NO: 423146 - protein, 8 aa, Influenza virus
FLAPRYAF

SEQ ID NO: 423147 - protein, 8 aa, Influenza virus
SFYKNLLW

SEQ ID NO: 423148 - protein, 8 aa, Influenza virus
KIMESGGI

SEQ ID NO: 423149 - protein, 8 aa, Influenza virus
RLEENTTY

SEQ ID NO: 423150 - protein, 8 aa, Influenza virus
ALILGFVL

SEQ ID NO: 423151 - protein, 8 aa, Influenza virus
IMMAGLSF

SEQ ID NO: 423152 - protein, 8 aa, Influenza virus
YQAKFESI

SEQ ID NO: 423153 - protein, 8 aa, Influenza virus
TLVSTRSW

SEQ ID NO: 423154 - protein, 8 aa, Influenza virus
APSCDLHL

SEQ ID NO: 423155 - protein, 8 aa, Influenza virus
FSDNGGLI

SEQ ID NO: 423156 - protein, 8 aa, Influenza virus
RMNNETIL

SEQ ID NO: 423157 - protein, 8 aa, Influenza virus
AINQITGK

SEQ ID NO: 423158 - protein, 8 aa, Influenza virus
RLGFEIIK

SEQ ID NO: 423159 - protein, 8 aa, Influenza virus
VIITREPY

SEQ ID NO: 423160 - protein, 8 aa, Influenza virus
RSLISWPL

SEQ ID NO: 423161 - protein, 8 aa, Influenza virus
RLNRNEIK

SEQ ID NO: 423162 - protein, 8 aa, Influenza virus
WMCSNGSL

SEQ ID NO: 423163 - protein, 8 aa, Influenza virus
MISKCKTK

SEQ ID NO: 423164 - protein, 8 aa, Influenza virus
GVRPLILK

SEQ ID NO: 423165 - protein, 8 aa, Influenza virus
RPVIDVNM

SEQ ID NO: 423166 - protein, 8 aa, Influenza virus
ILVLGLSM

SEQ ID NO: 423167 - protein, 8 aa, Influenza virus
SWFNSFLK

SEQ ID NO: 423168 - protein, 8 aa, Influenza virus
IIVDNNNW

SEQ ID NO: 423169 - protein, 8 aa, Influenza virus
DVILWFSL

SEQ ID NO: 423170 - protein, 8 aa, Influenza virus
VVNHEFSK

SEQ ID NO: 423171 - protein, 8 aa, Influenza virus
GTYDYPHY

SEQ ID NO: 423172 - protein, 8 aa, Influenza virus
ISNVGLNI

SEQ ID NO: 423173 - protein, 8 aa, Influenza virus
SLFSSIKR

SEQ ID NO: 423174 - protein, 8 aa, Influenza virus
RAIATPGM

SEQ ID NO: 423175 - protein, 8 aa, Influenza virus
SSMPLHNI

SEQ ID NO: 423176 - protein, 8 aa, Influenza virus
DSVKNGTY

SEQ ID NO: 423177 - protein, 8 aa, Influenza virus
EGRRKTNL

SEQ ID NO: 423178 - protein, 8 aa, Influenza virus
FIAEEFPW

SEQ ID NO: 423179 - protein, 8 aa, Influenza virus
MMGMFNML

SEQ ID NO: 423180 - protein, 8 aa, Influenza virus
YQAKFESI

SEQ ID NO: 423181 - protein, 8 aa, Influenza virus
KESLRLAI

SEQ ID NO: 423182 - protein, 8 aa, Influenza virus
RPVIDINM

SEQ ID NO: 423183 - protein, 8 aa, Influenza virus
ETYKILTI

SEQ ID NO: 423184 - protein, 8 aa, Influenza virus
GSASSQAY

SEQ ID NO: 423185 - protein, 8 aa, Influenza virus
ESSFYAEM

SEQ ID NO: 423186 - protein, 8 aa, Influenza virus
YQARFESV

SEQ ID NO: 423187 - protein, 8 aa, Influenza virus
RRGLFGAI

SEQ ID NO: 423188 - protein, 8 aa, Influenza virus
LVGPILSF

SEQ ID NO: 423189 - protein, 8 aa, Influenza virus
KPRGLFGA

SEQ ID NO: 423190 - protein, 8 aa, Influenza virus
RTLTLNTM

SEQ ID NO: 423191 - protein, 8 aa, Influenza virus
RILKWEPL

SEQ ID NO: 423192 - protein, 8 aa, Influenza virus
SISCFLLI

SEQ ID NO: 423193 - protein, 8 aa, Influenza virus
SSKDNQVF

SEQ ID NO: 423194 - protein, 8 aa, Influenza virus
SSKYRQSF

SEQ ID NO: 423195 - protein, 8 aa, Influenza virus
VTHTGTSK

SEQ ID NO: 423196 - protein, 8 aa, Influenza virus
APRGYFKI

SEQ ID NO: 423197 - protein, 8 aa, Influenza virus
RGRLCNPL

SEQ ID NO: 423198 - protein, 8 aa, Influenza virus
GYSGSFTI

SEQ ID NO: 423199 - protein, 8 aa, Influenza virus
LSSPPTVY

SEQ ID NO: 423200 - protein, 8 aa, Influenza virus
RALISWEM

SEQ ID NO: 423201 - protein, 8 aa, Influenza virus
WLGRTVSI

SEQ ID NO: 423202 - protein, 8 aa, Influenza virus
CPKYVRSA

SEQ ID NO: 423203 - protein, 8 aa, Influenza virus
GLIAPDRV

SEQ ID NO: 423204 - protein, 8 aa, Influenza virus
RSLIQFPM

SEQ ID NO: 423205 - protein, 8 aa, Influenza virus
HESECVCI

SEQ ID NO: 423206 - protein, 8 aa, Influenza virus
LIAPEYGF

SEQ ID NO: 423207 - protein, 8 aa, Influenza virus
RVKSNGNL

SEQ ID NO: 423208 - protein, 8 aa, Influenza virus
WMGRTIGK

SEQ ID NO: 423209 - protein, 8 aa, Influenza virus
LILAFILW

SEQ ID NO: 423210 - protein, 8 aa, Influenza virus
NSYDHSKY

SEQ ID NO: 423211 - protein, 8 aa, Influenza virus
CHDGKAWL

SEQ ID NO: 423212 - protein, 8 aa, Influenza virus
RPIIDINM

SEQ ID NO: 423213 - protein, 8 aa, Influenza virus
FQIQGVKL

SEQ ID NO: 423214 - protein, 8 aa, Influenza virus
APDRATFL

SEQ ID NO: 423215 - protein, 8 aa, Influenza virus
RVDTIMEK

SEQ ID NO: 423216 - protein, 8 aa, Influenza virus
AIDRITTK

SEQ ID NO: 423217 - protein, 8 aa, Influenza virus
LYLNGREW

SEQ ID NO: 423218 - protein, 8 aa, Influenza virus
NESADMSI

SEQ ID NO: 423219 - protein, 8 aa, Influenza virus
GSANSQAY

SEQ ID NO: 423220 - protein, 8 aa, Influenza virus
FMWAIHHP

SEQ ID NO: 423221 - protein, 8 aa, Influenza virus
SVLNLGQK

SEQ ID NO: 423222 - protein, 8 aa, Influenza virus
ILTFIMWA

SEQ ID NO: 423223 - protein, 8 aa, Influenza virus
ASSGSLEF

SEQ ID NO: 423224 - protein, 8 aa, Influenza virus
YTRVKRQL

SEQ ID NO: 423225 - protein, 8 aa, Influenza virus
TSNSIIAF

SEQ ID NO: 423226 - protein, 8 aa, Influenza virus
NQNPRIFL

SEQ ID NO: 423227 - protein, 8 aa, Influenza virus
RSRSGFEM

SEQ ID NO: 423228 - protein, 8 aa, Influenza virus
ASGSSISF

SEQ ID NO: 423229 - protein, 8 aa, Influenza virus
RTFSPRSR

SEQ ID NO: 423230 - protein, 8 aa, Influenza virus
RSRNGFEM

SEQ ID NO: 423231 - protein, 8 aa, Influenza virus
YEKVRLQL

SEQ ID NO: 423232 - protein, 8 aa, Influenza virus
IEGGWQGL

SEQ ID NO: 423233 - protein, 8 aa, Influenza virus
SFFRNMIW

SEQ ID NO: 423234 - protein, 8 aa, Influenza virus
MLLVSTNA

SEQ ID NO: 423235 - protein, 8 aa, Influenza virus
MVNGWYGF

SEQ ID NO: 423236 - protein, 8 aa, Influenza virus
KLLLVVQA

SEQ ID NO: 423237 - protein, 8 aa, Influenza virus
IFGAIAGF

SEQ ID NO: 423238 - protein, 8 aa, Influenza virus
AQKLEDVF

SEQ ID NO: 423239 - protein, 8 aa, Influenza virus
GVKPLILK

SEQ ID NO: 423240 - protein, 8 aa, Influenza virus
FPIGTAPV

SEQ ID NO: 423241 - protein, 8 aa, Influenza virus
KLFERVKR

SEQ ID NO: 423242 - protein, 8 aa, Influenza virus
IMEKSVTV

SEQ ID NO: 423243 - protein, 8 aa, Influenza virus
GRLTTTIK

SEQ ID NO: 423244 - protein, 8 aa, Influenza virus
ALSGVAIA

SEQ ID NO: 423245 - protein, 8 aa, Influenza virus
LLIGISNM

SEQ ID NO: 423246 - protein, 8 aa, Influenza virus
WIRFNSNL

SEQ ID NO: 423247 - protein, 8 aa, Influenza virus
NTYDHSQY

SEQ ID NO: 423248 - protein, 8 aa, Influenza virus
YLMLNKSL

SEQ ID NO: 423249 - protein, 8 aa, Influenza virus
MEFFWTLL

SEQ ID NO: 423250 - protein, 8 aa, Influenza virus
GVYINTAM

SEQ ID NO: 423251 - protein, 8 aa, Influenza virus
KSVFNNLY

SEQ ID NO: 423252 - protein, 8 aa, Influenza virus
CSIWFSHY

SEQ ID NO: 423253 - protein, 8 aa, Influenza virus
FYRNLVWL

SEQ ID NO: 423254 - protein, 8 aa, Influenza virus
ASSGNLEF

SEQ ID NO: 423255 - protein, 8 aa, Influenza virus
KTNQQFKL

SEQ ID NO: 423256 - protein, 8 aa, Influenza virus
ILSIYSCI

SEQ ID NO: 423257 - protein, 8 aa, Influenza virus
ILWISFAT

SEQ ID NO: 423258 - protein, 8 aa, Influenza virus
ILFIEEGK

SEQ ID NO: 423259 - protein, 8 aa, Influenza virus
KLYERVKR

SEQ ID NO: 423260 - protein, 8 aa, Influenza virus
SFYRNLAW

SEQ ID NO: 423261 - protein, 8 aa, Influenza virus
SSTYQNSF

SEQ ID NO: 423262 - protein, 8 aa, Influenza virus
VTQRTIGK

SEQ ID NO: 423263 - protein, 8 aa, Influenza virus
LIAPRYGY

SEQ ID NO: 423264 - protein, 8 aa, Influenza virus
VSNGTMVK

SEQ ID NO: 423265 - protein, 8 aa, Influenza virus
CHDGKSWL

SEQ ID NO: 423266 - protein, 8 aa, Influenza virus
GTYNHQEY

SEQ ID NO: 423267 - protein, 8 aa, Influenza virus
KVNSIIDK

SEQ ID NO: 423268 - protein, 8 aa, Influenza virus
SISSRNGF

SEQ ID NO: 423269 - protein, 8 aa, Influenza virus
YAFGNCPM

SEQ ID NO: 423270 - protein, 8 aa, Influenza virus
KMNIQFTA

SEQ ID NO: 423271 - protein, 8 aa, Influenza virus
SLVLLFMI

SEQ ID NO: 423272 - protein, 8 aa, Influenza virus
RMDYYWAI

SEQ ID NO: 423273 - protein, 8 aa, Influenza virus
ASMRRNYF

SEQ ID NO: 423274 - protein, 8 aa, Influenza virus
LRSGYEML

SEQ ID NO: 423275 - protein, 8 aa, Influenza virus
NITEIVYL

SEQ ID NO: 423276 - protein, 8 aa, Influenza virus
TRSGYEML

SEQ ID NO: 423277 - protein, 8 aa, Influenza virus
VESNGNLI

SEQ ID NO: 423278 - protein, 8 aa, Influenza virus
SRSGYEML

SEQ ID NO: 423279 - protein, 8 aa, Influenza virus
CVILLNPF

SEQ ID NO: 423280 - protein, 8 aa, Influenza virus
NIREWSYL

SEQ ID NO: 423281 - protein, 8 aa, Influenza virus
RTNMINDK

SEQ ID NO: 423282 - protein, 8 aa, Influenza virus
TITSNLPF

SEQ ID NO: 423283 - protein, 8 aa, Influenza virus
KLSNMGVY

SEQ ID NO: 423284 - protein, 8 aa, Influenza virus
FQNASRHH

SEQ ID NO: 423285 - protein, 8 aa, Influenza virus
GLIFMCVK

SEQ ID NO: 423286 - protein, 8 aa, Influenza virus
ATAVAVLK

SEQ ID NO: 423287 - protein, 8 aa, Influenza virus
ILVTTVTL

SEQ ID NO: 423288 - protein, 8 aa, Influenza virus
RYERVKMF

SEQ ID NO: 423289 - protein, 8 aa, Influenza virus
YMGECPNY

SEQ ID NO: 423290 - protein, 8 aa, Influenza virus
NQNPRMFL

SEQ ID NO: 423291 - protein, 8 aa, Influenza virus
KVNSIVDK

SEQ ID NO: 423292 - protein, 8 aa, Influenza virus
LVRGNSPV

SEQ ID NO: 423293 - protein, 8 aa, Influenza virus
RMNYYWTI

SEQ ID NO: 423294 - protein, 8 aa, Influenza virus
SGFAIASK

SEQ ID NO: 423295 - protein, 8 aa, Influenza virus
DTICIGYH

SEQ ID NO: 423296 - protein, 8 aa, Influenza virus
MVNGWYGF

SEQ ID NO: 423297 - protein, 8 aa, Influenza virus
RVNSIIDK

SEQ ID NO: 423298 - protein, 8 aa, Influenza virus
ALSGVAVA

SEQ ID NO: 423299 - protein, 8 aa, Influenza virus
KIVHVSPL

SEQ ID NO: 423300 - protein, 8 aa, Influenza virus
NILSMAPI

SEQ ID NO: 423301 - protein, 8 aa, Influenza virus
SIGITVIK

SEQ ID NO: 423302 - protein, 8 aa, Influenza virus
IALCGSPF

SEQ ID NO: 423303 - protein, 8 aa, Influenza virus
RPCFWVEL

SEQ ID NO: 423304 - protein, 8 aa, Influenza virus
SSKYQRSF

SEQ ID NO: 423305 - protein, 8 aa, Influenza virus
GIYQILAI

SEQ ID NO: 423306 - protein, 8 aa, Influenza virus
MEFSWTLL

SEQ ID NO: 423307 - protein, 8 aa, Influenza virus
SVSSFERF

SEQ ID NO: 423308 - protein, 8 aa, Influenza virus
GRVTVSTK

SEQ ID NO: 423309 - protein, 8 aa, Influenza virus
LYLSGREW

SEQ ID NO: 423310 - protein, 8 aa, Influenza virus
SLGGCSFA

SEQ ID NO: 423311 - protein, 8 aa, Influenza virus
APPVQSRM

SEQ ID NO: 423312 - protein, 8 aa, Influenza virus
LRFVFSSA

SEQ ID NO: 423313 - protein, 8 aa, Influenza virus
HQRSKFLL

SEQ ID NO: 423314 - protein, 8 aa, Influenza virus
SPLMVAYM

SEQ ID NO: 423315 - protein, 8 aa, Influenza virus
SLYSGFVR

SEQ ID NO: 423316 - protein, 8 aa, Influenza virus
GINTNRTF

SEQ ID NO: 423317 - protein, 8 aa, Influenza virus
HKDNAVRL

SEQ ID NO: 423318 - protein, 8 aa, Influenza virus
ERFEMFPK

SEQ ID NO: 423319 - protein, 8 aa, Influenza virus
KIRTNGNL

SEQ ID NO: 423320 - protein, 8 aa, Influenza virus
RGYMFESK

SEQ ID NO: 423321 - protein, 8 aa, Influenza virus
LLLAFMLW

SEQ ID NO: 423322 - protein, 8 aa, Influenza virus
CHNGTCVV

SEQ ID NO: 423323 - protein, 8 aa, Influenza virus
FIMWACQK

SEQ ID NO: 423324 - protein, 8 aa, Influenza virus
TQYREESL

SEQ ID NO: 423325 - protein, 8 aa, Influenza virus
RTVGQCPK

SEQ ID NO: 423326 - protein, 8 aa, Influenza virus
NIKGRDVL

SEQ ID NO: 423327 - protein, 8 aa, Influenza virus
VTQRTVGK

SEQ ID NO: 423328 - protein, 8 aa, Influenza virus
KSVFNCLY

SEQ ID NO: 423329 - protein, 8 aa, Influenza virus
YISSGSLK

SEQ ID NO: 423330 - protein, 8 aa, Influenza virus
SFFSRLNW

SEQ ID NO: 423331 - protein, 8 aa, Influenza virus
YNAEVLVL

SEQ ID NO: 423332 - protein, 8 aa, Influenza virus
LLIGVGNL

SEQ ID NO: 423333 - protein, 8 aa, Influenza virus
ILWISFSM

SEQ ID NO: 423334 - protein, 8 aa, Influenza virus
IMIAGLSF

SEQ ID NO: 423335 - protein, 8 aa, Influenza virus
KYERVKMF

SEQ ID NO: 423336 - protein, 8 aa, Influenza virus
AQSLSISV

SEQ ID NO: 423337 - protein, 8 aa, Influenza virus
MEMRRCLL

SEQ ID NO: 423338 - protein, 8 aa, Influenza virus
WMGSNRPV

SEQ ID NO: 423339 - protein, 8 aa, Influenza virus
VSLGAISF

SEQ ID NO: 423340 - protein, 8 aa, Influenza virus
SMMEAMVS

SEQ ID NO: 423341 - protein, 8 aa, Influenza virus
SSNAYQAK

SEQ ID NO: 423342 - protein, 8 aa, Influenza virus
RRKKRGLF

SEQ ID NO: 423343 - protein, 8 aa, Influenza virus
SFYRNLIW

SEQ ID NO: 423344 - protein, 8 aa, Influenza virus
PSNAQAFY

SEQ ID NO: 423345 - protein, 8 aa, Influenza virus
CHDGIARM

SEQ ID NO: 423346 - protein, 8 aa, Influenza virus
AESRKLLL

SEQ ID NO: 423347 - protein, 8 aa, Influenza virus
FEAIGREF

SEQ ID NO: 423348 - protein, 8 aa, Influenza virus
VLGNYREV

SEQ ID NO: 423349 - protein, 8 aa, Influenza virus
AVTDIWSY

SEQ ID NO: 423350 - protein, 8 aa, Influenza virus
EMSNEGSY

SEQ ID NO: 423351 - protein, 8 aa, Influenza virus
KRMEDGLL

SEQ ID NO: 423352 - protein, 8 aa, Influenza virus
ETNKLAAI

SEQ ID NO: 423353 - protein, 8 aa, Influenza virus
FRHMVWLI

SEQ ID NO: 423354 - protein, 8 aa, Influenza virus
RINVINDK

SEQ ID NO: 423355 - protein, 8 aa, Influenza virus
NMRCTICI

SEQ ID NO: 423356 - protein, 8 aa, Influenza virus
KGYMFESK

SEQ ID NO: 423357 - protein, 8 aa, Influenza virus
ASNQASYK

SEQ ID NO: 423358 - protein, 8 aa, Influenza virus
DPRMCSLM

SEQ ID NO: 423359 - protein, 8 aa, Influenza virus
NTYDHSRY

SEQ ID NO: 423360 - protein, 8 aa, Influenza virus
ILGFVLWA

SEQ ID NO: 423361 - protein, 8 aa, Influenza virus
YIQMCTEL

SEQ ID NO: 423362 - protein, 8 aa, Influenza virus
VTNVQNNY

SEQ ID NO: 423363 - protein, 8 aa, Influenza virus
GRLIQNSL

SEQ ID NO: 423364 - protein, 8 aa, Influenza virus
ISLGDCSF

SEQ ID NO: 423365 - protein, 8 aa, Influenza virus
MLLMSTNA

SEQ ID NO: 423366 - protein, 8 aa, Influenza virus
SVKLFSGY

SEQ ID NO: 423367 - protein, 8 aa, Influenza virus
GMRNVPEV

SEQ ID NO: 423368 - protein, 8 aa, Influenza virus
SRLGYETF

SEQ ID NO: 423369 - protein, 8 aa, Influenza virus
CYNPCFYV

SEQ ID NO: 423370 - protein, 8 aa, Influenza virus
IPKRNRSI

SEQ ID NO: 423371 - protein, 8 aa, Influenza virus
NPRPNDPA

SEQ ID NO: 423372 - protein, 8 aa, Influenza virus
FYRNLIWL

SEQ ID NO: 423373 - protein, 8 aa, Influenza virus
ETNHTGTY

SEQ ID NO: 423374 - protein, 8 aa, Influenza virus
FLWGIHHP

SEQ ID NO: 423375 - protein, 8 aa, Influenza virus
RMTFYWTM

SEQ ID NO: 423376 - protein, 8 aa, Influenza virus
YGVKGFSF

SEQ ID NO: 423377 - protein, 8 aa, Influenza virus
QMALQLFI

SEQ ID NO: 423378 - protein, 8 aa, Influenza virus
STYHNSFV

SEQ ID NO: 423379 - protein, 8 aa, Influenza virus
VIVDNNSW

SEQ ID NO: 423380 - protein, 8 aa, Influenza virus
KLSNMGIY

SEQ ID NO: 423381 - protein, 8 aa, Influenza virus
TTIKTWAK

SEQ ID NO: 423382 - protein, 8 aa, Influenza virus
RFSYVFCL

SEQ ID NO: 423383 - protein, 8 aa, Influenza virus
LEFIAEQF

SEQ ID NO: 423384 - protein, 8 aa, Influenza virus
TIKDRSPY

SEQ ID NO: 423385 - protein, 8 aa, Influenza virus
NQEELKSL

SEQ ID NO: 423386 - protein, 8 aa, Influenza virus
FYKNLIWL

SEQ ID NO: 423387 - protein, 8 aa, Influenza virus
QESSCVCM

SEQ ID NO: 423388 - protein, 8 aa, Influenza virus
LRSGYWAI

SEQ ID NO: 423389 - protein, 8 aa, Influenza virus
NTYDHTQY

SEQ ID NO: 423390 - protein, 8 aa, Influenza virus
GRYGVKGF

SEQ ID NO: 423391 - protein, 8 aa, Influenza virus
TIVETGYV

SEQ ID NO: 423392 - protein, 8 aa, Influenza virus
GSLNFVSM

SEQ ID NO: 423393 - protein, 8 aa, Influenza virus
FSFTGEEM

SEQ ID NO: 423394 - protein, 8 aa, Influenza virus
RVPEWSYI

SEQ ID NO: 423395 - protein, 8 aa, Influenza virus
LTLKSEQF

SEQ ID NO: 423396 - protein, 8 aa, Influenza virus
FLAPRYAL

SEQ ID NO: 423397 - protein, 8 aa, Influenza virus
ASSGTVEF

SEQ ID NO: 423398 - protein, 8 aa, Influenza virus
ARIKTRLF

SEQ ID NO: 423399 - protein, 8 aa, Influenza virus
SLMLATGM

SEQ ID NO: 423400 - protein, 8 aa, Influenza virus
SGSFSIRW

SEQ ID NO: 423401 - protein, 8 aa, Influenza virus
TELGAPLV

SEQ ID NO: 423402 - protein, 8 aa, Influenza virus
ASIRRNYF

SEQ ID NO: 423403 - protein, 8 aa, Influenza virus
WAYNAELL

SEQ ID NO: 423404 - protein, 8 aa, Influenza virus
RMTFYWKI

SEQ ID NO: 423405 - protein, 8 aa, Influenza virus
TEKVDTLL

SEQ ID NO: 423406 - protein, 8 aa, Influenza virus
SLTEIWSY

SEQ ID NO: 423407 - protein, 8 aa, Influenza virus
GRWPGLVA

SEQ ID NO: 423408 - protein, 8 aa, Influenza virus
LETRIENL

SEQ ID NO: 423409 - protein, 8 aa, Influenza virus
TGFAPFSK

SEQ ID NO: 423410 - protein, 8 aa, Influenza virus
GTYDHNIY

SEQ ID NO: 423411 - protein, 8 aa, Influenza virus
SYRSLIRF

SEQ ID NO: 423412 - protein, 8 aa, Influenza virus
RPGDNITF

SEQ ID NO: 423413 - protein, 8 aa, Influenza virus
YSGAFIDY

SEQ ID NO: 423414 - protein, 8 aa, Influenza virus
SMREEYRK

SEQ ID NO: 423415 - protein, 8 aa, Influenza virus
LSSRISFY

SEQ ID NO: 423416 - protein, 8 aa, Influenza virus
GRIFQSPI

SEQ ID NO: 423417 - protein, 8 aa, Influenza virus
CSNGNCRF

SEQ ID NO: 423418 - protein, 8 aa, Influenza virus
WMACNSAA

SEQ ID NO: 423419 - protein, 8 aa, Influenza virus
KADTRILF

SEQ ID NO: 423420 - protein, 8 aa, Influenza virus
RLRGIPPL

SEQ ID NO: 423421 - protein, 8 aa, Influenza virus
GPTECRTF

SEQ ID NO: 423422 - protein, 8 aa, Influenza virus
NSWHIFSK

SEQ ID NO: 423423 - protein, 8 aa, Influenza virus
CHDGISRM

SEQ ID NO: 423424 - protein, 8 aa, Influenza virus
TSIRNNTY

SEQ ID NO: 423425 - protein, 8 aa, Influenza virus
GTYYYPKY

SEQ ID NO: 423426 - protein, 8 aa, Influenza virus
RPVIEINM

SEQ ID NO: 423427 - protein, 8 aa, Influenza virus
SLSLAIMI

SEQ ID NO: 423428 - protein, 8 aa, Influenza virus
FQRSKFLL

SEQ ID NO: 423429 - protein, 8 aa, Influenza virus
CSNNTTNY

SEQ ID NO: 423430 - protein, 8 aa, Influenza virus
GRVSVSTK

SEQ ID NO: 423431 - protein, 8 aa, Influenza virus
ALLNRLSI

SEQ ID NO: 423432 - protein, 8 aa, Influenza virus
MRFTYSGI

SEQ ID NO: 423433 - protein, 8 aa, Influenza virus
AILRKATK

SEQ ID NO: 423434 - protein, 8 aa, Influenza virus
NTYQWIIK

SEQ ID NO: 423435 - protein, 8 aa, Influenza virus
CHDGVNRM

SEQ ID NO: 423436 - protein, 8 aa, Influenza virus
QESSCTCI

SEQ ID NO: 423437 - protein, 8 aa, Influenza virus
GTCWEQMY

SEQ ID NO: 423438 - protein, 8 aa, Influenza virus
GPILSFIM

SEQ ID NO: 423439 - protein, 8 aa, Influenza virus
AMRAIGTH

SEQ ID NO: 423440 - protein, 8 aa, Influenza virus
TESSFEQI

SEQ ID NO: 423441 - protein, 8 aa, Influenza virus
TMHDRSPF

SEQ ID NO: 423442 - protein, 8 aa, Influenza virus
SLLRDNAK

SEQ ID NO: 423443 - protein, 8 aa, Influenza virus
NQASYKIF

SEQ ID NO: 423444 - protein, 8 aa, Influenza virus
TSGSSISF

SEQ ID NO: 423445 - protein, 8 aa, Influenza virus
KRLENLDK

SEQ ID NO: 423446 - protein, 8 aa, Influenza virus
LVAPEYGF

SEQ ID NO: 423447 - protein, 8 aa, Influenza virus
LSYSTGAL

SEQ ID NO: 423448 - protein, 8 aa, Influenza virus
IIKKYTSA

SEQ ID NO: 423449 - protein, 8 aa, Influenza virus
TFEFTSFF

SEQ ID NO: 423450 - protein, 8 aa, Influenza virus
ASRYGYEM

SEQ ID NO: 423451 - protein, 8 aa, Influenza virus
ALSYSTGA

SEQ ID NO: 423452 - protein, 8 aa, Influenza virus
KIITMGSV

SEQ ID NO: 423453 - protein, 8 aa, Influenza virus
SVWAGRTV

SEQ ID NO: 423454 - protein, 8 aa, Influenza virus
SFYRNMRW

SEQ ID NO: 423455 - protein, 8 aa, Influenza virus
VANVNNLY

SEQ ID NO: 423456 - protein, 8 aa, Influenza virus
ITVGSSKY

SEQ ID NO: 423457 - protein, 8 aa, Influenza virus
MPASRYLT

SEQ ID NO: 423458 - protein, 8 aa, Influenza virus
LTVPEWSY

SEQ ID NO: 423459 - protein, 8 aa, Influenza virus
HMECRTFF

SEQ ID NO: 423460 - protein, 8 aa, Influenza virus
NSWHILSK

SEQ ID NO: 423461 - protein, 8 aa, Influenza virus
VLNPGETL

SEQ ID NO: 423462 - protein, 8 aa, Influenza virus
KTKATKMK

SEQ ID NO: 423463 - protein, 8 aa, Influenza virus
SRSNIFNM

SEQ ID NO: 423464 - protein, 8 aa, Influenza virus
LQAYQKRM

SEQ ID NO: 423465 - protein, 8 aa, Influenza virus
KIVHVSPL

SEQ ID NO: 423466 - protein, 8 aa, Influenza virus
FPIGTAPI

SEQ ID NO: 423467 - protein, 8 aa, Influenza virus
GVWIGRTK

SEQ ID NO: 423468 - protein, 8 aa, Influenza virus
ALSIYSCI

SEQ ID NO: 423469 - protein, 8 aa, Influenza virus
RYPDVRCI

SEQ ID NO: 423470 - protein, 8 aa, Influenza virus
IAMGLVFI

SEQ ID NO: 423471 - protein, 8 aa, Influenza virus
KLYEKVRR

SEQ ID NO: 423472 - protein, 8 aa, Influenza virus
APLMVAYM

SEQ ID NO: 423473 - protein, 8 aa, Influenza virus
KLVLATGL

SEQ ID NO: 423474 - protein, 8 aa, Influenza virus
SRYICSGL

SEQ ID NO: 423475 - protein, 8 aa, Influenza virus
KISHISPL

SEQ ID NO: 423476 - protein, 8 aa, Influenza virus
AIDKITNK

SEQ ID NO: 423477 - protein, 8 aa, Influenza virus
DVIMEVVF

SEQ ID NO: 423478 - protein, 8 aa, Influenza virus
SFFRNVVW

SEQ ID NO: 423479 - protein, 8 aa, Influenza virus
APRGYFKV

SEQ ID NO: 423480 - protein, 8 aa, Influenza virus
RRRKRGLF

SEQ ID NO: 423481 - protein, 8 aa, Influenza virus
KMKWGMEL

SEQ ID NO: 423482 - protein, 8 aa, Influenza virus
RRDQRSLR

SEQ ID NO: 423483 - protein, 8 aa, Influenza virus
MRKKRGLF

SEQ ID NO: 423484 - protein, 8 aa, Influenza virus
TSNSIVTF

SEQ ID NO: 423485 - protein, 8 aa, Influenza virus
IELAEKAM

SEQ ID NO: 423486 - protein, 8 aa, Influenza virus
IFSARSAL

SEQ ID NO: 423487 - protein, 8 aa, Influenza virus
GVQMHRFK

SEQ ID NO: 423488 - protein, 8 aa, Influenza virus
FVSMEFSL

SEQ ID NO: 423489 - protein, 8 aa, Influenza virus
FMYSDFHF

SEQ ID NO: 423490 - protein, 8 aa, Influenza virus
SVPEWSYI

SEQ ID NO: 423491 - protein, 8 aa, Influenza virus
SVSECRTF

SEQ ID NO: 423492 - protein, 8 aa, Influenza virus
VISTDLSY

SEQ ID NO: 423493 - protein, 8 aa, Influenza virus
CYHIGGTI

SEQ ID NO: 423494 - protein, 8 aa, Influenza virus
GTYSYPQY

SEQ ID NO: 423495 - protein, 8 aa, Influenza virus
AICTHLEV

SEQ ID NO: 423496 - protein, 8 aa, Influenza virus
ETEQTKLY

SEQ ID NO: 423497 - protein, 8 aa, Influenza virus
SWPDGALF

SEQ ID NO: 423498 - protein, 8 aa, Influenza virus
CINGICTV

SEQ ID NO: 423499 - protein, 8 aa, Influenza virus
RSGYSGIF

SEQ ID NO: 423500 - protein, 8 aa, Influenza virus
TSNSIVVF

SEQ ID NO: 423501 - protein, 8 aa, Influenza virus
WPQSSPPT

SEQ ID NO: 423502 - protein, 8 aa, Influenza virus
CSFAGWIL

SEQ ID NO: 423503 - protein, 8 aa, Influenza virus
RMENLNKK

SEQ ID NO: 423504 - protein, 8 aa, Influenza virus
GTYDYSKY

SEQ ID NO: 423505 - protein, 8 aa, Influenza virus
SSNYQQSF

SEQ ID NO: 423506 - protein, 8 aa, Influenza virus
HKDNAIRL

SEQ ID NO: 423507 - protein, 8 aa, Influenza virus
AVAVLKYK

SEQ ID NO: 423508 - protein, 8 aa, Influenza virus
MGLAPSPY

SEQ ID NO: 423509 - protein, 8 aa, Influenza virus
GRYSIADK

SEQ ID NO: 423510 - protein, 8 aa, Influenza virus
FQNISPVW

SEQ ID NO: 423511 - protein, 8 aa, Influenza virus
FLMQIATL

SEQ ID NO: 423512 - protein, 8 aa, Influenza virus
VLNVSLHL

SEQ ID NO: 423513 - protein, 8 aa, Influenza virus
SFYSELKW

SEQ ID NO: 423514 - protein, 8 aa, Influenza virus
SITDIWTY

SEQ ID NO: 423515 - protein, 8 aa, Influenza virus
RLNTMHQL

SEQ ID NO: 423516 - protein, 8 aa, Influenza virus
NVLSIAPI

SEQ ID NO: 423517 - protein, 8 aa, Influenza virus
GIYQILSI

SEQ ID NO: 423518 - protein, 8 aa, Influenza virus
RRRGLFGA

SEQ ID NO: 423519 - protein, 8 aa, Influenza virus
TSNSIAVF

SEQ ID NO: 423520 - protein, 8 aa, Influenza virus
RGWAPLSK

SEQ ID NO: 423521 - protein, 8 aa, Influenza virus
GSASSQAY

SEQ ID NO: 423522 - protein, 8 aa, Influenza virus
GRMADSIK

SEQ ID NO: 423523 - protein, 8 aa, Influenza virus
NRIRIDPV

SEQ ID NO: 423524 - protein, 8 aa, Influenza virus
FSIAASYK

SEQ ID NO: 423525 - protein, 8 aa, Influenza virus
KRMEDGFL

SEQ ID NO: 423526 - protein, 8 aa, Influenza virus
RSFSRTEL

SEQ ID NO: 423527 - protein, 8 aa, Influenza virus
VYEGYEEF

SEQ ID NO: 423528 - protein, 8 aa, Influenza virus
RIFQSHIR

SEQ ID NO: 423529 - protein, 8 aa, Influenza virus
LEESHPGI

SEQ ID NO: 423530 - protein, 8 aa, Influenza virus
RGFLILGK

SEQ ID NO: 423531 - protein, 8 aa, Influenza virus
SLGAISFW

SEQ ID NO: 423532 - protein, 8 aa, Influenza virus
REVEVVNA

SEQ ID NO: 423533 - protein, 8 aa, Influenza virus
IVMCGVDY

SEQ ID NO: 423534 - protein, 8 aa, Influenza virus
GQRSRIDY

SEQ ID NO: 423535 - protein, 8 aa, Influenza virus
GYICSGIF

SEQ ID NO: 423536 - protein, 8 aa, Influenza virus
GTYSYPQY

SEQ ID NO: 423537 - protein, 8 aa, Influenza virus
YLFIKEGK

SEQ ID NO: 423538 - protein, 8 aa, Influenza virus
MQINPVKL

SEQ ID NO: 423539 - protein, 8 aa, Influenza virus
RPMDSTGS

SEQ ID NO: 423540 - protein, 8 aa, Influenza virus
FMQALQLL

SEQ ID NO: 423541 - protein, 8 aa, Influenza virus
TLSVVSLL

SEQ ID NO: 423542 - protein, 8 aa, Influenza virus
GLCYPGNF

SEQ ID NO: 423543 - protein, 8 aa, Influenza virus
TLVSTGSW

SEQ ID NO: 423544 - protein, 8 aa, Influenza virus
KVVHISPL

SEQ ID NO: 423545 - protein, 8 aa, Influenza virus
ALSYSAGA

SEQ ID NO: 423546 - protein, 8 aa, Influenza virus
RMNYYWTL

SEQ ID NO: 423547 - protein, 8 aa, Influenza virus
RYGDGVWI

SEQ ID NO: 423548 - protein, 8 aa, Influenza virus
SQYICSPV

SEQ ID NO: 423549 - protein, 8 aa, Influenza virus
VWSYNAEF

SEQ ID NO: 423550 - protein, 8 aa, Influenza virus
RVSFYWTI

SEQ ID NO: 423551 - protein, 8 aa, Influenza virus
RTATREGK

SEQ ID NO: 423552 - protein, 8 aa, Influenza virus
ALSGMAIA

SEQ ID NO: 423553 - protein, 8 aa, Influenza virus
SINTRLPF

SEQ ID NO: 423554 - protein, 8 aa, Influenza virus
SIYSTVAA

SEQ ID NO: 423555 - protein, 8 aa, Influenza virus
MQNKLNNV

SEQ ID NO: 423556 - protein, 8 aa, Influenza virus
MGQAPSPY

SEQ ID NO: 423557 - protein, 8 aa, Influenza virus
DTICVGYH

SEQ ID NO: 423558 - protein, 8 aa, Influenza virus
RYSIADKI

SEQ ID NO: 423559 - protein, 8 aa, Influenza virus
CTVPCFWV

SEQ ID NO: 423560 - protein, 8 aa, Influenza virus
FQKDARVL

SEQ ID NO: 423561 - protein, 8 aa, Influenza virus
RLILATGL

SEQ ID NO: 423562 - protein, 8 aa, Influenza virus
MDYYWAIL

SEQ ID NO: 423563 - protein, 8 aa, Influenza virus
FQKDARVL

SEQ ID NO: 423564 - protein, 8 aa, Influenza virus
YKSTQAAI

SEQ ID NO: 423565 - protein, 8 aa, Influenza virus
WKHVTNTI

SEQ ID NO: 423566 - protein, 8 aa, Influenza virus
ALGHGTTL

SEQ ID NO: 423567 - protein, 8 aa, Influenza virus
TIHDRSPY

SEQ ID NO: 423568 - protein, 8 aa, Influenza virus
MMAMRYPI

SEQ ID NO: 423569 - protein, 8 aa, Influenza virus
HKDNALRL

SEQ ID NO: 423570 - protein, 8 aa, Influenza virus
TTNSIVVF

SEQ ID NO: 423571 - protein, 8 aa, Influenza virus
WLIDQSGT

SEQ ID NO: 423572 - protein, 8 aa, Influenza virus
SIYASPQL

SEQ ID NO: 423573 - protein, 8 aa, Influenza virus
SESRSNIF

SEQ ID NO: 423574 - protein, 8 aa, Influenza virus
QLTHHMRK

SEQ ID NO: 423575 - protein, 8 aa, Influenza virus
YAYKIVKK

SEQ ID NO: 423576 - protein, 8 aa, Influenza virus
RMEFFWTL

SEQ ID NO: 423577 - protein, 8 aa, Influenza virus
FIMWACSS

SEQ ID NO: 423578 - protein, 8 aa, Influenza virus
YKWEKYCV

SEQ ID NO: 423579 - protein, 8 aa, Influenza virus
RIQIDSVK

SEQ ID NO: 423580 - protein, 8 aa, Influenza virus
IIVTREPY

SEQ ID NO: 423581 - protein, 8 aa, Influenza virus
LMDFLKDV

SEQ ID NO: 423582 - protein, 8 aa, Influenza virus
KVVHISPL

SEQ ID NO: 423583 - protein, 8 aa, Influenza virus
RRVLRENA

SEQ ID NO: 423584 - protein, 8 aa, Influenza virus
MSELGVPF

SEQ ID NO: 423585 - protein, 8 aa, Influenza virus
VTRSGTSK

SEQ ID NO: 423586 - protein, 8 aa, Influenza virus
CYRACFYV

SEQ ID NO: 423587 - protein, 8 aa, Influenza virus
FPMGTAPV

SEQ ID NO: 423588 - protein, 8 aa, Influenza virus
MVNGWYGY

SEQ ID NO: 423589 - protein, 8 aa, Influenza virus
RAGYETFK

SEQ ID NO: 423590 - protein, 8 aa, Influenza virus
KFFPSSSY

SEQ ID NO: 423591 - protein, 8 aa, Influenza virus
ITYSSPMM

SEQ ID NO: 423592 - protein, 8 aa, Influenza virus
FLNNTEPL

SEQ ID NO: 423593 - protein, 8 aa, Influenza virus
KYGDGVWI

SEQ ID NO: 423594 - protein, 8 aa, Influenza virus
MIIELAEK

SEQ ID NO: 423595 - protein, 8 aa, Influenza virus
RLENLNKK

SEQ ID NO: 423596 - protein, 8 aa, Influenza virus
MMMGMFNM

SEQ ID NO: 423597 - protein, 8 aa, Influenza virus
ASCMGLIY

SEQ ID NO: 423598 - protein, 8 aa, Influenza virus
TIASDILK

SEQ ID NO: 423599 - protein, 8 aa, Influenza virus
KRVRLFDY

SEQ ID NO: 423600 - protein, 8 aa, Influenza virus
ILSTKALL

SEQ ID NO: 423601 - protein, 8 aa, Influenza virus
GTYDYPRY

SEQ ID NO: 423602 - protein, 8 aa, Influenza virus
IRWETTGR

SEQ ID NO: 423603 - protein, 8 aa, Influenza virus
KAAMGLRI

SEQ ID NO: 423604 - protein, 8 aa, Influenza virus
SEECSCYV

SEQ ID NO: 423605 - protein, 8 aa, Influenza virus
WRGANRPV

SEQ ID NO: 423606 - protein, 8 aa, Influenza virus
FVVREPFI

SEQ ID NO: 423607 - protein, 8 aa, Influenza virus
GSIRNNTY

SEQ ID NO: 423608 - protein, 8 aa, Influenza virus
RYSKADKI

SEQ ID NO: 423609 - protein, 8 aa, Influenza virus
KGWAPLSK

SEQ ID NO: 423610 - protein, 8 aa, Influenza virus
YSGAFVDY

SEQ ID NO: 423611 - protein, 8 aa, Influenza virus
TTVTLHFK

SEQ ID NO: 423612 - protein, 8 aa, Influenza virus
KMVTQRTV

SEQ ID NO: 423613 - protein, 8 aa, Influenza virus
RSGYSGSF

SEQ ID NO: 423614 - protein, 8 aa, Influenza virus
LLFQDILM

SEQ ID NO: 423615 - protein, 8 aa, Influenza virus
SFYAELKW

SEQ ID NO: 423616 - protein, 8 aa, Influenza virus
IVKGRSHL

SEQ ID NO: 423617 - protein, 8 aa, Influenza virus
LIAPEFGY

SEQ ID NO: 423618 - protein, 8 aa, Influenza virus
SFYRNVVW

SEQ ID NO: 423619 - protein, 8 aa, Influenza virus
MTIGSVSL

SEQ ID NO: 423620 - protein, 8 aa, Influenza virus
QSSPPTVY

SEQ ID NO: 423621 - protein, 8 aa, Influenza virus
TITSPLPF

SEQ ID NO: 423622 - protein, 8 aa, Influenza virus
PMRTPIAF

SEQ ID NO: 423623 - protein, 8 aa, Influenza virus
KLCYPGEV

SEQ ID NO: 423624 - protein, 8 aa, Influenza virus
FRNMVWLV

SEQ ID NO: 423625 - protein, 8 aa, Influenza virus
AMDHTSQY

SEQ ID NO: 423626 - protein, 8 aa, Influenza virus
RIFQSPIR

SEQ ID NO: 423627 - protein, 8 aa, Influenza virus
GQSGRIDF

SEQ ID NO: 423628 - protein, 8 aa, Influenza virus
KLRSGFEM

SEQ ID NO: 423629 - protein, 8 aa, Influenza virus
KIAHISPL

SEQ ID NO: 423630 - protein, 8 aa, Influenza virus
FGDSAEEY

SEQ ID NO: 423631 - protein, 8 aa, Influenza virus
AMRTVGTH

SEQ ID NO: 423632 - protein, 8 aa, Influenza virus
RSGYSGVF

SEQ ID NO: 423633 - protein, 8 aa, Influenza virus
DRSPFRAL

SEQ ID NO: 423634 - protein, 8 aa, Influenza virus
MACHSAAF

SEQ ID NO: 423635 - protein, 8 aa, Influenza virus
YLIRTLTL

SEQ ID NO: 423636 - protein, 8 aa, Influenza virus
RMNYHWTL

SEQ ID NO: 423637 - protein, 8 aa, Influenza virus
RLRMATGL

SEQ ID NO: 423638 - protein, 8 aa, Influenza virus
NLYEKVRL

SEQ ID NO: 423639 - protein, 8 aa, Influenza virus
GTYNYPQY

SEQ ID NO: 423640 - protein, 8 aa, Influenza virus
VLLVSLGA

SEQ ID NO: 423641 - protein, 8 aa, Influenza virus
YVNIKSLK

SEQ ID NO: 423642 - protein, 8 aa, Influenza virus
TEIYNETV

SEQ ID NO: 423643 - protein, 8 aa, Influenza virus
YDRVRLQL

SEQ ID NO: 423644 - protein, 8 aa, Influenza virus
KLFERVRH

SEQ ID NO: 423645 - protein, 8 aa, Influenza virus
LSYSVGYL

SEQ ID NO: 423646 - protein, 8 aa, Influenza virus
SICTHLEV

SEQ ID NO: 423647 - protein, 8 aa, Influenza virus
ITYSSSMM

SEQ ID NO: 423648 - protein, 8 aa, Influenza virus
FLMQIAVL

SEQ ID NO: 423649 - protein, 8 aa, Influenza virus
MEFSWILL

SEQ ID NO: 423650 - protein, 8 aa, Influenza virus
IITHFQRK

SEQ ID NO: 423651 - protein, 8 aa, Influenza virus
TYNAELLI

SEQ ID NO: 423652 - protein, 8 aa, Influenza virus
NIIFLWGI

SEQ ID NO: 423653 - protein, 8 aa, Influenza virus
ILNLLIGI

SEQ ID NO: 423654 - protein, 8 aa, Influenza virus
KVDTLTEK

SEQ ID NO: 423655 - protein, 8 aa, Influenza virus
KYVKSERL

SEQ ID NO: 423656 - protein, 8 aa, Influenza virus
RISIYWTL

SEQ ID NO: 423657 - protein, 8 aa, Influenza virus
VENRINML

SEQ ID NO: 423658 - protein, 8 aa, Influenza virus
LARSALIL

SEQ ID NO: 423659 - protein, 8 aa, Influenza virus
LSFQVDCF

SEQ ID NO: 423660 - protein, 8 aa, Influenza virus
SSFERFEM

SEQ ID NO: 423661 - protein, 8 aa, Influenza virus
SIGVTVIK

SEQ ID NO: 423662 - protein, 8 aa, Influenza virus
KLEENTTY

SEQ ID NO: 423663 - protein, 8 aa, Influenza virus
TTHDRTAF

SEQ ID NO: 423664 - protein, 8 aa, Influenza virus
RHENRMVL

SEQ ID NO: 423665 - protein, 8 aa, Influenza virus
TAVAVLKY

SEQ ID NO: 423666 - protein, 8 aa, Influenza virus
FSFGASCV

SEQ ID NO: 423667 - protein, 8 aa, Influenza virus
TEQVDTIM

SEQ ID NO: 423668 - protein, 8 aa, Influenza virus
GYFGIFFV

SEQ ID NO: 423669 - protein, 8 aa, Influenza virus
TSYRTLLM

SEQ ID NO: 423670 - protein, 8 aa, Influenza virus
RIFQSGVR

SEQ ID NO: 423671 - protein, 8 aa, Influenza virus
MMAMKYPI

SEQ ID NO: 423672 - protein, 8 aa, Influenza virus
LMIIGGFI

SEQ ID NO: 423673 - protein, 8 aa, Influenza virus
DVYQILAI

SEQ ID NO: 423674 - protein, 8 aa, Influenza virus
AVIYGNPK

SEQ ID NO: 423675 - protein, 8 aa, Influenza virus
VLSIYSCI

SEQ ID NO: 423676 - protein, 8 aa, Influenza virus
SMQCRVCI

SEQ ID NO: 423677 - protein, 8 aa, Influenza virus
SFFRNMVW

SEQ ID NO: 423678 - protein, 8 aa, Influenza virus
SLRLALGL

SEQ ID NO: 423679 - protein, 8 aa, Influenza virus
AICTHMEV

SEQ ID NO: 423680 - protein, 8 aa, Influenza virus
FGASSFVL

SEQ ID NO: 423681 - protein, 8 aa, Influenza virus
GLVYGNPA

SEQ ID NO: 423682 - protein, 8 aa, Influenza virus
LHIPEAGL

SEQ ID NO: 423683 - protein, 8 aa, Influenza virus
ATTITLHF

SEQ ID NO: 423684 - protein, 8 aa, Influenza virus
KLEENSTY

SEQ ID NO: 423685 - protein, 8 aa, Influenza virus
LIAPWYGY

SEQ ID NO: 423686 - protein, 8 aa, Influenza virus
VTSSGTSK

SEQ ID NO: 423687 - protein, 8 aa, Influenza virus
VLFQGGHI

SEQ ID NO: 423688 - protein, 8 aa, Influenza virus
KENTGSYV

SEQ ID NO: 423689 - protein, 8 aa, Influenza virus
YKKLKREM

SEQ ID NO: 423690 - protein, 8 aa, Influenza virus
QESECICI

SEQ ID NO: 423691 - protein, 8 aa, Influenza virus
YNAELLVL

SEQ ID NO: 423692 - protein, 8 aa, Influenza virus
ISVGSSTY

SEQ ID NO: 423693 - protein, 8 aa, Influenza virus
FEEMRWLI

SEQ ID NO: 423694 - protein, 8 aa, Influenza virus
MMDGWYGF

SEQ ID NO: 423695 - protein, 8 aa, Influenza virus
YRNLVWIV

SEQ ID NO: 423696 - protein, 8 aa, Influenza virus
CHDGVSRM

SEQ ID NO: 423697 - protein, 8 aa, Influenza virus
RIENLNRK

SEQ ID NO: 423698 - protein, 8 aa, Influenza virus
SSVSSFEK

SEQ ID NO: 423699 - protein, 8 aa, Influenza virus
FPRTTNTY

SEQ ID NO: 423700 - protein, 8 aa, Influenza virus
KIVHISPL

SEQ ID NO: 423701 - protein, 8 aa, Influenza virus
MTNVQNNY

SEQ ID NO: 423702 - protein, 8 aa, Influenza virus
GLILAFIL

SEQ ID NO: 423703 - protein, 8 aa, Influenza virus
SSNYHQSF

SEQ ID NO: 423704 - protein, 8 aa, Influenza virus
VLDDCSLK

SEQ ID NO: 423705 - protein, 8 aa, Influenza virus
TFDLGGLY

SEQ ID NO: 423706 - protein, 8 aa, Influenza virus
PFQGFFPF

SEQ ID NO: 423707 - protein, 8 aa, Influenza virus
KYVKSEKL

SEQ ID NO: 423708 - protein, 8 aa, Influenza virus
ILSIYSTA

SEQ ID NO: 423709 - protein, 8 aa, Influenza virus
YMDIDVYC

SEQ ID NO: 423710 - protein, 8 aa, Influenza virus
IVVTREPY

SEQ ID NO: 423711 - protein, 8 aa, Influenza virus
IGIGNLAF

SEQ ID NO: 423712 - protein, 8 aa, Influenza virus
RRYGPALS

SEQ ID NO: 423713 - protein, 8 aa, Influenza virus
FGASCFVL

SEQ ID NO: 423714 - protein, 8 aa, Influenza virus
LLAPRYAF

SEQ ID NO: 423715 - protein, 8 aa, Influenza virus
SMQCRICI

SEQ ID NO: 423716 - protein, 8 aa, Influenza virus
RHNGTCAV

SEQ ID NO: 423717 - protein, 8 aa, Influenza virus
IMIAGLFF

SEQ ID NO: 423718 - protein, 8 aa, Influenza virus
VLIVSLGA

SEQ ID NO: 423719 - protein, 8 aa, Influenza virus
FQVDCFLW

SEQ ID NO: 423720 - protein, 8 aa, Influenza virus
VMNTSKPL

SEQ ID NO: 423721 - protein, 8 aa, Influenza virus
FQKDAKVL

SEQ ID NO: 423722 - protein, 8 aa, Influenza virus
RIFQSRIR

SEQ ID NO: 423723 - protein, 8 aa, Influenza virus
GEVPGWSW

SEQ ID NO: 423724 - protein, 8 aa, Influenza virus
SPGMMMGM

SEQ ID NO: 423725 - protein, 8 aa, Influenza virus
NLRCQICI

SEQ ID NO: 423726 - protein, 8 aa, Influenza virus
SIIDKMNI

SEQ ID NO: 423727 - protein, 8 aa, Influenza virus
MKIYWHLM

SEQ ID NO: 423728 - protein, 8 aa, Influenza virus
LSVVSLLI

SEQ ID NO: 423729 - protein, 8 aa, Influenza virus
VMLLAIAM

SEQ ID NO: 423730 - protein, 8 aa, Influenza virus
CSIAGWLL

SEQ ID NO: 423731 - protein, 8 aa, Influenza virus
KIMKIRPI

SEQ ID NO: 423732 - protein, 8 aa, Influenza virus
SRYREEAM

SEQ ID NO: 423733 - protein, 8 aa, Influenza virus
QIKIRRRV

SEQ ID NO: 423734 - protein, 8 aa, Influenza virus
LELRDCSI

SEQ ID NO: 423735 - protein, 8 aa, Influenza virus
SIQSDKPF

SEQ ID NO: 423736 - protein, 8 aa, Influenza virus
KLRMATGL

SEQ ID NO: 423737 - protein, 8 aa, Influenza virus
KIRKGKIM

SEQ ID NO: 423738 - protein, 8 aa, Influenza virus
LIAPEYGY

SEQ ID NO: 423739 - protein, 8 aa, Influenza virus
RPQMNGQS

SEQ ID NO: 423740 - protein, 8 aa, Influenza virus
TRLPFQNL

SEQ ID NO: 423741 - protein, 8 aa, Influenza virus
DANANNLY

SEQ ID NO: 423742 - protein, 8 aa, Influenza virus
RYVCTGIL

SEQ ID NO: 423743 - protein, 8 aa, Influenza virus
YEELKHLI

SEQ ID NO: 423744 - protein, 8 aa, Influenza virus
IPSWAGNV

SEQ ID NO: 423745 - protein, 8 aa, Influenza virus
ARLGKGYM

SEQ ID NO: 423746 - protein, 8 aa, Influenza virus
SFYRNLVW

SEQ ID NO: 423747 - protein, 8 aa, Influenza virus
SFYKNLIW

SEQ ID NO: 423748 - protein, 8 aa, Influenza virus
LLLLQANL

SEQ ID NO: 423749 - protein, 8 aa, Influenza virus
YRNVVWLI

SEQ ID NO: 423750 - protein, 8 aa, Influenza virus
NYQSLRSI

SEQ ID NO: 423751 - protein, 8 aa, Influenza virus
VTVWSSKY

SEQ ID NO: 423752 - protein, 8 aa, Influenza virus
VIVDNSNW

SEQ ID NO: 423753 - protein, 8 aa, Influenza virus
YVNVKSLK

SEQ ID NO: 423754 - protein, 8 aa, Influenza virus
LLIGISNM

SEQ ID NO: 423755 - protein, 8 aa, Influenza virus
SSMPFHNV

SEQ ID NO: 423756 - protein, 8 aa, Influenza virus
SRYVCSGL

SEQ ID NO: 423757 - protein, 8 aa, Influenza virus
AIMIAGLF

SEQ ID NO: 423758 - protein, 8 aa, Influenza virus
FAISCLLL

SEQ ID NO: 423759 - protein, 8 aa, Influenza virus
LMSPGERI

SEQ ID NO: 423760 - protein, 8 aa, Influenza virus
NRIQIDPV

SEQ ID NO: 423761 - protein, 8 aa, Influenza virus
NLRCTICI

SEQ ID NO: 423762 - protein, 8 aa, Influenza virus
RIGEDAHV

SEQ ID NO: 423763 - protein, 8 aa, Influenza virus
PELCPSPL

SEQ ID NO: 423764 - protein, 8 aa, Influenza virus
GEPGVKGF

SEQ ID NO: 423765 - protein, 8 aa, Influenza virus
GQRGRIDY

SEQ ID NO: 423766 - protein, 8 aa, Influenza virus
CQMEKIVL

SEQ ID NO: 423767 - protein, 8 aa, Influenza virus
IPIGERGL

SEQ ID NO: 423768 - protein, 8 aa, Influenza virus
SIQSRGLF

SEQ ID NO: 423769 - protein, 8 aa, Influenza virus
ALILVALA

SEQ ID NO: 423770 - protein, 8 aa, Influenza virus
EPYVSCSL

SEQ ID NO: 423771 - protein, 8 aa, Influenza virus
KILKWESL

SEQ ID NO: 423772 - protein, 8 aa, Influenza virus
NMDRAVKL

SEQ ID NO: 423773 - protein, 8 aa, Influenza virus
LIAGWYGF

SEQ ID NO: 423774 - protein, 8 aa, Influenza virus
KLYWHLMS

SEQ ID NO: 423775 - protein, 8 aa, Influenza virus
LLLAFVLW

SEQ ID NO: 423776 - protein, 8 aa, Influenza virus
GLRNVPSV

SEQ ID NO: 423777 - protein, 8 aa, Influenza virus
FVFVALIL

SEQ ID NO: 423778 - protein, 8 aa, Influenza virus
CHDGKFRM

SEQ ID NO: 423779 - protein, 8 aa, Influenza virus
QESECVCM

SEQ ID NO: 423780 - protein, 8 aa, Influenza virus
ILSKDNAI

SEQ ID NO: 423781 - protein, 8 aa, Influenza virus
SVKNGTYY

SEQ ID NO: 423782 - protein, 8 aa, Influenza virus
ARQMVHAM

SEQ ID NO: 423783 - protein, 8 aa, Influenza virus
NGMNRPVL

SEQ ID NO: 423784 - protein, 8 aa, Influenza virus
VTVWSSKY

SEQ ID NO: 423785 - protein, 8 aa, Influenza virus
SQKQEFKM

SEQ ID NO: 423786 - protein, 8 aa, Influenza virus
FRHMVWLI

SEQ ID NO: 423787 - protein, 8 aa, Influenza virus
RALVSWPL

SEQ ID NO: 423788 - protein, 8 aa, Influenza virus
FSDYEELK

SEQ ID NO: 423789 - protein, 8 aa, Influenza virus
SMDSRSGY

SEQ ID NO: 423790 - protein, 8 aa, Influenza virus
LLMIIGGF

SEQ ID NO: 423791 - protein, 8 aa, Influenza virus
MRWLTLKS

SEQ ID NO: 423792 - protein, 8 aa, Influenza virus
ILHKCDNK

SEQ ID NO: 423793 - protein, 8 aa, Influenza virus
GYSGSFSI

SEQ ID NO: 423794 - protein, 8 aa, Influenza virus
CSIWFSHY

SEQ ID NO: 423795 - protein, 8 aa, Influenza virus
ILASSGSL

SEQ ID NO: 423796 - protein, 8 aa, Influenza virus
RSGYSGIF

SEQ ID NO: 423797 - protein, 8 aa, Influenza virus
KECFNPCF

SEQ ID NO: 423798 - protein, 8 aa, Influenza virus
QESECVCI

SEQ ID NO: 423799 - protein, 8 aa, Influenza virus
KPWARNIL

SEQ ID NO: 423800 - protein, 8 aa, Influenza virus
LIAFVLWA

SEQ ID NO: 423801 - protein, 8 aa, Influenza virus
GTYNHREY

SEQ ID NO: 423802 - protein, 8 aa, Influenza virus
RYPGVRCI

SEQ ID NO: 423803 - protein, 8 aa, Influenza virus
ERFEMFPR

SEQ ID NO: 423804 - protein, 8 aa, Influenza virus
TIYWWDGL

SEQ ID NO: 423805 - protein, 8 aa, Influenza virus
YAFGTCPK

SEQ ID NO: 423806 - protein, 8 aa, Influenza virus
THLEICFM

SEQ ID NO: 423807 - protein, 8 aa, Influenza virus
FMDYWAEG

SEQ ID NO: 423808 - protein, 8 aa, Influenza virus
MMGMFNML

SEQ ID NO: 423809 - protein, 8 aa, Influenza virus
LKITENSF

SEQ ID NO: 423810 - protein, 8 aa, Influenza virus
YQAKFESV

SEQ ID NO: 423811 - protein, 8 aa, Influenza virus
PADTRIYY

SEQ ID NO: 423812 - protein, 8 aa, Influenza virus
QVTGFAPF

SEQ ID NO: 423813 - protein, 8 aa, Influenza virus
YEKVRMQL

SEQ ID NO: 423814 - protein, 8 aa, Influenza virus
QAYTKVLY

SEQ ID NO: 423815 - protein, 8 aa, Influenza virus
GVQMQRFK

SEQ ID NO: 423816 - protein, 8 aa, Influenza virus
HSNNSTEK

SEQ ID NO: 423817 - protein, 8 aa, Influenza virus
RYSRADKI

SEQ ID NO: 423818 - protein, 8 aa, Influenza virus
SRYREEAM

SEQ ID NO: 423819 - protein, 8 aa, Influenza virus
YDRVRMQL

SEQ ID NO: 423820 - protein, 8 aa, Influenza virus
YRYGFVAN

SEQ ID NO: 423821 - protein, 8 aa, Influenza virus
YRKLKREI

SEQ ID NO: 423822 - protein, 8 aa, Influenza virus
MRINNETI

SEQ ID NO: 423823 - protein, 8 aa, Influenza virus
MACNSAAF

SEQ ID NO: 423824 - protein, 8 aa, Influenza virus
IMVAGLSF

SEQ ID NO: 423825 - protein, 8 aa, Influenza virus
ILSICSCI

SEQ ID NO: 423826 - protein, 8 aa, Influenza virus
TINSWHIF

SEQ ID NO: 423827 - protein, 8 aa, Influenza virus
SIDRFLRV

SEQ ID NO: 423828 - protein, 8 aa, Influenza virus
APDRVSFL

SEQ ID NO: 423829 - protein, 8 aa, Influenza virus
RRDQKSLK

SEQ ID NO: 423830 - protein, 8 aa, Influenza virus
LTKGILGF

SEQ ID NO: 423831 - protein, 8 aa, Influenza virus
GLNVSLHL

SEQ ID NO: 423832 - protein, 8 aa, Influenza virus
WITREPYV

SEQ ID NO: 423833 - protein, 8 aa, Influenza virus
FGYFGIFF

SEQ ID NO: 423834 - protein, 8 aa, Influenza virus
TIKTWAGK

SEQ ID NO: 423835 - protein, 8 aa, Influenza virus
SVCYNPCF

SEQ ID NO: 423836 - protein, 8 aa, Influenza virus
LLNASCAA

SEQ ID NO: 423837 - protein, 8 aa, Influenza virus
FIAPRYAF

SEQ ID NO: 423838 - protein, 8 aa, Influenza virus
DEFQLIPM

SEQ ID NO: 423839 - protein, 8 aa, Influenza virus
TFDLEGLY

SEQ ID NO: 423840 - protein, 8 aa, Influenza virus
TITYSSSM

SEQ ID NO: 423841 - protein, 8 aa, Influenza virus
VEKEFSNL

SEQ ID NO: 423842 - protein, 8 aa, Influenza virus
QVKLSSGY

SEQ ID NO: 423843 - protein, 8 aa, Influenza virus
CSSGNCRF

SEQ ID NO: 423844 - protein, 8 aa, Influenza virus
YKSTQTAI

SEQ ID NO: 423845 - protein, 8 aa, Influenza virus
TKYRTESL

SEQ ID NO: 423846 - protein, 8 aa, Influenza virus
NRLNINSV

SEQ ID NO: 423847 - protein, 8 aa, Influenza virus
FGASCFTL

SEQ ID NO: 423848 - protein, 8 aa, Influenza virus
KYGSGRIF

SEQ ID NO: 423849 - protein, 8 aa, Influenza virus
LTLKSEQF

SEQ ID NO: 423850 - protein, 8 aa, Influenza virus
GLNVGLHL

SEQ ID NO: 423851 - protein, 8 aa, Influenza virus
FEFIAEDF

SEQ ID NO: 423852 - protein, 8 aa, Influenza virus
ARQMVQAM

SEQ ID NO: 423853 - protein, 8 aa, Influenza virus
WQGANRPI

SEQ ID NO: 423854 - protein, 8 aa, Influenza virus
TVKDRSPY

SEQ ID NO: 423855 - protein, 8 aa, Influenza virus
KLCKLNGI

SEQ ID NO: 423856 - protein, 8 aa, Influenza virus
YNAELIVL

SEQ ID NO: 423857 - protein, 8 aa, Influenza virus
TSNSIIVF

SEQ ID NO: 423858 - protein, 8 aa, Influenza virus
RARIKTRL

SEQ ID NO: 423859 - protein, 8 aa, Influenza virus
RSGFEMLK

SEQ ID NO: 423860 - protein, 8 aa, Influenza virus
RRINMLAD

SEQ ID NO: 423861 - protein, 8 aa, Influenza virus
SPRTVGQC

SEQ ID NO: 423862 - protein, 8 aa, Influenza virus
IEERINRL

SEQ ID NO: 423863 - protein, 8 aa, Influenza virus
SSFSFGGF

SEQ ID NO: 423864 - protein, 8 aa, Influenza virus
RASFLRGK

SEQ ID NO: 423865 - protein, 8 aa, Influenza virus
LINGWYGF

SEQ ID NO: 423866 - protein, 8 aa, Influenza virus
RRDQKALK

SEQ ID NO: 423867 - protein, 8 aa, Influenza virus
HSRSGFEM

SEQ ID NO: 423868 - protein, 8 aa, Influenza virus
LERRIESL

SEQ ID NO: 423869 - protein, 8 aa, Influenza virus
VISSDLSY

SEQ ID NO: 423870 - protein, 8 aa, Influenza virus
RRILKENA

SEQ ID NO: 423871 - protein, 8 aa, Influenza virus
SFYRSMKW

SEQ ID NO: 423872 - protein, 8 aa, Influenza virus
GLNMSLHL

SEQ ID NO: 423873 - protein, 8 aa, Influenza virus
RRQKWWVW

SEQ ID NO: 423874 - protein, 8 aa, Influenza virus
IRLFDYSK

SEQ ID NO: 423875 - protein, 8 aa, Influenza virus
GRYSRADK

SEQ ID NO: 423876 - protein, 8 aa, Influenza virus
IRMAINLV

SEQ ID NO: 423877 - protein, 8 aa, Influenza virus
LVNTYQWV

SEQ ID NO: 423878 - protein, 8 aa, Influenza virus
GLRNVPQM

SEQ ID NO: 423879 - protein, 8 aa, Influenza virus
TMTITFLI

SEQ ID NO: 423880 - protein, 8 aa, Influenza virus
SRSGFEVI

SEQ ID NO: 423881 - protein, 8 aa, Influenza virus
KEKEICSV

SEQ ID NO: 423882 - protein, 8 aa, Influenza virus
SSFQVDCF

SEQ ID NO: 423883 - protein, 8 aa, Influenza virus
TELGSPLV

SEQ ID NO: 423884 - protein, 8 aa, Influenza virus
FRNMIWLI

SEQ ID NO: 423885 - protein, 8 aa, Influenza virus
QIAGFAPF

SEQ ID NO: 423886 - protein, 8 aa, Influenza virus
THLEVCFM

SEQ ID NO: 423887 - protein, 8 aa, Influenza virus
LILGFVLW

SEQ ID NO: 423888 - protein, 8 aa, Influenza virus
SLRLATGL

SEQ ID NO: 423889 - protein, 8 aa, Influenza virus
TIHDRSQF

SEQ ID NO: 423890 - protein, 8 aa, Influenza virus
RSGYEMLK

SEQ ID NO: 423891 - protein, 8 aa, Influenza virus
NMSLNISL

SEQ ID NO: 423892 - protein, 8 aa, Influenza virus
MTFYWTII

SEQ ID NO: 423893 - protein, 8 aa, Influenza virus
KPKYLPDL

SEQ ID NO: 423894 - protein, 8 aa, Influenza virus
FVYFVEIL

SEQ ID NO: 423895 - protein, 8 aa, Influenza virus
INYENNTW

SEQ ID NO: 423896 - protein, 8 aa, Influenza virus
TVKDRSPF

SEQ ID NO: 423897 - protein, 8 aa, Influenza virus
LAALNMGF

SEQ ID NO: 423898 - protein, 8 aa, Influenza virus
TITYSSPM

SEQ ID NO: 423899 - protein, 8 aa, Influenza virus
LTLKLGQF

SEQ ID NO: 423900 - protein, 8 aa, Influenza virus
STWVSQTY

SEQ ID NO: 423901 - protein, 8 aa, Influenza virus
MKRKRNSS

SEQ ID NO: 423902 - protein, 8 aa, Influenza virus
ASMRRDYF

SEQ ID NO: 423903 - protein, 8 aa, Influenza virus
YGVKGFAF

SEQ ID NO: 423904 - protein, 8 aa, Influenza virus
VEALARSI

SEQ ID NO: 423905 - protein, 8 aa, Influenza virus
LTHQSGTY

SEQ ID NO: 423906 - protein, 8 aa, Influenza virus
EVRRRLST

SEQ ID NO: 423907 - protein, 8 aa, Influenza virus
RRVWRQAN

SEQ ID NO: 423908 - protein, 8 aa, Influenza virus
FRNMIWLI

SEQ ID NO: 423909 - protein, 8 aa, Influenza virus
KYVRSEKL

SEQ ID NO: 423910 - protein, 8 aa, Influenza virus
GPRNVPQA

SEQ ID NO: 423911 - protein, 8 aa, Influenza virus
NIRCTFCI

SEQ ID NO: 423912 - protein, 8 aa, Influenza virus
WVWLWLVL

SEQ ID NO: 423913 - protein, 8 aa, Influenza virus
FIMWTCNS

SEQ ID NO: 423914 - protein, 8 aa, Influenza virus
FALIVNAL

SEQ ID NO: 423915 - protein, 8 aa, Influenza virus
GRVTVSTR

SEQ ID NO: 423916 - protein, 8 aa, Influenza virus
MMAMKYPI

SEQ ID NO: 423917 - protein, 8 aa, Influenza virus
KEPDTYDF

SEQ ID NO: 423918 - protein, 8 aa, Influenza virus
TTVDHMAI

SEQ ID NO: 423919 - protein, 8 aa, Influenza virus
FEAVGKEF

SEQ ID NO: 423920 - protein, 8 aa, Influenza virus
GRLVRFRH

SEQ ID NO: 423921 - protein, 8 aa, Influenza virus
TQMAIDNM

SEQ ID NO: 423922 - protein, 8 aa, Influenza virus
RMDYYWAV

SEQ ID NO: 423923 - protein, 8 aa, Influenza virus
SLSYSTGA

SEQ ID NO: 423924 - protein, 8 aa, Influenza virus
MEMRRCLL

SEQ ID NO: 423925 - protein, 8 aa, Influenza virus
GSIRNGTY

SEQ ID NO: 423926 - protein, 8 aa, Influenza virus
HSNNSTKK

SEQ ID NO: 423927 - protein, 8 aa, Influenza virus
AVNQITGK

SEQ ID NO: 423928 - protein, 8 aa, Influenza virus
FIVEKFQW

SEQ ID NO: 423929 - protein, 8 aa, Influenza virus
MQALQLLL

SEQ ID NO: 423930 - protein, 8 aa, Influenza virus
YSKVYKTY

SEQ ID NO: 423931 - protein, 8 aa, Influenza virus
FLLMDALK

SEQ ID NO: 423932 - protein, 8 aa, Influenza virus
NQEELRFL

SEQ ID NO: 423933 - protein, 8 aa, Influenza virus
SRSIIFNM

SEQ ID NO: 423934 - protein, 8 aa, Influenza virus
WESLAGTA

SEQ ID NO: 423935 - protein, 8 aa, Influenza virus
NEDGNIIF

SEQ ID NO: 423936 - protein, 8 aa, Influenza virus
RIQDIWAY

SEQ ID NO: 423937 - protein, 8 aa, Influenza virus
MNNEGSYF

SEQ ID NO: 423938 - protein, 8 aa, Influenza virus
DMSNDGSY

SEQ ID NO: 423939 - protein, 8 aa, Influenza virus
SRINGVKL

SEQ ID NO: 423940 - protein, 8 aa, Influenza virus
RPGETLNV

SEQ ID NO: 423941 - protein, 8 aa, Influenza virus
SFYRSMRW

SEQ ID NO: 423942 - protein, 8 aa, Influenza virus
TYSSSLMW

SEQ ID NO: 423943 - protein, 8 aa, Influenza virus
WSYNAQLL

SEQ ID NO: 423944 - protein, 8 aa, Influenza virus
KETGNGCF

SEQ ID NO: 423945 - protein, 8 aa, Influenza virus
TPKRNRSI

SEQ ID NO: 423946 - protein, 8 aa, Influenza virus
RATAILRK

SEQ ID NO: 423947 - protein, 8 aa, Influenza virus
RIFQSGIR

SEQ ID NO: 423948 - protein, 8 aa, Influenza virus
ILIAGGLI

SEQ ID NO: 423949 - protein, 8 aa, Influenza virus
STWVSQTY

SEQ ID NO: 423950 - protein, 8 aa, Influenza virus
VSVGSGSF

SEQ ID NO: 423951 - protein, 8 aa, Influenza virus
TQRAIDNM

SEQ ID NO: 423952 - protein, 8 aa, Influenza virus
SLDEQNKL

SEQ ID NO: 423953 - protein, 8 aa, Influenza virus
LMIWHSNL

SEQ ID NO: 423954 - protein, 8 aa, Influenza virus
SGYSGSFM

SEQ ID NO: 423955 - protein, 8 aa, Influenza virus
SFYSEMKW

SEQ ID NO: 423956 - protein, 8 aa, Influenza virus
KPKSLPDL

SEQ ID NO: 423957 - protein, 8 aa, Influenza virus
NTYDHSKY

SEQ ID NO: 423958 - protein, 8 aa, Influenza virus
LSIYSTAA

SEQ ID NO: 423959 - protein, 8 aa, Influenza virus
MKWLSSSM

SEQ ID NO: 423960 - protein, 8 aa, Influenza virus
VIVENNNW

SEQ ID NO: 423961 - protein, 8 aa, Influenza virus
CHDGRARM

SEQ ID NO: 423962 - protein, 8 aa, Influenza virus
SRYGYEML

SEQ ID NO: 423963 - protein, 8 aa, Influenza virus
YRNLIWLV

SEQ ID NO: 423964 - protein, 8 aa, Influenza virus
STYQNNFV

SEQ ID NO: 423965 - protein, 8 aa, Influenza virus
QPNDGQVL

SEQ ID NO: 423966 - protein, 8 aa, Influenza virus
QESECACI

SEQ ID NO: 423967 - protein, 8 aa, Influenza virus
YRYGNGVW

SEQ ID NO: 423968 - protein, 8 aa, Influenza virus
SLCEVNSW

SEQ ID NO: 423969 - protein, 8 aa, Influenza virus
KYVKSDRL

SEQ ID NO: 423970 - protein, 8 aa, Influenza virus
AIVTREPY

SEQ ID NO: 423971 - protein, 8 aa, Influenza virus
SFYRSINW

SEQ ID NO: 423972 - protein, 8 aa, Influenza virus
YQRSKFLL

SEQ ID NO: 423973 - protein, 8 aa, Influenza virus
RMEFSWTL

SEQ ID NO: 423974 - protein, 8 aa, Influenza virus
KATAILRK

SEQ ID NO: 423975 - protein, 8 aa, Influenza virus
AMRTIGTH

SEQ ID NO: 423976 - protein, 8 aa, Influenza virus
FQVDCYLW

SEQ ID NO: 423977 - protein, 8 aa, Influenza virus
SKINGVIL

SEQ ID NO: 423978 - protein, 8 aa, Influenza virus
FEFIVEKF

SEQ ID NO: 423979 - protein, 8 aa, Influenza virus
RIQIDPVK

SEQ ID NO: 423980 - protein, 8 aa, Influenza virus
RQTYDWTL

SEQ ID NO: 423981 - protein, 8 aa, Influenza virus
TLVSTKSW

SEQ ID NO: 423982 - protein, 8 aa, Influenza virus
RRQILRTQ

SEQ ID NO: 423983 - protein, 8 aa, Influenza virus
WQGANRPV

SEQ ID NO: 423984 - protein, 8 aa, Influenza virus
AYISFRNL

SEQ ID NO: 423985 - protein, 8 aa, Influenza virus
GVYQILAI

SEQ ID NO: 423986 - protein, 8 aa, Influenza virus
FQKNAKVL

SEQ ID NO: 423987 - protein, 8 aa, Influenza virus
NQSGRISI

SEQ ID NO: 423988 - protein, 8 aa, Influenza virus
STDTVDTV

SEQ ID NO: 423989 - protein, 8 aa, Influenza virus
FSMSCFVF

SEQ ID NO: 423990 - protein, 8 aa, Influenza virus
GTYDYPHY

SEQ ID NO: 423991 - protein, 8 aa, Influenza virus
SQTVINNY

SEQ ID NO: 423992 - protein, 8 aa, Influenza virus
KRMGVQLQ

SEQ ID NO: 423993 - protein, 8 aa, Influenza virus
PTTEINTW

SEQ ID NO: 423994 - protein, 8 aa, Influenza virus
APKYGYII

SEQ ID NO: 423995 - protein, 8 aa, Influenza virus
SRYICSGL

SEQ ID NO: 423996 - protein, 8 aa, Influenza virus
TFYRNMRW

SEQ ID NO: 423997 - protein, 8 aa, Influenza virus
AINQINGK

SEQ ID NO: 423998 - protein, 8 aa, Influenza virus
YIKSGQLK

SEQ ID NO: 423999 - protein, 8 aa, Influenza virus
TANSIIVF

SEQ ID NO: 424000 - protein, 8 aa, Influenza virus
NIYKILSI

SEQ ID NO: 424001 - protein, 8 aa, Influenza virus
HNVHRSTI

SEQ ID NO: 424002 - protein, 8 aa, Influenza virus
YLTGTWDT

SEQ ID NO: 424003 - protein, 8 aa, Influenza virus
EVITAQEL

SEQ ID NO: 424004 - protein, 8 aa, Influenza virus
RFLFSSIK

SEQ ID NO: 424005 - protein, 8 aa, Influenza virus
ATRLYVNK

SEQ ID NO: 424006 - protein, 8 aa, Influenza virus
SIVRRATV

SEQ ID NO: 424007 - protein, 8 aa, Influenza virus
SLESRSGF

SEQ ID NO: 424008 - protein, 8 aa, Influenza virus
WSGYSGIF

SEQ ID NO: 424009 - protein, 8 aa, Influenza virus
IASMRRSY

SEQ ID NO: 424010 - protein, 8 aa, Influenza virus
SFGGFTFK

SEQ ID NO: 424011 - protein, 8 aa, Influenza virus
LENSHPGI

SEQ ID NO: 424012 - protein, 8 aa, Influenza virus
LLEKNVTV

SEQ ID NO: 424013 - protein, 8 aa, Influenza virus
AIMIAGIF

SEQ ID NO: 424014 - protein, 8 aa, Influenza virus
GLVLGNPM

SEQ ID NO: 424015 - protein, 8 aa, Influenza virus
SVSSFEKF

SEQ ID NO: 424016 - protein, 8 aa, Influenza virus
LLLAFILW

SEQ ID NO: 424017 - protein, 8 aa, Influenza virus
DANVHNLY

SEQ ID NO: 424018 - protein, 8 aa, Influenza virus
RLGKGYMF

SEQ ID NO: 424019 - protein, 8 aa, Influenza virus
MRTFFGWK

SEQ ID NO: 424020 - protein, 8 aa, Influenza virus
LILRDCSV

SEQ ID NO: 424021 - protein, 8 aa, Influenza virus
SVWAGRTM

SEQ ID NO: 424022 - protein, 8 aa, Influenza virus
FQKDAKIL

SEQ ID NO: 424023 - protein, 8 aa, Influenza virus
GTYDYSKY

SEQ ID NO: 424024 - protein, 8 aa, Influenza virus
SLMLATGM

SEQ ID NO: 424025 - protein, 8 aa, Influenza virus
GTYNYPKY

SEQ ID NO: 424026 - protein, 8 aa, Influenza virus
HANNSTTK

SEQ ID NO: 424027 - protein, 8 aa, Influenza virus
SEAPGWSW

SEQ ID NO: 424028 - protein, 8 aa, Influenza virus
RRNYFTAE

SEQ ID NO: 424029 - protein, 8 aa, Influenza virus
IMINPVKL

SEQ ID NO: 424030 - protein, 8 aa, Influenza virus
LILAFIMW

SEQ ID NO: 424031 - protein, 8 aa, Influenza virus
CHDGMSRM

SEQ ID NO: 424032 - protein, 8 aa, Influenza virus
MTHTSQYI

SEQ ID NO: 424033 - protein, 8 aa, Influenza virus
SFYRGMRW

SEQ ID NO: 424034 - protein, 8 aa, Influenza virus
PEWFRNVL

SEQ ID NO: 424035 - protein, 8 aa, Influenza virus
KAVKLYRK

SEQ ID NO: 424036 - protein, 8 aa, Influenza virus
KYVEDTKI

SEQ ID NO: 424037 - protein, 8 aa, Influenza virus
APDRASFF

SEQ ID NO: 424038 - protein, 8 aa, Influenza virus
QASYRIFK

SEQ ID NO: 424039 - protein, 8 aa, Influenza virus
KYSRADKI

SEQ ID NO: 424040 - protein, 8 aa, Influenza virus
KMFDFTKW

SEQ ID NO: 424041 - protein, 8 aa, Influenza virus
ALGQGTTL

SEQ ID NO: 424042 - protein, 8 aa, Influenza virus
GLNIGLHL

SEQ ID NO: 424043 - protein, 8 aa, Influenza virus
SLKLASGL

SEQ ID NO: 424044 - protein, 8 aa, Influenza virus
GIITDTLK

SEQ ID NO: 424045 - protein, 8 aa, Influenza virus
IRQEMASK

SEQ ID NO: 424046 - protein, 8 aa, Influenza virus
LVAGWYGF

SEQ ID NO: 424047 - protein, 8 aa, Influenza virus
RTLDFHDF

SEQ ID NO: 424048 - protein, 8 aa, Influenza virus
YNAQLLVW

SEQ ID NO: 424049 - protein, 8 aa, Influenza virus
TRQMVHAM

SEQ ID NO: 424050 - protein, 8 aa, Influenza virus
ATKLYVNK

SEQ ID NO: 424051 - protein, 8 aa, Influenza virus
VIAKDNAV

SEQ ID NO: 424052 - protein, 8 aa, Influenza virus
ALALSHTA

SEQ ID NO: 424053 - protein, 8 aa, Influenza virus
TFDIGGLY

SEQ ID NO: 424054 - protein, 8 aa, Influenza virus
FRNMVWLI

SEQ ID NO: 424055 - protein, 8 aa, Influenza virus
AESRKMLL

SEQ ID NO: 424056 - protein, 8 aa, Influenza virus
NRMQINPV

SEQ ID NO: 424057 - protein, 8 aa, Influenza virus
VSWTSNSI

SEQ ID NO: 424058 - protein, 8 aa, Influenza virus
LVAGWYGF

SEQ ID NO: 424059 - protein, 8 aa, Influenza virus
CYHSGGTI

SEQ ID NO: 424060 - protein, 8 aa, Influenza virus
GRMTFYWT

SEQ ID NO: 424061 - protein, 8 aa, Influenza virus
DRSPYRAL

SEQ ID NO: 424062 - protein, 8 aa, Influenza virus
CFVFVALI

SEQ ID NO: 424063 - protein, 8 aa, Influenza virus
RALTLNTM

SEQ ID NO: 424064 - protein, 8 aa, Influenza virus
YLEEHPST

SEQ ID NO: 424065 - protein, 8 aa, Influenza virus
LPACVYGL

SEQ ID NO: 424066 - protein, 8 aa, Influenza virus
RADTRILF

SEQ ID NO: 424067 - protein, 8 aa, Influenza virus
DRSQFRAL

SEQ ID NO: 424068 - protein, 8 aa, Influenza virus
GIYKILTI

SEQ ID NO: 424069 - protein, 8 aa, Influenza virus
GVQLQRFK

SEQ ID NO: 424070 - protein, 8 aa, Influenza virus
RRQLRENA

SEQ ID NO: 424071 - protein, 8 aa, Influenza virus
FEVVDHEF

SEQ ID NO: 424072 - protein, 8 aa, Influenza virus
FFGAIAGF

SEQ ID NO: 424073 - protein, 8 aa, Influenza virus
LTVPEWSY

SEQ ID NO: 424074 - protein, 8 aa, Influenza virus
MMAGLSFW

SEQ ID NO: 424075 - protein, 8 aa, Influenza virus
CSVAGWLL

SEQ ID NO: 424076 - protein, 8 aa, Influenza virus
SVSSFKRF

SEQ ID NO: 424077 - protein, 8 aa, Influenza virus
FGDNAEEY

SEQ ID NO: 424078 - protein, 8 aa, Influenza virus
FIERPTAV

SEQ ID NO: 424079 - protein, 8 aa, Influenza virus
ESAVLRGF

SEQ ID NO: 424080 - protein, 8 aa, Influenza virus
YRNLVWFI

SEQ ID NO: 424081 - protein, 8 aa, Influenza virus
NTYDHTKY

SEQ ID NO: 424082 - protein, 8 aa, Influenza virus
WMKIYWSL

SEQ ID NO: 424083 - protein, 8 aa, Influenza virus
IRVGCVIL

SEQ ID NO: 424084 - protein, 8 aa, Influenza virus
NTYDHKKY

SEQ ID NO: 424085 - protein, 8 aa, Influenza virus
TEIIIRMM

SEQ ID NO: 424086 - protein, 8 aa, Influenza virus
KAAIGLRI

SEQ ID NO: 424087 - protein, 8 aa, Influenza virus
KMFDFSKW

SEQ ID NO: 424088 - protein, 8 aa, Influenza virus
GLRNVPQV

SEQ ID NO: 424089 - protein, 8 aa, Influenza virus
FSSLTVSV

SEQ ID NO: 424090 - protein, 8 aa, Influenza virus
YVKQSTLK

SEQ ID NO: 424091 - protein, 8 aa, Influenza virus
ILEKNITV

SEQ ID NO: 424092 - protein, 8 aa, Influenza virus
SLYDKVRM

SEQ ID NO: 424093 - protein, 8 aa, Influenza virus
QGFAPFSK

SEQ ID NO: 424094 - protein, 8 aa, Influenza virus
FESTGNLV

SEQ ID NO: 424095 - protein, 8 aa, Influenza virus
RIRIDPVK

SEQ ID NO: 424096 - protein, 8 aa, Influenza virus
RTSISCLY

SEQ ID NO: 424097 - protein, 8 aa, Influenza virus
NRIQIDAV

SEQ ID NO: 424098 - protein, 8 aa, Influenza virus
KGFNSFYR

SEQ ID NO: 424099 - protein, 8 aa, Influenza virus
RYVEDTKI

SEQ ID NO: 424100 - protein, 8 aa, Influenza virus
NLDYQIGY

SEQ ID NO: 424101 - protein, 8 aa, Influenza virus
YAFGICPK

SEQ ID NO: 424102 - protein, 8 aa, Influenza virus
RQEKNPAL

SEQ ID NO: 424103 - protein, 8 aa, Influenza virus
LVRGNSPA

SEQ ID NO: 424104 - protein, 8 aa, Influenza virus
KLYVWGVH

SEQ ID NO: 424105 - protein, 8 aa, Influenza virus
NIVRRATV

SEQ ID NO: 424106 - protein, 8 aa, Influenza virus
FYRSIRWL

SEQ ID NO: 424107 - protein, 8 aa, Influenza virus
ISIYWTLV

SEQ ID NO: 424108 - protein, 8 aa, Influenza virus
GSFYRSMR

SEQ ID NO: 424109 - protein, 8 aa, Influenza virus
IEKEFSEI

SEQ ID NO: 424110 - protein, 8 aa, Influenza virus
SSMNNQVF

SEQ ID NO: 424111 - protein, 8 aa, Influenza virus
SRYVCSGL

SEQ ID NO: 424112 - protein, 8 aa, Influenza virus
WSYNAQLL

SEQ ID NO: 424113 - protein, 8 aa, Influenza virus
SLTEIWSY

SEQ ID NO: 424114 - protein, 8 aa, Influenza virus
SWMKIYWV

SEQ ID NO: 424115 - protein, 8 aa, Influenza virus
RGFLIIGK

SEQ ID NO: 424116 - protein, 8 aa, Influenza virus
WPLSSPPT

SEQ ID NO: 424117 - protein, 8 aa, Influenza virus
SMFLYVRT

SEQ ID NO: 424118 - protein, 8 aa, Influenza virus
RALMSVPM

SEQ ID NO: 424119 - protein, 8 aa, Influenza virus
RALMSVPL

SEQ ID NO: 424120 - protein, 8 aa, Influenza virus
KAAMGLKI

SEQ ID NO: 424121 - protein, 8 aa, Influenza virus
RQTYDWTL

SEQ ID NO: 424122 - protein, 8 aa, Influenza virus
RALMSCPL

SEQ ID NO: 424123 - protein, 8 aa, Influenza virus
IYNETVRL

SEQ ID NO: 424124 - protein, 8 aa, Influenza virus
HQYSERGK

SEQ ID NO: 424125 - protein, 8 aa, Influenza virus
ALHQGTTI

SEQ ID NO: 424126 - protein, 8 aa, Influenza virus
TTAVAVLK

SEQ ID NO: 424127 - protein, 8 aa, Influenza virus
WIRFNSDL

SEQ ID NO: 424128 - protein, 8 aa, Influenza virus
VPKRNRSI

SEQ ID NO: 424129 - protein, 8 aa, Influenza virus
TSNQGSFY

SEQ ID NO: 424130 - protein, 8 aa, Influenza virus
SFYAEMEW

SEQ ID NO: 424131 - protein, 8 aa, Influenza virus
GTYDHKEF

SEQ ID NO: 424132 - protein, 8 aa, Influenza virus
TFDIEGLY

SEQ ID NO: 424133 - protein, 8 aa, Influenza virus
FLMQITIL

SEQ ID NO: 424134 - protein, 8 aa, Influenza virus
KLNRLIER

SEQ ID NO: 424135 - protein, 8 aa, Influenza virus
ITVGSSNY

SEQ ID NO: 424136 - protein, 8 aa, Influenza virus
DECRFYAL

SEQ ID NO: 424137 - protein, 8 aa, Influenza virus
VSWTSNSM

SEQ ID NO: 424138 - protein, 8 aa, Influenza virus
FALSGVAI

SEQ ID NO: 424139 - protein, 8 aa, Influenza virus
IVALCGSK

SEQ ID NO: 424140 - protein, 8 aa, Influenza virus
CQLNEGVM

SEQ ID NO: 424141 - protein, 8 aa, Influenza virus
CMRTFFGW

SEQ ID NO: 424142 - protein, 8 aa, Influenza virus
FEATGNLV

SEQ ID NO: 424143 - protein, 8 aa, Influenza virus
KAALGLRI

SEQ ID NO: 424144 - protein, 8 aa, Influenza virus
MTLSVVSL

SEQ ID NO: 424145 - protein, 8 aa, Influenza virus
RMEFSWTI

SEQ ID NO: 424146 - protein, 8 aa, Influenza virus
SVQSRGLF

SEQ ID NO: 424147 - protein, 8 aa, Influenza virus
GLLDVWTY

SEQ ID NO: 424148 - protein, 8 aa, Influenza virus
SFYAELRW

SEQ ID NO: 424149 - protein, 8 aa, Influenza virus
SRLNRQEI

SEQ ID NO: 424150 - protein, 8 aa, Influenza virus
IQNEDIPI

SEQ ID NO: 424151 - protein, 8 aa, Influenza virus
APPEQSRM

SEQ ID NO: 424152 - protein, 8 aa, Influenza virus
FELINNEF

SEQ ID NO: 424153 - protein, 8 aa, Influenza virus
RAVKLYRK

SEQ ID NO: 424154 - protein, 8 aa, Influenza virus
HGVKGFSF

SEQ ID NO: 424155 - protein, 8 aa, Influenza virus
GTNNYGVK

SEQ ID NO: 424156 - protein, 8 aa, Influenza virus
MLLIVQAL

SEQ ID NO: 424157 - protein, 8 aa, Influenza virus
DRIPHRTL

SEQ ID NO: 424158 - protein, 8 aa, Influenza virus
RKRMTRGL

SEQ ID NO: 424159 - protein, 8 aa, Influenza virus
QAYTKVMY

SEQ ID NO: 424160 - protein, 8 aa, Influenza virus
VEQEIRAF

SEQ ID NO: 424161 - protein, 8 aa, Influenza virus
HKMESRGL

SEQ ID NO: 424162 - protein, 8 aa, Influenza virus
QINGKLNK

SEQ ID NO: 424163 - protein, 8 aa, Influenza virus
RTLMSVEI

SEQ ID NO: 424164 - protein, 8 aa, Influenza virus
AATVTLHF

SEQ ID NO: 424165 - protein, 8 aa, Influenza virus
MSDIEAMA

SEQ ID NO: 424166 - protein, 8 aa, Influenza virus
ITYSSPMM

SEQ ID NO: 424167 - protein, 8 aa, Influenza virus
LEVGTRWM

SEQ ID NO: 424168 - protein, 8 aa, Influenza virus
LRDNAKEL

SEQ ID NO: 424169 - protein, 8 aa, Influenza virus
NKCYQFAL

SEQ ID NO: 424170 - protein, 8 aa, Influenza virus
FYRSVRWL

SEQ ID NO: 424171 - protein, 8 aa, Influenza virus
PADTRVYY

SEQ ID NO: 424172 - protein, 8 aa, Influenza virus
QITGFAPF

SEQ ID NO: 424173 - protein, 8 aa, Influenza virus
VLKPGQTV

SEQ ID NO: 424174 - protein, 8 aa, Influenza virus
SPRSRSGF

SEQ ID NO: 424175 - protein, 8 aa, Influenza virus
SLQFRICI

SEQ ID NO: 424176 - protein, 8 aa, Influenza virus
FQKNAKVL

SEQ ID NO: 424177 - protein, 8 aa, Influenza virus
YLCTGILT

SEQ ID NO: 424178 - protein, 8 aa, Influenza virus
KSCVNRCF

SEQ ID NO: 424179 - protein, 8 aa, Influenza virus
LIDSIGSW

SEQ ID NO: 424180 - protein, 8 aa, Influenza virus
LAIYSTAA

SEQ ID NO: 424181 - protein, 8 aa, Influenza virus
WSYNADLL

SEQ ID NO: 424182 - protein, 8 aa, Influenza virus
GENSDVLV

SEQ ID NO: 424183 - protein, 8 aa, Influenza virus
SSTYQSNF

SEQ ID NO: 424184 - protein, 8 aa, Influenza virus
GYQSLRSI

SEQ ID NO: 424185 - protein, 8 aa, Influenza virus
NSFEQITF

SEQ ID NO: 424186 - protein, 8 aa, Influenza virus
SLLLQANL

SEQ ID NO: 424187 - protein, 8 aa, Influenza virus
RPKEMEGI

SEQ ID NO: 424188 - protein, 8 aa, Influenza virus
LSYSAGAL

SEQ ID NO: 424189 - protein, 8 aa, Influenza virus
RIDFHWLL

SEQ ID NO: 424190 - protein, 8 aa, Influenza virus
TEEQAVGI

SEQ ID NO: 424191 - protein, 8 aa, Influenza virus
CQTPLGAL

SEQ ID NO: 424192 - protein, 8 aa, Influenza virus
RIESLNKK

SEQ ID NO: 424193 - protein, 8 aa, Influenza virus
SLVLIVSL

SEQ ID NO: 424194 - protein, 8 aa, Influenza virus
EVKRRLST

SEQ ID NO: 424195 - protein, 8 aa, Influenza virus
GTIRNGTY

SEQ ID NO: 424196 - protein, 8 aa, Influenza virus
FRNMVWLI

SEQ ID NO: 424197 - protein, 8 aa, Influenza virus
YLWGVHHP

SEQ ID NO: 424198 - protein, 8 aa, Influenza virus
CIVPCFWL

SEQ ID NO: 424199 - protein, 8 aa, Influenza virus
KGMLGFVF

SEQ ID NO: 424200 - protein, 8 aa, Influenza virus
FAISCFLL

SEQ ID NO: 424201 - protein, 8 aa, Influenza virus
SQYICSPV

SEQ ID NO: 424202 - protein, 8 aa, Influenza virus
RANENDFF

SEQ ID NO: 424203 - protein, 8 aa, Influenza virus
NGMNRPIL

SEQ ID NO: 424204 - protein, 8 aa, Influenza virus
KMEKIVLL

SEQ ID NO: 424205 - protein, 8 aa, Influenza virus
FESNGGLL

SEQ ID NO: 424206 - protein, 8 aa, Influenza virus
SFYAELKW

SEQ ID NO: 424207 - protein, 8 aa, Influenza virus
LIRGNSPI

SEQ ID NO: 424208 - protein, 8 aa, Influenza virus
ITIGKCPK

SEQ ID NO: 424209 - protein, 8 aa, Influenza virus
VLFIEDGW

SEQ ID NO: 424210 - protein, 8 aa, Influenza virus
QIIDIWAY

SEQ ID NO: 424211 - protein, 8 aa, Influenza virus
FPQMTRSY

SEQ ID NO: 424212 - protein, 8 aa, Influenza virus
MKHTSQYL

SEQ ID NO: 424213 - protein, 8 aa, Influenza virus
NHTTINNI

SEQ ID NO: 424214 - protein, 8 aa, Influenza virus
IVLGIINL

SEQ ID NO: 424215 - protein, 8 aa, Influenza virus
KLRMATGL

SEQ ID NO: 424216 - protein, 8 aa, Influenza virus
MSELGVPF

SEQ ID NO: 424217 - protein, 8 aa, Influenza virus
VQNNYTTV

SEQ ID NO: 424218 - protein, 8 aa, Influenza virus
MKLYWHLM

SEQ ID NO: 424219 - protein, 8 aa, Influenza virus
RSRSGFEM

SEQ ID NO: 424220 - protein, 8 aa, Influenza virus
LRFVFSIA

SEQ ID NO: 424221 - protein, 8 aa, Influenza virus
GYSGSFII

SEQ ID NO: 424222 - protein, 8 aa, Influenza virus
VLNLLIGI

SEQ ID NO: 424223 - protein, 8 aa, Influenza virus
FESNGGFL

SEQ ID NO: 424224 - protein, 8 aa, Influenza virus
YLCAGLPS

SEQ ID NO: 424225 - protein, 8 aa, Influenza virus
EWSRRYEL

SEQ ID NO: 424226 - protein, 8 aa, Influenza virus
KIRRRVDM

SEQ ID NO: 424227 - protein, 8 aa, Influenza virus
SLQNRIQI

SEQ ID NO: 424228 - protein, 8 aa, Influenza virus
SLKLATGM

SEQ ID NO: 424229 - protein, 8 aa, Influenza virus
SRINRQEI

SEQ ID NO: 424230 - protein, 8 aa, Influenza virus
NWILWISF

SEQ ID NO: 424231 - protein, 8 aa, Influenza virus
GRIDFYWL

SEQ ID NO: 424232 - protein, 8 aa, Influenza virus
LVGINMSK

SEQ ID NO: 424233 - protein, 8 aa, Influenza virus
RRLSANAI

SEQ ID NO: 424234 - protein, 8 aa, Influenza virus
ILASSGSL

SEQ ID NO: 424235 - protein, 8 aa, Influenza virus
AETRIYYF

SEQ ID NO: 424236 - protein, 8 aa, Influenza virus
GVQIQRFK

SEQ ID NO: 424237 - protein, 8 aa, Influenza virus
TQAAIDQV

SEQ ID NO: 424238 - protein, 8 aa, Influenza virus
LILSFIMW

SEQ ID NO: 424239 - protein, 8 aa, Influenza virus
RIQIDQVK

SEQ ID NO: 424240 - protein, 8 aa, Influenza virus
LLLIVQAF

SEQ ID NO: 424241 - protein, 8 aa, Influenza virus
NVLSVAPI

SEQ ID NO: 424242 - protein, 8 aa, Influenza virus
GQGGRMEF

SEQ ID NO: 424243 - protein, 8 aa, Influenza virus
VANGTMVK

SEQ ID NO: 424244 - protein, 8 aa, Influenza virus
GTYDYPHY

SEQ ID NO: 424245 - protein, 8 aa, Influenza virus
RTLMSCPM

SEQ ID NO: 424246 - protein, 8 aa, Influenza virus
KYDNGVWI

SEQ ID NO: 424247 - protein, 8 aa, Influenza virus
FSFQLILL

SEQ ID NO: 424248 - protein, 8 aa, Influenza virus
GYSGSFTL

SEQ ID NO: 424249 - protein, 8 aa, Influenza virus
KTEDNIYK

SEQ ID NO: 424250 - protein, 8 aa, Influenza virus
IMEKNVTV

SEQ ID NO: 424251 - protein, 8 aa, Influenza virus
YLCAGIPS

SEQ ID NO: 424252 - protein, 8 aa, Influenza virus
GRMTDSIK

SEQ ID NO: 424253 - protein, 8 aa, Influenza virus
LLTEVETY

SEQ ID NO: 424254 - protein, 8 aa, Influenza virus
YINNTTII

SEQ ID NO: 424255 - protein, 8 aa, Influenza virus
CYHNGGTI

SEQ ID NO: 424256 - protein, 8 aa, Influenza virus
FSLGASCF

SEQ ID NO: 424257 - protein, 8 aa, Influenza virus
NLKLATGL

SEQ ID NO: 424258 - protein, 8 aa, Influenza virus
YIKQNTLK

SEQ ID NO: 424259 - protein, 8 aa, Influenza virus
APEYGHLI

SEQ ID NO: 424260 - protein, 8 aa, Influenza virus
IQIDSVKL

SEQ ID NO: 424261 - protein, 8 aa, Influenza virus
SLPLCPFK

SEQ ID NO: 424262 - protein, 8 aa, Influenza virus
KGILGFVF

SEQ ID NO: 424263 - protein, 8 aa, Influenza virus
RADTKILF

SEQ ID NO: 424264 - protein, 8 aa, Influenza virus
YKSTQSAI

SEQ ID NO: 424265 - protein, 8 aa, Influenza virus
CHDGRSRM

SEQ ID NO: 424266 - protein, 8 aa, Influenza virus
VPEWSYIM

SEQ ID NO: 424267 - protein, 8 aa, Influenza virus
ASGSSISF

SEQ ID NO: 424268 - protein, 8 aa, Influenza virus
QIIKLLPF

SEQ ID NO: 424269 - protein, 8 aa, Influenza virus
GLILGNPK

SEQ ID NO: 424270 - protein, 8 aa, Influenza virus
SSSYRRPI

SEQ ID NO: 424271 - protein, 8 aa, Influenza virus
YLIRALTL

SEQ ID NO: 424272 - protein, 8 aa, Influenza virus
PEWFRNIL

SEQ ID NO: 424273 - protein, 8 aa, Influenza virus
DRSPHRAL

SEQ ID NO: 424274 - protein, 8 aa, Influenza virus
GRCPRYVK

SEQ ID NO: 424275 - protein, 8 aa, Influenza virus
YMGECPKY

SEQ ID NO: 424276 - protein, 8 aa, Influenza virus
SFFRNIVW

SEQ ID NO: 424277 - protein, 8 aa, Influenza virus
TRFTYSGI

SEQ ID NO: 424278 - protein, 8 aa, Influenza virus
VTIGKCPK

SEQ ID NO: 424279 - protein, 8 aa, Influenza virus
PTAVDTCY

SEQ ID NO: 424280 - protein, 8 aa, Influenza virus
TSYKILSI

SEQ ID NO: 424281 - protein, 8 aa, Influenza virus
ASMRRNYF

SEQ ID NO: 424282 - protein, 8 aa, Influenza virus
KLYIWGVH

SEQ ID NO: 424283 - protein, 8 aa, Influenza virus
AIFRKATR

SEQ ID NO: 424284 - protein, 8 aa, Influenza virus
IQLIVSGK

SEQ ID NO: 424285 - protein, 8 aa, Influenza virus
KESLRLAV

SEQ ID NO: 424286 - protein, 8 aa, Influenza virus
STYQNSFV

SEQ ID NO: 424287 - protein, 8 aa, Influenza virus
ITNKVNSI

SEQ ID NO: 424288 - protein, 8 aa, Influenza virus
WMKIYWHL

SEQ ID NO: 424289 - protein, 8 aa, Influenza virus
VVDATETV

SEQ ID NO: 424290 - protein, 8 aa, Influenza virus
ATTVTLHF

SEQ ID NO: 424291 - protein, 8 aa, Influenza virus
SISCFLLA

SEQ ID NO: 424292 - protein, 8 aa, Influenza virus
ITIGKCSK

SEQ ID NO: 424293 - protein, 8 aa, Influenza virus
TEVYSETV

SEQ ID NO: 424294 - protein, 8 aa, Influenza virus
TRVYYFKK

SEQ ID NO: 424295 - protein, 8 aa, Influenza virus
RIDFHWLI

SEQ ID NO: 424296 - protein, 8 aa, Influenza virus
VGVAPSPY

SEQ ID NO: 424297 - protein, 8 aa, Influenza virus
KPKFLPDL

SEQ ID NO: 424298 - protein, 8 aa, Influenza virus
MALQLFIK

SEQ ID NO: 424299 - protein, 8 aa, Influenza virus
ALKLVVAM

SEQ ID NO: 424300 - protein, 8 aa, Influenza virus
SLRLAVGL

SEQ ID NO: 424301 - protein, 8 aa, Influenza virus
VLMENEMT

SEQ ID NO: 424302 - protein, 8 aa, Influenza virus
YKKLKREI

SEQ ID NO: 424303 - protein, 8 aa, Influenza virus
TRPILSPL

SEQ ID NO: 424304 - protein, 8 aa, Influenza virus
LIRGNSPI

SEQ ID NO: 424305 - protein, 8 aa, Influenza virus
SFYKSMRW

SEQ ID NO: 424306 - protein, 8 aa, Influenza virus
FFRNIVWL

SEQ ID NO: 424307 - protein, 8 aa, Influenza virus
HVDTIMEK

SEQ ID NO: 424308 - protein, 8 aa, Influenza virus
MRISNETI

SEQ ID NO: 424309 - protein, 8 aa, Influenza virus
STDTVDTI

SEQ ID NO: 424310 - protein, 8 aa, Influenza virus
YQAELLVA

SEQ ID NO: 424311 - protein, 8 aa, Influenza virus
QVTGFAPF

SEQ ID NO: 424312 - protein, 8 aa, Influenza virus
RISHRTLL

SEQ ID NO: 424313 - protein, 8 aa, Influenza virus
CPSPLRLI

SEQ ID NO: 424314 - protein, 8 aa, Influenza virus
FRNVVWLV

SEQ ID NO: 424315 - protein, 8 aa, Influenza virus
VANVNNLY

SEQ ID NO: 424316 - protein, 8 aa, Influenza virus
YVSMEFSL

SEQ ID NO: 424317 - protein, 8 aa, Influenza virus
FFRNMVWL

SEQ ID NO: 424318 - protein, 8 aa, Influenza virus
KTSWSYIV

SEQ ID NO: 424319 - protein, 8 aa, Influenza virus
FFRNMIWL

SEQ ID NO: 424320 - protein, 8 aa, Influenza virus
HQSGTYPI

SEQ ID NO: 424321 - protein, 8 aa, Influenza virus
TYQRTRAL

SEQ ID NO: 424322 - protein, 8 aa, Influenza virus
GTYDYPQY

SEQ ID NO: 424323 - protein, 8 aa, Influenza virus
RALMSVPM

SEQ ID NO: 424324 - protein, 8 aa, Influenza virus
VTVGSSKY

SEQ ID NO: 424325 - protein, 8 aa, Influenza virus
LMIWHSNL

SEQ ID NO: 424326 - protein, 8 aa, Influenza virus
SLQCRVCI

SEQ ID NO: 424327 - protein, 8 aa, Influenza virus
DEICIGYL

SEQ ID NO: 424328 - protein, 8 aa, Influenza virus
LRFVFSNA

SEQ ID NO: 424329 - protein, 8 aa, Influenza virus
SQRSKFLL

SEQ ID NO: 424330 - protein, 8 aa, Influenza virus
GPNNNASA

SEQ ID NO: 424331 - protein, 8 aa, Influenza virus
RMEFSWTL

SEQ ID NO: 424332 - protein, 8 aa, Influenza virus
YRNLVWLV

SEQ ID NO: 424333 - protein, 8 aa, Influenza virus
TSGSSIAF

SEQ ID NO: 424334 - protein, 8 aa, Influenza virus
AETRVYYF

SEQ ID NO: 424335 - protein, 8 aa, Influenza virus
SRFESVAW

SEQ ID NO: 424336 - protein, 8 aa, Influenza virus
RLRGIPPL

SEQ ID NO: 424337 - protein, 8 aa, Influenza virus
SQYLCTGI

SEQ ID NO: 424338 - protein, 8 aa, Influenza virus
APEFGYLL

SEQ ID NO: 424339 - protein, 8 aa, Influenza virus
RRLSTNAI

SEQ ID NO: 424340 - protein, 8 aa, Influenza virus
KTEDNVYK

SEQ ID NO: 424341 - protein, 8 aa, Influenza virus
AVTDVWSY

SEQ ID NO: 424342 - protein, 8 aa, Influenza virus
CHDGKGWL

SEQ ID NO: 424343 - protein, 8 aa, Influenza virus
GSANSQAY

SEQ ID NO: 424344 - protein, 8 aa, Influenza virus
SLQCRICI

SEQ ID NO: 424345 - protein, 8 aa, Influenza virus
WHDGAEIT

SEQ ID NO: 424346 - protein, 8 aa, Influenza virus
YIKQGSLK

SEQ ID NO: 424347 - protein, 8 aa, Influenza virus
ILGDCSVA

SEQ ID NO: 424348 - protein, 8 aa, Influenza virus
GVRLTQGY

SEQ ID NO: 424349 - protein, 8 aa, Influenza virus
LIAPWYGY

SEQ ID NO: 424350 - protein, 8 aa, Influenza virus
WREQLSQK

SEQ ID NO: 424351 - protein, 8 aa, Influenza virus
QYLLFQDI

SEQ ID NO: 424352 - protein, 8 aa, Influenza virus
KMITQRTI

SEQ ID NO: 424353 - protein, 8 aa, Influenza virus
VLIAGGLI

SEQ ID NO: 424354 - protein, 8 aa, Influenza virus
TIHDRSQY

SEQ ID NO: 424355 - protein, 8 aa, Influenza virus
WMKIYWVL

SEQ ID NO: 424356 - protein, 8 aa, Influenza virus
KGVKLSSM

SEQ ID NO: 424357 - protein, 8 aa, Influenza virus
MKTIIIVL

SEQ ID NO: 424358 - protein, 8 aa, Influenza virus
STSSRSGF

SEQ ID NO: 424359 - protein, 8 aa, Influenza virus
LTKGILGF

SEQ ID NO: 424360 - protein, 8 aa, Influenza virus
VIVDNNNW

SEQ ID NO: 424361 - protein, 8 aa, Influenza virus
ILTDSQTA

SEQ ID NO: 424362 - protein, 8 aa, Influenza virus
FSSLTVNV

SEQ ID NO: 424363 - protein, 8 aa, Influenza virus
FSFQLILL

SEQ ID NO: 424364 - protein, 8 aa, Influenza virus
TPLGSPPI

SEQ ID NO: 424365 - protein, 8 aa, Influenza virus
LSIYSSVA

SEQ ID NO: 424366 - protein, 8 aa, Influenza virus
GTYDYPQY

SEQ ID NO: 424367 - protein, 8 aa, Influenza virus
GRLIQNSI

SEQ ID NO: 424368 - protein, 8 aa, Influenza virus
VTYTGTSR

SEQ ID NO: 424369 - protein, 8 aa, Influenza virus
YLIRTLTL

SEQ ID NO: 424370 - protein, 8 aa, Influenza virus
DSEMSKLY

SEQ ID NO: 424371 - protein, 8 aa, Influenza virus
WVWLWLVL

SEQ ID NO: 424372 - protein, 8 aa, Influenza virus
KISHISPL

SEQ ID NO: 424373 - protein, 8 aa, Influenza virus
WTYNAELF

SEQ ID NO: 424374 - protein, 8 aa, Influenza virus
SLKLATGL

SEQ ID NO: 424375 - protein, 8 aa, Influenza virus
SLVLLVSL

SEQ ID NO: 424376 - protein, 8 aa, Influenza virus
KTWARNIL

SEQ ID NO: 424377 - protein, 8 aa, Influenza virus
SMVTFCGL

SEQ ID NO: 424378 - protein, 8 aa, Influenza virus
CPKYVRSA

SEQ ID NO: 424379 - protein, 8 aa, Influenza virus
MSRARIDA

SEQ ID NO: 424380 - protein, 8 aa, Influenza virus
SGVKGWAF

SEQ ID NO: 424381 - protein, 8 aa, Influenza virus
NSIRNGTY

SEQ ID NO: 424382 - protein, 8 aa, Influenza virus
GVAIALSV

SEQ ID NO: 424383 - protein, 8 aa, Influenza virus
SEIRTFSF

SEQ ID NO: 424384 - protein, 8 aa, Influenza virus
DRSPFRTL

SEQ ID NO: 424385 - protein, 8 aa, Influenza virus
ASDILTRM

SEQ ID NO: 424386 - protein, 8 aa, Influenza virus
ILHLILWI

SEQ ID NO: 424387 - protein, 8 aa, Influenza virus
RTSISCLY

SEQ ID NO: 424388 - protein, 8 aa, Influenza virus
KRCINRCF

SEQ ID NO: 424389 - protein, 8 aa, Influenza virus
QGFFPFHK

SEQ ID NO: 424390 - protein, 8 aa, Influenza virus
DELCPSPL

SEQ ID NO: 424391 - protein, 8 aa, Influenza virus
TYSSSMMW

SEQ ID NO: 424392 - protein, 8 aa, Influenza virus
RSSFYAEM

SEQ ID NO: 424393 - protein, 8 aa, Influenza virus
NLEELRFV

SEQ ID NO: 424394 - protein, 8 aa, Influenza virus
SRFQIQGV

SEQ ID NO: 424395 - protein, 8 aa, Influenza virus
CVLEAMAF

SEQ ID NO: 424396 - protein, 8 aa, Influenza virus
NGRAPISL

SEQ ID NO: 424397 - protein, 8 aa, Influenza virus
GTYSYPQY

SEQ ID NO: 424398 - protein, 8 aa, Influenza virus
VSWTSNSM

SEQ ID NO: 424399 - protein, 8 aa, Influenza virus
VLEDEQMY

SEQ ID NO: 424400 - protein, 8 aa, Influenza virus
RRAIATPG

SEQ ID NO: 424401 - protein, 8 aa, Influenza virus
STAVAVIK

SEQ ID NO: 424402 - protein, 8 aa, Influenza virus
ILKPGQTV

SEQ ID NO: 424403 - protein, 8 aa, Influenza virus
LSGREWSY

SEQ ID NO: 424404 - protein, 8 aa, Influenza virus
FIMWACNS

SEQ ID NO: 424405 - protein, 8 aa, Influenza virus
SFYAEMKW

SEQ ID NO: 424406 - protein, 8 aa, Influenza virus
SQGTKRPY

SEQ ID NO: 424407 - protein, 8 aa, Influenza virus
YKSTPSAI

SEQ ID NO: 424408 - protein, 8 aa, Influenza virus
SRLNRNEI

SEQ ID NO: 424409 - protein, 8 aa, Influenza virus
MRCTISLV

SEQ ID NO: 424410 - protein, 8 aa, Influenza virus
SFYRSIRW

SEQ ID NO: 424411 - protein, 8 aa, Influenza virus
SVKLSSGY

SEQ ID NO: 424412 - protein, 8 aa, Influenza virus
SFFSKLNW

SEQ ID NO: 424413 - protein, 8 aa, Influenza virus
NARLLVLL

SEQ ID NO: 424414 - protein, 8 aa, Influenza virus
FGASCFIL

SEQ ID NO: 424415 - protein, 8 aa, Influenza virus
GTYNHREY

SEQ ID NO: 424416 - protein, 8 aa, Influenza virus
LIRHENRM

SEQ ID NO: 424417 - protein, 8 aa, Influenza virus
VWWTANSI

SEQ ID NO: 424418 - protein, 8 aa, Influenza virus
AMQNRIQI

SEQ ID NO: 424419 - protein, 8 aa, Influenza virus
SRVDNHSM

SEQ ID NO: 424420 - protein, 8 aa, Influenza virus
WRGSNRPV

SEQ ID NO: 424421 - protein, 8 aa, Influenza virus
TVVLNTDW

SEQ ID NO: 424422 - protein, 8 aa, Influenza virus
SPRSRNGF

SEQ ID NO: 424423 - protein, 8 aa, Influenza virus
GTYNYPQY

SEQ ID NO: 424424 - protein, 8 aa, Influenza virus
ERNVTETL

SEQ ID NO: 424425 - protein, 8 aa, Influenza virus
VTTVTLHF

SEQ ID NO: 424426 - protein, 8 aa, Influenza virus
SECYNPCF

SEQ ID NO: 424427 - protein, 8 aa, Influenza virus
LTDNHVEV

SEQ ID NO: 424428 - protein, 8 aa, Influenza virus
GLVFMCVK

SEQ ID NO: 424429 - protein, 8 aa, Influenza virus
GVYQILSI

SEQ ID NO: 424430 - protein, 8 aa, Influenza virus
RRSYFTAE

SEQ ID NO: 424431 - protein, 8 aa, Influenza virus
LRDNANDL

SEQ ID NO: 424432 - protein, 8 aa, Influenza virus
TSNSIVSM

SEQ ID NO: 424433 - protein, 8 aa, Influenza virus
ASRSGYEM

SEQ ID NO: 424434 - protein, 8 aa, Influenza virus
SYKRIRLF

SEQ ID NO: 424435 - protein, 8 aa, Influenza virus
FLMQIAIL

SEQ ID NO: 424436 - protein, 8 aa, Influenza virus
RREIHIYY

SEQ ID NO: 424437 - protein, 8 aa, Influenza virus
GRMSDSIK

SEQ ID NO: 424438 - protein, 8 aa, Influenza virus
VLGDCSIA

SEQ ID NO: 424439 - protein, 8 aa, Influenza virus
YHANNSTT

SEQ ID NO: 424440 - protein, 8 aa, Influenza virus
GMITDTIK

SEQ ID NO: 424441 - protein, 8 aa, Influenza virus
SLRLAIGL

SEQ ID NO: 424442 - protein, 8 aa, Influenza virus
ETTHTGTY

SEQ ID NO: 424443 - protein, 8 aa, Influenza virus
SLVLVVSL

SEQ ID NO: 424444 - protein, 8 aa, Influenza virus
NHVEVVSA

SEQ ID NO: 424445 - protein, 8 aa, Influenza virus
RIENLNKK

SEQ ID NO: 424446 - protein, 8 aa, Influenza virus
LANTIEIF

SEQ ID NO: 424447 - protein, 8 aa, Influenza virus
FATSCFLL

SEQ ID NO: 424448 - protein, 8 aa, Influenza virus
VIVTREPY

SEQ ID NO: 424449 - protein, 8 aa, Influenza virus
FEREGYSL

SEQ ID NO: 424450 - protein, 8 aa, Influenza virus
LFGAIAGF

SEQ ID NO: 424451 - protein, 8 aa, Influenza virus
GINTNKTF

SEQ ID NO: 424452 - protein, 8 aa, Influenza virus
NGDYTRLY

SEQ ID NO: 424453 - protein, 8 aa, Influenza virus
LRDNVKEL

SEQ ID NO: 424454 - protein, 8 aa, Influenza virus
FSFGASSF

SEQ ID NO: 424455 - protein, 8 aa, Influenza virus
GYICSGVF

SEQ ID NO: 424456 - protein, 8 aa, Influenza virus
ASVPASRY

SEQ ID NO: 424457 - protein, 8 aa, Influenza virus
KAWLHICV

SEQ ID NO: 424458 - protein, 8 aa, Influenza virus
HNVHRNTI

SEQ ID NO: 424459 - protein, 8 aa, Influenza virus
FIKWNVTY

SEQ ID NO: 424460 - protein, 8 aa, Influenza virus
SQYREEAL

SEQ ID NO: 424461 - protein, 8 aa, Influenza virus
MQNRLNNV

SEQ ID NO: 424462 - protein, 8 aa, Influenza virus
GYKDWVLW

SEQ ID NO: 424463 - protein, 8 aa, Influenza virus
RTLTLNTM

SEQ ID NO: 424464 - protein, 8 aa, Influenza virus
FTFNGSFI

SEQ ID NO: 424465 - protein, 8 aa, Influenza virus
GQKARIDY

SEQ ID NO: 424466 - protein, 8 aa, Influenza virus
VVAAQELV

SEQ ID NO: 424467 - protein, 8 aa, Influenza virus
HQSGTYPI

SEQ ID NO: 424468 - protein, 8 aa, Influenza virus
GRGLFGAK

SEQ ID NO: 424469 - protein, 8 aa, Influenza virus
VQLIVSGK

SEQ ID NO: 424470 - protein, 8 aa, Influenza virus
SVYKALSI

SEQ ID NO: 424471 - protein, 8 aa, Influenza virus
YINNATII

SEQ ID NO: 424472 - protein, 8 aa, Influenza virus
YMFESKSM

SEQ ID NO: 424473 - protein, 8 aa, Influenza virus
KYGTGRIF

SEQ ID NO: 424474 - protein, 8 aa, Influenza virus
RATAIIRK

SEQ ID NO: 424475 - protein, 8 aa, Influenza virus
IRAFSFQL

SEQ ID NO: 424476 - protein, 8 aa, Influenza virus
YLLLNKSL

SEQ ID NO: 424477 - protein, 8 aa, Influenza virus
ESDEALKM

SEQ ID NO: 424478 - protein, 8 aa, Influenza virus
FSFQLILI

SEQ ID NO: 424479 - protein, 8 aa, Influenza virus
LFSGVNSF

SEQ ID NO: 424480 - protein, 8 aa, Influenza virus
GLIDGWYG

SEQ ID NO: 424481 - protein, 8 aa, Influenza virus
VLKYKGII

SEQ ID NO: 424482 - protein, 8 aa, Influenza virus
DEICIGHL

SEQ ID NO: 424483 - protein, 8 aa, Influenza virus
ATIRNGTY

SEQ ID NO: 424484 - protein, 8 aa, Influenza virus
QYICSPVL

SEQ ID NO: 424485 - protein, 8 aa, Influenza virus
LTDNHVEV

SEQ ID NO: 424486 - protein, 8 aa, Influenza virus
TQYRTESL

SEQ ID NO: 424487 - protein, 8 aa, Influenza virus
SYKRVRLF

SEQ ID NO: 424488 - protein, 8 aa, Influenza virus
KSLIWLWL

SEQ ID NO: 424489 - protein, 8 aa, Influenza virus
YLLLNKSL

SEQ ID NO: 424490 - protein, 8 aa, Influenza virus
SFYRNLLW

SEQ ID NO: 424491 - protein, 8 aa, Influenza virus
GMIDGWYG

SEQ ID NO: 424492 - protein, 8 aa, Influenza virus
SIQTRGLF

SEQ ID NO: 424493 - protein, 8 aa, Influenza virus
RNIVRRAI

SEQ ID NO: 424494 - protein, 8 aa, Influenza virus
IEYQIGNV

SEQ ID NO: 424495 - protein, 8 aa, Influenza virus
DRAPYRSL

SEQ ID NO: 424496 - protein, 8 aa, Influenza virus
NSAHHRVY

SEQ ID NO: 424497 - protein, 8 aa, Influenza virus
GTYNHKEY

SEQ ID NO: 424498 - protein, 8 aa, Influenza virus
GTPACDLY

SEQ ID NO: 424499 - protein, 8 aa, Influenza virus
DRSQYRAL

SEQ ID NO: 424500 - protein, 8 aa, Influenza virus
KRLIQLIV

SEQ ID NO: 424501 - protein, 8 aa, Influenza virus
ILEQNVTV

SEQ ID NO: 424502 - protein, 8 aa, Influenza virus
SMTEIWSY

SEQ ID NO: 424503 - protein, 8 aa, Influenza virus
IQIDSVKL

SEQ ID NO: 424504 - protein, 8 aa, Influenza virus
KLKRRAIA

SEQ ID NO: 424505 - protein, 8 aa, Influenza virus
ASTGAQSF

SEQ ID NO: 424506 - protein, 8 aa, Influenza virus
HMYYLEKA

SEQ ID NO: 424507 - protein, 8 aa, Influenza virus
DRNATASL

SEQ ID NO: 424508 - protein, 8 aa, Influenza virus
VANVNNLY

SEQ ID NO: 424509 - protein, 8 aa, Influenza virus
TSNRGSFY

SEQ ID NO: 424510 - protein, 8 aa, Influenza virus
LTKGMLGF

SEQ ID NO: 424511 - protein, 8 aa, Influenza virus
SFFRHMVW

SEQ ID NO: 424512 - protein, 8 aa, Influenza virus
QAYTKIMY

SEQ ID NO: 424513 - protein, 8 aa, Influenza virus
SEVPGWSW

SEQ ID NO: 424514 - protein, 8 aa, Influenza virus
SIIPSGPL

SEQ ID NO: 424515 - protein, 8 aa, Influenza virus
KRKTRGLF

SEQ ID NO: 424516 - protein, 8 aa, Influenza virus
SLHGRICI

SEQ ID NO: 424517 - protein, 8 aa, Influenza virus
LRLGYETF

SEQ ID NO: 424518 - protein, 8 aa, Influenza virus
SLSPGMMM

SEQ ID NO: 424519 - protein, 8 aa, Influenza virus
AIEKITNK

SEQ ID NO: 424520 - protein, 8 aa, Influenza virus
TENSFEQI

SEQ ID NO: 424521 - protein, 8 aa, Influenza virus
KTWAGKIL

SEQ ID NO: 424522 - protein, 8 aa, Influenza virus
RLCKVEGW

SEQ ID NO: 424523 - protein, 8 aa, Influenza virus
LSYTVGYL

SEQ ID NO: 424524 - protein, 8 aa, Influenza virus
NRCFYVEL

SEQ ID NO: 424525 - protein, 8 aa, Influenza virus
GVHHSSSL

SEQ ID NO: 424526 - protein, 8 aa, Influenza virus
SFRGRGVF

SEQ ID NO: 424527 - protein, 8 aa, Influenza virus
MVDGWYGY

SEQ ID NO: 424528 - protein, 8 aa, Influenza virus
DQQGNVLL

SEQ ID NO: 424529 - protein, 8 aa, Influenza virus
WSYNAELL

SEQ ID NO: 424530 - protein, 8 aa, Influenza virus
RALTLNTM

SEQ ID NO: 424531 - protein, 8 aa, Influenza virus
EELLTGNL

SEQ ID NO: 424532 - protein, 8 aa, Influenza virus
TILETGYI

SEQ ID NO: 424533 - protein, 8 aa, Influenza virus
NIRCNICI

SEQ ID NO: 424534 - protein, 8 aa, Influenza virus
SITEVWSY

SEQ ID NO: 424535 - protein, 8 aa, Influenza virus
NTYDHSRY

SEQ ID NO: 424536 - protein, 8 aa, Influenza virus
KGVELSSM

SEQ ID NO: 424537 - protein, 8 aa, Influenza virus
CSNDTINY

SEQ ID NO: 424538 - protein, 8 aa, Influenza virus
HKWERYCV

SEQ ID NO: 424539 - protein, 8 aa, Influenza virus
GAVAVLKY

SEQ ID NO: 424540 - protein, 8 aa, Influenza virus
QTVINNYY

SEQ ID NO: 424541 - protein, 8 aa, Influenza virus
YRNLAWFV

SEQ ID NO: 424542 - protein, 8 aa, Influenza virus
AMKHTSQY

SEQ ID NO: 424543 - protein, 8 aa, Influenza virus
MTIGSVSL

SEQ ID NO: 424544 - protein, 8 aa, Influenza virus
SRINGVKL

SEQ ID NO: 424545 - protein, 8 aa, Influenza virus
DQDWSYIV

SEQ ID NO: 424546 - protein, 8 aa, Influenza virus
FYRYGFVA

SEQ ID NO: 424547 - protein, 8 aa, Influenza virus
FEEVRWLI

SEQ ID NO: 424548 - protein, 8 aa, Influenza virus
QMESRGLF

SEQ ID NO: 424549 - protein, 8 aa, Influenza virus
ILWISFSM

SEQ ID NO: 424550 - protein, 8 aa, Influenza virus
ARFESVAW

SEQ ID NO: 424551 - protein, 8 aa, Influenza virus
LYFHKGLI

SEQ ID NO: 424552 - protein, 8 aa, Influenza virus
GTYNHQEY

SEQ ID NO: 424553 - protein, 8 aa, Influenza virus
FQNINSRV

SEQ ID NO: 424554 - protein, 8 aa, Influenza virus
FESSGGLL

SEQ ID NO: 424555 - protein, 8 aa, Influenza virus
FTFNGAFI

SEQ ID NO: 424556 - protein, 8 aa, Influenza virus
TQFEAVGK

SEQ ID NO: 424557 - protein, 8 aa, Influenza virus
ALYGTQSL

SEQ ID NO: 424558 - protein, 8 aa, Influenza virus
LILVALAL

SEQ ID NO: 424559 - protein, 8 aa, Influenza virus
SVTELWSY

SEQ ID NO: 424560 - protein, 8 aa, Influenza virus
IQIDAVKL

SEQ ID NO: 424561 - protein, 8 aa, Influenza virus
CIASSIVM

SEQ ID NO: 424562 - protein, 8 aa, Influenza virus
SRFEAVAW

SEQ ID NO: 424563 - protein, 8 aa, Influenza virus
IESKLSQM

SEQ ID NO: 424564 - protein, 8 aa, Influenza virus
MTLSVVSL

SEQ ID NO: 424565 - protein, 8 aa, Influenza virus
ASSQLEGF

SEQ ID NO: 424566 - protein, 8 aa, Influenza virus
KLKRNEIK

SEQ ID NO: 424567 - protein, 8 aa, Influenza virus
WKSSNRPV

SEQ ID NO: 424568 - protein, 8 aa, Influenza virus
SQDTELSF

SEQ ID NO: 424569 - protein, 8 aa, Influenza virus
YHTGRSSF

SEQ ID NO: 424570 - protein, 8 aa, Influenza virus
RTLMSVEV

SEQ ID NO: 424571 - protein, 8 aa, Influenza virus
TSGSSISF

SEQ ID NO: 424572 - protein, 8 aa, Influenza virus
SFYAEMKW

SEQ ID NO: 424573 - protein, 8 aa, Influenza virus
SRSGFEII

SEQ ID NO: 424574 - protein, 8 aa, Influenza virus
RPLVRSQS

SEQ ID NO: 424575 - protein, 8 aa, Influenza virus
SFYTELKW

SEQ ID NO: 424576 - protein, 8 aa, Influenza virus
VMEHTSQY

SEQ ID NO: 424577 - protein, 8 aa, Influenza virus
YDKVRHQL

SEQ ID NO: 424578 - protein, 8 aa, Influenza virus
DQAWSYIV

SEQ ID NO: 424579 - protein, 8 aa, Influenza virus
VTVWSSKY

SEQ ID NO: 424580 - protein, 8 aa, Influenza virus
NMDKAVKL

SEQ ID NO: 424581 - protein, 8 aa, Influenza virus
SVWAGRTM

SEQ ID NO: 424582 - protein, 8 aa, Influenza virus
DQQGNILL

SEQ ID NO: 424583 - protein, 8 aa, Influenza virus
MGSSPNAY

SEQ ID NO: 424584 - protein, 8 aa, Influenza virus
IWGVHHPI

SEQ ID NO: 424585 - protein, 8 aa, Influenza virus
FERVRHQL

SEQ ID NO: 424586 - protein, 8 aa, Influenza virus
VISTDLSY

SEQ ID NO: 424587 - protein, 8 aa, Influenza virus
FMDVWTYN

SEQ ID NO: 424588 - protein, 8 aa, Influenza virus
RKRNSSIL

SEQ ID NO: 424589 - protein, 8 aa, Influenza virus
AVIHYGGV

SEQ ID NO: 424590 - protein, 8 aa, Influenza virus
CHDGKEWL

SEQ ID NO: 424591 - protein, 8 aa, Influenza virus
YQAELLVA

SEQ ID NO: 424592 - protein, 8 aa, Influenza virus
IAFLTSSI

SEQ ID NO: 424593 - protein, 8 aa, Influenza virus
DMSNEGSY

SEQ ID NO: 424594 - protein, 8 aa, Influenza virus
WSYNAELL

SEQ ID NO: 424595 - protein, 8 aa, Influenza virus
VLRGFLIL

SEQ ID NO: 424596 - protein, 8 aa, Influenza virus
LVLAASIM

SEQ ID NO: 424597 - protein, 8 aa, Influenza virus
YQMGYICS

SEQ ID NO: 424598 - protein, 8 aa, Influenza virus
GLVFICVK

SEQ ID NO: 424599 - protein, 8 aa, Influenza virus
RPVIEIDM

SEQ ID NO: 424600 - protein, 8 aa, Influenza virus
RPIIEIDM

SEQ ID NO: 424601 - protein, 8 aa, Influenza virus
EMNKLFEK

SEQ ID NO: 424602 - protein, 8 aa, Influenza virus
KLLKERGF

SEQ ID NO: 424603 - protein, 8 aa, Influenza virus
VEIRINMI

SEQ ID NO: 424604 - protein, 8 aa, Influenza virus
RALISWGM

SEQ ID NO: 424605 - protein, 8 aa, Influenza virus
MSDINIMA

SEQ ID NO: 424606 - protein, 8 aa, Influenza virus
VLWTSNSM

SEQ ID NO: 424607 - protein, 8 aa, Influenza virus
MTDGPANK

SEQ ID NO: 424608 - protein, 8 aa, Influenza virus
GTYDYPQY

SEQ ID NO: 424609 - protein, 8 aa, Influenza virus
KYVKQGSL

SEQ ID NO: 424610 - protein, 8 aa, Influenza virus
LTNSEMNK

SEQ ID NO: 424611 - protein, 8 aa, Influenza virus
KMNTQFDA

SEQ ID NO: 424612 - protein, 8 aa, Influenza virus
ARRMVQAM

SEQ ID NO: 424613 - protein, 8 aa, Influenza virus
YNAELLIL

SEQ ID NO: 424614 - protein, 8 aa, Influenza virus
NMQCTICI

SEQ ID NO: 424615 - protein, 8 aa, Influenza virus
SLVLLLMI

SEQ ID NO: 424616 - protein, 8 aa, Influenza virus
KRMENGFL

SEQ ID NO: 424617 - protein, 8 aa, Influenza virus
YDKVRFQL

SEQ ID NO: 424618 - protein, 8 aa, Influenza virus
AIDGITNK

SEQ ID NO: 424619 - protein, 8 aa, Influenza virus
NTYNHTEY

SEQ ID NO: 424620 - protein, 8 aa, Influenza virus
IMKTEGTL

SEQ ID NO: 424621 - protein, 8 aa, Influenza virus
MIIGGFIF

SEQ ID NO: 424622 - protein, 8 aa, Influenza virus
FATSCFLL

SEQ ID NO: 424623 - protein, 8 aa, Influenza virus
RYVKQGSL

SEQ ID NO: 424624 - protein, 8 aa, Influenza virus
REIHIYYL

SEQ ID NO: 424625 - protein, 8 aa, Influenza virus
TYCSLNGI

SEQ ID NO: 424626 - protein, 8 aa, Influenza virus
FEEIRWLI

SEQ ID NO: 424627 - protein, 8 aa, Influenza virus
RSLIRFPI

SEQ ID NO: 424628 - protein, 8 aa, Influenza virus
TSNSIVEF

SEQ ID NO: 424629 - protein, 8 aa, Influenza virus
YQSLRSIL

SEQ ID NO: 424630 - protein, 8 aa, Influenza virus
FVTREPFI

SEQ ID NO: 424631 - protein, 8 aa, Influenza virus
IIIVVLLY

SEQ ID NO: 424632 - protein, 8 aa, Influenza virus
LRFLFSSI

SEQ ID NO: 424633 - protein, 8 aa, Influenza virus
RIDFNWLL

SEQ ID NO: 424634 - protein, 8 aa, Influenza virus
STWVSQTY

SEQ ID NO: 424635 - protein, 8 aa, Influenza virus
LSIYSTVA

SEQ ID NO: 424636 - protein, 8 aa, Influenza virus
GYSGSFVI

SEQ ID NO: 424637 - protein, 8 aa, Influenza virus
MSDIEIMA

SEQ ID NO: 424638 - protein, 8 aa, Influenza virus
MMMGMFNM

SEQ ID NO: 424639 - protein, 8 aa, Influenza virus
VTSSVDLI

SEQ ID NO: 424640 - protein, 8 aa, Influenza virus
RLYIWGVH

SEQ ID NO: 424641 - protein, 8 aa, Influenza virus
LPACIYGL

SEQ ID NO: 424642 - protein, 8 aa, Influenza virus
MVIASTTA

SEQ ID NO: 424643 - protein, 8 aa, Influenza virus
SRGLFGAK

SEQ ID NO: 424644 - protein, 8 aa, Influenza virus
QTAAQRAM

SEQ ID NO: 424645 - protein, 8 aa, Influenza virus
NIVRRAIV

SEQ ID NO: 424646 - protein, 8 aa, Influenza virus
SGFVRTLF

SEQ ID NO: 424647 - protein, 8 aa, Influenza virus
IPLTTTPT

SEQ ID NO: 424648 - protein, 8 aa, Influenza virus
YQKVGTYV

SEQ ID NO: 424649 - protein, 8 aa, Influenza virus
MRTFSFQL

SEQ ID NO: 424650 - protein, 8 aa, Influenza virus
MNELGVPL

SEQ ID NO: 424651 - protein, 8 aa, Influenza virus
SACYNPCF

SEQ ID NO: 424652 - protein, 8 aa, Influenza virus
TQNNTTLI

SEQ ID NO: 424653 - protein, 8 aa, Influenza virus
NTWARNIL

SEQ ID NO: 424654 - protein, 8 aa, Influenza virus
RQTYDWTL

SEQ ID NO: 424655 - protein, 8 aa, Influenza virus
SMQCNVCI

SEQ ID NO: 424656 - protein, 8 aa, Influenza virus
SGICPVVF

SEQ ID NO: 424657 - protein, 8 aa, Influenza virus
IGIGNLVF

SEQ ID NO: 424658 - protein, 8 aa, Influenza virus
NLIAPRGY

SEQ ID NO: 424659 - protein, 8 aa, Influenza virus
FQNVSPVW

SEQ ID NO: 424660 - protein, 8 aa, Influenza virus
ALLNASCA

SEQ ID NO: 424661 - protein, 8 aa, Influenza virus
NQTKTMTI

SEQ ID NO: 424662 - protein, 8 aa, Influenza virus
STVASSFV

SEQ ID NO: 424663 - protein, 8 aa, Influenza virus
YKSTQAAV

SEQ ID NO: 424664 - protein, 8 aa, Influenza virus
SPYRTLLM

SEQ ID NO: 424665 - protein, 8 aa, Influenza virus
ATTITLHF

SEQ ID NO: 424666 - protein, 8 aa, Influenza virus
AAFLFWAM

SEQ ID NO: 424667 - protein, 8 aa, Influenza virus
ASSRAYTK

SEQ ID NO: 424668 - protein, 8 aa, Influenza virus
WAYNAELI

SEQ ID NO: 424669 - protein, 8 aa, Influenza virus
GTYDYPKY

SEQ ID NO: 424670 - protein, 8 aa, Influenza virus
LLVSLGAI

SEQ ID NO: 424671 - protein, 8 aa, Influenza virus
MIALILVA

SEQ ID NO: 424672 - protein, 8 aa, Influenza virus
MTIASDIL

SEQ ID NO: 424673 - protein, 8 aa, Influenza virus
RTLMSCPI

SEQ ID NO: 424674 - protein, 8 aa, Influenza virus
LTVPEWSY

SEQ ID NO: 424675 - protein, 8 aa, Influenza virus
MTDSEMNK

SEQ ID NO: 424676 - protein, 8 aa, Influenza virus
KPRPRRGL

SEQ ID NO: 424677 - protein, 8 aa, Influenza virus
SINGRAPI

SEQ ID NO: 424678 - protein, 8 aa, Influenza virus
GIILGNPK

SEQ ID NO: 424679 - protein, 8 aa, Influenza virus
IPSWEGNI

SEQ ID NO: 424680 - protein, 8 aa, Influenza virus
IQFPMGTA

SEQ ID NO: 424681 - protein, 8 aa, Influenza virus
YQRSKFLL

SEQ ID NO: 424682 - protein, 8 aa, Influenza virus
WSYNARLL

SEQ ID NO: 424683 - protein, 8 aa, Influenza virus
AVIHYGGM

SEQ ID NO: 424684 - protein, 8 aa, Influenza virus
RRIDFHWL

SEQ ID NO: 424685 - protein, 8 aa, Influenza virus
IYGKDNAI

SEQ ID NO: 424686 - protein, 8 aa, Influenza virus
MVHAMRTI

SEQ ID NO: 424687 - protein, 8 aa, Influenza virus
KTWAKNIL

SEQ ID NO: 424688 - protein, 8 aa, Influenza virus
FLMQIATL

SEQ ID NO: 424689 - protein, 8 aa, Influenza virus
KLFASSGI

SEQ ID NO: 424690 - protein, 8 aa, Influenza virus
TSRHYIGK

SEQ ID NO: 424691 - protein, 8 aa, Influenza virus
GIITGTIK

SEQ ID NO: 424692 - protein, 8 aa, Influenza virus
DSEMDKLY

SEQ ID NO: 424693 - protein, 8 aa, Influenza virus
AIDGVTNK

SEQ ID NO: 424694 - protein, 8 aa, Influenza virus
RPKEMEGV

SEQ ID NO: 424695 - protein, 8 aa, Influenza virus
SLYDKVRM

SEQ ID NO: 424696 - protein, 8 aa, Influenza virus
YVRQNTLK

SEQ ID NO: 424697 - protein, 8 aa, Influenza virus
KRMGLQMQ

SEQ ID NO: 424698 - protein, 8 aa, Influenza virus
NENATASF

SEQ ID NO: 424699 - protein, 8 aa, Influenza virus
ITVGSSKY

SEQ ID NO: 424700 - protein, 8 aa, Influenza virus
FFRNVIWL

SEQ ID NO: 424701 - protein, 8 aa, Influenza virus
AMSCFLLC

SEQ ID NO: 424702 - protein, 8 aa, Influenza virus
YESSINPA

SEQ ID NO: 424703 - protein, 8 aa, Influenza virus
NRFQIKSV

SEQ ID NO: 424704 - protein, 8 aa, Influenza virus
EEVLTGNL

SEQ ID NO: 424705 - protein, 8 aa, Influenza virus
APPVQSKM

SEQ ID NO: 424706 - protein, 8 aa, Influenza virus
GRHANGTM

SEQ ID NO: 424707 - protein, 8 aa, Influenza virus
RQTFDWTL

SEQ ID NO: 424708 - protein, 8 aa, Influenza virus
APDRVSKL

SEQ ID NO: 424709 - protein, 8 aa, Influenza virus
FFRNVVWL

SEQ ID NO: 424710 - protein, 8 aa, Influenza virus
SFYRGMRW

SEQ ID NO: 424711 - protein, 8 aa, Influenza virus
GYFGVFSV

SEQ ID NO: 424712 - protein, 8 aa, Influenza virus
RSLIRFPI

SEQ ID NO: 424713 - protein, 8 aa, Influenza virus
GQQGTMDY

SEQ ID NO: 424714 - protein, 8 aa, Influenza virus
VVSPDLSY

SEQ ID NO: 424715 - protein, 8 aa, Influenza virus
YRNLIWLV

SEQ ID NO: 424716 - protein, 8 aa, Influenza virus
KLCFPGEV

SEQ ID NO: 424717 - protein, 8 aa, Influenza virus
RANVNDFF

SEQ ID NO: 424718 - protein, 8 aa, Influenza virus
RIDFHWML

SEQ ID NO: 424719 - protein, 8 aa, Influenza virus
LQGTKRSY

SEQ ID NO: 424720 - protein, 8 aa, Influenza virus
EVSSWHIL

SEQ ID NO: 424721 - protein, 8 aa, Influenza virus
VTASCLDK

SEQ ID NO: 424722 - protein, 8 aa, Influenza virus
FAYDKICI

SEQ ID NO: 424723 - protein, 8 aa, Influenza virus
SLYSSPQL

SEQ ID NO: 424724 - protein, 8 aa, Influenza virus
SFYSELKW

SEQ ID NO: 424725 - protein, 8 aa, Influenza virus
ILEENTTY

SEQ ID NO: 424726 - protein, 8 aa, Influenza virus
ILHLVLWI

SEQ ID NO: 424727 - protein, 8 aa, Influenza virus
ALQNRIMI

SEQ ID NO: 424728 - protein, 8 aa, Influenza virus
LIAPWYAY

SEQ ID NO: 424729 - protein, 8 aa, Influenza virus
GTYNYPQY

SEQ ID NO: 424730 - protein, 8 aa, Influenza virus
YQSGTYPV

SEQ ID NO: 424731 - protein, 8 aa, Influenza virus
CSKYHWNL

SEQ ID NO: 424732 - protein, 8 aa, Influenza virus
LRSRYWAI

SEQ ID NO: 424733 - protein, 8 aa, Influenza virus
ISHRTLLM

SEQ ID NO: 424734 - protein, 8 aa, Influenza virus
TKSYFANL

SEQ ID NO: 424735 - protein, 8 aa, Influenza virus
TVYWWDGL

SEQ ID NO: 424736 - protein, 8 aa, Influenza virus
MVGLILAF

SEQ ID NO: 424737 - protein, 8 aa, Influenza virus
YLIRTLTL

SEQ ID NO: 424738 - protein, 8 aa, Influenza virus
GRMNYYWT

SEQ ID NO: 424739 - protein, 8 aa, Influenza virus
SPLPFQNI

SEQ ID NO: 424740 - protein, 8 aa, Influenza virus
KAWLHVCV

SEQ ID NO: 424741 - protein, 8 aa, Influenza virus
FQIQGVRL

SEQ ID NO: 424742 - protein, 8 aa, Influenza virus
ISIGTSTL

SEQ ID NO: 424743 - protein, 8 aa, Influenza virus
RRLSANAV

SEQ ID NO: 424744 - protein, 8 aa, Influenza virus
IEGRWPGL

SEQ ID NO: 424745 - protein, 8 aa, Influenza virus
IAFLTSSI

SEQ ID NO: 424746 - protein, 8 aa, Influenza virus
AMQNRMQI

SEQ ID NO: 424747 - protein, 8 aa, Influenza virus
SFYGELKW

SEQ ID NO: 424748 - protein, 8 aa, Influenza virus
CSNNTTNY

SEQ ID NO: 424749 - protein, 8 aa, Influenza virus
NPSCASNI

SEQ ID NO: 424750 - protein, 8 aa, Influenza virus
DMSKEGSY

SEQ ID NO: 424751 - protein, 8 aa, Influenza virus
VQNNYTTI

SEQ ID NO: 424752 - protein, 8 aa, Influenza virus
QVKIRRRV

SEQ ID NO: 424753 - protein, 8 aa, Influenza virus
NSFYAELK

SEQ ID NO: 424754 - protein, 8 aa, Influenza virus
NSFEQITF

SEQ ID NO: 424755 - protein, 8 aa, Influenza virus
NRLNINPV

SEQ ID NO: 424756 - protein, 8 aa, Influenza virus
RTNGTSKI

SEQ ID NO: 424757 - protein, 8 aa, Influenza virus
GTYDHKEY

SEQ ID NO: 424758 - protein, 8 aa, Influenza virus
MVQAMRAI

SEQ ID NO: 424759 - protein, 8 aa, Influenza virus
LSVVNLLI

SEQ ID NO: 424760 - protein, 8 aa, Influenza virus
YNARLLVL

SEQ ID NO: 424761 - protein, 8 aa, Influenza virus
NTYDHAQY

SEQ ID NO: 424762 - protein, 8 aa, Influenza virus
NIRCQICI

SEQ ID NO: 424763 - protein, 8 aa, Influenza virus
AIDQITTK

SEQ ID NO: 424764 - protein, 8 aa, Influenza virus
TSGSSIAF

SEQ ID NO: 424765 - protein, 8 aa, Influenza virus
IIALLIGI

SEQ ID NO: 424766 - protein, 8 aa, Influenza virus
RLRMATGL

SEQ ID NO: 424767 - protein, 8 aa, Influenza virus
RFYRICKL

SEQ ID NO: 424768 - protein, 8 aa, Influenza virus
TPACDLHL

SEQ ID NO: 424769 - protein, 8 aa, Influenza virus
CHDGIGRM

SEQ ID NO: 424770 - protein, 8 aa, Influenza virus
NRFQIKSV

SEQ ID NO: 424771 - protein, 8 aa, Influenza virus
PILYFWGV

SEQ ID NO: 424772 - protein, 8 aa, Influenza virus
MARSALIL

SEQ ID NO: 424773 - protein, 8 aa, Influenza virus
FEKEGYSL

SEQ ID NO: 424774 - protein, 8 aa, Influenza virus
RRLSVNAI

SEQ ID NO: 424775 - protein, 8 aa, Influenza virus
FIYSGIRT

SEQ ID NO: 424776 - protein, 8 aa, Influenza virus
GTYDHNIY

SEQ ID NO: 424777 - protein, 8 aa, Influenza virus
NSWHIFGK

SEQ ID NO: 424778 - protein, 8 aa, Influenza virus
ILRGSVAH

SEQ ID NO: 424779 - protein, 8 aa, Influenza virus
FLMQIAVL

SEQ ID NO: 424780 - protein, 8 aa, Influenza virus
FPIGTAPV

SEQ ID NO: 424781 - protein, 8 aa, Influenza virus
MVLASTTA

SEQ ID NO: 424782 - protein, 8 aa, Influenza virus
RRRFIQNA

SEQ ID NO: 424783 - protein, 8 aa, Influenza virus
KQMTRGLF

SEQ ID NO: 424784 - protein, 8 aa, Influenza virus
ALGIINLL

SEQ ID NO: 424785 - protein, 8 aa, Influenza virus
THIHIFSF

SEQ ID NO: 424786 - protein, 8 aa, Influenza virus
GYKNWILW

SEQ ID NO: 424787 - protein, 8 aa, Influenza virus
LAAIIMGF

SEQ ID NO: 424788 - protein, 8 aa, Influenza virus
KAAMGMRI

SEQ ID NO: 424789 - protein, 8 aa, Influenza virus
MVIASTTA

SEQ ID NO: 424790 - protein, 8 aa, Influenza virus
KMPASRYL

SEQ ID NO: 424791 - protein, 8 aa, Influenza virus
WRGSNRPI

SEQ ID NO: 424792 - protein, 8 aa, Influenza virus
CHNSTCVV

SEQ ID NO: 424793 - protein, 8 aa, Influenza virus
RPLVRGQS

SEQ ID NO: 424794 - protein, 8 aa, Influenza virus
TTVTLHLK

SEQ ID NO: 424795 - protein, 8 aa, Influenza virus
IVTHFQRK

SEQ ID NO: 424796 - protein, 8 aa, Influenza virus
RATAILKK

SEQ ID NO: 424797 - protein, 8 aa, Influenza virus
ARFEAVAW

SEQ ID NO: 424798 - protein, 8 aa, Influenza virus
KLYIWGIH

SEQ ID NO: 424799 - protein, 8 aa, Influenza virus
SRMQFSSL

SEQ ID NO: 424800 - protein, 8 aa, Influenza virus
IEGGWCGM

SEQ ID NO: 424801 - protein, 8 aa, Influenza virus
WESLNGTA

SEQ ID NO: 424802 - protein, 8 aa, Influenza virus
FEATGNLV

SEQ ID NO: 424803 - protein, 8 aa, Influenza virus
TEEQAVNI

SEQ ID NO: 424804 - protein, 8 aa, Influenza virus
FQKDAKVL

SEQ ID NO: 424805 - protein, 8 aa, Influenza virus
SNRPWLSF

SEQ ID NO: 424806 - protein, 8 aa, Influenza virus
WVTRELYV

SEQ ID NO: 424807 - protein, 8 aa, Influenza virus
YRNLVWLV

SEQ ID NO: 424808 - protein, 8 aa, Influenza virus
NTASRSGY

SEQ ID NO: 424809 - protein, 8 aa, Influenza virus
CSFTGWIL

SEQ ID NO: 424810 - protein, 8 aa, Influenza virus
FVHFVEAL

SEQ ID NO: 424811 - protein, 8 aa, Influenza virus
PFHNVHPF

SEQ ID NO: 424812 - protein, 8 aa, Influenza virus
SRARIKTR

SEQ ID NO: 424813 - protein, 8 aa, Influenza virus
RLNWLTKA

SEQ ID NO: 424814 - protein, 8 aa, Influenza virus
AVTWWNRK

SEQ ID NO: 424815 - protein, 8 aa, Influenza virus
YNVELLVL

SEQ ID NO: 424816 - protein, 8 aa, Influenza virus
FPIGVAPV

SEQ ID NO: 424817 - protein, 8 aa, Influenza virus
ALKLVVAM

SEQ ID NO: 424818 - protein, 8 aa, Influenza virus
YFFLKVPV

SEQ ID NO: 424819 - protein, 8 aa, Influenza virus
FLDVWTYN

SEQ ID NO: 424820 - protein, 8 aa, Influenza virus
EVSFQGGH

SEQ ID NO: 424821 - protein, 8 aa, Influenza virus
SFYKNLLW

SEQ ID NO: 424822 - protein, 8 aa, Influenza virus
GIVHLILW

SEQ ID NO: 424823 - protein, 8 aa, Influenza virus
LLVGIGNL

SEQ ID NO: 424824 - protein, 8 aa, Influenza virus
KESTQRAI

SEQ ID NO: 424825 - protein, 8 aa, Influenza virus
ITVWSSKY

SEQ ID NO: 424826 - protein, 8 aa, Influenza virus
NTYDHTQY

SEQ ID NO: 424827 - protein, 8 aa, Influenza virus
DANVNNLY

SEQ ID NO: 424828 - protein, 8 aa, Influenza virus
LEPGTFDI

SEQ ID NO: 424829 - protein, 8 aa, Influenza virus
LLENLQAY

SEQ ID NO: 424830 - protein, 8 aa, Influenza virus
RRDQKSLR

SEQ ID NO: 424831 - protein, 8 aa, Influenza virus
EMSKLFEK

SEQ ID NO: 424832 - protein, 8 aa, Influenza virus
NADVLVAL

SEQ ID NO: 424833 - protein, 8 aa, Influenza virus
SLVLVGLV

SEQ ID NO: 424834 - protein, 8 aa, Influenza virus
ELSSMGVY

SEQ ID NO: 424835 - protein, 8 aa, Influenza virus
FRNVVWLI

SEQ ID NO: 424836 - protein, 8 aa, Influenza virus
CQNGVCPV

SEQ ID NO: 424837 - protein, 8 aa, Influenza virus
WMKLYWHL

SEQ ID NO: 424838 - protein, 8 aa, Influenza virus
IASSIVLV

SEQ ID NO: 424839 - protein, 8 aa, Influenza virus
SHTAYSQI

SEQ ID NO: 424840 - protein, 8 aa, Influenza virus
AIDIMQNK

SEQ ID NO: 424841 - protein, 8 aa, Influenza virus
TSKHYIGK

SEQ ID NO: 424842 - protein, 8 aa, Influenza virus
YLIRALTL

SEQ ID NO: 424843 - protein, 8 aa, Influenza virus
MKWLSSSM

SEQ ID NO: 424844 - protein, 8 aa, Influenza virus
AVTDVWSY

SEQ ID NO: 424845 - protein, 8 aa, Influenza virus
AINSSMPL

SEQ ID NO: 424846 - protein, 8 aa, Influenza virus
GVYMNTAL

SEQ ID NO: 424847 - protein, 8 aa, Influenza virus
RTLDYHDF

SEQ ID NO: 424848 - protein, 8 aa, Influenza virus
LIWLWLVL

SEQ ID NO: 424849 - protein, 8 aa, Influenza virus
FLMQITIL

SEQ ID NO: 424850 - protein, 8 aa, Influenza virus
FFRNLVWL

SEQ ID NO: 424851 - protein, 8 aa, Influenza virus
SGDYARLY

SEQ ID NO: 424852 - protein, 8 aa, Influenza virus
GVNTNKTF

SEQ ID NO: 424853 - protein, 8 aa, Influenza virus
LRSRYWAI

SEQ ID NO: 424854 - protein, 8 aa, Influenza virus
FFMQIAIL

SEQ ID NO: 424855 - protein, 8 aa, Influenza virus
NVSEWSYI

SEQ ID NO: 424856 - protein, 8 aa, Influenza virus
GYFGIFFV

SEQ ID NO: 424857 - protein, 8 aa, Influenza virus
RPWIRFNS

SEQ ID NO: 424858 - protein, 8 aa, Influenza virus
RRRLSVNA

SEQ ID NO: 424859 - protein, 8 aa, Influenza virus
TIASSLPF

SEQ ID NO: 424860 - protein, 8 aa, Influenza virus
IMIAGLFF

SEQ ID NO: 424861 - protein, 8 aa, Influenza virus
FYKSMRWL

SEQ ID NO: 424862 - protein, 8 aa, Influenza virus
ITMGSVSL

SEQ ID NO: 424863 - protein, 8 aa, Influenza virus
SLVLAASI

SEQ ID NO: 424864 - protein, 8 aa, Influenza virus
MRTPIAFL

SEQ ID NO: 424865 - protein, 8 aa, Influenza virus
CSFAGWIL

SEQ ID NO: 424866 - protein, 8 aa, Influenza virus
ASSGNLEF

SEQ ID NO: 424867 - protein, 8 aa, Influenza virus
RPDSSWLF

SEQ ID NO: 424868 - protein, 8 aa, Influenza virus
SQTIINNY

SEQ ID NO: 424869 - protein, 8 aa, Influenza virus
ISSMGEAM

SEQ ID NO: 424870 - protein, 8 aa, Influenza virus
LEGRIENL

SEQ ID NO: 424871 - protein, 8 aa, Influenza virus
WSYNAEFL

SEQ ID NO: 424872 - protein, 8 aa, Influenza virus
ITNKVNNI

SEQ ID NO: 424873 - protein, 8 aa, Influenza virus
ESIRTGTY

SEQ ID NO: 424874 - protein, 8 aa, Influenza virus
TIKDRSPY

SEQ ID NO: 424875 - protein, 8 aa, Influenza virus
RSGYEILK

SEQ ID NO: 424876 - protein, 8 aa, Influenza virus
ITMGSVSL

SEQ ID NO: 424877 - protein, 8 aa, Influenza virus
SKDNSIQL

SEQ ID NO: 424878 - protein, 8 aa, Influenza virus
RTFSFQLI

SEQ ID NO: 424879 - protein, 8 aa, Influenza virus
SGRVSFYW

SEQ ID NO: 424880 - protein, 8 aa, Influenza virus
LSNNSTEK

SEQ ID NO: 424881 - protein, 8 aa, Influenza virus
FLNNTEPL

SEQ ID NO: 424882 - protein, 8 aa, Influenza virus
RPADGTGS

SEQ ID NO: 424883 - protein, 8 aa, Influenza virus
WSYIVEKI

SEQ ID NO: 424884 - protein, 8 aa, Influenza virus
QASYKIFK

SEQ ID NO: 424885 - protein, 8 aa, Influenza virus
YNAQLLVL

SEQ ID NO: 424886 - protein, 8 aa, Influenza virus
TFIFNGAF

SEQ ID NO: 424887 - protein, 8 aa, Influenza virus
ILEKNVTV

SEQ ID NO: 424888 - protein, 8 aa, Influenza virus
YQAKFESV

SEQ ID NO: 424889 - protein, 8 aa, Influenza virus
SSIAFCGV

SEQ ID NO: 424890 - protein, 8 aa, Influenza virus
STDKVNTI

SEQ ID NO: 424891 - protein, 8 aa, Influenza virus
TIVSSLPF

SEQ ID NO: 424892 - protein, 8 aa, Influenza virus
NGNMRCTI

SEQ ID NO: 424893 - protein, 8 aa, Influenza virus
MKIYWHLM

SEQ ID NO: 424894 - protein, 8 aa, Influenza virus
KRKRNSSI

SEQ ID NO: 424895 - protein, 8 aa, Influenza virus
ISSMVEAM

SEQ ID NO: 424896 - protein, 8 aa, Influenza virus
SQGTKRSY

SEQ ID NO: 424897 - protein, 8 aa, Influenza virus
ASCMGLIY

SEQ ID NO: 424898 - protein, 8 aa, Influenza virus
LSNRFQIK

SEQ ID NO: 424899 - protein, 8 aa, Influenza virus
SQDTEISF

SEQ ID NO: 424900 - protein, 8 aa, Influenza virus
FSISCFLL

SEQ ID NO: 424901 - protein, 8 aa, Influenza virus
KIRRRVDM

SEQ ID NO: 424902 - protein, 8 aa, Influenza virus
LRSKYWAI

SEQ ID NO: 424903 - protein, 8 aa, Influenza virus
TRDAMTEI

SEQ ID NO: 424904 - protein, 8 aa, Influenza virus
NRVKIDPV

SEQ ID NO: 424905 - protein, 8 aa, Influenza virus
NIYKILSI

SEQ ID NO: 424906 - protein, 8 aa, Influenza virus
DSEMNKLY

SEQ ID NO: 424907 - protein, 8 aa, Influenza virus
TLSTIALF

SEQ ID NO: 424908 - protein, 8 aa, Influenza virus
KSVFNSLY

SEQ ID NO: 424909 - protein, 8 aa, Influenza virus
FRSGYETF

SEQ ID NO: 424910 - protein, 8 aa, Influenza virus
LAIYSTVA

SEQ ID NO: 424911 - protein, 8 aa, Influenza virus
TAVAVIKY

SEQ ID NO: 424912 - protein, 8 aa, Influenza virus
EHQIGNVI

SEQ ID NO: 424913 - protein, 8 aa, Influenza virus
WSWPDGAL

SEQ ID NO: 424914 - protein, 8 aa, Influenza virus
SLKLAVGL

SEQ ID NO: 424915 - protein, 8 aa, Influenza virus
RISHRTLL

SEQ ID NO: 424916 - protein, 8 aa, Influenza virus
RANINDFF

SEQ ID NO: 424917 - protein, 8 aa, Influenza virus
SPGARPKV

SEQ ID NO: 424918 - protein, 8 aa, Influenza virus
TLVSTKEW

SEQ ID NO: 424919 - protein, 8 aa, Influenza virus
IIFESNGA

SEQ ID NO: 424920 - protein, 8 aa, Influenza virus
FPIGVAPV

SEQ ID NO: 424921 - protein, 8 aa, Influenza virus
FEATGNLI

SEQ ID NO: 424922 - protein, 8 aa, Influenza virus
APEYGHLV

SEQ ID NO: 424923 - protein, 8 aa, Influenza virus
KINTLTER

SEQ ID NO: 424924 - protein, 8 aa, Influenza virus
ETQTRGIF

SEQ ID NO: 424925 - protein, 8 aa, Influenza virus
YLCTGVLT

SEQ ID NO: 424926 - protein, 8 aa, Influenza virus
LVAPRGHY

SEQ ID NO: 424927 - protein, 8 aa, Influenza virus
ALRLAENK

SEQ ID NO: 424928 - protein, 8 aa, Influenza virus
RKRKTRGL

SEQ ID NO: 424929 - protein, 8 aa, Influenza virus
YSIDSSYI

SEQ ID NO: 424930 - protein, 8 aa, Influenza virus
NASWFNSF

SEQ ID NO: 424931 - protein, 8 aa, Influenza virus
SRYSKADK

SEQ ID NO: 424932 - protein, 8 aa, Influenza virus
AAFLFWTM

SEQ ID NO: 424933 - protein, 8 aa, Influenza virus
NIDRFLRV

SEQ ID NO: 424934 - protein, 8 aa, Influenza virus
YRNMRWLT

SEQ ID NO: 424935 - protein, 8 aa, Influenza virus
RIDYYWSM

SEQ ID NO: 424936 - protein, 8 aa, Influenza virus
LYFHKGLL

SEQ ID NO: 424937 - protein, 8 aa, Influenza virus
NENGDIIF

SEQ ID NO: 424938 - protein, 8 aa, Influenza virus
SFERFEIF

SEQ ID NO: 424939 - protein, 8 aa, Influenza virus
VWWTSNSI

SEQ ID NO: 424940 - protein, 8 aa, Influenza virus
RQTFDWTL

SEQ ID NO: 424941 - protein, 8 aa, Influenza virus
TTLPFHNV

SEQ ID NO: 424942 - protein, 8 aa, Influenza virus
DRSPYRTL

SEQ ID NO: 424943 - protein, 8 aa, Influenza virus
GRLGFEII

SEQ ID NO: 424944 - protein, 8 aa, Influenza virus
VARLGKGY

SEQ ID NO: 424945 - protein, 8 aa, Influenza virus
GSFYRSIR

SEQ ID NO: 424946 - protein, 8 aa, Influenza virus
LSYQVGYL

SEQ ID NO: 424947 - protein, 8 aa, Influenza virus
YESTQAAI

SEQ ID NO: 424948 - protein, 8 aa, Influenza virus
EWSKRYEL

SEQ ID NO: 424949 - protein, 8 aa, Influenza virus
WSYNAEFL

SEQ ID NO: 424950 - protein, 8 aa, Influenza virus
DVIVFNTI

SEQ ID NO: 424951 - protein, 8 aa, Influenza virus
TRDAMTEV

SEQ ID NO: 424952 - protein, 8 aa, Influenza virus
TLEHTSRY

SEQ ID NO: 424953 - protein, 8 aa, Influenza virus
GLITDTIK

SEQ ID NO: 424954 - protein, 8 aa, Influenza virus
YQWVIRNW

SEQ ID NO: 424955 - protein, 8 aa, Influenza virus
LLFLKVPV

SEQ ID NO: 424956 - protein, 8 aa, Influenza virus
ARLYIWGV

SEQ ID NO: 424957 - protein, 8 aa, Influenza virus
DMNNEGSY

SEQ ID NO: 424958 - protein, 8 aa, Influenza virus
KYSKEAKL

SEQ ID NO: 424959 - protein, 8 aa, Influenza virus
DRISHRTL

SEQ ID NO: 424960 - protein, 8 aa, Influenza virus
TFYRNMRW

SEQ ID NO: 424961 - protein, 8 aa, Influenza virus
KAVKLYKK

SEQ ID NO: 424962 - protein, 8 aa, Influenza virus
MEDGFLGV

SEQ ID NO: 424963 - protein, 8 aa, Influenza virus
FMARSALI

SEQ ID NO: 424964 - protein, 8 aa, Influenza virus
TQSAIDQV

SEQ ID NO: 424965 - protein, 8 aa, Influenza virus
RTLMSCPV

SEQ ID NO: 424966 - protein, 8 aa, Influenza virus
YLECRTFF

SEQ ID NO: 424967 - protein, 8 aa, Influenza virus
FQKDAKML

SEQ ID NO: 424968 - protein, 8 aa, Influenza virus
TSYRSLIR

SEQ ID NO: 424969 - protein, 8 aa, Influenza virus
RPKENPAH

SEQ ID NO: 424970 - protein, 8 aa, Influenza virus
NMGKVECV

SEQ ID NO: 424971 - protein, 8 aa, Influenza virus
SLQCRICI

SEQ ID NO: 424972 - protein, 8 aa, Influenza virus
QESECQCI

SEQ ID NO: 424973 - protein, 8 aa, Influenza virus
TLSGVAIA

SEQ ID NO: 424974 - protein, 8 aa, Influenza virus
KYVKSKRL

SEQ ID NO: 424975 - protein, 8 aa, Influenza virus
MTFYWTII

SEQ ID NO: 424976 - protein, 8 aa, Influenza virus
RMKWMMAM

SEQ ID NO: 424977 - protein, 8 aa, Influenza virus
AIDEITTK

SEQ ID NO: 424978 - protein, 8 aa, Influenza virus
ASTGGQSF

SEQ ID NO: 424979 - protein, 8 aa, Influenza virus
GFFSRLNW

SEQ ID NO: 424980 - protein, 8 aa, Influenza virus
QTIINNYY

SEQ ID NO: 424981 - protein, 8 aa, Influenza virus
GLVFICIK

SEQ ID NO: 424982 - protein, 8 aa, Influenza virus
NRRLTTTI

SEQ ID NO: 424983 - protein, 8 aa, Influenza virus
NMSKKKSY

SEQ ID NO: 424984 - protein, 8 aa, Influenza virus
RQASPSCL

SEQ ID NO: 424985 - protein, 8 aa, Influenza virus
FQNISPVW

SEQ ID NO: 424986 - protein, 8 aa, Influenza virus
CISGTCAV

SEQ ID NO: 424987 - protein, 8 aa, Influenza virus
GVITDTLK

SEQ ID NO: 424988 - protein, 8 aa, Influenza virus
LGVKGFGF

SEQ ID NO: 424989 - protein, 8 aa, Influenza virus
LTDWSGYS

SEQ ID NO: 424990 - protein, 8 aa, Influenza virus
RRRLSTNA

SEQ ID NO: 424991 - protein, 8 aa, Influenza virus
TPLGSPPV

SEQ ID NO: 424992 - protein, 8 aa, Influenza virus
TQNNTTVV

SEQ ID NO: 424993 - protein, 8 aa, Influenza virus
IYSSSMMW

SEQ ID NO: 424994 - protein, 8 aa, Influenza virus
TSKVKMKW

SEQ ID NO: 424995 - protein, 8 aa, Influenza virus
ASIRNSTY

SEQ ID NO: 424996 - protein, 8 aa, Influenza virus
NADHRIYW

SEQ ID NO: 424997 - protein, 8 aa, Influenza virus
LRSLFSSI

SEQ ID NO: 424998 - protein, 8 aa, Influenza virus
SLKLAIGL

SEQ ID NO: 424999 - protein, 8 aa, Influenza virus
QGTMDYYW

SEQ ID NO: 425000 - protein, 8 aa, Influenza virus
MGAVNSSM

SEQ ID NO: 425001 - protein, 8 aa, Influenza virus
APDRVSFF

SEQ ID NO: 425002 - protein, 8 aa, Influenza virus
IHYGGVPT

SEQ ID NO: 425003 - protein, 8 aa, Influenza virus
RREVHIYY

SEQ ID NO: 425004 - protein, 8 aa, Influenza virus
RLGRGYMF

SEQ ID NO: 425005 - protein, 8 aa, Influenza virus
LLNPFVSH

SEQ ID NO: 425006 - protein, 8 aa, Influenza virus
DRSPHRTL

SEQ ID NO: 425007 - protein, 8 aa, Influenza virus
ITIDSVSL

SEQ ID NO: 425008 - protein, 8 aa, Influenza virus
WSYNADLL

SEQ ID NO: 425009 - protein, 8 aa, Influenza virus
RSLIRFPV

SEQ ID NO: 425010 - protein, 8 aa, Influenza virus
WMCSNGSL

SEQ ID NO: 425011 - protein, 8 aa, Influenza virus
SERGEETI

SEQ ID NO: 425012 - protein, 8 aa, Influenza virus
FQRSKFLL

SEQ ID NO: 425013 - protein, 8 aa, Influenza virus
ASMRRDYF

SEQ ID NO: 425014 - protein, 8 aa, Influenza virus
GLVAPSRV

SEQ ID NO: 425015 - protein, 8 aa, Influenza virus
YNTELLVL

SEQ ID NO: 425016 - protein, 8 aa, Influenza virus
NTWVNQTF

SEQ ID NO: 425017 - protein, 8 aa, Influenza virus
WEMGQAPS

SEQ ID NO: 425018 - protein, 8 aa, Influenza virus
FPMGTAPV

SEQ ID NO: 425019 - protein, 8 aa, Influenza virus
GYVCSGIF

SEQ ID NO: 425020 - protein, 8 aa, Influenza virus
ELIRGRPI

SEQ ID NO: 425021 - protein, 8 aa, Influenza virus
YDKVRLQL

SEQ ID NO: 425022 - protein, 8 aa, Influenza virus
LSGREWSY

SEQ ID NO: 425023 - protein, 8 aa, Influenza virus
LRMKWMMA

SEQ ID NO: 425024 - protein, 8 aa, Influenza virus
DVCYPGRF

SEQ ID NO: 425025 - protein, 8 aa, Influenza virus
NEEGDIIF

SEQ ID NO: 425026 - protein, 8 aa, Influenza virus
VQNDYTTV

SEQ ID NO: 425027 - protein, 8 aa, Influenza virus
ETKCQSPL

SEQ ID NO: 425028 - protein, 8 aa, Influenza virus
IQIDAVKL

SEQ ID NO: 425029 - protein, 8 aa, Influenza virus
TLASTNAY

SEQ ID NO: 425030 - protein, 8 aa, Influenza virus
ITSKVNSI

SEQ ID NO: 425031 - protein, 8 aa, Influenza virus
IAILATTI

SEQ ID NO: 425032 - protein, 8 aa, Influenza virus
RLYLWGVH

SEQ ID NO: 425033 - protein, 8 aa, Influenza virus
IHYGGMPT

SEQ ID NO: 425034 - protein, 8 aa, Influenza virus
AIDNMQNK

SEQ ID NO: 425035 - protein, 8 aa, Influenza virus
GRYSKADK

SEQ ID NO: 425036 - protein, 8 aa, Influenza virus
TINSWHIY

SEQ ID NO: 425037 - protein, 8 aa, Influenza virus
VRSEKLVL

SEQ ID NO: 425038 - protein, 8 aa, Influenza virus
LSMVRSDK

SEQ ID NO: 425039 - protein, 8 aa, Influenza virus
RTWAKNIL

SEQ ID NO: 425040 - protein, 8 aa, Influenza virus
RSGYEVLK

SEQ ID NO: 425041 - protein, 8 aa, Influenza virus
LTQGRQTY

SEQ ID NO: 425042 - protein, 8 aa, Influenza virus
RRLSTNAM

SEQ ID NO: 425043 - protein, 8 aa, Influenza virus
DIIFLWGI

SEQ ID NO: 425044 - protein, 8 aa, Influenza virus
RMITQRTI

SEQ ID NO: 425045 - protein, 8 aa, Influenza virus
FHFEECSC

SEQ ID NO: 425046 - protein, 8 aa, Influenza virus
GTSKIKMK

SEQ ID NO: 425047 - protein, 8 aa, Influenza virus
WINSPNHV

SEQ ID NO: 425048 - protein, 8 aa, Influenza virus
RSWRRQIL

SEQ ID NO: 425049 - protein, 8 aa, Influenza virus
MIVELAEK

SEQ ID NO: 425050 - protein, 8 aa, Influenza virus
IENGWEGM

SEQ ID NO: 425051 - protein, 8 aa, Influenza virus
SFYRSMRW

SEQ ID NO: 425052 - protein, 8 aa, Influenza virus
NVYKILSI

SEQ ID NO: 425053 - protein, 8 aa, Influenza virus
AMISRARI

SEQ ID NO: 425054 - protein, 8 aa, Influenza virus
FYRSMRWL

SEQ ID NO: 425055 - protein, 8 aa, Influenza virus
DINLMPIY

SEQ ID NO: 425056 - protein, 8 aa, Influenza virus
ASTGGQAF

SEQ ID NO: 425057 - protein, 8 aa, Influenza virus
KIEGWVVV

SEQ ID NO: 425058 - protein, 8 aa, Influenza virus
RALVRSGM

SEQ ID NO: 425059 - protein, 8 aa, Influenza virus
GTSKVKMK

SEQ ID NO: 425060 - protein, 8 aa, Influenza virus
SSSYRRPV

SEQ ID NO: 425061 - protein, 8 aa, Influenza virus
CHDGVGRM

SEQ ID NO: 425062 - protein, 8 aa, Influenza virus
NVPEWSYI

SEQ ID NO: 425063 - protein, 8 aa, Influenza virus
EEGDIIFL

SEQ ID NO: 425064 - protein, 8 aa, Influenza virus
THFEKIKI

SEQ ID NO: 425065 - protein, 8 aa, Influenza virus
WESLTGTA

SEQ ID NO: 425066 - protein, 8 aa, Influenza virus
GLRNTPSV

SEQ ID NO: 425067 - protein, 8 aa, Influenza virus
VLHLILWI

SEQ ID NO: 425068 - protein, 8 aa, Influenza virus
FTKWNVTY

SEQ ID NO: 425069 - protein, 8 aa, Influenza virus
FRYGNGVW

SEQ ID NO: 425070 - protein, 8 aa, Influenza virus
VLGIINLL

SEQ ID NO: 425071 - protein, 8 aa, Influenza virus
HSRYREEA

SEQ ID NO: 425072 - protein, 8 aa, Influenza virus
GTYDYPRY

SEQ ID NO: 425073 - protein, 8 aa, Influenza virus
SLQCKICI

SEQ ID NO: 425074 - protein, 8 aa, Influenza virus
KLCRLSGI

SEQ ID NO: 425075 - protein, 8 aa, Influenza virus
KIITIGSI

SEQ ID NO: 425076 - protein, 8 aa, Influenza virus
ELCPSPLK

SEQ ID NO: 425077 - protein, 8 aa, Influenza virus
HMAIIKKY

SEQ ID NO: 425078 - protein, 8 aa, Influenza virus
SMRRNYFT

SEQ ID NO: 425079 - protein, 8 aa, Influenza virus
NTYDHSQY

SEQ ID NO: 425080 - protein, 8 aa, Influenza virus
LAALIMGF

SEQ ID NO: 425081 - protein, 8 aa, Influenza virus
SFYGELKW

SEQ ID NO: 425082 - protein, 8 aa, Influenza virus
TSNRGSFY

SEQ ID NO: 425083 - protein, 8 aa, Influenza virus
SNDTINYY

SEQ ID NO: 425084 - protein, 8 aa, Influenza virus
ISLCSIWF

SEQ ID NO: 425085 - protein, 8 aa, Influenza virus
LQALQLLL

SEQ ID NO: 425086 - protein, 8 aa, Influenza virus
APRYAFEL

SEQ ID NO: 425087 - protein, 8 aa, Influenza virus
ITVWSSKY

SEQ ID NO: 425088 - protein, 8 aa, Influenza virus
RAVKLYKK

SEQ ID NO: 425089 - protein, 8 aa, Influenza virus
NINFMPYI

SEQ ID NO: 425090 - protein, 8 aa, Influenza virus
RALISWPL

SEQ ID NO: 425091 - protein, 8 aa, Influenza virus
ALGYSTGA

SEQ ID NO: 425092 - protein, 8 aa, Influenza virus
KTFQNIER

SEQ ID NO: 425093 - protein, 8 aa, Influenza virus
SQYLCTGI

SEQ ID NO: 425094 - protein, 8 aa, Influenza virus
YQSLRSIL

SEQ ID NO: 425095 - protein, 8 aa, Influenza virus
ASTGAQSF

SEQ ID NO: 425096 - protein, 8 aa, Influenza virus
ILEDEQMY

SEQ ID NO: 425097 - protein, 8 aa, Influenza virus
MTNVQNNY

SEQ ID NO: 425098 - protein, 8 aa, Influenza virus
WMKIYWSL

SEQ ID NO: 425099 - protein, 8 aa, Influenza virus
AINSSMPL

SEQ ID NO: 425100 - protein, 8 aa, Influenza virus
NRFQIQGI

SEQ ID NO: 425101 - protein, 8 aa, Influenza virus
TREGKHIV

SEQ ID NO: 425102 - protein, 8 aa, Influenza virus
FESIESEF

SEQ ID NO: 425103 - protein, 8 aa, Influenza virus
ISKTNQQF

SEQ ID NO: 425104 - protein, 8 aa, Influenza virus
NTYDHSTY

SEQ ID NO: 425105 - protein, 8 aa, Influenza virus
VETLARSI

SEQ ID NO: 425106 - protein, 8 aa, Influenza virus
QIQTRRAF

SEQ ID NO: 425107 - protein, 8 aa, Influenza virus
QLRMATGL

SEQ ID NO: 425108 - protein, 8 aa, Influenza virus
GLGIQSGV

SEQ ID NO: 425109 - protein, 8 aa, Influenza virus
SMQCRICI

SEQ ID NO: 425110 - protein, 8 aa, Influenza virus
HKWEKYCI

SEQ ID NO: 425111 - protein, 8 aa, Influenza virus
CSFTGWIL

SEQ ID NO: 425112 - protein, 8 aa, Influenza virus
GSIRNETY

SEQ ID NO: 425113 - protein, 8 aa, Influenza virus
VMLLAIAM

SEQ ID NO: 425114 - protein, 8 aa, Influenza virus
CHDGKARM

SEQ ID NO: 425115 - protein, 8 aa, Influenza virus
NSIRNGTY

SEQ ID NO: 425116 - protein, 8 aa, Influenza virus
CFILLAVI

SEQ ID NO: 425117 - protein, 8 aa, Influenza virus
RGVKGFGF

SEQ ID NO: 425118 - protein, 8 aa, Influenza virus
ITTHFQRK

SEQ ID NO: 425119 - protein, 8 aa, Influenza virus
GIDKVCTK

SEQ ID NO: 425120 - protein, 8 aa, Influenza virus
ITYNNTVI

SEQ ID NO: 425121 - protein, 8 aa, Influenza virus
SLVLAALI

SEQ ID NO: 425122 - protein, 8 aa, Influenza virus
GIFESSCL

SEQ ID NO: 425123 - protein, 8 aa, Influenza virus
AQSFYRSI

SEQ ID NO: 425124 - protein, 8 aa, Influenza virus
YRVGYLCA

SEQ ID NO: 425125 - protein, 8 aa, Influenza virus
ILAATVTL

SEQ ID NO: 425126 - protein, 8 aa, Influenza virus
RTSHRTLL

SEQ ID NO: 425127 - protein, 8 aa, Influenza virus
SLILAAII

SEQ ID NO: 425128 - protein, 8 aa, Influenza virus
RATEYMMK

SEQ ID NO: 425129 - protein, 8 aa, Influenza virus
YIKSDQLK

SEQ ID NO: 425130 - protein, 8 aa, Influenza virus
FEANGNLI

SEQ ID NO: 425131 - protein, 8 aa, Influenza virus
NGKAPISL

SEQ ID NO: 425132 - protein, 8 aa, Influenza virus
ISIGTSTL

SEQ ID NO: 425133 - protein, 8 aa, Influenza virus
VLEKNVTV

SEQ ID NO: 425134 - protein, 8 aa, Influenza virus
WFGYFGIF

SEQ ID NO: 425135 - protein, 8 aa, Influenza virus
VSSSGTSK

SEQ ID NO: 425136 - protein, 8 aa, Influenza virus
IMIDGSAS

SEQ ID NO: 425137 - protein, 8 aa, Influenza virus
LTHHMRKK

SEQ ID NO: 425138 - protein, 8 aa, Influenza virus
TRDSITEV

SEQ ID NO: 425139 - protein, 8 aa, Influenza virus
SKVYKTYF

SEQ ID NO: 425140 - protein, 8 aa, Influenza virus
ITNKINSI

SEQ ID NO: 425141 - protein, 8 aa, Influenza virus
RVLRENAV

SEQ ID NO: 425142 - protein, 8 aa, Influenza virus
STQPTFSV

SEQ ID NO: 425143 - protein, 8 aa, Influenza virus
LLASTNAH

SEQ ID NO: 425144 - protein, 8 aa, Influenza virus
WSYNAKLL

SEQ ID NO: 425145 - protein, 8 aa, Influenza virus
NRLSINPV

SEQ ID NO: 425146 - protein, 8 aa, Influenza virus
VTYQILSI

SEQ ID NO: 425147 - protein, 8 aa, Influenza virus
STDTVNTL

SEQ ID NO: 425148 - protein, 8 aa, Influenza virus
CSNDTINY

SEQ ID NO: 425149 - protein, 8 aa, Influenza virus
YQSIRSIL

SEQ ID NO: 425150 - protein, 8 aa, Influenza virus
IQMCTELK

SEQ ID NO: 425151 - protein, 8 aa, Influenza virus
KTNLYGFI

SEQ ID NO: 425152 - protein, 8 aa, Influenza virus
NTKCQTSL

SEQ ID NO: 425153 - protein, 8 aa, Influenza virus
IMIWHSNL

SEQ ID NO: 425154 - protein, 8 aa, Influenza virus
KIMKIRPI

SEQ ID NO: 425155 - protein, 8 aa, Influenza virus
KSTKSTVL

SEQ ID NO: 425156 - protein, 8 aa, Influenza virus
KMITQRTI

SEQ ID NO: 425157 - protein, 8 aa, Influenza virus
AQYREEAL

SEQ ID NO: 425158 - protein, 8 aa, Influenza virus
TEVYNETV

SEQ ID NO: 425159 - protein, 8 aa, Influenza virus
NAYKIVKK

SEQ ID NO: 425160 - protein, 8 aa, Influenza virus
RQMVHAMR

SEQ ID NO: 425161 - protein, 8 aa, Influenza virus
SMQCKICI

SEQ ID NO: 425162 - protein, 8 aa, Influenza virus
KILSIYST

SEQ ID NO: 425163 - protein, 8 aa, Influenza virus
SSFVLLAV

SEQ ID NO: 425164 - protein, 8 aa, Influenza virus
GQKGRIDY

SEQ ID NO: 425165 - protein, 8 aa, Influenza virus
FTSFFYRY

SEQ ID NO: 425166 - protein, 8 aa, Influenza virus
ATAVAVIK

SEQ ID NO: 425167 - protein, 8 aa, Influenza virus
LIRGNSPV

SEQ ID NO: 425168 - protein, 8 aa, Influenza virus
RRVLKENA

SEQ ID NO: 425169 - protein, 8 aa, Influenza virus
LVGIDPFK

SEQ ID NO: 425170 - protein, 8 aa, Influenza virus
FQIQGIKL

SEQ ID NO: 425171 - protein, 8 aa, Influenza virus
RRRLSANA

SEQ ID NO: 425172 - protein, 8 aa, Influenza virus
HEGEGIPL

SEQ ID NO: 425173 - protein, 8 aa, Influenza virus
SQLEGFSA

SEQ ID NO: 425174 - protein, 8 aa, Influenza virus
SLNGVSPI

SEQ ID NO: 425175 - protein, 8 aa, Influenza virus
HKWEKYCV

SEQ ID NO: 425176 - protein, 8 aa, Influenza virus
FTAVGKEF

SEQ ID NO: 425177 - protein, 8 aa, Influenza virus
RLVLATGL

SEQ ID NO: 425178 - protein, 8 aa, Influenza virus
KIVHIGPL

SEQ ID NO: 425179 - protein, 8 aa, Influenza virus
FYRNMRWL

SEQ ID NO: 425180 - protein, 8 aa, Influenza virus
FALSGVAI

SEQ ID NO: 425181 - protein, 8 aa, Influenza virus
RSRNGFEM

SEQ ID NO: 425182 - protein, 8 aa, Influenza virus
SLFEKFFP

SEQ ID NO: 425183 - protein, 8 aa, Influenza virus
LLFLKIPV

SEQ ID NO: 425184 - protein, 8 aa, Influenza virus
KRMEDGFI

SEQ ID NO: 425185 - protein, 8 aa, Influenza virus
KLRMVTGL

SEQ ID NO: 425186 - protein, 8 aa, Influenza virus
SRSLKLAI

SEQ ID NO: 425187 - protein, 8 aa, Influenza virus
VSSLVLAI

SEQ ID NO: 425188 - protein, 8 aa, Influenza virus
IVLVMKRK

SEQ ID NO: 425189 - protein, 8 aa, Influenza virus
STDKVDTI

SEQ ID NO: 425190 - protein, 8 aa, Influenza virus
TQYRAESL

SEQ ID NO: 425191 - protein, 8 aa, Influenza virus
GRILKNNL

SEQ ID NO: 425192 - protein, 8 aa, Influenza virus
GMGMAADK

SEQ ID NO: 425193 - protein, 8 aa, Influenza virus
IAPNRASF

SEQ ID NO: 425194 - protein, 8 aa, Influenza virus
SIAHKSCL

SEQ ID NO: 425195 - protein, 8 aa, Influenza virus
SFYTELKW

SEQ ID NO: 425196 - protein, 8 aa, Influenza virus
LTQGRQTF

SEQ ID NO: 425197 - protein, 8 aa, Influenza virus
ILRGSIAH

SEQ ID NO: 425198 - protein, 8 aa, Influenza virus
KVDNIVDK

SEQ ID NO: 425199 - protein, 8 aa, Influenza virus
LTIGKCPK

SEQ ID NO: 425200 - protein, 8 aa, Influenza virus
YAQTDCVL

SEQ ID NO: 425201 - protein, 8 aa, Influenza virus
SSSMMWEI

SEQ ID NO: 425202 - protein, 8 aa, Influenza virus
YIVERPTA

SEQ ID NO: 425203 - protein, 8 aa, Influenza virus
NECRFYAL

SEQ ID NO: 425204 - protein, 8 aa, Influenza virus
TEMWSYNA

SEQ ID NO: 425205 - protein, 8 aa, Influenza virus
RQTFDWTL

SEQ ID NO: 425206 - protein, 8 aa, Influenza virus
FAAICTHL

SEQ ID NO: 425207 - protein, 8 aa, Influenza virus
IEHQIGNV

SEQ ID NO: 425208 - protein, 8 aa, Influenza virus
MGAINSSM

SEQ ID NO: 425209 - protein, 8 aa, Influenza virus
RPFVRGQQ

SEQ ID NO: 425210 - protein, 8 aa, Influenza virus
GINDRNFW

SEQ ID NO: 425211 - protein, 8 aa, Influenza virus
MMGMFNML

SEQ ID NO: 425212 - protein, 8 aa, Influenza virus
ALLAPRYA

SEQ ID NO: 425213 - protein, 8 aa, Influenza virus
IRMAINLV

SEQ ID NO: 425214 - protein, 8 aa, Influenza virus
YQFALGHG

SEQ ID NO: 425215 - protein, 8 aa, Influenza virus
MENERTLY

SEQ ID NO: 425216 - protein, 8 aa, Influenza virus
FQLFLVCV

SEQ ID NO: 425217 - protein, 8 aa, Influenza virus
LEECSCYV

SEQ ID NO: 425218 - protein, 8 aa, Influenza virus
RKRDSSIL

SEQ ID NO: 425219 - protein, 8 aa, Influenza virus
TSYRTLLM

SEQ ID NO: 425220 - protein, 8 aa, Influenza virus
SLYASPQL

SEQ ID NO: 425221 - protein, 8 aa, Influenza virus
AIVQITGK

SEQ ID NO: 425222 - protein, 8 aa, Influenza virus
IHYGGIPT

SEQ ID NO: 425223 - protein, 8 aa, Influenza virus
TYSSSLMW

SEQ ID NO: 425224 - protein, 8 aa, Influenza virus
MQALQLLL

SEQ ID NO: 425225 - protein, 8 aa, Influenza virus
YRNLAWFV

SEQ ID NO: 425226 - protein, 8 aa, Influenza virus
KTLKWEPL

SEQ ID NO: 425227 - protein, 8 aa, Influenza virus
QYRALVSW

SEQ ID NO: 425228 - protein, 8 aa, Influenza virus
YAFGNCPK

SEQ ID NO: 425229 - protein, 8 aa, Influenza virus
GTYDYPRY

SEQ ID NO: 425230 - protein, 8 aa, Influenza virus
ITNKANSI

SEQ ID NO: 425231 - protein, 8 aa, Influenza virus
ISATGMTL

SEQ ID NO: 425232 - protein, 8 aa, Influenza virus
VWWASNSL

SEQ ID NO: 425233 - protein, 8 aa, Influenza virus
VELAEKAM

SEQ ID NO: 425234 - protein, 8 aa, Influenza virus
SKCYQFAL

SEQ ID NO: 425235 - protein, 8 aa, Influenza virus
ASIRRNYF

SEQ ID NO: 425236 - protein, 8 aa, Influenza virus
NKRYGPAL

SEQ ID NO: 425237 - protein, 8 aa, Influenza virus
MDYYWGIL

SEQ ID NO: 425238 - protein, 8 aa, Influenza virus
FGASCFLL

SEQ ID NO: 425239 - protein, 8 aa, Influenza virus
ISATGVTL

SEQ ID NO: 425240 - protein, 8 aa, Influenza virus
YDKVRMQL

SEQ ID NO: 425241 - protein, 8 aa, Influenza virus
THFEKVKI

SEQ ID NO: 425242 - protein, 8 aa, Influenza virus
SGNCRFSV

SEQ ID NO: 425243 - protein, 8 aa, Influenza virus
GQAFYRSI

SEQ ID NO: 425244 - protein, 8 aa, Influenza virus
SVASSLVL

SEQ ID NO: 425245 - protein, 8 aa, Influenza virus
LLLQITSL

SEQ ID NO: 425246 - protein, 8 aa, Influenza virus
LHNGGLIA

SEQ ID NO: 425247 - protein, 8 aa, Influenza virus
IGKTSWSY

SEQ ID NO: 425248 - protein, 8 aa, Influenza virus
LVASSGTL

SEQ ID NO: 425249 - protein, 8 aa, Influenza virus
LIASSGTL

SEQ ID NO: 425250 - protein, 8 aa, Influenza virus
YIIRALTL

SEQ ID NO: 425251 - protein, 8 aa, Influenza virus
WSYNAGLL

SEQ ID NO: 425252 - protein, 8 aa, Influenza virus
RQKSLIWL

SEQ ID NO: 425253 - protein, 8 aa, Influenza virus
FSHYNQMK

SEQ ID NO: 425254 - protein, 8 aa, Influenza virus
HMGECPKY

SEQ ID NO: 425255 - protein, 8 aa, Influenza virus
NVRCTFCI

SEQ ID NO: 425256 - protein, 8 aa, Influenza virus
VANGTIVK

SEQ ID NO: 425257 - protein, 8 aa, Influenza virus
FFNNTEPL

SEQ ID NO: 425258 - protein, 8 aa, Influenza virus
VLRPGQTL

SEQ ID NO: 425259 - protein, 8 aa, Influenza virus
CYPNLCQV

SEQ ID NO: 425260 - protein, 8 aa, Influenza virus
IITREPYV

SEQ ID NO: 425261 - protein, 8 aa, Influenza virus
STGGQAFY

SEQ ID NO: 425262 - protein, 8 aa, Influenza virus
FQSLIPKA

SEQ ID NO: 425263 - protein, 8 aa, Influenza virus
VNSDTTSW

SEQ ID NO: 425264 - protein, 8 aa, Influenza virus
VTTHFQRK

SEQ ID NO: 425265 - protein, 8 aa, Influenza virus
SLQNRIQI

SEQ ID NO: 425266 - protein, 8 aa, Influenza virus
WQGSNRPV

SEQ ID NO: 425267 - protein, 8 aa, Influenza virus
RMEFSWIL

SEQ ID NO: 425268 - protein, 8 aa, Influenza virus
SSSLMWEI

SEQ ID NO: 425269 - protein, 8 aa, Influenza virus
CPSPLRLV

SEQ ID NO: 425270 - protein, 8 aa, Influenza virus
KIKMKWGM

SEQ ID NO: 425271 - protein, 8 aa, Influenza virus
GRFYIQMC

SEQ ID NO: 425272 - protein, 8 aa, Influenza virus
YRNLIWFV

SEQ ID NO: 425273 - protein, 8 aa, Influenza virus
KIIRVGCV

SEQ ID NO: 425274 - protein, 8 aa, Influenza virus
ISSMMEAM

SEQ ID NO: 425275 - protein, 8 aa, Influenza virus
LVKTTLFL

SEQ ID NO: 425276 - protein, 8 aa, Influenza virus
KYGNGVWM

SEQ ID NO: 425277 - protein, 8 aa, Influenza virus
RFYRTCKL

SEQ ID NO: 425278 - protein, 8 aa, Influenza virus
FSMELPSF

SEQ ID NO: 425279 - protein, 8 aa, Influenza virus
NQNNTTVV

SEQ ID NO: 425280 - protein, 8 aa, Influenza virus
ETKCQTPL

SEQ ID NO: 425281 - protein, 8 aa, Influenza virus
ISFQSGHI

SEQ ID NO: 425282 - protein, 8 aa, Influenza virus
IRTFFGWK

SEQ ID NO: 425283 - protein, 8 aa, Influenza virus
IMERNVTV

SEQ ID NO: 425284 - protein, 8 aa, Influenza virus
GINMSKKK

SEQ ID NO: 425285 - protein, 8 aa, Influenza virus
GTYSYPQY

SEQ ID NO: 425286 - protein, 8 aa, Influenza virus
GQCGILGI

SEQ ID NO: 425287 - protein, 8 aa, Influenza virus
LKMPASRY

SEQ ID NO: 425288 - protein, 8 aa, Influenza virus
GESEQIVV

SEQ ID NO: 425289 - protein, 8 aa, Influenza virus
HANNSTEK

SEQ ID NO: 425290 - protein, 8 aa, Influenza virus
FAAICTHM

SEQ ID NO: 425291 - protein, 8 aa, Influenza virus
GTYYYPKY

SEQ ID NO: 425292 - protein, 8 aa, Influenza virus
NLYDRVRL

SEQ ID NO: 425293 - protein, 8 aa, Influenza virus
GYKDWILW

SEQ ID NO: 425294 - protein, 8 aa, Influenza virus
SFYRNLAW

SEQ ID NO: 425295 - protein, 8 aa, Influenza virus
MEYDAVAT

SEQ ID NO: 425296 - protein, 8 aa, Influenza virus
EVSFRGGH

SEQ ID NO: 425297 - protein, 8 aa, Influenza virus
NSADHRVY

SEQ ID NO: 425298 - protein, 8 aa, Influenza virus
SRSGFEMI

SEQ ID NO: 425299 - protein, 8 aa, Influenza virus
FVFSIAAS

SEQ ID NO: 425300 - protein, 8 aa, Influenza virus
TETVNTLI

SEQ ID NO: 425301 - protein, 8 aa, Influenza virus
SHNGGLIA

SEQ ID NO: 425302 - protein, 8 aa, Influenza virus
YVNNTTVI

SEQ ID NO: 425303 - protein, 8 aa, Influenza virus
YSSVASSL

SEQ ID NO: 425304 - protein, 8 aa, Influenza virus
GQQGWMDY

SEQ ID NO: 425305 - protein, 8 aa, Influenza virus
RVKRRPVA

SEQ ID NO: 425306 - protein, 8 aa, Influenza virus
RIPHRTLL

SEQ ID NO: 425307 - protein, 8 aa, Influenza virus
YQAELLIA

SEQ ID NO: 425308 - protein, 8 aa, Influenza virus
NTYNHTQY

SEQ ID NO: 425309 - protein, 8 aa, Influenza virus
RRRFVQNA

SEQ ID NO: 425310 - protein, 8 aa, Influenza virus
GTYDYPRY

SEQ ID NO: 425311 - protein, 8 aa, Influenza virus
ESDGAFLA

SEQ ID NO: 425312 - protein, 8 aa, Influenza virus
NPKCDRLL

SEQ ID NO: 425313 - protein, 8 aa, Influenza virus
WTSNSIAV

SEQ ID NO: 425314 - protein, 8 aa, Influenza virus
GTYNHQDY

SEQ ID NO: 425315 - protein, 8 aa, Influenza virus
NTYDHAQY

SEQ ID NO: 425316 - protein, 8 aa, Influenza virus
LRGRGSTL

SEQ ID NO: 425317 - protein, 8 aa, Influenza virus
VSSFYSEM

SEQ ID NO: 425318 - protein, 8 aa, Influenza virus
FESTGNLV

SEQ ID NO: 425319 - protein, 8 aa, Influenza virus
GYKDIILW

SEQ ID NO: 425320 - protein, 8 aa, Influenza virus
NVIDKMYK

SEQ ID NO: 425321 - protein, 8 aa, Influenza virus
FERVRRQL

SEQ ID NO: 425322 - protein, 8 aa, Influenza virus
LINTYQWI

SEQ ID NO: 425323 - protein, 8 aa, Influenza virus
FLMQIAIL

SEQ ID NO: 425324 - protein, 8 aa, Influenza virus
LEHTSRYI

SEQ ID NO: 425325 - protein, 8 aa, Influenza virus
KSCLPACI

SEQ ID NO: 425326 - protein, 8 aa, Influenza virus
TVNRTHQY

SEQ ID NO: 425327 - protein, 8 aa, Influenza virus
YNFNEGSY

SEQ ID NO: 425328 - protein, 8 aa, Influenza virus
ESRSGFEM

SEQ ID NO: 425329 - protein, 8 aa, Influenza virus
IGDGQRSW

SEQ ID NO: 425330 - protein, 8 aa, Influenza virus
YKSTQSAV

SEQ ID NO: 425331 - protein, 8 aa, Influenza virus
NRHSNGTI

SEQ ID NO: 425332 - protein, 8 aa, Influenza virus
CYMDIDVY

SEQ ID NO: 425333 - protein, 8 aa, Influenza virus
CSNGSCRF

SEQ ID NO: 425334 - protein, 8 aa, Influenza virus
NLGQVECV

SEQ ID NO: 425335 - protein, 8 aa, Influenza virus
YRNLIWFV

SEQ ID NO: 425336 - protein, 8 aa, Influenza virus
WEPLAGTA

SEQ ID NO: 425337 - protein, 8 aa, Influenza virus
CKRTVSSF

SEQ ID NO: 425338 - protein, 8 aa, Influenza virus
RTLMSVKI

SEQ ID NO: 425339 - protein, 8 aa, Influenza virus
AVTDIWSY

SEQ ID NO: 425340 - protein, 8 aa, Influenza virus
YIVERPSA

SEQ ID NO: 425341 - protein, 8 aa, Influenza virus
ILCASATA

SEQ ID NO: 425342 - protein, 8 aa, Influenza virus
LINDPWVL

SEQ ID NO: 425343 - protein, 8 aa, Influenza virus
CRFYALSQ

SEQ ID NO: 425344 - protein, 8 aa, Influenza virus
WIRFNSDL

SEQ ID NO: 425345 - protein, 8 aa, Influenza virus
YLIGKTSW

SEQ ID NO: 425346 - protein, 8 aa, Influenza virus
KPGQTLRV

SEQ ID NO: 425347 - protein, 8 aa, Influenza virus
TSRSGFEM

SEQ ID NO: 425348 - protein, 8 aa, Influenza virus
SFYKSMRW

SEQ ID NO: 425349 - protein, 8 aa, Influenza virus
QSGRISFY

SEQ ID NO: 425350 - protein, 8 aa, Influenza virus
NTIEVFRL

SEQ ID NO: 425351 - protein, 8 aa, Influenza virus
AGFIENGW

SEQ ID NO: 425352 - protein, 8 aa, Influenza virus
SISCLYKL

SEQ ID NO: 425353 - protein, 8 aa, Influenza virus
MQNRLNNV

SEQ ID NO: 425354 - protein, 8 aa, Influenza virus
KLGSPLVL

SEQ ID NO: 425355 - protein, 8 aa, Influenza virus
SLNGISPI

SEQ ID NO: 425356 - protein, 8 aa, Influenza virus
ISVGTSTL

SEQ ID NO: 425357 - protein, 8 aa, Influenza virus
ELKWLISK

SEQ ID NO: 425358 - protein, 8 aa, Influenza virus
IMYFHKGL

SEQ ID NO: 425359 - protein, 8 aa, Influenza virus
SSKYHQSF

SEQ ID NO: 425360 - protein, 8 aa, Influenza virus
HSVHRNTI

SEQ ID NO: 425361 - protein, 8 aa, Influenza virus
ALILRGSI

SEQ ID NO: 425362 - protein, 8 aa, Influenza virus
SVYKALSI

SEQ ID NO: 425363 - protein, 8 aa, Influenza virus
KIRRRVDI

SEQ ID NO: 425364 - protein, 8 aa, Influenza virus
YQQSFTPS

SEQ ID NO: 425365 - protein, 8 aa, Influenza virus
SKCHQFAL

SEQ ID NO: 425366 - protein, 8 aa, Influenza virus
YLIRALTL

SEQ ID NO: 425367 - protein, 8 aa, Influenza virus
WWVWLWLV

SEQ ID NO: 425368 - protein, 8 aa, Influenza virus
RREVHVYY

SEQ ID NO: 425369 - protein, 8 aa, Influenza virus
SPHRTLLM

SEQ ID NO: 425370 - protein, 8 aa, Influenza virus
FYRSMKWL

SEQ ID NO: 425371 - protein, 8 aa, Influenza virus
ELRSKYWA

SEQ ID NO: 425372 - protein, 8 aa, Influenza virus
FVIREPCI

SEQ ID NO: 425373 - protein, 8 aa, Influenza virus
CYPRYPNV

SEQ ID NO: 425374 - protein, 8 aa, Influenza virus
EVNSWHIL

SEQ ID NO: 425375 - protein, 8 aa, Influenza virus
RVSFYWTI

SEQ ID NO: 425376 - protein, 8 aa, Influenza virus
KRKKRGLF

SEQ ID NO: 425377 - protein, 8 aa, Influenza virus
EVTNATEL

SEQ ID NO: 425378 - protein, 8 aa, Influenza virus
VKMEKIVL

SEQ ID NO: 425379 - protein, 8 aa, Influenza virus
SLQQIESM

SEQ ID NO: 425380 - protein, 8 aa, Influenza virus
YEVGYLCA

SEQ ID NO: 425381 - protein, 8 aa, Influenza virus
RYICSGLV

SEQ ID NO: 425382 - protein, 8 aa, Influenza virus
TRDSLTEI

SEQ ID NO: 425383 - protein, 8 aa, Influenza virus
KPGQTLRI

SEQ ID NO: 425384 - protein, 8 aa, Influenza virus
TRRAFELK

SEQ ID NO: 425385 - protein, 8 aa, Influenza virus
KSITQTLV

SEQ ID NO: 425386 - protein, 8 aa, Influenza virus
MGLFFFCL

SEQ ID NO: 425387 - protein, 8 aa, Influenza virus
SLCSVEGW

SEQ ID NO: 425388 - protein, 8 aa, Influenza virus
KRLLRENA

SEQ ID NO: 425389 - protein, 8 aa, Influenza virus
FELIDNEF

SEQ ID NO: 425390 - protein, 8 aa, Influenza virus
YIIEKYGT

SEQ ID NO: 425391 - protein, 8 aa, Influenza virus
GMCYPGSV

SEQ ID NO: 425392 - protein, 8 aa, Influenza virus
SIQSKGLF

SEQ ID NO: 425393 - protein, 8 aa, Influenza virus
WMDYYWGI

SEQ ID NO: 425394 - protein, 8 aa, Influenza virus
YVQMCTEL

SEQ ID NO: 425395 - protein, 8 aa, Influenza virus
YSTVASSI

SEQ ID NO: 425396 - protein, 8 aa, Influenza virus
QESSCVCV

SEQ ID NO: 425397 - protein, 8 aa, Influenza virus
SVFNSLYA

SEQ ID NO: 425398 - protein, 8 aa, Influenza virus
ITNLGLNI

SEQ ID NO: 425399 - protein, 8 aa, Influenza virus
NPSCATNI

SEQ ID NO: 425400 - protein, 8 aa, Influenza virus
FESTGNLI

SEQ ID NO: 425401 - protein, 8 aa, Influenza virus
KRGLFGAI

SEQ ID NO: 425402 - protein, 8 aa, Influenza virus
LILTFIMW

SEQ ID NO: 425403 - protein, 8 aa, Influenza virus
WEINGPES

SEQ ID NO: 425404 - protein, 9 aa, Influenza virus
FMYSDFHFI

SEQ ID NO: 425405 - protein, 9 aa, Influenza virus
ITYSSSLMW

SEQ ID NO: 425406 - protein, 9 aa, Influenza virus
YMGECPNYV

SEQ ID NO: 425407 - protein, 9 aa, Influenza virus
LSSRISFYW

SEQ ID NO: 425408 - protein, 9 aa, Influenza virus
CAVATTHSW

SEQ ID NO: 425409 - protein, 9 aa, Influenza virus
YMGECPEYV

SEQ ID NO: 425410 - protein, 9 aa, Influenza virus
YTLVTTSSW

SEQ ID NO: 425411 - protein, 9 aa, Influenza virus
TLMEQNVPV

SEQ ID NO: 425412 - protein, 9 aa, Influenza virus
ITYSSSMMW

SEQ ID NO: 425413 - protein, 9 aa, Influenza virus
ITYSSPMMW

SEQ ID NO: 425414 - protein, 9 aa, Influenza virus
YTLVSTSSW

SEQ ID NO: 425415 - protein, 9 aa, Influenza virus
WHDGAILPL

SEQ ID NO: 425416 - protein, 9 aa, Influenza virus
WMACHSAAF

SEQ ID NO: 425417 - protein, 9 aa, Influenza virus
TLMSCPMGV

SEQ ID NO: 425418 - protein, 9 aa, Influenza virus
FMDVWTYNA

SEQ ID NO: 425419 - protein, 9 aa, Influenza virus
GTMDYYWGI

SEQ ID NO: 425420 - protein, 9 aa, Influenza virus
REPYVSCSL

SEQ ID NO: 425421 - protein, 9 aa, Influenza virus
FLDVWTYNA

SEQ ID NO: 425422 - protein, 9 aa, Influenza virus
FIAPEYAYI

SEQ ID NO: 425423 - protein, 9 aa, Influenza virus
KSFYRNLVW

SEQ ID NO: 425424 - protein, 9 aa, Influenza virus
ETYKILTIY

SEQ ID NO: 425425 - protein, 9 aa, Influenza virus
LLTEVETYV

SEQ ID NO: 425426 - protein, 9 aa, Influenza virus
TLMSCPIGV

SEQ ID NO: 425427 - protein, 9 aa, Influenza virus
MVSPLAVTW

SEQ ID NO: 425428 - protein, 9 aa, Influenza virus
GMFNMLSTV

SEQ ID NO: 425429 - protein, 9 aa, Influenza virus
LMNELGVPF

SEQ ID NO: 425430 - protein, 9 aa, Influenza virus
DVYQILAIY

SEQ ID NO: 425431 - protein, 9 aa, Influenza virus
GMLGFVFTL

SEQ ID NO: 425432 - protein, 9 aa, Influenza virus
IVSPLAVTW

SEQ ID NO: 425433 - protein, 9 aa, Influenza virus
MVSPLAITW

SEQ ID NO: 425434 - protein, 9 aa, Influenza virus
LMNELGIPF

SEQ ID NO: 425435 - protein, 9 aa, Influenza virus
TLIEQNIPV

SEQ ID NO: 425436 - protein, 9 aa, Influenza virus
WMMAMKYPI

SEQ ID NO: 425437 - protein, 9 aa, Influenza virus
CQIAGFAPF

SEQ ID NO: 425438 - protein, 9 aa, Influenza virus
FLDIWTYNA

SEQ ID NO: 425439 - protein, 9 aa, Influenza virus
YLECRTFFL

SEQ ID NO: 425440 - protein, 9 aa, Influenza virus
TLMSCPVGV

SEQ ID NO: 425441 - protein, 9 aa, Influenza virus
LTHALRELW

SEQ ID NO: 425442 - protein, 9 aa, Influenza virus
VSLGAVSFW

SEQ ID NO: 425443 - protein, 9 aa, Influenza virus
WMMAMRYPI

SEQ ID NO: 425444 - protein, 9 aa, Influenza virus
VSLGAISFW

SEQ ID NO: 425445 - protein, 9 aa, Influenza virus
FVFSNAASY

SEQ ID NO: 425446 - protein, 9 aa, Influenza virus
TLLENNVPV

SEQ ID NO: 425447 - protein, 9 aa, Influenza virus
YTLVSTRSW

SEQ ID NO: 425448 - protein, 9 aa, Influenza virus
LMSELGVPF

SEQ ID NO: 425449 - protein, 9 aa, Influenza virus
CQITGFAPF

SEQ ID NO: 425450 - protein, 9 aa, Influenza virus
FLAHALKLV

SEQ ID NO: 425451 - protein, 9 aa, Influenza virus
WMACNSAAF

SEQ ID NO: 425452 - protein, 9 aa, Influenza virus
VSDGGPNLY

SEQ ID NO: 425453 - protein, 9 aa, Influenza virus
ISDGGPNLY

SEQ ID NO: 425454 - protein, 9 aa, Influenza virus
TLIEQNVPV

SEQ ID NO: 425455 - protein, 9 aa, Influenza virus
TLLESDVPV

SEQ ID NO: 425456 - protein, 9 aa, Influenza virus
LMNELGVSF

SEQ ID NO: 425457 - protein, 9 aa, Influenza virus
RELWQCYYL

SEQ ID NO: 425458 - protein, 9 aa, Influenza virus
FSMSCFVFV

SEQ ID NO: 425459 - protein, 9 aa, Influenza virus
DTVNRTHQY

SEQ ID NO: 425460 - protein, 9 aa, Influenza virus
IVTTVGWSW

SEQ ID NO: 425461 - protein, 9 aa, Influenza virus
YTLVSTGSW

SEQ ID NO: 425462 - protein, 9 aa, Influenza virus
GAINTTLPF

SEQ ID NO: 425463 - protein, 9 aa, Influenza virus
MSNEGSYFF

SEQ ID NO: 425464 - protein, 9 aa, Influenza virus
SELGVPFHL

SEQ ID NO: 425465 - protein, 9 aa, Influenza virus
FLNVWTYNA

SEQ ID NO: 425466 - protein, 9 aa, Influenza virus
YMGECPKYV

SEQ ID NO: 425467 - protein, 9 aa, Influenza virus
YSGSFSIRW

SEQ ID NO: 425468 - protein, 9 aa, Influenza virus
FVFSSAASY

SEQ ID NO: 425469 - protein, 9 aa, Influenza virus
QVDCFLWYV

SEQ ID NO: 425470 - protein, 9 aa, Influenza virus
IMMAGLSFW

SEQ ID NO: 425471 - protein, 9 aa, Influenza virus
SSFYRNLLW

SEQ ID NO: 425472 - protein, 9 aa, Influenza virus
TLDFHDFNV

SEQ ID NO: 425473 - protein, 9 aa, Influenza virus
ISMCSSTEF

SEQ ID NO: 425474 - protein, 9 aa, Influenza virus
CQVTGFAPF

SEQ ID NO: 425475 - protein, 9 aa, Influenza virus
KSLCEVNSW

SEQ ID NO: 425476 - protein, 9 aa, Influenza virus
MQIRGFVHF

SEQ ID NO: 425477 - protein, 9 aa, Influenza virus
YIWTYQAEL

SEQ ID NO: 425478 - protein, 9 aa, Influenza virus
FVFSIAASY

SEQ ID NO: 425479 - protein, 9 aa, Influenza virus
RLQDTTWDV

SEQ ID NO: 425480 - protein, 9 aa, Influenza virus
KSLCSVEGW

SEQ ID NO: 425481 - protein, 9 aa, Influenza virus
GLWAYNAEL

SEQ ID NO: 425482 - protein, 9 aa, Influenza virus
YSGAFIDYW

SEQ ID NO: 425483 - protein, 9 aa, Influenza virus
CEVSSWHIL

SEQ ID NO: 425484 - protein, 9 aa, Influenza virus
GAINSSMPF

SEQ ID NO: 425485 - protein, 9 aa, Influenza virus
YTLVSTKSW

SEQ ID NO: 425486 - protein, 9 aa, Influenza virus
SSFYRNLVW

SEQ ID NO: 425487 - protein, 9 aa, Influenza virus
MYQRCCNLF

SEQ ID NO: 425488 - protein, 9 aa, Influenza virus
ELRSRYWAI

SEQ ID NO: 425489 - protein, 9 aa, Influenza virus
MMMGMFNML

SEQ ID NO: 425490 - protein, 9 aa, Influenza virus
ISNEGSYFF

SEQ ID NO: 425491 - protein, 9 aa, Influenza virus
WMMAMRYPI

SEQ ID NO: 425492 - protein, 9 aa, Influenza virus
MYQKCCNLF

SEQ ID NO: 425493 - protein, 9 aa, Influenza virus
MPFHNVHPL

SEQ ID NO: 425494 - protein, 9 aa, Influenza virus
SLFEKFFPS

SEQ ID NO: 425495 - protein, 9 aa, Influenza virus
FLGVWTYNA

SEQ ID NO: 425496 - protein, 9 aa, Influenza virus
MPFHNIHPL

SEQ ID NO: 425497 - protein, 9 aa, Influenza virus
ALCGSPFPV

SEQ ID NO: 425498 - protein, 9 aa, Influenza virus
MKRKRNSSI

SEQ ID NO: 425499 - protein, 9 aa, Influenza virus
YQNNFVPVV

SEQ ID NO: 425500 - protein, 9 aa, Influenza virus
YQNNFVPVM

SEQ ID NO: 425501 - protein, 9 aa, Influenza virus
YQNSFVPVV

SEQ ID NO: 425502 - protein, 9 aa, Influenza virus
GWMDYYWGI

SEQ ID NO: 425503 - protein, 9 aa, Influenza virus
CEVNSWHIL

SEQ ID NO: 425504 - protein, 9 aa, Influenza virus
REEALLNRL

SEQ ID NO: 425505 - protein, 9 aa, Influenza virus
GSYVRLYLW

SEQ ID NO: 425506 - protein, 9 aa, Influenza virus
MQIRGFVYF

SEQ ID NO: 425507 - protein, 9 aa, Influenza virus
DLIENLQAY

SEQ ID NO: 425508 - protein, 9 aa, Influenza virus
FSVQRSLPF

SEQ ID NO: 425509 - protein, 9 aa, Influenza virus
MISPLAVTW

SEQ ID NO: 425510 - protein, 9 aa, Influenza virus
AEIEDLIFL

SEQ ID NO: 425511 - protein, 9 aa, Influenza virus
AEIEDLTFL

SEQ ID NO: 425512 - protein, 9 aa, Influenza virus
FMQALQLLL

SEQ ID NO: 425513 - protein, 9 aa, Influenza virus
KEWSRRYEL

SEQ ID NO: 425514 - protein, 9 aa, Influenza virus
SMIEAESSV

SEQ ID NO: 425515 - protein, 9 aa, Influenza virus
FPFHKDNAL

SEQ ID NO: 425516 - protein, 9 aa, Influenza virus
SSFYAEMEW

SEQ ID NO: 425517 - protein, 9 aa, Influenza virus
RLSAGGHIW

SEQ ID NO: 425518 - protein, 9 aa, Influenza virus
IMIAGLFFW

SEQ ID NO: 425519 - protein, 9 aa, Influenza virus
YSGAFMDYW

SEQ ID NO: 425520 - protein, 9 aa, Influenza virus
RVSAGGDIW

SEQ ID NO: 425521 - protein, 9 aa, Influenza virus
REPFISCSI

SEQ ID NO: 425522 - protein, 9 aa, Influenza virus
IPSWAGNVL

SEQ ID NO: 425523 - protein, 9 aa, Influenza virus
NELGVSFHL

SEQ ID NO: 425524 - protein, 9 aa, Influenza virus
SWMKIYWHL

SEQ ID NO: 425525 - protein, 9 aa, Influenza virus
VSMCSSTEF

SEQ ID NO: 425526 - protein, 9 aa, Influenza virus
NMLSTVLGV

SEQ ID NO: 425527 - protein, 9 aa, Influenza virus
AQNAISTTF

SEQ ID NO: 425528 - protein, 9 aa, Influenza virus
WEINGPESV

SEQ ID NO: 425529 - protein, 9 aa, Influenza virus
KEWSKRYEL

SEQ ID NO: 425530 - protein, 9 aa, Influenza virus
YTLVSTKEW

SEQ ID NO: 425531 - protein, 9 aa, Influenza virus
QSGRVSFYW

SEQ ID NO: 425532 - protein, 9 aa, Influenza virus
SEDGVYKAL

SEQ ID NO: 425533 - protein, 9 aa, Influenza virus
YSGSFVDYW

SEQ ID NO: 425534 - protein, 9 aa, Influenza virus
SWMKIYWSL

SEQ ID NO: 425535 - protein, 9 aa, Influenza virus
KPNIGPRPL

SEQ ID NO: 425536 - protein, 9 aa, Influenza virus
KSLCNVEGW

SEQ ID NO: 425537 - protein, 9 aa, Influenza virus
TLLENGVPV

SEQ ID NO: 425538 - protein, 9 aa, Influenza virus
MEFEPFQSL

SEQ ID NO: 425539 - protein, 9 aa, Influenza virus
KPRGLFGAI

SEQ ID NO: 425540 - protein, 9 aa, Influenza virus
AIMMAGLSF

SEQ ID NO: 425541 - protein, 9 aa, Influenza virus
MYQKCCSLF

SEQ ID NO: 425542 - protein, 9 aa, Influenza virus
YRALMSVPL

SEQ ID NO: 425543 - protein, 9 aa, Influenza virus
SSFYRNLIW

SEQ ID NO: 425544 - protein, 9 aa, Influenza virus
WILWISFAI

SEQ ID NO: 425545 - protein, 9 aa, Influenza virus
WEINGPDSV

SEQ ID NO: 425546 - protein, 9 aa, Influenza virus
CETQCQTPL

SEQ ID NO: 425547 - protein, 9 aa, Influenza virus
SSFYAEMKW

SEQ ID NO: 425548 - protein, 9 aa, Influenza virus
IMIAGLSFW

SEQ ID NO: 425549 - protein, 9 aa, Influenza virus
REPFVSCSI

SEQ ID NO: 425550 - protein, 9 aa, Influenza virus
WVLWISFAI

SEQ ID NO: 425551 - protein, 9 aa, Influenza virus
SSFFRNMVW

SEQ ID NO: 425552 - protein, 9 aa, Influenza virus
KMNTQFTAV

SEQ ID NO: 425553 - protein, 9 aa, Influenza virus
ATNPVVPSF

SEQ ID NO: 425554 - protein, 9 aa, Influenza virus
REESLLNRL

SEQ ID NO: 425555 - protein, 9 aa, Influenza virus
SSFYSEMKW

SEQ ID NO: 425556 - protein, 9 aa, Influenza virus
NEIGVPFHL

SEQ ID NO: 425557 - protein, 9 aa, Influenza virus
NELYGTQSL

SEQ ID NO: 425558 - protein, 9 aa, Influenza virus
KMNTQILVF

SEQ ID NO: 425559 - protein, 9 aa, Influenza virus
GTIVSSLPF

SEQ ID NO: 425560 - protein, 9 aa, Influenza virus
QELGDAPFL

SEQ ID NO: 425561 - protein, 9 aa, Influenza virus
ETHIHIFSF

SEQ ID NO: 425562 - protein, 9 aa, Influenza virus
IEFEPFQSL

SEQ ID NO: 425563 - protein, 9 aa, Influenza virus
RPVGISSMM

SEQ ID NO: 425564 - protein, 9 aa, Influenza virus
MLLDPGDTV

SEQ ID NO: 425565 - protein, 9 aa, Influenza virus
SSEAPGWSW

SEQ ID NO: 425566 - protein, 9 aa, Influenza virus
MPLHNIHPL

SEQ ID NO: 425567 - protein, 9 aa, Influenza virus
KLAAICTHL

SEQ ID NO: 425568 - protein, 9 aa, Influenza virus
APIEHVASM

SEQ ID NO: 425569 - protein, 9 aa, Influenza virus
FQNASRHHM

SEQ ID NO: 425570 - protein, 9 aa, Influenza virus
IMVAGLSFW

SEQ ID NO: 425571 - protein, 9 aa, Influenza virus
YYNETFVNI

SEQ ID NO: 425572 - protein, 9 aa, Influenza virus
RLCNPLNPF

SEQ ID NO: 425573 - protein, 9 aa, Influenza virus
IEVTNATEL

SEQ ID NO: 425574 - protein, 9 aa, Influenza virus
AQMALQLFI

SEQ ID NO: 425575 - protein, 9 aa, Influenza virus
TLLEKNVTV

SEQ ID NO: 425576 - protein, 9 aa, Influenza virus
MLLAIAMGL

SEQ ID NO: 425577 - protein, 9 aa, Influenza virus
SWMKIYWYL

SEQ ID NO: 425578 - protein, 9 aa, Influenza virus
YVWWASNSL

SEQ ID NO: 425579 - protein, 9 aa, Influenza virus
SVLNLLIGV

SEQ ID NO: 425580 - protein, 9 aa, Influenza virus
TLSEQNVPV

SEQ ID NO: 425581 - protein, 9 aa, Influenza virus
HLFSGIRSF

SEQ ID NO: 425582 - protein, 9 aa, Influenza virus
ALISWEMGL

SEQ ID NO: 425583 - protein, 9 aa, Influenza virus
YRALISWPL

SEQ ID NO: 425584 - protein, 9 aa, Influenza virus
FHNVHPFTI

SEQ ID NO: 425585 - protein, 9 aa, Influenza virus
GAVNSSMPF

SEQ ID NO: 425586 - protein, 9 aa, Influenza virus
LLKHRFEII

SEQ ID NO: 425587 - protein, 9 aa, Influenza virus
KPRPRRGLF

SEQ ID NO: 425588 - protein, 9 aa, Influenza virus
ISMCSSTEF

SEQ ID NO: 425589 - protein, 9 aa, Influenza virus
FVANFSMEL

SEQ ID NO: 425590 - protein, 9 aa, Influenza virus
VLMENEMTL

SEQ ID NO: 425591 - protein, 9 aa, Influenza virus
QAGRMTFYW

SEQ ID NO: 425592 - protein, 9 aa, Influenza virus
VMVGLILAF

SEQ ID NO: 425593 - protein, 9 aa, Influenza virus
GIMNTSKPF

SEQ ID NO: 425594 - protein, 9 aa, Influenza virus
GSFYRSMRW

SEQ ID NO: 425595 - protein, 9 aa, Influenza virus
APIEHIASM

SEQ ID NO: 425596 - protein, 9 aa, Influenza virus
GALNTTLPF

SEQ ID NO: 425597 - protein, 9 aa, Influenza virus
KMNTQFETV

SEQ ID NO: 425598 - protein, 9 aa, Influenza virus
LTITYSSPM

SEQ ID NO: 425599 - protein, 9 aa, Influenza virus
TLDEHDANV

SEQ ID NO: 425600 - protein, 9 aa, Influenza virus
SSFFRNVVW

SEQ ID NO: 425601 - protein, 9 aa, Influenza virus
GVMNTSKPF

SEQ ID NO: 425602 - protein, 9 aa, Influenza virus
FIDVWTYNA

SEQ ID NO: 425603 - protein, 9 aa, Influenza virus
LQNASRHYM

SEQ ID NO: 425604 - protein, 9 aa, Influenza virus
WTSSSSTVF

SEQ ID NO: 425605 - protein, 9 aa, Influenza virus
ALFVYSLRK

SEQ ID NO: 425606 - protein, 9 aa, Influenza virus
LAATVTLHF

SEQ ID NO: 425607 - protein, 9 aa, Influenza virus
IIYSSSMMW

SEQ ID NO: 425608 - protein, 9 aa, Influenza virus
WMMAMRYPI

SEQ ID NO: 425609 - protein, 9 aa, Influenza virus
SSFYRNVVW

SEQ ID NO: 425610 - protein, 9 aa, Influenza virus
KSLCKVEGW

SEQ ID NO: 425611 - protein, 9 aa, Influenza virus
MYQKCCTLF

SEQ ID NO: 425612 - protein, 9 aa, Influenza virus
FLWCKIVTT

SEQ ID NO: 425613 - protein, 9 aa, Influenza virus
KMNTQFEAV

SEQ ID NO: 425614 - protein, 9 aa, Influenza virus
FVFSSAASY

SEQ ID NO: 425615 - protein, 9 aa, Influenza virus
VQNAISTTF

SEQ ID NO: 425616 - protein, 9 aa, Influenza virus
QVDCFLWHV

SEQ ID NO: 425617 - protein, 9 aa, Influenza virus
MLSKSLCKV

SEQ ID NO: 425618 - protein, 9 aa, Influenza virus
NEGNGCFEL

SEQ ID NO: 425619 - protein, 9 aa, Influenza virus
CEITGFAPF

SEQ ID NO: 425620 - protein, 9 aa, Influenza virus
FTIGECPRY

SEQ ID NO: 425621 - protein, 9 aa, Influenza virus
KSLCKIEGW

SEQ ID NO: 425622 - protein, 9 aa, Influenza virus
SLIRFPIGV

SEQ ID NO: 425623 - protein, 9 aa, Influenza virus
IEVVAAQEL

SEQ ID NO: 425624 - protein, 9 aa, Influenza virus
CFMYSDFHF

SEQ ID NO: 425625 - protein, 9 aa, Influenza virus
SWMKLYWHL

SEQ ID NO: 425626 - protein, 9 aa, Influenza virus
GPATAQMAL

SEQ ID NO: 425627 - protein, 9 aa, Influenza virus
MLADWVDDA

SEQ ID NO: 425628 - protein, 9 aa, Influenza virus
YVWWTSNSL

SEQ ID NO: 425629 - protein, 9 aa, Influenza virus
HTKYRTESL

SEQ ID NO: 425630 - protein, 9 aa, Influenza virus
TLFEKFFPS

SEQ ID NO: 425631 - protein, 9 aa, Influenza virus
FQNASRHYM

SEQ ID NO: 425632 - protein, 9 aa, Influenza virus
ILDEHDSNV

SEQ ID NO: 425633 - protein, 9 aa, Influenza virus
ILFASATAI

SEQ ID NO: 425634 - protein, 9 aa, Influenza virus
FHNIHPLAI

SEQ ID NO: 425635 - protein, 9 aa, Influenza virus
DAVKLSSGY

SEQ ID NO: 425636 - protein, 9 aa, Influenza virus
LTIAMGLVF

SEQ ID NO: 425637 - protein, 9 aa, Influenza virus
SMSCFVFVA

SEQ ID NO: 425638 - protein, 9 aa, Influenza virus
IASSGTLEF

SEQ ID NO: 425639 - protein, 9 aa, Influenza virus
IILWFSFSI

SEQ ID NO: 425640 - protein, 9 aa, Influenza virus
YRALVSWPL

SEQ ID NO: 425641 - protein, 9 aa, Influenza virus
NELGVPFHL

SEQ ID NO: 425642 - protein, 9 aa, Influenza virus
FHNVHPLAI

SEQ ID NO: 425643 - protein, 9 aa, Influenza virus
SEDNVYKAL

SEQ ID NO: 425644 - protein, 9 aa, Influenza virus
GSFYRNMRW

SEQ ID NO: 425645 - protein, 9 aa, Influenza virus
ELRSKYWAI

SEQ ID NO: 425646 - protein, 9 aa, Influenza virus
SSFFRNIVW

SEQ ID NO: 425647 - protein, 9 aa, Influenza virus
KTMTITFLI

SEQ ID NO: 425648 - protein, 9 aa, Influenza virus
YSGSFMDYW

SEQ ID NO: 425649 - protein, 9 aa, Influenza virus
FQNIDSWAV

SEQ ID NO: 425650 - protein, 9 aa, Influenza virus
FHDSNVKSL

SEQ ID NO: 425651 - protein, 9 aa, Influenza virus
YRSLISWPL

SEQ ID NO: 425652 - protein, 9 aa, Influenza virus
QSGRISFYW

SEQ ID NO: 425653 - protein, 9 aa, Influenza virus
LLNKSLCSV

SEQ ID NO: 425654 - protein, 9 aa, Influenza virus
NELGIPFHL

SEQ ID NO: 425655 - protein, 9 aa, Influenza virus
DSVKLSSGY

SEQ ID NO: 425656 - protein, 9 aa, Influenza virus
LVRGNSPAF

SEQ ID NO: 425657 - protein, 9 aa, Influenza virus
FGYFGIFFV

SEQ ID NO: 425658 - protein, 9 aa, Influenza virus
YQRSKFLLM

SEQ ID NO: 425659 - protein, 9 aa, Influenza virus
IQIIKLLPF

SEQ ID NO: 425660 - protein, 9 aa, Influenza virus
YRYTYRCHK

SEQ ID NO: 425661 - protein, 9 aa, Influenza virus
YMNTALLNA

SEQ ID NO: 425662 - protein, 9 aa, Influenza virus
RSMKWLTLK

SEQ ID NO: 425663 - protein, 9 aa, Influenza virus
TELGSPLVL

SEQ ID NO: 425664 - protein, 9 aa, Influenza virus
RSMRWLTLK

SEQ ID NO: 425665 - protein, 9 aa, Influenza virus
GSINTRLPF

SEQ ID NO: 425666 - protein, 9 aa, Influenza virus
IPSWAGNIL

SEQ ID NO: 425667 - protein, 9 aa, Influenza virus
NELGVPFNL

SEQ ID NO: 425668 - protein, 9 aa, Influenza virus
FQNVSRYAF

SEQ ID NO: 425669 - protein, 9 aa, Influenza virus
YRNLIWLVK

SEQ ID NO: 425670 - protein, 9 aa, Influenza virus
MSFQGRGVF

SEQ ID NO: 425671 - protein, 9 aa, Influenza virus
IPKRNRSIL

SEQ ID NO: 425672 - protein, 9 aa, Influenza virus
GTINSPLPF

SEQ ID NO: 425673 - protein, 9 aa, Influenza virus
FTIGECPKY

SEQ ID NO: 425674 - protein, 9 aa, Influenza virus
KTMTITFLI

SEQ ID NO: 425675 - protein, 9 aa, Influenza virus
RSYNNTSGK

SEQ ID NO: 425676 - protein, 9 aa, Influenza virus
SSTEFLGQW

SEQ ID NO: 425677 - protein, 9 aa, Influenza virus
LLDVWTYNA

SEQ ID NO: 425678 - protein, 9 aa, Influenza virus
FSVQRNLPF

SEQ ID NO: 425679 - protein, 9 aa, Influenza virus
LPFHNVHPL

SEQ ID NO: 425680 - protein, 9 aa, Influenza virus
SEFNKACEL

SEQ ID NO: 425681 - protein, 9 aa, Influenza virus
RLAAAGDIW

SEQ ID NO: 425682 - protein, 9 aa, Influenza virus
HLFSGIKSF

SEQ ID NO: 425683 - protein, 9 aa, Influenza virus
LLNKSLCNV

SEQ ID NO: 425684 - protein, 9 aa, Influenza virus
FSFGASCFV

SEQ ID NO: 425685 - protein, 9 aa, Influenza virus
VASSLVLLF

SEQ ID NO: 425686 - protein, 9 aa, Influenza virus
FIFNGAFIA

SEQ ID NO: 425687 - protein, 9 aa, Influenza virus
QSGRIDFYW

SEQ ID NO: 425688 - protein, 9 aa, Influenza virus
YYNGRSSFF

SEQ ID NO: 425689 - protein, 9 aa, Influenza virus
LMNELGVPL

SEQ ID NO: 425690 - protein, 9 aa, Influenza virus
REILTRTTV

SEQ ID NO: 425691 - protein, 9 aa, Influenza virus
RMADSIKSW

SEQ ID NO: 425692 - protein, 9 aa, Influenza virus
AIMVAGLSF

SEQ ID NO: 425693 - protein, 9 aa, Influenza virus
LPFHNIHPL

SEQ ID NO: 425694 - protein, 9 aa, Influenza virus
RLSAGGAIW

SEQ ID NO: 425695 - protein, 9 aa, Influenza virus
AQIIKLLPF

SEQ ID NO: 425696 - protein, 9 aa, Influenza virus
GTITSNLPF

SEQ ID NO: 425697 - protein, 9 aa, Influenza virus
LTITYSSSM

SEQ ID NO: 425698 - protein, 9 aa, Influenza virus
FQNTSRHYM

SEQ ID NO: 425699 - protein, 9 aa, Influenza virus
FIDIWTYNA

SEQ ID NO: 425700 - protein, 9 aa, Influenza virus
FYRNVVWLI

SEQ ID NO: 425701 - protein, 9 aa, Influenza virus
WMMAMKYPI

SEQ ID NO: 425702 - protein, 9 aa, Influenza virus
NSFFSRLNW

SEQ ID NO: 425703 - protein, 9 aa, Influenza virus
MLNKSLCKV

SEQ ID NO: 425704 - protein, 9 aa, Influenza virus
FQRSKFLLM

SEQ ID NO: 425705 - protein, 9 aa, Influenza virus
MPFHNVHPF

SEQ ID NO: 425706 - protein, 9 aa, Influenza virus
CETKCQTPL

SEQ ID NO: 425707 - protein, 9 aa, Influenza virus
MLNASCAAM

SEQ ID NO: 425708 - protein, 9 aa, Influenza virus
NELGVPLHL

SEQ ID NO: 425709 - protein, 9 aa, Influenza virus
SQSGRISFY

SEQ ID NO: 425710 - protein, 9 aa, Influenza virus
RLIDFLKDV

SEQ ID NO: 425711 - protein, 9 aa, Influenza virus
ALANTIEVF

SEQ ID NO: 425712 - protein, 9 aa, Influenza virus
WEVNGPESV

SEQ ID NO: 425713 - protein, 9 aa, Influenza virus
FVFSNAASY

SEQ ID NO: 425714 - protein, 9 aa, Influenza virus
GMMMGMFNM

SEQ ID NO: 425715 - protein, 9 aa, Influenza virus
GAINSSKPF

SEQ ID NO: 425716 - protein, 9 aa, Influenza virus
FVALILGFV

SEQ ID NO: 425717 - protein, 9 aa, Influenza virus
KLASGLRNV

SEQ ID NO: 425718 - protein, 9 aa, Influenza virus
SLRGRGSTL

SEQ ID NO: 425719 - protein, 9 aa, Influenza virus
NELGVPFYL

SEQ ID NO: 425720 - protein, 9 aa, Influenza virus
SKYHWNLAL

SEQ ID NO: 425721 - protein, 9 aa, Influenza virus
REILTKITV

SEQ ID NO: 425722 - protein, 9 aa, Influenza virus
AQNAISITF

SEQ ID NO: 425723 - protein, 9 aa, Influenza virus
MIWDANGWV

SEQ ID NO: 425724 - protein, 9 aa, Influenza virus
ITCVCRDNW

SEQ ID NO: 425725 - protein, 9 aa, Influenza virus
NSFYAELKW

SEQ ID NO: 425726 - protein, 9 aa, Influenza virus
RMSDSIKSW

SEQ ID NO: 425727 - protein, 9 aa, Influenza virus
CETRCQTPL

SEQ ID NO: 425728 - protein, 9 aa, Influenza virus
GTSKVKMKW

SEQ ID NO: 425729 - protein, 9 aa, Influenza virus
NHEGEGIPL

SEQ ID NO: 425730 - protein, 9 aa, Influenza virus
RPWVRGLSS

SEQ ID NO: 425731 - protein, 9 aa, Influenza virus
KMNTQFDAV

SEQ ID NO: 425732 - protein, 9 aa, Influenza virus
DAVTDIWSY

SEQ ID NO: 425733 - protein, 9 aa, Influenza virus
IILWISFSI

SEQ ID NO: 425734 - protein, 9 aa, Influenza virus
LAATVTLHF

SEQ ID NO: 425735 - protein, 9 aa, Influenza virus
KMEDGFLDV

SEQ ID NO: 425736 - protein, 9 aa, Influenza virus
QESSCTCIL

SEQ ID NO: 425737 - protein, 9 aa, Influenza virus
TLKSGQFPV

SEQ ID NO: 425738 - protein, 9 aa, Influenza virus
QTGRIDFHW

SEQ ID NO: 425739 - protein, 9 aa, Influenza virus
LVISSDLSY

SEQ ID NO: 425740 - protein, 9 aa, Influenza virus
MKRKRDSSI

SEQ ID NO: 425741 - protein, 9 aa, Influenza virus
ATNPIVPSF

SEQ ID NO: 425742 - protein, 9 aa, Influenza virus
GSFYRSIRW

SEQ ID NO: 425743 - protein, 9 aa, Influenza virus
YVKQKTLKL

SEQ ID NO: 425744 - protein, 9 aa, Influenza virus
IEVVTAQEL

SEQ ID NO: 425745 - protein, 9 aa, Influenza virus
DTKVDLWSY

SEQ ID NO: 425746 - protein, 9 aa, Influenza virus
NVYKVLAIY

SEQ ID NO: 425747 - protein, 9 aa, Influenza virus
VASSGTLEF

SEQ ID NO: 425748 - protein, 9 aa, Influenza virus
MGYKDIILW

SEQ ID NO: 425749 - protein, 9 aa, Influenza virus
RLSAGGSIW

SEQ ID NO: 425750 - protein, 9 aa, Influenza virus
KLATGLKNV

SEQ ID NO: 425751 - protein, 9 aa, Influenza virus
FHNIHPLTI

SEQ ID NO: 425752 - protein, 9 aa, Influenza virus
SVLVNTYQW

SEQ ID NO: 425753 - protein, 9 aa, Influenza virus
CPVKGWAPL

SEQ ID NO: 425754 - protein, 9 aa, Influenza virus
NLFEKFFPS

SEQ ID NO: 425755 - protein, 9 aa, Influenza virus
LIRGNSPVF

SEQ ID NO: 425756 - protein, 9 aa, Influenza virus
GVINTSKPF

SEQ ID NO: 425757 - protein, 9 aa, Influenza virus
REPFISCSV

SEQ ID NO: 425758 - protein, 9 aa, Influenza virus
GELNNNGEL

SEQ ID NO: 425759 - protein, 9 aa, Influenza virus
YLTGTWDTL

SEQ ID NO: 425760 - protein, 9 aa, Influenza virus
WMMAMKYPI

SEQ ID NO: 425761 - protein, 9 aa, Influenza virus
TMLNLYERV

SEQ ID NO: 425762 - protein, 9 aa, Influenza virus
SWMKIYWVL

SEQ ID NO: 425763 - protein, 9 aa, Influenza virus
DQIENLWAY

SEQ ID NO: 425764 - protein, 9 aa, Influenza virus
IILWFSFGA

SEQ ID NO: 425765 - protein, 9 aa, Influenza virus
VADGGPNLY

SEQ ID NO: 425766 - protein, 9 aa, Influenza virus
KPNIGPRPF

SEQ ID NO: 425767 - protein, 9 aa, Influenza virus
FHNVHPLTI

SEQ ID NO: 425768 - protein, 9 aa, Influenza virus
LIDNEFTEV

SEQ ID NO: 425769 - protein, 9 aa, Influenza virus
TIMEKNVTV

SEQ ID NO: 425770 - protein, 9 aa, Influenza virus
RLSASGDIW

SEQ ID NO: 425771 - protein, 9 aa, Influenza virus
KAVRGDLNF

SEQ ID NO: 425772 - protein, 9 aa, Influenza virus
FLLMDSLKL

SEQ ID NO: 425773 - protein, 9 aa, Influenza virus
FLTHALRFL

SEQ ID NO: 425774 - protein, 9 aa, Influenza virus
GRMTFYWTM

SEQ ID NO: 425775 - protein, 9 aa, Influenza virus
VEFEPFQSL

SEQ ID NO: 425776 - protein, 9 aa, Influenza virus
GELDNNGEL

SEQ ID NO: 425777 - protein, 9 aa, Influenza virus
YRNLVWLVK

SEQ ID NO: 425778 - protein, 9 aa, Influenza virus
QSGRIDFHW

SEQ ID NO: 425779 - protein, 9 aa, Influenza virus
FQNASRYYM

SEQ ID NO: 425780 - protein, 9 aa, Influenza virus
GMIDGWYGF

SEQ ID NO: 425781 - protein, 9 aa, Influenza virus
CQMEKIVLL

SEQ ID NO: 425782 - protein, 9 aa, Influenza virus
LTIAMGLVF

SEQ ID NO: 425783 - protein, 9 aa, Influenza virus
FLLMDALKL

SEQ ID NO: 425784 - protein, 9 aa, Influenza virus
VILWFSFGA

SEQ ID NO: 425785 - protein, 9 aa, Influenza virus
SMVEAESSV

SEQ ID NO: 425786 - protein, 9 aa, Influenza virus
YSSSMMWEV

SEQ ID NO: 425787 - protein, 9 aa, Influenza virus
YQAELLVAM

SEQ ID NO: 425788 - protein, 9 aa, Influenza virus
LPQSGRIVV

SEQ ID NO: 425789 - protein, 9 aa, Influenza virus
VQIIKLLPF

SEQ ID NO: 425790 - protein, 9 aa, Influenza virus
HMRKKRGLF

SEQ ID NO: 425791 - protein, 9 aa, Influenza virus
DSITDIWTY

SEQ ID NO: 425792 - protein, 9 aa, Influenza virus
LMSCPIGEV

SEQ ID NO: 425793 - protein, 9 aa, Influenza virus
LTITYSSPM

SEQ ID NO: 425794 - protein, 9 aa, Influenza virus
ALNEITTKI

SEQ ID NO: 425795 - protein, 9 aa, Influenza virus
KLATGLRNV

SEQ ID NO: 425796 - protein, 9 aa, Influenza virus
VPKRNRSIL

SEQ ID NO: 425797 - protein, 9 aa, Influenza virus
LIALCGSPF

SEQ ID NO: 425798 - protein, 9 aa, Influenza virus
KQAKGLFGA

SEQ ID NO: 425799 - protein, 9 aa, Influenza virus
IILWVSFSI

SEQ ID NO: 425800 - protein, 9 aa, Influenza virus
LLIGISNVV

SEQ ID NO: 425801 - protein, 9 aa, Influenza virus
VSMCSSTEF

SEQ ID NO: 425802 - protein, 9 aa, Influenza virus
KLLGINMSK

SEQ ID NO: 425803 - protein, 9 aa, Influenza virus
VEVTNATEL

SEQ ID NO: 425804 - protein, 9 aa, Influenza virus
DAMTEIWSY

SEQ ID NO: 425805 - protein, 9 aa, Influenza virus
TTYKILSIY

SEQ ID NO: 425806 - protein, 9 aa, Influenza virus
CPIKGWAPL

SEQ ID NO: 425807 - protein, 9 aa, Influenza virus
LASSGSLEF

SEQ ID NO: 425808 - protein, 9 aa, Influenza virus
GRMDYYWAV

SEQ ID NO: 425809 - protein, 9 aa, Influenza virus
QSGRINFHW

SEQ ID NO: 425810 - protein, 9 aa, Influenza virus
SVYKALSIY

SEQ ID NO: 425811 - protein, 9 aa, Influenza virus
GILGFVFTL

SEQ ID NO: 425812 - protein, 9 aa, Influenza virus
LATTVTLHF

SEQ ID NO: 425813 - protein, 9 aa, Influenza virus
QMRDVLGTF

SEQ ID NO: 425814 - protein, 9 aa, Influenza virus
SYINRTGTF

SEQ ID NO: 425815 - protein, 9 aa, Influenza virus
KMTDSIKSW

SEQ ID NO: 425816 - protein, 9 aa, Influenza virus
ATSPIVPSF

SEQ ID NO: 425817 - protein, 9 aa, Influenza virus
KMNTQILIF

SEQ ID NO: 425818 - protein, 9 aa, Influenza virus
DVIVTREPY

SEQ ID NO: 425819 - protein, 9 aa, Influenza virus
AIMIAGLSF

SEQ ID NO: 425820 - protein, 9 aa, Influenza virus
CETKCQSPL

SEQ ID NO: 425821 - protein, 9 aa, Influenza virus
RLSAGGNIW

SEQ ID NO: 425822 - protein, 9 aa, Influenza virus
FRTLMSCPM

SEQ ID NO: 425823 - protein, 9 aa, Influenza virus
GMIDGWYGY

SEQ ID NO: 425824 - protein, 9 aa, Influenza virus
GTITSPLPF

SEQ ID NO: 425825 - protein, 9 aa, Influenza virus
FVRQCFNPM

SEQ ID NO: 425826 - protein, 9 aa, Influenza virus
RRIDFNWLL

SEQ ID NO: 425827 - protein, 9 aa, Influenza virus
REGYSLVGI

SEQ ID NO: 425828 - protein, 9 aa, Influenza virus
GRMNYHWTL

SEQ ID NO: 425829 - protein, 9 aa, Influenza virus
LVISTDLSY

SEQ ID NO: 425830 - protein, 9 aa, Influenza virus
DTKIDLWSY

SEQ ID NO: 425831 - protein, 9 aa, Influenza virus
GRMNYYWTL

SEQ ID NO: 425832 - protein, 9 aa, Influenza virus
GTFEFTSFF

SEQ ID NO: 425833 - protein, 9 aa, Influenza virus
STYKILSIY

SEQ ID NO: 425834 - protein, 9 aa, Influenza virus
DSMTEIWSY

SEQ ID NO: 425835 - protein, 9 aa, Influenza virus
IIIAGLSFW

SEQ ID NO: 425836 - protein, 9 aa, Influenza virus
LLNPFVSHK

SEQ ID NO: 425837 - protein, 9 aa, Influenza virus
DQIEGLWAY

SEQ ID NO: 425838 - protein, 9 aa, Influenza virus
SLRMKWMMA

SEQ ID NO: 425839 - protein, 9 aa, Influenza virus
LLQSAILSL

SEQ ID NO: 425840 - protein, 9 aa, Influenza virus
RPMDSTGSC

SEQ ID NO: 425841 - protein, 9 aa, Influenza virus
FQGRGVFEL

SEQ ID NO: 425842 - protein, 9 aa, Influenza virus
EQLSSVSSF

SEQ ID NO: 425843 - protein, 9 aa, Influenza virus
STDTVNTLM

SEQ ID NO: 425844 - protein, 9 aa, Influenza virus
VLWTSNSMV

SEQ ID NO: 425845 - protein, 9 aa, Influenza virus
RTSISCLYK

SEQ ID NO: 425846 - protein, 9 aa, Influenza virus
NSFYRNLIW

SEQ ID NO: 425847 - protein, 9 aa, Influenza virus
RLSAGGDIW

SEQ ID NO: 425848 - protein, 9 aa, Influenza virus
FQRSKFLLM

SEQ ID NO: 425849 - protein, 9 aa, Influenza virus
FSFGGFTFK

SEQ ID NO: 425850 - protein, 9 aa, Influenza virus
QLSSVSSFK

SEQ ID NO: 425851 - protein, 9 aa, Influenza virus
DSITEVWSY

SEQ ID NO: 425852 - protein, 9 aa, Influenza virus
LEMCHSTQI

SEQ ID NO: 425853 - protein, 9 aa, Influenza virus
WASGSSISF

SEQ ID NO: 425854 - protein, 9 aa, Influenza virus
SQRSKFLLM

SEQ ID NO: 425855 - protein, 9 aa, Influenza virus
IYSTVASSF

SEQ ID NO: 425856 - protein, 9 aa, Influenza virus
GTMHDRSPF

SEQ ID NO: 425857 - protein, 9 aa, Influenza virus
YQNNFVPVI

SEQ ID NO: 425858 - protein, 9 aa, Influenza virus
RLAAGGDIW

SEQ ID NO: 425859 - protein, 9 aa, Influenza virus
FSFGASSFV

SEQ ID NO: 425860 - protein, 9 aa, Influenza virus
NVYKILSIY

SEQ ID NO: 425861 - protein, 9 aa, Influenza virus
WTSNSVVVF

SEQ ID NO: 425862 - protein, 9 aa, Influenza virus
IASSGTLEF

SEQ ID NO: 425863 - protein, 9 aa, Influenza virus
TLIEQKVPV

SEQ ID NO: 425864 - protein, 9 aa, Influenza virus
GRMTFYWAI

SEQ ID NO: 425865 - protein, 9 aa, Influenza virus
LIAPWYAYK

SEQ ID NO: 425866 - protein, 9 aa, Influenza virus
TLTEQNVPV

SEQ ID NO: 425867 - protein, 9 aa, Influenza virus
LRFLFSSIK

SEQ ID NO: 425868 - protein, 9 aa, Influenza virus
SWMKIYWDL

SEQ ID NO: 425869 - protein, 9 aa, Influenza virus
LSFQGRGVF

SEQ ID NO: 425870 - protein, 9 aa, Influenza virus
SLLEMCHST

SEQ ID NO: 425871 - protein, 9 aa, Influenza virus
WTANSIIVF

SEQ ID NO: 425872 - protein, 9 aa, Influenza virus
LEMCHGTQI

SEQ ID NO: 425873 - protein, 9 aa, Influenza virus
RMTDSIKSW

SEQ ID NO: 425874 - protein, 9 aa, Influenza virus
LVRGNSPVF

SEQ ID NO: 425875 - protein, 9 aa, Influenza virus
YQAELLVAM

SEQ ID NO: 425876 - protein, 9 aa, Influenza virus
RMDYYWAVL

SEQ ID NO: 425877 - protein, 9 aa, Influenza virus
QMRDILGTF

SEQ ID NO: 425878 - protein, 9 aa, Influenza virus
QAGRIDFHW

SEQ ID NO: 425879 - protein, 9 aa, Influenza virus
MVWDANGWV

SEQ ID NO: 425880 - protein, 9 aa, Influenza virus
KILSIYSSV

SEQ ID NO: 425881 - protein, 9 aa, Influenza virus
MVLASTTAK

SEQ ID NO: 425882 - protein, 9 aa, Influenza virus
YRALMSVLL

SEQ ID NO: 425883 - protein, 9 aa, Influenza virus
IMQNKLNNV

SEQ ID NO: 425884 - protein, 9 aa, Influenza virus
ASWFNSFLK

SEQ ID NO: 425885 - protein, 9 aa, Influenza virus
GLNMSLHLK

SEQ ID NO: 425886 - protein, 9 aa, Influenza virus
ITSLCSIWF

SEQ ID NO: 425887 - protein, 9 aa, Influenza virus
AMDHTSQYL

SEQ ID NO: 425888 - protein, 9 aa, Influenza virus
KTKKMTITF

SEQ ID NO: 425889 - protein, 9 aa, Influenza virus
FPFHKDNAI

SEQ ID NO: 425890 - protein, 9 aa, Influenza virus
GRMNYYWTI

SEQ ID NO: 425891 - protein, 9 aa, Influenza virus
FRGLMSTPL

SEQ ID NO: 425892 - protein, 9 aa, Influenza virus
ITFSFNGAF

SEQ ID NO: 425893 - protein, 9 aa, Influenza virus
LMLNKSLCK

SEQ ID NO: 425894 - protein, 9 aa, Influenza virus
TQIIKLLPF

SEQ ID NO: 425895 - protein, 9 aa, Influenza virus
GMVNGWYGF

SEQ ID NO: 425896 - protein, 9 aa, Influenza virus
CPIRGWAPL

SEQ ID NO: 425897 - protein, 9 aa, Influenza virus
QPKWFRNVL

SEQ ID NO: 425898 - protein, 9 aa, Influenza virus
FIAPNRASF

SEQ ID NO: 425899 - protein, 9 aa, Influenza virus
SPRMFLAMI

SEQ ID NO: 425900 - protein, 9 aa, Influenza virus
HLEECSCYV

SEQ ID NO: 425901 - protein, 9 aa, Influenza virus
RLGYETFKV

SEQ ID NO: 425902 - protein, 9 aa, Influenza virus
FLAPGYAFE

SEQ ID NO: 425903 - protein, 9 aa, Influenza virus
VEVVAAQEL

SEQ ID NO: 425904 - protein, 9 aa, Influenza virus
LLNASCAAM

SEQ ID NO: 425905 - protein, 9 aa, Influenza virus
ALSGVAIAL

SEQ ID NO: 425906 - protein, 9 aa, Influenza virus
SHEGEGIPL

SEQ ID NO: 425907 - protein, 9 aa, Influenza virus
MSNEGSYFF

SEQ ID NO: 425908 - protein, 9 aa, Influenza virus
RRIDFHWLL

SEQ ID NO: 425909 - protein, 9 aa, Influenza virus
STIALLIGV

SEQ ID NO: 425910 - protein, 9 aa, Influenza virus
YQRSKFLLM

SEQ ID NO: 425911 - protein, 9 aa, Influenza virus
NTVKDRSPY

SEQ ID NO: 425912 - protein, 9 aa, Influenza virus
MLATGMRNV

SEQ ID NO: 425913 - protein, 9 aa, Influenza virus
YRNLVWIVK

SEQ ID NO: 425914 - protein, 9 aa, Influenza virus
EQLSTVSSF

SEQ ID NO: 425915 - protein, 9 aa, Influenza virus
KVPEWSYIV

SEQ ID NO: 425916 - protein, 9 aa, Influenza virus
TMHQLLRHF

SEQ ID NO: 425917 - protein, 9 aa, Influenza virus
FSISCFLLV

SEQ ID NO: 425918 - protein, 9 aa, Influenza virus
RMTFYWTMV

SEQ ID NO: 425919 - protein, 9 aa, Influenza virus
GRMTFYWTI

SEQ ID NO: 425920 - protein, 9 aa, Influenza virus
GTRRIDFHW

SEQ ID NO: 425921 - protein, 9 aa, Influenza virus
MSKEGSYFF

SEQ ID NO: 425922 - protein, 9 aa, Influenza virus
RMKWMMAMK

SEQ ID NO: 425923 - protein, 9 aa, Influenza virus
CYQRSKFLL

SEQ ID NO: 425924 - protein, 9 aa, Influenza virus
LLAPKYGYI

SEQ ID NO: 425925 - protein, 9 aa, Influenza virus
IMFESNGGL

SEQ ID NO: 425926 - protein, 9 aa, Influenza virus
YLWGVHHPS

SEQ ID NO: 425927 - protein, 9 aa, Influenza virus
FRGLISTPL

SEQ ID NO: 425928 - protein, 9 aa, Influenza virus
LMNELGVPL

SEQ ID NO: 425929 - protein, 9 aa, Influenza virus
GPNNNASAI

SEQ ID NO: 425930 - protein, 9 aa, Influenza virus
LAIAMGLIF

SEQ ID NO: 425931 - protein, 9 aa, Influenza virus
FHDSNVRNL

SEQ ID NO: 425932 - protein, 9 aa, Influenza virus
YRSINWLTK

SEQ ID NO: 425933 - protein, 9 aa, Influenza virus
VTFNFNGAF

SEQ ID NO: 425934 - protein, 9 aa, Influenza virus
RRIENLNRK

SEQ ID NO: 425935 - protein, 9 aa, Influenza virus
LMLSKSLCK

SEQ ID NO: 425936 - protein, 9 aa, Influenza virus
QSFYRSINW

SEQ ID NO: 425937 - protein, 9 aa, Influenza virus
NTIGNCPKY

SEQ ID NO: 425938 - protein, 9 aa, Influenza virus
GMVDGWYGF

SEQ ID NO: 425939 - protein, 9 aa, Influenza virus
GTIISNLPF

SEQ ID NO: 425940 - protein, 9 aa, Influenza virus
SLAIMIAGI

SEQ ID NO: 425941 - protein, 9 aa, Influenza virus
LASSGSLEF

SEQ ID NO: 425942 - protein, 9 aa, Influenza virus
KMNIQFTAV

SEQ ID NO: 425943 - protein, 9 aa, Influenza virus
KEYEEEAKL

SEQ ID NO: 425944 - protein, 9 aa, Influenza virus
SYIIRALTL

SEQ ID NO: 425945 - protein, 9 aa, Influenza virus
MLATGMKNV

SEQ ID NO: 425946 - protein, 9 aa, Influenza virus
ELRFLFSSI

SEQ ID NO: 425947 - protein, 9 aa, Influenza virus
KSLIWLWLV

SEQ ID NO: 425948 - protein, 9 aa, Influenza virus
DVIITREPY

SEQ ID NO: 425949 - protein, 9 aa, Influenza virus
FVRQCFNPM

SEQ ID NO: 425950 - protein, 9 aa, Influenza virus
WTSNSIVAF

SEQ ID NO: 425951 - protein, 9 aa, Influenza virus
FHGAKEIAL

SEQ ID NO: 425952 - protein, 9 aa, Influenza virus
KSSLPLCPF

SEQ ID NO: 425953 - protein, 9 aa, Influenza virus
RPMDGTGSC

SEQ ID NO: 425954 - protein, 9 aa, Influenza virus
TPKRNRSIL

SEQ ID NO: 425955 - protein, 9 aa, Influenza virus
GLANLGLNV

SEQ ID NO: 425956 - protein, 9 aa, Influenza virus
GMIDGWYGF

SEQ ID NO: 425957 - protein, 9 aa, Influenza virus
REILTKTTV

SEQ ID NO: 425958 - protein, 9 aa, Influenza virus
KMNIQFTSV

SEQ ID NO: 425959 - protein, 9 aa, Influenza virus
LVISPDLSY

SEQ ID NO: 425960 - protein, 9 aa, Influenza virus
ALCGSPVPV

SEQ ID NO: 425961 - protein, 9 aa, Influenza virus
YRSLIQFPM

SEQ ID NO: 425962 - protein, 9 aa, Influenza virus
KTHIHIFSF

SEQ ID NO: 425963 - protein, 9 aa, Influenza virus
NIWAYNAEL

SEQ ID NO: 425964 - protein, 9 aa, Influenza virus
YRNMRWLTL

SEQ ID NO: 425965 - protein, 9 aa, Influenza virus
CTINSWHIF

SEQ ID NO: 425966 - protein, 9 aa, Influenza virus
YVRLYLWGV

SEQ ID NO: 425967 - protein, 9 aa, Influenza virus
GTSKIKMKW

SEQ ID NO: 425968 - protein, 9 aa, Influenza virus
NPSQKLFAL

SEQ ID NO: 425969 - protein, 9 aa, Influenza virus
FRTLMSCPV

SEQ ID NO: 425970 - protein, 9 aa, Influenza virus
KRMGLQMQR

SEQ ID NO: 425971 - protein, 9 aa, Influenza virus
GAVNSSKPF

SEQ ID NO: 425972 - protein, 9 aa, Influenza virus
LLAPRYGYI

SEQ ID NO: 425973 - protein, 9 aa, Influenza virus
VQVIKLLPF

SEQ ID NO: 425974 - protein, 9 aa, Influenza virus
KEKENSYPM

SEQ ID NO: 425975 - protein, 9 aa, Influenza virus
AEIEDLIFM

SEQ ID NO: 425976 - protein, 9 aa, Influenza virus
VLVGPILSF

SEQ ID NO: 425977 - protein, 9 aa, Influenza virus
TLDEHDSNV

SEQ ID NO: 425978 - protein, 9 aa, Influenza virus
NAISTTFPY

SEQ ID NO: 425979 - protein, 9 aa, Influenza virus
RRLENLNKK

SEQ ID NO: 425980 - protein, 9 aa, Influenza virus
SACHDGASW

SEQ ID NO: 425981 - protein, 9 aa, Influenza virus
FVRQCFNPM

SEQ ID NO: 425982 - protein, 9 aa, Influenza virus
FRGLLSTPL

SEQ ID NO: 425983 - protein, 9 aa, Influenza virus
MMTHTSQYI

SEQ ID NO: 425984 - protein, 9 aa, Influenza virus
KMQFSSLTV

SEQ ID NO: 425985 - protein, 9 aa, Influenza virus
LAIVMGLVF

SEQ ID NO: 425986 - protein, 9 aa, Influenza virus
NVYKVLSIY

SEQ ID NO: 425987 - protein, 9 aa, Influenza virus
CSNNTTNYY

SEQ ID NO: 425988 - protein, 9 aa, Influenza virus
GLYDAIEEC

SEQ ID NO: 425989 - protein, 9 aa, Influenza virus
WTSNSIIAF

SEQ ID NO: 425990 - protein, 9 aa, Influenza virus
ALSGVAISL

SEQ ID NO: 425991 - protein, 9 aa, Influenza virus
MPLHNIHPL

SEQ ID NO: 425992 - protein, 9 aa, Influenza virus
YRNVVWLIK

SEQ ID NO: 425993 - protein, 9 aa, Influenza virus
HQRSKFLLM

SEQ ID NO: 425994 - protein, 9 aa, Influenza virus
MHDANVRNL

SEQ ID NO: 425995 - protein, 9 aa, Influenza virus
FRTLMSCPI

SEQ ID NO: 425996 - protein, 9 aa, Influenza virus
SFGASCFLF

SEQ ID NO: 425997 - protein, 9 aa, Influenza virus
RRIENLNKK

SEQ ID NO: 425998 - protein, 9 aa, Influenza virus
YQSGTYPVI

SEQ ID NO: 425999 - protein, 9 aa, Influenza virus
CQDEFCYTL

SEQ ID NO: 426000 - protein, 9 aa, Influenza virus
GEVDNNGEL

SEQ ID NO: 426001 - protein, 9 aa, Influenza virus
LIISPDLSY

SEQ ID NO: 426002 - protein, 9 aa, Influenza virus
KQLTHHMRK

SEQ ID NO: 426003 - protein, 9 aa, Influenza virus
FMQALQLLF

SEQ ID NO: 426004 - protein, 9 aa, Influenza virus
YRACFYVEL

SEQ ID NO: 426005 - protein, 9 aa, Influenza virus
FRDMRKNTL

SEQ ID NO: 426006 - protein, 9 aa, Influenza virus
YVRQNTLKL

SEQ ID NO: 426007 - protein, 9 aa, Influenza virus
GQSGRISFY

SEQ ID NO: 426008 - protein, 9 aa, Influenza virus
LAIAMGLIF

SEQ ID NO: 426009 - protein, 9 aa, Influenza virus
SACHDGISW

SEQ ID NO: 426010 - protein, 9 aa, Influenza virus
IEYQIGNVI

SEQ ID NO: 426011 - protein, 9 aa, Influenza virus
FLAFILWAC

SEQ ID NO: 426012 - protein, 9 aa, Influenza virus
SWTKIYWYL

SEQ ID NO: 426013 - protein, 9 aa, Influenza virus
RLYVNKNPY

SEQ ID NO: 426014 - protein, 9 aa, Influenza virus
LLIAFVLWA

SEQ ID NO: 426015 - protein, 9 aa, Influenza virus
KLITVGSSK

SEQ ID NO: 426016 - protein, 9 aa, Influenza virus
GPALSISEL

SEQ ID NO: 426017 - protein, 9 aa, Influenza virus
SLFSSIKRY

SEQ ID NO: 426018 - protein, 9 aa, Influenza virus
TLKSEQFPV

SEQ ID NO: 426019 - protein, 9 aa, Influenza virus
ETNGNYGPI

SEQ ID NO: 426020 - protein, 9 aa, Influenza virus
VEVITAQEL

SEQ ID NO: 426021 - protein, 9 aa, Influenza virus
VASSGTLEF

SEQ ID NO: 426022 - protein, 9 aa, Influenza virus
GSINTKLPF

SEQ ID NO: 426023 - protein, 9 aa, Influenza virus
QILAIYATV

SEQ ID NO: 426024 - protein, 9 aa, Influenza virus
RSLFSSIKK

SEQ ID NO: 426025 - protein, 9 aa, Influenza virus
SILNLLIGI

SEQ ID NO: 426026 - protein, 9 aa, Influenza virus
NHTGTYCSL

SEQ ID NO: 426027 - protein, 9 aa, Influenza virus
RMDYYWAIL

SEQ ID NO: 426028 - protein, 9 aa, Influenza virus
RRIDFHWLF

SEQ ID NO: 426029 - protein, 9 aa, Influenza virus
NPNQKLFAL

SEQ ID NO: 426030 - protein, 9 aa, Influenza virus
SYLECRTFF

SEQ ID NO: 426031 - protein, 9 aa, Influenza virus
KSLFSSIKK

SEQ ID NO: 426032 - protein, 9 aa, Influenza virus
WTSNSIVVF

SEQ ID NO: 426033 - protein, 9 aa, Influenza virus
LTIIYSSSM

SEQ ID NO: 426034 - protein, 9 aa, Influenza virus
WTSGSSIAF

SEQ ID NO: 426035 - protein, 9 aa, Influenza virus
MRFTYSGIR

SEQ ID NO: 426036 - protein, 9 aa, Influenza virus
LLLAFILWA

SEQ ID NO: 426037 - protein, 9 aa, Influenza virus
SSEVPEWSW

SEQ ID NO: 426038 - protein, 9 aa, Influenza virus
YELEIGTRI

SEQ ID NO: 426039 - protein, 9 aa, Influenza virus
YRSMRWLTL

SEQ ID NO: 426040 - protein, 9 aa, Influenza virus
YRNMRWLTL

SEQ ID NO: 426041 - protein, 9 aa, Influenza virus
FMARSALIL

SEQ ID NO: 426042 - protein, 9 aa, Influenza virus
ETILETGYI

SEQ ID NO: 426043 - protein, 9 aa, Influenza virus
FHDSNVKNL

SEQ ID NO: 426044 - protein, 9 aa, Influenza virus
GLSPNVYQA

SEQ ID NO: 426045 - protein, 9 aa, Influenza virus
VLVNTYQWV

SEQ ID NO: 426046 - protein, 9 aa, Influenza virus
GVNSDTTSW

SEQ ID NO: 426047 - protein, 9 aa, Influenza virus
SLNISLYSK

SEQ ID NO: 426048 - protein, 9 aa, Influenza virus
LTITYSSSM

SEQ ID NO: 426049 - protein, 9 aa, Influenza virus
RLSADGDIW

SEQ ID NO: 426050 - protein, 9 aa, Influenza virus
AEDMGNGCL

SEQ ID NO: 426051 - protein, 9 aa, Influenza virus
SYLIRTLTL

SEQ ID NO: 426052 - protein, 9 aa, Influenza virus
VTFSFNGAF

SEQ ID NO: 426053 - protein, 9 aa, Influenza virus
RLRRDQRAL

SEQ ID NO: 426054 - protein, 9 aa, Influenza virus
GMVDGWYGY

SEQ ID NO: 426055 - protein, 9 aa, Influenza virus
FLFSSIKKY

SEQ ID NO: 426056 - protein, 9 aa, Influenza virus
AANPIVPSF

SEQ ID NO: 426057 - protein, 9 aa, Influenza virus
KINPVTLTM

SEQ ID NO: 426058 - protein, 9 aa, Influenza virus
WTSGSSISF

SEQ ID NO: 426059 - protein, 9 aa, Influenza virus
FIAPDRASF

SEQ ID NO: 426060 - protein, 9 aa, Influenza virus
ASNINIREW

SEQ ID NO: 426061 - protein, 9 aa, Influenza virus
ILSIYSTVV

SEQ ID NO: 426062 - protein, 9 aa, Influenza virus
CLLQSLQQI

SEQ ID NO: 426063 - protein, 9 aa, Influenza virus
QPNIGPRAL

SEQ ID NO: 426064 - protein, 9 aa, Influenza virus
APIEYVASM

SEQ ID NO: 426065 - protein, 9 aa, Influenza virus
AIIIAGLSF

SEQ ID NO: 426066 - protein, 9 aa, Influenza virus
MRISNETIL

SEQ ID NO: 426067 - protein, 9 aa, Influenza virus
VTCVCRDNW

SEQ ID NO: 426068 - protein, 9 aa, Influenza virus
VASSGNLEF

SEQ ID NO: 426069 - protein, 9 aa, Influenza virus
FIAPDRVSF

SEQ ID NO: 426070 - protein, 9 aa, Influenza virus
ISIASRSGY

SEQ ID NO: 426071 - protein, 9 aa, Influenza virus
MMKAVRGDL

SEQ ID NO: 426072 - protein, 9 aa, Influenza virus
CLPACIYGL

SEQ ID NO: 426073 - protein, 9 aa, Influenza virus
CLRGGRNSF

SEQ ID NO: 426074 - protein, 9 aa, Influenza virus
FQNVSKYAF

SEQ ID NO: 426075 - protein, 9 aa, Influenza virus
RSINWLTKK

SEQ ID NO: 426076 - protein, 9 aa, Influenza virus
ISMDSRSGY

SEQ ID NO: 426077 - protein, 9 aa, Influenza virus
VLATGLRNV

SEQ ID NO: 426078 - protein, 9 aa, Influenza virus
KRMGVQMHR

SEQ ID NO: 426079 - protein, 9 aa, Influenza virus
TLTDNHVEV

SEQ ID NO: 426080 - protein, 9 aa, Influenza virus
KPSLPLCPF

SEQ ID NO: 426081 - protein, 9 aa, Influenza virus
ALALSHTAY

SEQ ID NO: 426082 - protein, 9 aa, Influenza virus
YMGECPKYA

SEQ ID NO: 426083 - protein, 9 aa, Influenza virus
LPRRSGAAG

SEQ ID NO: 426084 - protein, 9 aa, Influenza virus
QPNIGPRPL

SEQ ID NO: 426085 - protein, 9 aa, Influenza virus
GTIHDRSPF

SEQ ID NO: 426086 - protein, 9 aa, Influenza virus
VLNKSLCKV

SEQ ID NO: 426087 - protein, 9 aa, Influenza virus
KILTIYSTV

SEQ ID NO: 426088 - protein, 9 aa, Influenza virus
GTINDRSPF

SEQ ID NO: 426089 - protein, 9 aa, Influenza virus
DAVTDVWSY

SEQ ID NO: 426090 - protein, 9 aa, Influenza virus
APIMFSNKM

SEQ ID NO: 426091 - protein, 9 aa, Influenza virus
GARRIDFHW

SEQ ID NO: 426092 - protein, 9 aa, Influenza virus
MRINNETIL

SEQ ID NO: 426093 - protein, 9 aa, Influenza virus
MVNERTLDF

SEQ ID NO: 426094 - protein, 9 aa, Influenza virus
RANQRLNPM

SEQ ID NO: 426095 - protein, 9 aa, Influenza virus
SESSFYAEM

SEQ ID NO: 426096 - protein, 9 aa, Influenza virus
RILSIYSTV

SEQ ID NO: 426097 - protein, 9 aa, Influenza virus
IYSCIASSI

SEQ ID NO: 426098 - protein, 9 aa, Influenza virus
RRIESLNKK

SEQ ID NO: 426099 - protein, 9 aa, Influenza virus
YVKQSSLPL

SEQ ID NO: 426100 - protein, 9 aa, Influenza virus
FQPCFYIEL

SEQ ID NO: 426101 - protein, 9 aa, Influenza virus
FSFGASCVM

SEQ ID NO: 426102 - protein, 9 aa, Influenza virus
KRMGVQMQR

SEQ ID NO: 426103 - protein, 9 aa, Influenza virus
WHDGAILPF

SEQ ID NO: 426104 - protein, 9 aa, Influenza virus
GARRIDFNW

SEQ ID NO: 426105 - protein, 9 aa, Influenza virus
VPVVGDRPL

SEQ ID NO: 426106 - protein, 9 aa, Influenza virus
LATTITLHF

SEQ ID NO: 426107 - protein, 9 aa, Influenza virus
VLVTREPYV

SEQ ID NO: 426108 - protein, 9 aa, Influenza virus
CVLEAMAFL

SEQ ID NO: 426109 - protein, 9 aa, Influenza virus
YRYTYRCHR

SEQ ID NO: 426110 - protein, 9 aa, Influenza virus
ALSGMAIAL

SEQ ID NO: 426111 - protein, 9 aa, Influenza virus
TTYRILSIY

SEQ ID NO: 426112 - protein, 9 aa, Influenza virus
YQSGTYPVI

SEQ ID NO: 426113 - protein, 9 aa, Influenza virus
WTSNSIISM

SEQ ID NO: 426114 - protein, 9 aa, Influenza virus
RPRYNGQRS

SEQ ID NO: 426115 - protein, 9 aa, Influenza virus
FQNVNRITY

SEQ ID NO: 426116 - protein, 9 aa, Influenza virus
YRYGFVANF

SEQ ID NO: 426117 - protein, 9 aa, Influenza virus
HQRSKFLLM

SEQ ID NO: 426118 - protein, 9 aa, Influenza virus
SFYRNLVWF

SEQ ID NO: 426119 - protein, 9 aa, Influenza virus
SFYRNLAWF

SEQ ID NO: 426120 - protein, 9 aa, Influenza virus
FRGRGVFEL

SEQ ID NO: 426121 - protein, 9 aa, Influenza virus
WTANSIIVF

SEQ ID NO: 426122 - protein, 9 aa, Influenza virus
NPKSKLFTL

SEQ ID NO: 426123 - protein, 9 aa, Influenza virus
REEAMQNRM

SEQ ID NO: 426124 - protein, 9 aa, Influenza virus
VRKTRFLPV

SEQ ID NO: 426125 - protein, 9 aa, Influenza virus
GPNNNASAV

SEQ ID NO: 426126 - protein, 9 aa, Influenza virus
WMKLYWHLM

SEQ ID NO: 426127 - protein, 9 aa, Influenza virus
VLVGLILSF

SEQ ID NO: 426128 - protein, 9 aa, Influenza virus
RPWVRGQSG

SEQ ID NO: 426129 - protein, 9 aa, Influenza virus
VLNVSLHLK

SEQ ID NO: 426130 - protein, 9 aa, Influenza virus
GQSGRVSFY

SEQ ID NO: 426131 - protein, 9 aa, Influenza virus
NVYKALSIY

SEQ ID NO: 426132 - protein, 9 aa, Influenza virus
GMVNGWYGY

SEQ ID NO: 426133 - protein, 9 aa, Influenza virus
NNRIKINPV

SEQ ID NO: 426134 - protein, 9 aa, Influenza virus
FTFNGSFIA

SEQ ID NO: 426135 - protein, 9 aa, Influenza virus
STIALIIGV

SEQ ID NO: 426136 - protein, 9 aa, Influenza virus
MPFHNVHPL

SEQ ID NO: 426137 - protein, 9 aa, Influenza virus
TLTETGVPV

SEQ ID NO: 426138 - protein, 9 aa, Influenza virus
WHDGAVLPF

SEQ ID NO: 426139 - protein, 9 aa, Influenza virus
YVRKASLRL

SEQ ID NO: 426140 - protein, 9 aa, Influenza virus
MVIASTTAK

SEQ ID NO: 426141 - protein, 9 aa, Influenza virus
YRSLIQFPM

SEQ ID NO: 426142 - protein, 9 aa, Influenza virus
CTINSWHIY

SEQ ID NO: 426143 - protein, 9 aa, Influenza virus
MHDANVKNL

SEQ ID NO: 426144 - protein, 9 aa, Influenza virus
MPFHNIHPL

SEQ ID NO: 426145 - protein, 9 aa, Influenza virus
SVLINTYQW

SEQ ID NO: 426146 - protein, 9 aa, Influenza virus
ILVTREPYV

SEQ ID NO: 426147 - protein, 9 aa, Influenza virus
MQNGSYRCM

SEQ ID NO: 426148 - protein, 9 aa, Influenza virus
FQNVHPVTI

SEQ ID NO: 426149 - protein, 9 aa, Influenza virus
REEALLNRI

SEQ ID NO: 426150 - protein, 9 aa, Influenza virus
EIRASVGRM

SEQ ID NO: 426151 - protein, 9 aa, Influenza virus
LLLAFVLWA

SEQ ID NO: 426152 - protein, 9 aa, Influenza virus
MMMGMFNML

SEQ ID NO: 426153 - protein, 9 aa, Influenza virus
YRSLIRFPI

SEQ ID NO: 426154 - protein, 9 aa, Influenza virus
KLKSEDNVY

SEQ ID NO: 426155 - protein, 9 aa, Influenza virus
YVKQSSLPL

SEQ ID NO: 426156 - protein, 9 aa, Influenza virus
VEVVTAQEL

SEQ ID NO: 426157 - protein, 9 aa, Influenza virus
LIRGNSPIF

SEQ ID NO: 426158 - protein, 9 aa, Influenza virus
SACHDGTSW

SEQ ID NO: 426159 - protein, 9 aa, Influenza virus
FRNVVWLTK

SEQ ID NO: 426160 - protein, 9 aa, Influenza virus
KQASYKIFK

SEQ ID NO: 426161 - protein, 9 aa, Influenza virus
GLIDGWYGF

SEQ ID NO: 426162 - protein, 9 aa, Influenza virus
RWKHVTNTI

SEQ ID NO: 426163 - protein, 9 aa, Influenza virus
FPVGTAPVL

SEQ ID NO: 426164 - protein, 9 aa, Influenza virus
KINPVTLTM

SEQ ID NO: 426165 - protein, 9 aa, Influenza virus
NEEALRQIL

SEQ ID NO: 426166 - protein, 9 aa, Influenza virus
KLATGMRNV

SEQ ID NO: 426167 - protein, 9 aa, Influenza virus
LMIIGGFIF

SEQ ID NO: 426168 - protein, 9 aa, Influenza virus
GMGQAPSPY

SEQ ID NO: 426169 - protein, 9 aa, Influenza virus
KLSSGYKEV

SEQ ID NO: 426170 - protein, 9 aa, Influenza virus
LLSSKANQV

SEQ ID NO: 426171 - protein, 9 aa, Influenza virus
RRLENLSKR

SEQ ID NO: 426172 - protein, 9 aa, Influenza virus
SPSECRTFF

SEQ ID NO: 426173 - protein, 9 aa, Influenza virus
RLKITENSF

SEQ ID NO: 426174 - protein, 9 aa, Influenza virus
LQITSLCSI

SEQ ID NO: 426175 - protein, 9 aa, Influenza virus
FYRNLVWFI

SEQ ID NO: 426176 - protein, 9 aa, Influenza virus
MTDSEMLNL

SEQ ID NO: 426177 - protein, 9 aa, Influenza virus
TYQWVIRNW

SEQ ID NO: 426178 - protein, 9 aa, Influenza virus
VLVGLILAF

SEQ ID NO: 426179 - protein, 9 aa, Influenza virus
WMMAMRYPI

SEQ ID NO: 426180 - protein, 9 aa, Influenza virus
LPFHNVHPF

SEQ ID NO: 426181 - protein, 9 aa, Influenza virus
QAFYRSINW

SEQ ID NO: 426182 - protein, 9 aa, Influenza virus
APIEYIASM

SEQ ID NO: 426183 - protein, 9 aa, Influenza virus
SLAIMVAGI

SEQ ID NO: 426184 - protein, 9 aa, Influenza virus
RANQRLNPM

SEQ ID NO: 426185 - protein, 9 aa, Influenza virus
MLQSRTREI

SEQ ID NO: 426186 - protein, 9 aa, Influenza virus
NEFNKACEL

SEQ ID NO: 426187 - protein, 9 aa, Influenza virus
WTSNSIVTF

SEQ ID NO: 426188 - protein, 9 aa, Influenza virus
GSIKTKLPF

SEQ ID NO: 426189 - protein, 9 aa, Influenza virus
LKISSSFSF

SEQ ID NO: 426190 - protein, 9 aa, Influenza virus
NENGDIIFL

SEQ ID NO: 426191 - protein, 9 aa, Influenza virus
MARLGRGYM

SEQ ID NO: 426192 - protein, 9 aa, Influenza virus
SVLNLLIGI

SEQ ID NO: 426193 - protein, 9 aa, Influenza virus
FVAPDRVSF

SEQ ID NO: 426194 - protein, 9 aa, Influenza virus
TIIESNVTV

SEQ ID NO: 426195 - protein, 9 aa, Influenza virus
YRSLIRFPV

SEQ ID NO: 426196 - protein, 9 aa, Influenza virus
YQAELLVAM

SEQ ID NO: 426197 - protein, 9 aa, Influenza virus
SMSDIEAMA

SEQ ID NO: 426198 - protein, 9 aa, Influenza virus
KLEENTSYK

SEQ ID NO: 426199 - protein, 9 aa, Influenza virus
SLDEQNKLY

SEQ ID NO: 426200 - protein, 9 aa, Influenza virus
SVKNGTYEY

SEQ ID NO: 426201 - protein, 9 aa, Influenza virus
QSGRISIYW

SEQ ID NO: 426202 - protein, 9 aa, Influenza virus
IAWSSSSCF

SEQ ID NO: 426203 - protein, 9 aa, Influenza virus
FVAPDRASF

SEQ ID NO: 426204 - protein, 9 aa, Influenza virus
STYKILSIY

SEQ ID NO: 426205 - protein, 9 aa, Influenza virus
SHTGTYCSL

SEQ ID NO: 426206 - protein, 9 aa, Influenza virus
SSFERFEIF

SEQ ID NO: 426207 - protein, 9 aa, Influenza virus
WTSNSIIVF

SEQ ID NO: 426208 - protein, 9 aa, Influenza virus
ETKGLFGAI

SEQ ID NO: 426209 - protein, 9 aa, Influenza virus
KRMGVQIQR

SEQ ID NO: 426210 - protein, 9 aa, Influenza virus
YSHGTGTGY

SEQ ID NO: 426211 - protein, 9 aa, Influenza virus
SYINKTGTF

SEQ ID NO: 426212 - protein, 9 aa, Influenza virus
LRWALGENM

SEQ ID NO: 426213 - protein, 9 aa, Influenza virus
LGNGCFEFW

SEQ ID NO: 426214 - protein, 9 aa, Influenza virus
ILDFHDSNV

SEQ ID NO: 426215 - protein, 9 aa, Influenza virus
FMARSALIL

SEQ ID NO: 426216 - protein, 9 aa, Influenza virus
GLNISLHLK

SEQ ID NO: 426217 - protein, 9 aa, Influenza virus
FHSDTPRPV

SEQ ID NO: 426218 - protein, 9 aa, Influenza virus
VTFTFNGAF

SEQ ID NO: 426219 - protein, 9 aa, Influenza virus
YRSLIQFPI

SEQ ID NO: 426220 - protein, 9 aa, Influenza virus
YSSPQLEGF

SEQ ID NO: 426221 - protein, 9 aa, Influenza virus
MLADRIDDA

SEQ ID NO: 426222 - protein, 9 aa, Influenza virus
KMNREFEVM

SEQ ID NO: 426223 - protein, 9 aa, Influenza virus
SFSFGGFTF

SEQ ID NO: 426224 - protein, 9 aa, Influenza virus
SSVSSFERF

SEQ ID NO: 426225 - protein, 9 aa, Influenza virus
RMATGLRNV

SEQ ID NO: 426226 - protein, 9 aa, Influenza virus
GLNVSLHLK

SEQ ID NO: 426227 - protein, 9 aa, Influenza virus
WTSNSMVTF

SEQ ID NO: 426228 - protein, 9 aa, Influenza virus
VLWTSNSVV

SEQ ID NO: 426229 - protein, 9 aa, Influenza virus
TLDQHDANV

SEQ ID NO: 426230 - protein, 9 aa, Influenza virus
GQAGRMTFY

SEQ ID NO: 426231 - protein, 9 aa, Influenza virus
SIRNGTYNY

SEQ ID NO: 426232 - protein, 9 aa, Influenza virus
GTYDHKEFK

SEQ ID NO: 426233 - protein, 9 aa, Influenza virus
YHWNLALDI

SEQ ID NO: 426234 - protein, 9 aa, Influenza virus
TLSTIALFI

SEQ ID NO: 426235 - protein, 9 aa, Influenza virus
YAVIHYGGM

SEQ ID NO: 426236 - protein, 9 aa, Influenza virus
YPRYPGVRC

SEQ ID NO: 426237 - protein, 9 aa, Influenza virus
ETILETGYV

SEQ ID NO: 426238 - protein, 9 aa, Influenza virus
MMMGMFNML

SEQ ID NO: 426239 - protein, 9 aa, Influenza virus
KMNTQFEAI

SEQ ID NO: 426240 - protein, 9 aa, Influenza virus
YQNNFVPVI

SEQ ID NO: 426241 - protein, 9 aa, Influenza virus
YHDSNVKNL

SEQ ID NO: 426242 - protein, 9 aa, Influenza virus
YRGRLCNPL

SEQ ID NO: 426243 - protein, 9 aa, Influenza virus
KILSIYSCV

SEQ ID NO: 426244 - protein, 9 aa, Influenza virus
LVAPWYAYK

SEQ ID NO: 426245 - protein, 9 aa, Influenza virus
QAYTKVLYF

SEQ ID NO: 426246 - protein, 9 aa, Influenza virus
ELKSLFSSI

SEQ ID NO: 426247 - protein, 9 aa, Influenza virus
GRMNYHWTL

SEQ ID NO: 426248 - protein, 9 aa, Influenza virus
VLINTYQWI

SEQ ID NO: 426249 - protein, 9 aa, Influenza virus
TYQWIIKNW

SEQ ID NO: 426250 - protein, 9 aa, Influenza virus
DAMTEVWSY

SEQ ID NO: 426251 - protein, 9 aa, Influenza virus
YRSMRWLTL

SEQ ID NO: 426252 - protein, 9 aa, Influenza virus
FPIGTAPVL

SEQ ID NO: 426253 - protein, 9 aa, Influenza virus
STVSSFERF

SEQ ID NO: 426254 - protein, 9 aa, Influenza virus
FTFKRTKGF

SEQ ID NO: 426255 - protein, 9 aa, Influenza virus
FQGRGVFEL

SEQ ID NO: 426256 - protein, 9 aa, Influenza virus
RVGSRGHVF

SEQ ID NO: 426257 - protein, 9 aa, Influenza virus
YRSLIRFPI

SEQ ID NO: 426258 - protein, 9 aa, Influenza virus
WTSGSIISF

SEQ ID NO: 426259 - protein, 9 aa, Influenza virus
SSFERFEMF

SEQ ID NO: 426260 - protein, 9 aa, Influenza virus
ALANTIEIF

SEQ ID NO: 426261 - protein, 9 aa, Influenza virus
RPRRGLFGA

SEQ ID NO: 426262 - protein, 9 aa, Influenza virus
FLAMITYIT

SEQ ID NO: 426263 - protein, 9 aa, Influenza virus
CQDEFCYTL

SEQ ID NO: 426264 - protein, 9 aa, Influenza virus
GRINYYWTL

SEQ ID NO: 426265 - protein, 9 aa, Influenza virus
GTIVSSLPF

SEQ ID NO: 426266 - protein, 9 aa, Influenza virus
TSYRSLIRF

SEQ ID NO: 426267 - protein, 9 aa, Influenza virus
FHGAKEVAL

SEQ ID NO: 426268 - protein, 9 aa, Influenza virus
LENQHTIHL

SEQ ID NO: 426269 - protein, 9 aa, Influenza virus
RLIERTNEK

SEQ ID NO: 426270 - protein, 9 aa, Influenza virus
RTHIHIFSF

SEQ ID NO: 426271 - protein, 9 aa, Influenza virus
QPGWFRNVL

SEQ ID NO: 426272 - protein, 9 aa, Influenza virus
RGRHANGTM

SEQ ID NO: 426273 - protein, 9 aa, Influenza virus
GWMDYYWGI

SEQ ID NO: 426274 - protein, 9 aa, Influenza virus
TILEQNVTV

SEQ ID NO: 426275 - protein, 9 aa, Influenza virus
CLPACVYGL

SEQ ID NO: 426276 - protein, 9 aa, Influenza virus
RPVAKAGFI

SEQ ID NO: 426277 - protein, 9 aa, Influenza virus
NSADHRVYW

SEQ ID NO: 426278 - protein, 9 aa, Influenza virus
WILWISFAM

SEQ ID NO: 426279 - protein, 9 aa, Influenza virus
QVLAIYATV

SEQ ID NO: 426280 - protein, 9 aa, Influenza virus
AAWSSSSCF

SEQ ID NO: 426281 - protein, 9 aa, Influenza virus
RRKTNLYGF

SEQ ID NO: 426282 - protein, 9 aa, Influenza virus
NRMQINPVK

SEQ ID NO: 426283 - protein, 9 aa, Influenza virus
LIAPRGYYK

SEQ ID NO: 426284 - protein, 9 aa, Influenza virus
HLRDQGWSY

SEQ ID NO: 426285 - protein, 9 aa, Influenza virus
VASSGTVEF

SEQ ID NO: 426286 - protein, 9 aa, Influenza virus
VVNYVSMEF

SEQ ID NO: 426287 - protein, 9 aa, Influenza virus
KSLPDLYDY

SEQ ID NO: 426288 - protein, 9 aa, Influenza virus
RLATGLRNV

SEQ ID NO: 426289 - protein, 9 aa, Influenza virus
RRRTNLYGF

SEQ ID NO: 426290 - protein, 9 aa, Influenza virus
DQIEDLWAY

SEQ ID NO: 426291 - protein, 9 aa, Influenza virus
YVKQSSLPL

SEQ ID NO: 426292 - protein, 9 aa, Influenza virus
QSGRIEFHW

SEQ ID NO: 426293 - protein, 9 aa, Influenza virus
YRALMSVPL

SEQ ID NO: 426294 - protein, 9 aa, Influenza virus
GTITSPLPF

SEQ ID NO: 426295 - protein, 9 aa, Influenza virus
VLWTSNSIV

SEQ ID NO: 426296 - protein, 9 aa, Influenza virus
LIAPRGYFK

SEQ ID NO: 426297 - protein, 9 aa, Influenza virus
LIFMARSAL

SEQ ID NO: 426298 - protein, 9 aa, Influenza virus
RMDYYWAVL

SEQ ID NO: 426299 - protein, 9 aa, Influenza virus
RANQRLNPM

SEQ ID NO: 426300 - protein, 9 aa, Influenza virus
GPVHFRNQI

SEQ ID NO: 426301 - protein, 9 aa, Influenza virus
VPAQNAISI

SEQ ID NO: 426302 - protein, 9 aa, Influenza virus
FQNIHPATI

SEQ ID NO: 426303 - protein, 9 aa, Influenza virus
TYQWIIRNW

SEQ ID NO: 426304 - protein, 9 aa, Influenza virus
MPFHNVHPL

SEQ ID NO: 426305 - protein, 9 aa, Influenza virus
SLFSSIKKY

SEQ ID NO: 426306 - protein, 9 aa, Influenza virus
RRINMLADR

SEQ ID NO: 426307 - protein, 9 aa, Influenza virus
SVRNGTYNY

SEQ ID NO: 426308 - protein, 9 aa, Influenza virus
WTSNSIVSM

SEQ ID NO: 426309 - protein, 9 aa, Influenza virus
SASTGGQSF

SEQ ID NO: 426310 - protein, 9 aa, Influenza virus
FYSEMKWLL

SEQ ID NO: 426311 - protein, 9 aa, Influenza virus
LLLAFMLWA

SEQ ID NO: 426312 - protein, 9 aa, Influenza virus
EIRASVGKM

SEQ ID NO: 426313 - protein, 9 aa, Influenza virus
ALLKHRFEI

SEQ ID NO: 426314 - protein, 9 aa, Influenza virus
IPSWEGNIL

SEQ ID NO: 426315 - protein, 9 aa, Influenza virus
CEVNSWHIF

SEQ ID NO: 426316 - protein, 9 aa, Influenza virus
ALSGVAVAL

SEQ ID NO: 426317 - protein, 9 aa, Influenza virus
GERGLFGAI

SEQ ID NO: 426318 - protein, 9 aa, Influenza virus
FRALISWEM

SEQ ID NO: 426319 - protein, 9 aa, Influenza virus
GLYEAIEEC

SEQ ID NO: 426320 - protein, 9 aa, Influenza virus
WMKIYWHLM

SEQ ID NO: 426321 - protein, 9 aa, Influenza virus
RPADGTGSC

SEQ ID NO: 426322 - protein, 9 aa, Influenza virus
SLAIMMAGI

SEQ ID NO: 426323 - protein, 9 aa, Influenza virus
NEEGDIIFL

SEQ ID NO: 426324 - protein, 9 aa, Influenza virus
YRSIRWLTL

SEQ ID NO: 426325 - protein, 9 aa, Influenza virus
AMLNASCAA

SEQ ID NO: 426326 - protein, 9 aa, Influenza virus
LYDKVRHQL

SEQ ID NO: 426327 - protein, 9 aa, Influenza virus
GPAECRTFF

SEQ ID NO: 426328 - protein, 9 aa, Influenza virus
TLDMHDANV

SEQ ID NO: 426329 - protein, 9 aa, Influenza virus
ISFATSCFL

SEQ ID NO: 426330 - protein, 9 aa, Influenza virus
TILEKNVTV

SEQ ID NO: 426331 - protein, 9 aa, Influenza virus
REEAMQNRI

SEQ ID NO: 426332 - protein, 9 aa, Influenza virus
RVYWIREGK

SEQ ID NO: 426333 - protein, 9 aa, Influenza virus
FQNVHPITI

SEQ ID NO: 426334 - protein, 9 aa, Influenza virus
APRYAFEIV

SEQ ID NO: 426335 - protein, 9 aa, Influenza virus
RIKTRLFTI

SEQ ID NO: 426336 - protein, 9 aa, Influenza virus
SLGASCFLL

SEQ ID NO: 426337 - protein, 9 aa, Influenza virus
RPRVNGQSG

SEQ ID NO: 426338 - protein, 9 aa, Influenza virus
DSMTEVWSY

SEQ ID NO: 426339 - protein, 9 aa, Influenza virus
YQGRLCNPL

SEQ ID NO: 426340 - protein, 9 aa, Influenza virus
IEQQIGNVI

SEQ ID NO: 426341 - protein, 9 aa, Influenza virus
LYDKVRFQL

SEQ ID NO: 426342 - protein, 9 aa, Influenza virus
CRLSGIPPL

SEQ ID NO: 426343 - protein, 9 aa, Influenza virus
FLYVRTNGT

SEQ ID NO: 426344 - protein, 9 aa, Influenza virus
VTCTCRDNW

SEQ ID NO: 426345 - protein, 9 aa, Influenza virus
FVRQCFNPM

SEQ ID NO: 426346 - protein, 9 aa, Influenza virus
IINKMNTQF

SEQ ID NO: 426347 - protein, 9 aa, Influenza virus
LYNKVRMQL

SEQ ID NO: 426348 - protein, 9 aa, Influenza virus
FQPCFYVEL

SEQ ID NO: 426349 - protein, 9 aa, Influenza virus
LAVVMGLVF

SEQ ID NO: 426350 - protein, 9 aa, Influenza virus
LSSKANQVF

SEQ ID NO: 426351 - protein, 9 aa, Influenza virus
LVVSPDLSY

SEQ ID NO: 426352 - protein, 9 aa, Influenza virus
KSFSRTELI

SEQ ID NO: 426353 - protein, 9 aa, Influenza virus
GTIHDRTAF

SEQ ID NO: 426354 - protein, 9 aa, Influenza virus
FQTAAQRAM

SEQ ID NO: 426355 - protein, 9 aa, Influenza virus
SLRGRGSTL

SEQ ID NO: 426356 - protein, 9 aa, Influenza virus
APFAKDNSI

SEQ ID NO: 426357 - protein, 9 aa, Influenza virus
SISVGSSTY

SEQ ID NO: 426358 - protein, 9 aa, Influenza virus
QPEWFRNVL

SEQ ID NO: 426359 - protein, 9 aa, Influenza virus
GPVHFRSQV

SEQ ID NO: 426360 - protein, 9 aa, Influenza virus
WTQDAMTEV

SEQ ID NO: 426361 - protein, 9 aa, Influenza virus
KLYVNKNPY

SEQ ID NO: 426362 - protein, 9 aa, Influenza virus
RTHIHIFSF

SEQ ID NO: 426363 - protein, 9 aa, Influenza virus
KLKTEDNVY

SEQ ID NO: 426364 - protein, 9 aa, Influenza virus
SVKNGTYYY

SEQ ID NO: 426365 - protein, 9 aa, Influenza virus
WTSSSSTVF

SEQ ID NO: 426366 - protein, 9 aa, Influenza virus
ISFAMSCFL

SEQ ID NO: 426367 - protein, 9 aa, Influenza virus
MENQHIIDL

SEQ ID NO: 426368 - protein, 9 aa, Influenza virus
TILEKNITV

SEQ ID NO: 426369 - protein, 9 aa, Influenza virus
THTGTYCSL

SEQ ID NO: 426370 - protein, 9 aa, Influenza virus
NTIGDCPKY

SEQ ID NO: 426371 - protein, 9 aa, Influenza virus
IPVTQTMEL

SEQ ID NO: 426372 - protein, 9 aa, Influenza virus
EIRSSVGKM

SEQ ID NO: 426373 - protein, 9 aa, Influenza virus
ETIVETGYV

SEQ ID NO: 426374 - protein, 9 aa, Influenza virus
TLDLHDANV

SEQ ID NO: 426375 - protein, 9 aa, Influenza virus
LPFAAAPPV

SEQ ID NO: 426376 - protein, 9 aa, Influenza virus
TTVDHMAII

SEQ ID NO: 426377 - protein, 9 aa, Influenza virus
LLATGMRNV

SEQ ID NO: 426378 - protein, 9 aa, Influenza virus
ISFAISCFL

SEQ ID NO: 426379 - protein, 9 aa, Influenza virus
FRNVVWLVK

SEQ ID NO: 426380 - protein, 9 aa, Influenza virus
WKHVTNTIL

SEQ ID NO: 426381 - protein, 9 aa, Influenza virus
GSIITELPF

SEQ ID NO: 426382 - protein, 9 aa, Influenza virus
QTIVLNTDW

SEQ ID NO: 426383 - protein, 9 aa, Influenza virus
KQIDTIMEK

SEQ ID NO: 426384 - protein, 9 aa, Influenza virus
KAGFIENGW

SEQ ID NO: 426385 - protein, 9 aa, Influenza virus
LIAPRGHYK

SEQ ID NO: 426386 - protein, 9 aa, Influenza virus
MPFHNIHPL

SEQ ID NO: 426387 - protein, 9 aa, Influenza virus
FQNIHPITI

SEQ ID NO: 426388 - protein, 9 aa, Influenza virus
DQIQNIWAY

SEQ ID NO: 426389 - protein, 9 aa, Influenza virus
VLSCIFCLA

SEQ ID NO: 426390 - protein, 9 aa, Influenza virus
YELEIGARI

SEQ ID NO: 426391 - protein, 9 aa, Influenza virus
FIQALQLLL

SEQ ID NO: 426392 - protein, 9 aa, Influenza virus
LLATGMKNV

SEQ ID NO: 426393 - protein, 9 aa, Influenza virus
STIALFIGV

SEQ ID NO: 426394 - protein, 9 aa, Influenza virus
TILERNVTV

SEQ ID NO: 426395 - protein, 9 aa, Influenza virus
ETRGLFGAI

SEQ ID NO: 426396 - protein, 9 aa, Influenza virus
KTFQNISPV

SEQ ID NO: 426397 - protein, 9 aa, Influenza virus
GLKVSLHLK

SEQ ID NO: 426398 - protein, 9 aa, Influenza virus
HHAVPNGTL

SEQ ID NO: 426399 - protein, 9 aa, Influenza virus
QVDCYLWHI

SEQ ID NO: 426400 - protein, 9 aa, Influenza virus
WLIHQSGTY

SEQ ID NO: 426401 - protein, 9 aa, Influenza virus
WTGMVNGWY

SEQ ID NO: 426402 - protein, 9 aa, Influenza virus
FQNISKYAF

SEQ ID NO: 426403 - protein, 9 aa, Influenza virus
ELREHLSSV

SEQ ID NO: 426404 - protein, 9 aa, Influenza virus
RTFQNVSPL

SEQ ID NO: 426405 - protein, 9 aa, Influenza virus
LMSCPIGVV

SEQ ID NO: 426406 - protein, 9 aa, Influenza virus
YRALMSVLL

SEQ ID NO: 426407 - protein, 9 aa, Influenza virus
KRLVLATGL

SEQ ID NO: 426408 - protein, 9 aa, Influenza virus
GVSSEVPEW

SEQ ID NO: 426409 - protein, 9 aa, Influenza virus
IEHQIGNVI

SEQ ID NO: 426410 - protein, 9 aa, Influenza virus
WLIDQSGTY

SEQ ID NO: 426411 - protein, 9 aa, Influenza virus
QAYTKILYF

SEQ ID NO: 426412 - protein, 9 aa, Influenza virus
KTHIHIFSF

SEQ ID NO: 426413 - protein, 9 aa, Influenza virus
NSADHRIYW

SEQ ID NO: 426414 - protein, 9 aa, Influenza virus
LAKSVFNSL

SEQ ID NO: 426415 - protein, 9 aa, Influenza virus
NELGVPFHM

SEQ ID NO: 426416 - protein, 9 aa, Influenza virus
TACSDGPGW

SEQ ID NO: 426417 - protein, 9 aa, Influenza virus
FTFNGAFIA

SEQ ID NO: 426418 - protein, 9 aa, Influenza virus
VSSWHILSK

SEQ ID NO: 426419 - protein, 9 aa, Influenza virus
KLEENTTYK

SEQ ID NO: 426420 - protein, 9 aa, Influenza virus
GRMTFYWKI

SEQ ID NO: 426421 - protein, 9 aa, Influenza virus
SYCRATEYI

SEQ ID NO: 426422 - protein, 9 aa, Influenza virus
IYSTVAASL

SEQ ID NO: 426423 - protein, 9 aa, Influenza virus
NILLHIASI

SEQ ID NO: 426424 - protein, 9 aa, Influenza virus
NEESLRQVL

SEQ ID NO: 426425 - protein, 9 aa, Influenza virus
REICIAWSS

SEQ ID NO: 426426 - protein, 9 aa, Influenza virus
APSPSNSRF

SEQ ID NO: 426427 - protein, 9 aa, Influenza virus
WPDGAKLPF

SEQ ID NO: 426428 - protein, 9 aa, Influenza virus
NEESLRQIL

SEQ ID NO: 426429 - protein, 9 aa, Influenza virus
SLLTEVETL

SEQ ID NO: 426430 - protein, 9 aa, Influenza virus
FIAPDRATF

SEQ ID NO: 426431 - protein, 9 aa, Influenza virus
KMARLGRGY

SEQ ID NO: 426432 - protein, 9 aa, Influenza virus
FYAELKWLI

SEQ ID NO: 426433 - protein, 9 aa, Influenza virus
MLNKSLCKI

SEQ ID NO: 426434 - protein, 9 aa, Influenza virus
LEMCHSTRI

SEQ ID NO: 426435 - protein, 9 aa, Influenza virus
LESRSGFEM

SEQ ID NO: 426436 - protein, 9 aa, Influenza virus
MENERTLYF

SEQ ID NO: 426437 - protein, 9 aa, Influenza virus
NQSGRISIY

SEQ ID NO: 426438 - protein, 9 aa, Influenza virus
HTQYRTGSL

SEQ ID NO: 426439 - protein, 9 aa, Influenza virus
EPRGLFGAI

SEQ ID NO: 426440 - protein, 9 aa, Influenza virus
SSVSSFKRF

SEQ ID NO: 426441 - protein, 9 aa, Influenza virus
SQASYKIFK

SEQ ID NO: 426442 - protein, 9 aa, Influenza virus
FRALVSWEM

SEQ ID NO: 426443 - protein, 9 aa, Influenza virus
FEATGNLVV

SEQ ID NO: 426444 - protein, 9 aa, Influenza virus
NVSEWSYIV

SEQ ID NO: 426445 - protein, 9 aa, Influenza virus
YSGAFTIPV

SEQ ID NO: 426446 - protein, 9 aa, Influenza virus
ALCGSPISV

SEQ ID NO: 426447 - protein, 9 aa, Influenza virus
GAKEVSLSY

SEQ ID NO: 426448 - protein, 9 aa, Influenza virus
YRSMKWLTL

SEQ ID NO: 426449 - protein, 9 aa, Influenza virus
FVFSIAASY

SEQ ID NO: 426450 - protein, 9 aa, Influenza virus
WPDGALLPL

SEQ ID NO: 426451 - protein, 9 aa, Influenza virus
FMWAIHHPP

SEQ ID NO: 426452 - protein, 9 aa, Influenza virus
RLSGGGDIW

SEQ ID NO: 426453 - protein, 9 aa, Influenza virus
VTCGCRDNW

SEQ ID NO: 426454 - protein, 9 aa, Influenza virus
ALNNRFQIK

SEQ ID NO: 426455 - protein, 9 aa, Influenza virus
FQNIDRNAL

SEQ ID NO: 426456 - protein, 9 aa, Influenza virus
SERGLFGAI

SEQ ID NO: 426457 - protein, 9 aa, Influenza virus
NLYASKNPY

SEQ ID NO: 426458 - protein, 9 aa, Influenza virus
CIASSIVLV

SEQ ID NO: 426459 - protein, 9 aa, Influenza virus
YRSMRWLTL

SEQ ID NO: 426460 - protein, 9 aa, Influenza virus
FHRAKEVAL

SEQ ID NO: 426461 - protein, 9 aa, Influenza virus
VAWSSSSCF

SEQ ID NO: 426462 - protein, 9 aa, Influenza virus
VAWSSTSCF

SEQ ID NO: 426463 - protein, 9 aa, Influenza virus
LVTTVTLHF

SEQ ID NO: 426464 - protein, 9 aa, Influenza virus
WLIYQSGTY

SEQ ID NO: 426465 - protein, 9 aa, Influenza virus
GVWTYNAEL

SEQ ID NO: 426466 - protein, 9 aa, Influenza virus
RIFQSGVRM

SEQ ID NO: 426467 - protein, 9 aa, Influenza virus
LEEESDEAL

SEQ ID NO: 426468 - protein, 9 aa, Influenza virus
KFEFIAEEF

SEQ ID NO: 426469 - protein, 9 aa, Influenza virus
YRSMKWLTL

SEQ ID NO: 426470 - protein, 9 aa, Influenza virus
GSNIGFMPK

SEQ ID NO: 426471 - protein, 9 aa, Influenza virus
FSDYEELKH

SEQ ID NO: 426472 - protein, 9 aa, Influenza virus
WLIHQSETY

SEQ ID NO: 426473 - protein, 9 aa, Influenza virus
GTINSPLPF

SEQ ID NO: 426474 - protein, 9 aa, Influenza virus
FQNIERNAL

SEQ ID NO: 426475 - protein, 9 aa, Influenza virus
RMTRGLFGA

SEQ ID NO: 426476 - protein, 9 aa, Influenza virus
ATNINIREW

SEQ ID NO: 426477 - protein, 9 aa, Influenza virus
NILLHVASI

SEQ ID NO: 426478 - protein, 9 aa, Influenza virus
NEEPLRQIL

SEQ ID NO: 426479 - protein, 9 aa, Influenza virus
GTYNHEDYK

SEQ ID NO: 426480 - protein, 9 aa, Influenza virus
YRNMRWLTL

SEQ ID NO: 426481 - protein, 9 aa, Influenza virus
QSRMQFSSL

SEQ ID NO: 426482 - protein, 9 aa, Influenza virus
QTLVSNSDW

SEQ ID NO: 426483 - protein, 9 aa, Influenza virus
RMTFYWTIV

SEQ ID NO: 426484 - protein, 9 aa, Influenza virus
HGSLVLSLW

SEQ ID NO: 426485 - protein, 9 aa, Influenza virus
LATTVTLHF

SEQ ID NO: 426486 - protein, 9 aa, Influenza virus
NVYRALSIY

SEQ ID NO: 426487 - protein, 9 aa, Influenza virus
ALLNASCAA

SEQ ID NO: 426488 - protein, 9 aa, Influenza virus
GAKEISLSY

SEQ ID NO: 426489 - protein, 9 aa, Influenza virus
RRAIATPGM

SEQ ID NO: 426490 - protein, 9 aa, Influenza virus
EMKWLSSSM

SEQ ID NO: 426491 - protein, 9 aa, Influenza virus
FSYKYDNGV

SEQ ID NO: 426492 - protein, 9 aa, Influenza virus
RRNYFTTEV

SEQ ID NO: 426493 - protein, 9 aa, Influenza virus
CRLRGIPPL

SEQ ID NO: 426494 - protein, 9 aa, Influenza virus
WTSNSIIAF

SEQ ID NO: 426495 - protein, 9 aa, Influenza virus
SQYICSPVL

SEQ ID NO: 426496 - protein, 9 aa, Influenza virus
MRRCLLQSL

SEQ ID NO: 426497 - protein, 9 aa, Influenza virus
FPFHKDNAV

SEQ ID NO: 426498 - protein, 9 aa, Influenza virus
RMQFSSLAV

SEQ ID NO: 426499 - protein, 9 aa, Influenza virus
YSSPMMWEI

SEQ ID NO: 426500 - protein, 9 aa, Influenza virus
QTIVSNTDW

SEQ ID NO: 426501 - protein, 9 aa, Influenza virus
NRLSINPVK

SEQ ID NO: 426502 - protein, 9 aa, Influenza virus
IRMAINWGR

SEQ ID NO: 426503 - protein, 9 aa, Influenza virus
NLLIGISNV

SEQ ID NO: 426504 - protein, 9 aa, Influenza virus
NLDYQIGYV

SEQ ID NO: 426505 - protein, 9 aa, Influenza virus
IYSTVASSI

SEQ ID NO: 426506 - protein, 9 aa, Influenza virus
HQNAEGTGM

SEQ ID NO: 426507 - protein, 9 aa, Influenza virus
KFEEIRWLI

SEQ ID NO: 426508 - protein, 9 aa, Influenza virus
SVKLSSGYK

SEQ ID NO: 426509 - protein, 9 aa, Influenza virus
HSKYREEAM

SEQ ID NO: 426510 - protein, 9 aa, Influenza virus
VLVGLILTF

SEQ ID NO: 426511 - protein, 9 aa, Influenza virus
MSSVKNGTY

SEQ ID NO: 426512 - protein, 9 aa, Influenza virus
KTNLYGFII

SEQ ID NO: 426513 - protein, 9 aa, Influenza virus
RRRGLFGAI

SEQ ID NO: 426514 - protein, 9 aa, Influenza virus
WMDYYWGIL

SEQ ID NO: 426515 - protein, 9 aa, Influenza virus
YASKNPYTL

SEQ ID NO: 426516 - protein, 9 aa, Influenza virus
RIFQSGIRM

SEQ ID NO: 426517 - protein, 9 aa, Influenza virus
QNRMQFSSL

SEQ ID NO: 426518 - protein, 9 aa, Influenza virus
TLLMSELGV

SEQ ID NO: 426519 - protein, 9 aa, Influenza virus
VLLKHRFEI

SEQ ID NO: 426520 - protein, 9 aa, Influenza virus
SVYKALSIY

SEQ ID NO: 426521 - protein, 9 aa, Influenza virus
APFSKDNSI

SEQ ID NO: 426522 - protein, 9 aa, Influenza virus
LLAIAMGLV

SEQ ID NO: 426523 - protein, 9 aa, Influenza virus
NAISTTFPY

SEQ ID NO: 426524 - protein, 9 aa, Influenza virus
NEDGNIIFL

SEQ ID NO: 426525 - protein, 9 aa, Influenza virus
ILRGSIAHK

SEQ ID NO: 426526 - protein, 9 aa, Influenza virus
MENQHTIDL

SEQ ID NO: 426527 - protein, 9 aa, Influenza virus
NRLNINPVK

SEQ ID NO: 426528 - protein, 9 aa, Influenza virus
SLIWLWLVL

SEQ ID NO: 426529 - protein, 9 aa, Influenza virus
RMTFYWAIV

SEQ ID NO: 426530 - protein, 9 aa, Influenza virus
LMDALKLSI

SEQ ID NO: 426531 - protein, 9 aa, Influenza virus
SLIMRTVIA

SEQ ID NO: 426532 - protein, 9 aa, Influenza virus
KYVNNTTII

SEQ ID NO: 426533 - protein, 9 aa, Influenza virus
RRLENLNKR

SEQ ID NO: 426534 - protein, 9 aa, Influenza virus
ASYKIFKSY

SEQ ID NO: 426535 - protein, 9 aa, Influenza virus
STQEKNDLY

SEQ ID NO: 426536 - protein, 9 aa, Influenza virus
FRNVVWLIK

SEQ ID NO: 426537 - protein, 9 aa, Influenza virus
VEWTSNSLI

SEQ ID NO: 426538 - protein, 9 aa, Influenza virus
RPIGISSMV

SEQ ID NO: 426539 - protein, 9 aa, Influenza virus
FYAEMKWLL

SEQ ID NO: 426540 - protein, 9 aa, Influenza virus
QTKKMTITF

SEQ ID NO: 426541 - protein, 9 aa, Influenza virus
QTVVLNTDW

SEQ ID NO: 426542 - protein, 9 aa, Influenza virus
TTAKAMEQM

SEQ ID NO: 426543 - protein, 9 aa, Influenza virus
SVRNGTYKY

SEQ ID NO: 426544 - protein, 9 aa, Influenza virus
VTCICRDNW

SEQ ID NO: 426545 - protein, 9 aa, Influenza virus
LVRGNSPAF

SEQ ID NO: 426546 - protein, 9 aa, Influenza virus
HLKDQSWSY

SEQ ID NO: 426547 - protein, 9 aa, Influenza virus
VVNFLSMEF

SEQ ID NO: 426548 - protein, 9 aa, Influenza virus
TIIENNVTV

SEQ ID NO: 426549 - protein, 9 aa, Influenza virus
FHKDNAIRL

SEQ ID NO: 426550 - protein, 9 aa, Influenza virus
IYSCIASSL

SEQ ID NO: 426551 - protein, 9 aa, Influenza virus
VASSGTVEF

SEQ ID NO: 426552 - protein, 9 aa, Influenza virus
TEDNVYKVL

SEQ ID NO: 426553 - protein, 9 aa, Influenza virus
APSPYNSRF

SEQ ID NO: 426554 - protein, 9 aa, Influenza virus
RPVGISSMV

SEQ ID NO: 426555 - protein, 9 aa, Influenza virus
MESGGISKI

SEQ ID NO: 426556 - protein, 9 aa, Influenza virus
LAIVMGLVF

SEQ ID NO: 426557 - protein, 9 aa, Influenza virus
WTGMIDGWY

SEQ ID NO: 426558 - protein, 9 aa, Influenza virus
RLSAGGGIW

SEQ ID NO: 426559 - protein, 9 aa, Influenza virus
ILAIYSTAA

SEQ ID NO: 426560 - protein, 9 aa, Influenza virus
MESGGISKM

SEQ ID NO: 426561 - protein, 9 aa, Influenza virus
MRCTISLVK

SEQ ID NO: 426562 - protein, 9 aa, Influenza virus
GPALSINEL

SEQ ID NO: 426563 - protein, 9 aa, Influenza virus
SEHTAYSQI

SEQ ID NO: 426564 - protein, 9 aa, Influenza virus
VEVVSAKEL

SEQ ID NO: 426565 - protein, 9 aa, Influenza virus
SRFQIQGVK

SEQ ID NO: 426566 - protein, 9 aa, Influenza virus
KTHNGRLCK

SEQ ID NO: 426567 - protein, 9 aa, Influenza virus
RFEFIAEEF

SEQ ID NO: 426568 - protein, 9 aa, Influenza virus
VSFQGRGVF

SEQ ID NO: 426569 - protein, 9 aa, Influenza virus
YRSIRWLTL

SEQ ID NO: 426570 - protein, 9 aa, Influenza virus
NPRMFLAMI

SEQ ID NO: 426571 - protein, 9 aa, Influenza virus
AANPIVPSF

SEQ ID NO: 426572 - protein, 9 aa, Influenza virus
KANQVFPQL

SEQ ID NO: 426573 - protein, 9 aa, Influenza virus
DQIEELWAY

SEQ ID NO: 426574 - protein, 9 aa, Influenza virus
YQKRMGVQM

SEQ ID NO: 426575 - protein, 9 aa, Influenza virus
KLAIGLRNV

SEQ ID NO: 426576 - protein, 9 aa, Influenza virus
STQERNDLY

SEQ ID NO: 426577 - protein, 9 aa, Influenza virus
GMMMGMFNM

SEQ ID NO: 426578 - protein, 9 aa, Influenza virus
KLTQGRQTF

SEQ ID NO: 426579 - protein, 9 aa, Influenza virus
NLTKRLCTI

SEQ ID NO: 426580 - protein, 9 aa, Influenza virus
FHKDNAVRL

SEQ ID NO: 426581 - protein, 9 aa, Influenza virus
LLSSKDNQV

SEQ ID NO: 426582 - protein, 9 aa, Influenza virus
KMNREFEVV

SEQ ID NO: 426583 - protein, 9 aa, Influenza virus
WPWPDGALL

SEQ ID NO: 426584 - protein, 9 aa, Influenza virus
RLRRDQRSL

SEQ ID NO: 426585 - protein, 9 aa, Influenza virus
IEIITIGSI

SEQ ID NO: 426586 - protein, 9 aa, Influenza virus
SPRMFLAMI

SEQ ID NO: 426587 - protein, 9 aa, Influenza virus
LENQNTIDL

SEQ ID NO: 426588 - protein, 9 aa, Influenza virus
SSVSSFERF

SEQ ID NO: 426589 - protein, 9 aa, Influenza virus
ATNPVVPSF

SEQ ID NO: 426590 - protein, 9 aa, Influenza virus
CTINSWHIF

SEQ ID NO: 426591 - protein, 9 aa, Influenza virus
FVAPDRASF

SEQ ID NO: 426592 - protein, 9 aa, Influenza virus
SMCSSTEFL

SEQ ID NO: 426593 - protein, 9 aa, Influenza virus
TTLSTIALF

SEQ ID NO: 426594 - protein, 9 aa, Influenza virus
FHGAKEISL

SEQ ID NO: 426595 - protein, 9 aa, Influenza virus
MLADRVDDA

SEQ ID NO: 426596 - protein, 9 aa, Influenza virus
SISCFLLAA

SEQ ID NO: 426597 - protein, 9 aa, Influenza virus
HRFEIIEGR

SEQ ID NO: 426598 - protein, 9 aa, Influenza virus
APFTKDNSI

SEQ ID NO: 426599 - protein, 9 aa, Influenza virus
KSFSRTQLI

SEQ ID NO: 426600 - protein, 9 aa, Influenza virus
RVKMFDFSK

SEQ ID NO: 426601 - protein, 9 aa, Influenza virus
KTRPILSPL

SEQ ID NO: 426602 - protein, 9 aa, Influenza virus
NLIIGISNV

SEQ ID NO: 426603 - protein, 9 aa, Influenza virus
KGLCTINSW

SEQ ID NO: 426604 - protein, 9 aa, Influenza virus
RVKMFDFTK

SEQ ID NO: 426605 - protein, 9 aa, Influenza virus
SIIPSGPLK

SEQ ID NO: 426606 - protein, 9 aa, Influenza virus
GRMDYYWTL

SEQ ID NO: 426607 - protein, 9 aa, Influenza virus
SSVSSFEKF

SEQ ID NO: 426608 - protein, 9 aa, Influenza virus
TLYFHDSNV

SEQ ID NO: 426609 - protein, 9 aa, Influenza virus
YRSIRWLTL

SEQ ID NO: 426610 - protein, 9 aa, Influenza virus
GRMDYYWTL

SEQ ID NO: 426611 - protein, 9 aa, Influenza virus
STDTVNTLI

SEQ ID NO: 426612 - protein, 9 aa, Influenza virus
GVYKALSIY

SEQ ID NO: 426613 - protein, 9 aa, Influenza virus
SIRNGTYDY

SEQ ID NO: 426614 - protein, 9 aa, Influenza virus
SISVESSTY

SEQ ID NO: 426615 - protein, 9 aa, Influenza virus
LSSKANQVF

SEQ ID NO: 426616 - protein, 9 aa, Influenza virus
NMQNKLNNV

SEQ ID NO: 426617 - protein, 9 aa, Influenza virus
YRSLIKFPI

SEQ ID NO: 426618 - protein, 9 aa, Influenza virus
GPSECRTFF

SEQ ID NO: 426619 - protein, 9 aa, Influenza virus
MSKEGSYFF

SEQ ID NO: 426620 - protein, 9 aa, Influenza virus
FQNIDKNAL

SEQ ID NO: 426621 - protein, 9 aa, Influenza virus
KLYGAGNKL

SEQ ID NO: 426622 - protein, 9 aa, Influenza virus
FQNVSPLWV

SEQ ID NO: 426623 - protein, 9 aa, Influenza virus
WMDYYWGIL

SEQ ID NO: 426624 - protein, 9 aa, Influenza virus
ILRGSVAHK

SEQ ID NO: 426625 - protein, 9 aa, Influenza virus
NILLHIVSI

SEQ ID NO: 426626 - protein, 9 aa, Influenza virus
CLINDPWVL

SEQ ID NO: 426627 - protein, 9 aa, Influenza virus
SINECRTFF

SEQ ID NO: 426628 - protein, 9 aa, Influenza virus
MTSIRNNTY

SEQ ID NO: 426629 - protein, 9 aa, Influenza virus
RSFSRTELI

SEQ ID NO: 426630 - protein, 9 aa, Influenza virus
WILWISFAT

SEQ ID NO: 426631 - protein, 9 aa, Influenza virus
TIIYSSSMM

SEQ ID NO: 426632 - protein, 9 aa, Influenza virus
SLVKTTLFL

SEQ ID NO: 426633 - protein, 9 aa, Influenza virus
FMIIGGFIF

SEQ ID NO: 426634 - protein, 9 aa, Influenza virus
SRISFYWTI

SEQ ID NO: 426635 - protein, 9 aa, Influenza virus
SLMLATGMK

SEQ ID NO: 426636 - protein, 9 aa, Influenza virus
LHDSNVRSL

SEQ ID NO: 426637 - protein, 9 aa, Influenza virus
LATTITLHF

SEQ ID NO: 426638 - protein, 9 aa, Influenza virus
KCMKTFFGW

SEQ ID NO: 426639 - protein, 9 aa, Influenza virus
TLTERGIEV

SEQ ID NO: 426640 - protein, 9 aa, Influenza virus
ALSNRFQIK

SEQ ID NO: 426641 - protein, 9 aa, Influenza virus
SIIEAESSV

SEQ ID NO: 426642 - protein, 9 aa, Influenza virus
LLAVVMGLV

SEQ ID NO: 426643 - protein, 9 aa, Influenza virus
GRISFYWTI

SEQ ID NO: 426644 - protein, 9 aa, Influenza virus
LRHLFSGIK

SEQ ID NO: 426645 - protein, 9 aa, Influenza virus
WTTNSIVVF

SEQ ID NO: 426646 - protein, 9 aa, Influenza virus
GRISIYWTL

SEQ ID NO: 426647 - protein, 9 aa, Influenza virus
IAGFIENGW

SEQ ID NO: 426648 - protein, 9 aa, Influenza virus
GPNDNASAV

SEQ ID NO: 426649 - protein, 9 aa, Influenza virus
GQNHGICAV

SEQ ID NO: 426650 - protein, 9 aa, Influenza virus
LILSFIMWA

SEQ ID NO: 426651 - protein, 9 aa, Influenza virus
HQNAQGSGY

SEQ ID NO: 426652 - protein, 9 aa, Influenza virus
KLYKNTNTL

SEQ ID NO: 426653 - protein, 9 aa, Influenza virus
VLLVSLGAV

SEQ ID NO: 426654 - protein, 9 aa, Influenza virus
FQNIEKNAL

SEQ ID NO: 426655 - protein, 9 aa, Influenza virus
ILFASATAI

SEQ ID NO: 426656 - protein, 9 aa, Influenza virus
HLMIWHSNL

SEQ ID NO: 426657 - protein, 9 aa, Influenza virus
RGLCTINSW

SEQ ID NO: 426658 - protein, 9 aa, Influenza virus
FALAQGALV

SEQ ID NO: 426659 - protein, 9 aa, Influenza virus
YQNNFVPVI

SEQ ID NO: 426660 - protein, 9 aa, Influenza virus
MMMGMFNML

SEQ ID NO: 426661 - protein, 9 aa, Influenza virus
SECVCHSGI

SEQ ID NO: 426662 - protein, 9 aa, Influenza virus
SISIGSSTY

SEQ ID NO: 426663 - protein, 9 aa, Influenza virus
FTFKRTKGF

SEQ ID NO: 426664 - protein, 9 aa, Influenza virus
GSFCSINGK

SEQ ID NO: 426665 - protein, 9 aa, Influenza virus
LYNKVRLQL

SEQ ID NO: 426666 - protein, 9 aa, Influenza virus
LIAPSRVTK

SEQ ID NO: 426667 - protein, 9 aa, Influenza virus
LANNGRFEF

SEQ ID NO: 426668 - protein, 9 aa, Influenza virus
IAGFIEGRW

SEQ ID NO: 426669 - protein, 9 aa, Influenza virus
SPGVKGWAF

SEQ ID NO: 426670 - protein, 9 aa, Influenza virus
MQNKLNNVI

SEQ ID NO: 426671 - protein, 9 aa, Influenza virus
MIKAVRGDL

SEQ ID NO: 426672 - protein, 9 aa, Influenza virus
WTSNSIVTF

SEQ ID NO: 426673 - protein, 9 aa, Influenza virus
QVDCFLWHI

SEQ ID NO: 426674 - protein, 9 aa, Influenza virus
KVCRTLLAK

SEQ ID NO: 426675 - protein, 9 aa, Influenza virus
AMGLIFMCV

SEQ ID NO: 426676 - protein, 9 aa, Influenza virus
ISNEGSYFF

SEQ ID NO: 426677 - protein, 9 aa, Influenza virus
GVSSEVPGW

SEQ ID NO: 426678 - protein, 9 aa, Influenza virus
GYKDVILWF

SEQ ID NO: 426679 - protein, 9 aa, Influenza virus
RLTTTIRTW

SEQ ID NO: 426680 - protein, 9 aa, Influenza virus
GTMKDRSPY

SEQ ID NO: 426681 - protein, 9 aa, Influenza virus
QSKMQFSSL

SEQ ID NO: 426682 - protein, 9 aa, Influenza virus
NRLNINSVK

SEQ ID NO: 426683 - protein, 9 aa, Influenza virus
SQRSKFLLM

SEQ ID NO: 426684 - protein, 9 aa, Influenza virus
ALMSVPMGS

SEQ ID NO: 426685 - protein, 9 aa, Influenza virus
GRMNYYWTL

SEQ ID NO: 426686 - protein, 9 aa, Influenza virus
RMQFSSLTV

SEQ ID NO: 426687 - protein, 9 aa, Influenza virus
RSDKICIGY

SEQ ID NO: 426688 - protein, 9 aa, Influenza virus
LIFMARSAL

SEQ ID NO: 426689 - protein, 9 aa, Influenza virus
YRSLIQFPI

SEQ ID NO: 426690 - protein, 9 aa, Influenza virus
YRALISWPL

SEQ ID NO: 426691 - protein, 9 aa, Influenza virus
LTITYSSSL

SEQ ID NO: 426692 - protein, 9 aa, Influenza virus
CIASSVVLV

SEQ ID NO: 426693 - protein, 9 aa, Influenza virus
TLSTIALLI

SEQ ID NO: 426694 - protein, 9 aa, Influenza virus
LAVVMGLVF

SEQ ID NO: 426695 - protein, 9 aa, Influenza virus
IAWSSSSCF

SEQ ID NO: 426696 - protein, 9 aa, Influenza virus
SACHDGTNW

SEQ ID NO: 426697 - protein, 9 aa, Influenza virus
IYSSVASSL

SEQ ID NO: 426698 - protein, 9 aa, Influenza virus
IYSTVTSSL

SEQ ID NO: 426699 - protein, 9 aa, Influenza virus
NPRMFLAMI

SEQ ID NO: 426700 - protein, 9 aa, Influenza virus
GSNRPWLSF

SEQ ID NO: 426701 - protein, 9 aa, Influenza virus
FPIGVAPVL

SEQ ID NO: 426702 - protein, 9 aa, Influenza virus
FEATGNLVV

SEQ ID NO: 426703 - protein, 9 aa, Influenza virus
ALASCMGLI

SEQ ID NO: 426704 - protein, 9 aa, Influenza virus
VLASTTAKA

SEQ ID NO: 426705 - protein, 9 aa, Influenza virus
SSQDTELSF

SEQ ID NO: 426706 - protein, 9 aa, Influenza virus
ATNPIVPSF

SEQ ID NO: 426707 - protein, 9 aa, Influenza virus
MGLKISSSF

SEQ ID NO: 426708 - protein, 9 aa, Influenza virus
ISLVKTTLF

SEQ ID NO: 426709 - protein, 9 aa, Influenza virus
ISPLAVTWW

SEQ ID NO: 426710 - protein, 9 aa, Influenza virus
SSDDFALIV

SEQ ID NO: 426711 - protein, 9 aa, Influenza virus
KMARLGRGY

SEQ ID NO: 426712 - protein, 9 aa, Influenza virus
GTIHDRTTF

SEQ ID NO: 426713 - protein, 9 aa, Influenza virus
YVRSEKLVL

SEQ ID NO: 426714 - protein, 9 aa, Influenza virus
LIAPSRVSK

SEQ ID NO: 426715 - protein, 9 aa, Influenza virus
SRYGYEMLK

SEQ ID NO: 426716 - protein, 9 aa, Influenza virus
RPQMNGQSG

SEQ ID NO: 426717 - protein, 9 aa, Influenza virus
SFYRNLIWF

SEQ ID NO: 426718 - protein, 9 aa, Influenza virus
EMRTFSFQL

SEQ ID NO: 426719 - protein, 9 aa, Influenza virus
WPDGALLPL

SEQ ID NO: 426720 - protein, 9 aa, Influenza virus
YSSSMMWEI

SEQ ID NO: 426721 - protein, 9 aa, Influenza virus
WTGMVDGWY

SEQ ID NO: 426722 - protein, 9 aa, Influenza virus
WTSSSSVVM

SEQ ID NO: 426723 - protein, 9 aa, Influenza virus
HQSETYPVI

SEQ ID NO: 426724 - protein, 9 aa, Influenza virus
RRNRYLEEH

SEQ ID NO: 426725 - protein, 9 aa, Influenza virus
KRYGPALSI

SEQ ID NO: 426726 - protein, 9 aa, Influenza virus
DAVATTHSW

SEQ ID NO: 426727 - protein, 9 aa, Influenza virus
APIEHIASI

SEQ ID NO: 426728 - protein, 9 aa, Influenza virus
GRMDYYWAI

SEQ ID NO: 426729 - protein, 9 aa, Influenza virus
NMSKRKSYI

SEQ ID NO: 426730 - protein, 9 aa, Influenza virus
MILSVVSLL

SEQ ID NO: 426731 - protein, 9 aa, Influenza virus
KMNTQILVF

SEQ ID NO: 426732 - protein, 9 aa, Influenza virus
YRSLISWPL

SEQ ID NO: 426733 - protein, 9 aa, Influenza virus
AMKHTSQYL

SEQ ID NO: 426734 - protein, 9 aa, Influenza virus
CRLRGIPPL

SEQ ID NO: 426735 - protein, 9 aa, Influenza virus
YQNNFVPVV

SEQ ID NO: 426736 - protein, 9 aa, Influenza virus
NRIMINPVK

SEQ ID NO: 426737 - protein, 9 aa, Influenza virus
CMRTFFGWK

SEQ ID NO: 426738 - protein, 9 aa, Influenza virus
MARLGRGYM

SEQ ID NO: 426739 - protein, 9 aa, Influenza virus
SFQVDCYLW

SEQ ID NO: 426740 - protein, 9 aa, Influenza virus
RMFLAMITY

SEQ ID NO: 426741 - protein, 9 aa, Influenza virus
ATCVCRDNW

SEQ ID NO: 426742 - protein, 9 aa, Influenza virus
SQYRALISW

SEQ ID NO: 426743 - protein, 9 aa, Influenza virus
WTSGSIISF

SEQ ID NO: 426744 - protein, 9 aa, Influenza virus
SQYICSPVL

SEQ ID NO: 426745 - protein, 9 aa, Influenza virus
APRYAFELV

SEQ ID NO: 426746 - protein, 9 aa, Influenza virus
TAVDTCYPF

SEQ ID NO: 426747 - protein, 9 aa, Influenza virus
RLIQNSMTI

SEQ ID NO: 426748 - protein, 9 aa, Influenza virus
AIMIAGLFF

SEQ ID NO: 426749 - protein, 9 aa, Influenza virus
CMKTFFGWK

SEQ ID NO: 426750 - protein, 9 aa, Influenza virus
RIGSKGHVF

SEQ ID NO: 426751 - protein, 9 aa, Influenza virus
NRFQIQGVK

SEQ ID NO: 426752 - protein, 9 aa, Influenza virus
RTFSFQLIL

SEQ ID NO: 426753 - protein, 9 aa, Influenza virus
GMVDGWYGF

SEQ ID NO: 426754 - protein, 9 aa, Influenza virus
TLDYHDSNV

SEQ ID NO: 426755 - protein, 9 aa, Influenza virus
ALCGSPVSV

SEQ ID NO: 426756 - protein, 9 aa, Influenza virus
NVPEWSYIV

SEQ ID NO: 426757 - protein, 9 aa, Influenza virus
KMARLGKGY

SEQ ID NO: 426758 - protein, 9 aa, Influenza virus
KWWVWLWLV

SEQ ID NO: 426759 - protein, 9 aa, Influenza virus
LVLGLSMVK

SEQ ID NO: 426760 - protein, 9 aa, Influenza virus
ITNKVNTVI

SEQ ID NO: 426761 - protein, 9 aa, Influenza virus
TTNYYNETF

SEQ ID NO: 426762 - protein, 9 aa, Influenza virus
KTIDQVTGK

SEQ ID NO: 426763 - protein, 9 aa, Influenza virus
GLIDGWYGF

SEQ ID NO: 426764 - protein, 9 aa, Influenza virus
TLKLGQFPV

SEQ ID NO: 426765 - protein, 9 aa, Influenza virus
GTVKDRSPF

SEQ ID NO: 426766 - protein, 9 aa, Influenza virus
FSFKYGNGV

SEQ ID NO: 426767 - protein, 9 aa, Influenza virus
EMKWLSSSM

SEQ ID NO: 426768 - protein, 9 aa, Influenza virus
NIWSYNAQL

SEQ ID NO: 426769 - protein, 9 aa, Influenza virus
WPDRAELPF

SEQ ID NO: 426770 - protein, 9 aa, Influenza virus
ISHCRATEY

SEQ ID NO: 426771 - protein, 9 aa, Influenza virus
TVLEKNVTV

SEQ ID NO: 426772 - protein, 9 aa, Influenza virus
KMNTQILIL

SEQ ID NO: 426773 - protein, 9 aa, Influenza virus
MTIASDILK

SEQ ID NO: 426774 - protein, 9 aa, Influenza virus
YQNNFVPVM

SEQ ID NO: 426775 - protein, 9 aa, Influenza virus
YRALISWEM

SEQ ID NO: 426776 - protein, 9 aa, Influenza virus
KTFQNVSPL

SEQ ID NO: 426777 - protein, 9 aa, Influenza virus
FHKDNALRL

SEQ ID NO: 426778 - protein, 9 aa, Influenza virus
APRYSFELV

SEQ ID NO: 426779 - protein, 9 aa, Influenza virus
HLKDQGWSY

SEQ ID NO: 426780 - protein, 9 aa, Influenza virus
QTKTMTITF

SEQ ID NO: 426781 - protein, 9 aa, Influenza virus
FLYIRTNGT

SEQ ID NO: 426782 - protein, 9 aa, Influenza virus
NMQNRLNNV

SEQ ID NO: 426783 - protein, 9 aa, Influenza virus
GYKEVILWF

SEQ ID NO: 426784 - protein, 9 aa, Influenza virus
LRISSSFSF

SEQ ID NO: 426785 - protein, 9 aa, Influenza virus
RLRRDQKAL

SEQ ID NO: 426786 - protein, 9 aa, Influenza virus
VILWFSLGA

SEQ ID NO: 426787 - protein, 9 aa, Influenza virus
APLMMAYML

SEQ ID NO: 426788 - protein, 9 aa, Influenza virus
LPACAYGPA

SEQ ID NO: 426789 - protein, 9 aa, Influenza virus
FQTAAQKAM

SEQ ID NO: 426790 - protein, 9 aa, Influenza virus
RTNLYGFII

SEQ ID NO: 426791 - protein, 9 aa, Influenza virus
LVAPRGYFK

SEQ ID NO: 426792 - protein, 9 aa, Influenza virus
SVKNGTYNY

SEQ ID NO: 426793 - protein, 9 aa, Influenza virus
ETIIETGYV

SEQ ID NO: 426794 - protein, 9 aa, Influenza virus
LANNGKFEF

SEQ ID NO: 426795 - protein, 9 aa, Influenza virus
RVWWTTNSI

SEQ ID NO: 426796 - protein, 9 aa, Influenza virus
MRRCLLQSL

SEQ ID NO: 426797 - protein, 9 aa, Influenza virus
AILAATVTL

SEQ ID NO: 426798 - protein, 9 aa, Influenza virus
SQYRSLISW

SEQ ID NO: 426799 - protein, 9 aa, Influenza virus
LQITSLCSI

SEQ ID NO: 426800 - protein, 9 aa, Influenza virus
RRNYFTAEV

SEQ ID NO: 426801 - protein, 9 aa, Influenza virus
LIMRTVIAL

SEQ ID NO: 426802 - protein, 9 aa, Influenza virus
WLVHQSGTY

SEQ ID NO: 426803 - protein, 9 aa, Influenza virus
RRFIQNALN

SEQ ID NO: 426804 - protein, 9 aa, Influenza virus
WLIDQSGTY

SEQ ID NO: 426805 - protein, 9 aa, Influenza virus
WHASNRPWV

SEQ ID NO: 426806 - protein, 9 aa, Influenza virus
ISFSISCFL

SEQ ID NO: 426807 - protein, 9 aa, Influenza virus
GLYESIEEC

SEQ ID NO: 426808 - protein, 9 aa, Influenza virus
NVYKALSIY

SEQ ID NO: 426809 - protein, 9 aa, Influenza virus
ARLGKGYMF

SEQ ID NO: 426810 - protein, 9 aa, Influenza virus
VPVTQTMEL

SEQ ID NO: 426811 - protein, 9 aa, Influenza virus
NRIQINPVK

SEQ ID NO: 426812 - protein, 9 aa, Influenza virus
CKITGFAPF

SEQ ID NO: 426813 - protein, 9 aa, Influenza virus
WISFATSCF

SEQ ID NO: 426814 - protein, 9 aa, Influenza virus
TEHQIGNVI

SEQ ID NO: 426815 - protein, 9 aa, Influenza virus
TLTEREVEV

SEQ ID NO: 426816 - protein, 9 aa, Influenza virus
LEFKADLII

SEQ ID NO: 426817 - protein, 9 aa, Influenza virus
REVCIAWSS

SEQ ID NO: 426818 - protein, 9 aa, Influenza virus
RISHRTLLM

SEQ ID NO: 426819 - protein, 9 aa, Influenza virus
HTQYRTESL

SEQ ID NO: 426820 - protein, 9 aa, Influenza virus
LVSLGAVSF

SEQ ID NO: 426821 - protein, 9 aa, Influenza virus
SQYRALVSW

SEQ ID NO: 426822 - protein, 9 aa, Influenza virus
KRLGNLNKK

SEQ ID NO: 426823 - protein, 9 aa, Influenza virus
GTITSNLPF

SEQ ID NO: 426824 - protein, 9 aa, Influenza virus
IRINMINSK

SEQ ID NO: 426825 - protein, 9 aa, Influenza virus
SGYSGIFSV

SEQ ID NO: 426826 - protein, 9 aa, Influenza virus
LIFSARSAL

SEQ ID NO: 426827 - protein, 9 aa, Influenza virus
KCMRTFFGW

SEQ ID NO: 426828 - protein, 9 aa, Influenza virus
QAYTKVMYF

SEQ ID NO: 426829 - protein, 9 aa, Influenza virus
RLIEKTNEK

SEQ ID NO: 426830 - protein, 9 aa, Influenza virus
WTSSSSIVM

SEQ ID NO: 426831 - protein, 9 aa, Influenza virus
LVAPRGHYK

SEQ ID NO: 426832 - protein, 9 aa, Influenza virus
LIFLARSAL

SEQ ID NO: 426833 - protein, 9 aa, Influenza virus
GLSSRISFY

SEQ ID NO: 426834 - protein, 9 aa, Influenza virus
ELRFVFSSA

SEQ ID NO: 426835 - protein, 9 aa, Influenza virus
FLWGIHHPP

SEQ ID NO: 426836 - protein, 9 aa, Influenza virus
RISIYWTLV

SEQ ID NO: 426837 - protein, 9 aa, Influenza virus
STIGDCPKY

SEQ ID NO: 426838 - protein, 9 aa, Influenza virus
ASWFNSFLV

SEQ ID NO: 426839 - protein, 9 aa, Influenza virus
LMWALGENM

SEQ ID NO: 426840 - protein, 9 aa, Influenza virus
TYINNTTII

SEQ ID NO: 426841 - protein, 9 aa, Influenza virus
FASSGIAIV

SEQ ID NO: 426842 - protein, 9 aa, Influenza virus
KMNTQILIF

SEQ ID NO: 426843 - protein, 9 aa, Influenza virus
SECVCHNGI

SEQ ID NO: 426844 - protein, 9 aa, Influenza virus
KFEEMRWLI

SEQ ID NO: 426845 - protein, 9 aa, Influenza virus
KVWWTSNSI

SEQ ID NO: 426846 - protein, 9 aa, Influenza virus
KFEEIKWLI

SEQ ID NO: 426847 - protein, 9 aa, Influenza virus
LANNGRFEF

SEQ ID NO: 426848 - protein, 9 aa, Influenza virus
LILAFIMWA

SEQ ID NO: 426849 - protein, 9 aa, Influenza virus
GAINTTLPF

SEQ ID NO: 426850 - protein, 9 aa, Influenza virus
KSSLPLCPF

SEQ ID NO: 426851 - protein, 9 aa, Influenza virus
KIDDQIEEL

SEQ ID NO: 426852 - protein, 9 aa, Influenza virus
SPYRALMSV

SEQ ID NO: 426853 - protein, 9 aa, Influenza virus
GVNSDTTGW

SEQ ID NO: 426854 - protein, 9 aa, Influenza virus
SSCHDGNAW

SEQ ID NO: 426855 - protein, 9 aa, Influenza virus
ALNNRSQIK

SEQ ID NO: 426856 - protein, 9 aa, Influenza virus
EREAKLFVL

SEQ ID NO: 426857 - protein, 9 aa, Influenza virus
STDTVDTLI

SEQ ID NO: 426858 - protein, 9 aa, Influenza virus
RRQKSLIWL

SEQ ID NO: 426859 - protein, 9 aa, Influenza virus
IQSKGLFGA

SEQ ID NO: 426860 - protein, 9 aa, Influenza virus
TLTENGVPV

SEQ ID NO: 426861 - protein, 9 aa, Influenza virus
YAFGNCSKY

SEQ ID NO: 426862 - protein, 9 aa, Influenza virus
ISNKVNSVI

SEQ ID NO: 426863 - protein, 9 aa, Influenza virus
RMDYYWAIL

SEQ ID NO: 426864 - protein, 9 aa, Influenza virus
RIDDAVTDV

SEQ ID NO: 426865 - protein, 9 aa, Influenza virus
TEDNIYKIL

SEQ ID NO: 426866 - protein, 9 aa, Influenza virus
KEGYSLVGI

SEQ ID NO: 426867 - protein, 9 aa, Influenza virus
MEFEPFQSL

SEQ ID NO: 426868 - protein, 9 aa, Influenza virus
MQNRLNNVI

SEQ ID NO: 426869 - protein, 9 aa, Influenza virus
VMCVCRDNW

SEQ ID NO: 426870 - protein, 9 aa, Influenza virus
YNAEFLVAL

SEQ ID NO: 426871 - protein, 9 aa, Influenza virus
WTSNSIVAF

SEQ ID NO: 426872 - protein, 9 aa, Influenza virus
GSIPNGKPF

SEQ ID NO: 426873 - protein, 9 aa, Influenza virus
LSNPKCDLY

SEQ ID NO: 426874 - protein, 9 aa, Influenza virus
HQSGTYPVV

SEQ ID NO: 426875 - protein, 9 aa, Influenza virus
TVLERNVTV

SEQ ID NO: 426876 - protein, 9 aa, Influenza virus
RLESVFAGK

SEQ ID NO: 426877 - protein, 9 aa, Influenza virus
ATAVAVLKY

SEQ ID NO: 426878 - protein, 9 aa, Influenza virus
CLRGGRNSF

SEQ ID NO: 426879 - protein, 9 aa, Influenza virus
TACSDGSGW

SEQ ID NO: 426880 - protein, 9 aa, Influenza virus
YQNSFVPVV

SEQ ID NO: 426881 - protein, 9 aa, Influenza virus
GTIKDRSPY

SEQ ID NO: 426882 - protein, 9 aa, Influenza virus
HMECRTFFL

SEQ ID NO: 426883 - protein, 9 aa, Influenza virus
SQFRALISW

SEQ ID NO: 426884 - protein, 9 aa, Influenza virus
YVKSERLVL

SEQ ID NO: 426885 - protein, 9 aa, Influenza virus
GLNIGLHLK

SEQ ID NO: 426886 - protein, 9 aa, Influenza virus
WTSNSVVVF

SEQ ID NO: 426887 - protein, 9 aa, Influenza virus
YSSPMMWEI

SEQ ID NO: 426888 - protein, 9 aa, Influenza virus
HQNEQGSGY

SEQ ID NO: 426889 - protein, 9 aa, Influenza virus
NSVKLSSGY

SEQ ID NO: 426890 - protein, 9 aa, Influenza virus
VQSYFQLFL

SEQ ID NO: 426891 - protein, 9 aa, Influenza virus
VLNTDWSGY

SEQ ID NO: 426892 - protein, 9 aa, Influenza virus
ISFESNGNF

SEQ ID NO: 426893 - protein, 9 aa, Influenza virus
WTSNSIVSM

SEQ ID NO: 426894 - protein, 9 aa, Influenza virus
SSVSSFEKF

SEQ ID NO: 426895 - protein, 9 aa, Influenza virus
YPRYPNVRC

SEQ ID NO: 426896 - protein, 9 aa, Influenza virus
QQIESIIEA

SEQ ID NO: 426897 - protein, 9 aa, Influenza virus
GRMDYYWGI

SEQ ID NO: 426898 - protein, 9 aa, Influenza virus
VTKENTGSY

SEQ ID NO: 426899 - protein, 9 aa, Influenza virus
MQIRGFVYF

SEQ ID NO: 426900 - protein, 9 aa, Influenza virus
TVSSFYSEM

SEQ ID NO: 426901 - protein, 9 aa, Influenza virus
KAIDRITTK

SEQ ID NO: 426902 - protein, 9 aa, Influenza virus
RRQKWWVWL

SEQ ID NO: 426903 - protein, 9 aa, Influenza virus
ILFNTIGNL

SEQ ID NO: 426904 - protein, 9 aa, Influenza virus
EVWSYNAEF

SEQ ID NO: 426905 - protein, 9 aa, Influenza virus
SQYRSLISW

SEQ ID NO: 426906 - protein, 9 aa, Influenza virus
HQSGTYPVI

SEQ ID NO: 426907 - protein, 9 aa, Influenza virus
TFQNVSPLW

SEQ ID NO: 426908 - protein, 9 aa, Influenza virus
RILFIREGK

SEQ ID NO: 426909 - protein, 9 aa, Influenza virus
NHGSLVLSL

SEQ ID NO: 426910 - protein, 9 aa, Influenza virus
ELWAYNAEL

SEQ ID NO: 426911 - protein, 9 aa, Influenza virus
KSLESRSGF

SEQ ID NO: 426912 - protein, 9 aa, Influenza virus
APFSKDNSV

SEQ ID NO: 426913 - protein, 9 aa, Influenza virus
YSSSLMWEI

SEQ ID NO: 426914 - protein, 9 aa, Influenza virus
YPKVYRTYF

SEQ ID NO: 426915 - protein, 9 aa, Influenza virus
EQITFMQAL

SEQ ID NO: 426916 - protein, 9 aa, Influenza virus
LTIIYSSSM

SEQ ID NO: 426917 - protein, 9 aa, Influenza virus
YNAEILVAL

SEQ ID NO: 426918 - protein, 9 aa, Influenza virus
FHGAKEVSL

SEQ ID NO: 426919 - protein, 9 aa, Influenza virus
SMRWLTLKL

SEQ ID NO: 426920 - protein, 9 aa, Influenza virus
ISFESNGNF

SEQ ID NO: 426921 - protein, 9 aa, Influenza virus
GQWDWPDGA

SEQ ID NO: 426922 - protein, 9 aa, Influenza virus
FSVQRSLPF

SEQ ID NO: 426923 - protein, 9 aa, Influenza virus
MGYICSGVF

SEQ ID NO: 426924 - protein, 9 aa, Influenza virus
TEDNVYKIL

SEQ ID NO: 426925 - protein, 9 aa, Influenza virus
ITNKVNSVI

SEQ ID NO: 426926 - protein, 9 aa, Influenza virus
FPIGTAPIL

SEQ ID NO: 426927 - protein, 9 aa, Influenza virus
TLDFHDSSV

SEQ ID NO: 426928 - protein, 9 aa, Influenza virus
GTYDHNIYR

SEQ ID NO: 426929 - protein, 9 aa, Influenza virus
IYSTVSSSL

SEQ ID NO: 426930 - protein, 9 aa, Influenza virus
KFEFIVEKF

SEQ ID NO: 426931 - protein, 9 aa, Influenza virus
MVGLILAFI

SEQ ID NO: 426932 - protein, 9 aa, Influenza virus
WPQSSPPTV

SEQ ID NO: 426933 - protein, 9 aa, Influenza virus
RLTQGRQTY

SEQ ID NO: 426934 - protein, 9 aa, Influenza virus
MMAMRYPIT

SEQ ID NO: 426935 - protein, 9 aa, Influenza virus
RANQRLNTM

SEQ ID NO: 426936 - protein, 9 aa, Influenza virus
FQNVNKVTY

SEQ ID NO: 426937 - protein, 9 aa, Influenza virus
KRYERVKMF

SEQ ID NO: 426938 - protein, 9 aa, Influenza virus
NSVKLSSGY

SEQ ID NO: 426939 - protein, 9 aa, Influenza virus
LISKTNQQF

SEQ ID NO: 426940 - protein, 9 aa, Influenza virus
SSSFSFGGF

SEQ ID NO: 426941 - protein, 9 aa, Influenza virus
FIKDYRYTY

SEQ ID NO: 426942 - protein, 9 aa, Influenza virus
WPDGALLPF

SEQ ID NO: 426943 - protein, 9 aa, Influenza virus
RLENVFAGK

SEQ ID NO: 426944 - protein, 9 aa, Influenza virus
NLLIGVSNV

SEQ ID NO: 426945 - protein, 9 aa, Influenza virus
TLNMHDANV

SEQ ID NO: 426946 - protein, 9 aa, Influenza virus
AMGLVFMCV

SEQ ID NO: 426947 - protein, 9 aa, Influenza virus
CRLSGIPPL

SEQ ID NO: 426948 - protein, 9 aa, Influenza virus
WHASNRPWI

SEQ ID NO: 426949 - protein, 9 aa, Influenza virus
WLGRTISPK

SEQ ID NO: 426950 - protein, 9 aa, Influenza virus
FRYGNGVWI

SEQ ID NO: 426951 - protein, 9 aa, Influenza virus
YRSMKWLTL

SEQ ID NO: 426952 - protein, 9 aa, Influenza virus
KTFQNVSPV

SEQ ID NO: 426953 - protein, 9 aa, Influenza virus
WTSNSIVVF

SEQ ID NO: 426954 - protein, 9 aa, Influenza virus
HMGECPKYV

SEQ ID NO: 426955 - protein, 9 aa, Influenza virus
GLNVGLHLK

SEQ ID NO: 426956 - protein, 9 aa, Influenza virus
FHQCDNNCI

SEQ ID NO: 426957 - protein, 9 aa, Influenza virus
GTIHDRSPY

SEQ ID NO: 426958 - protein, 9 aa, Influenza virus
TTMEKNVTV

SEQ ID NO: 426959 - protein, 9 aa, Influenza virus
GLIDGWYGY

SEQ ID NO: 426960 - protein, 9 aa, Influenza virus
KLYGSGAKL

SEQ ID NO: 426961 - protein, 9 aa, Influenza virus
GLIAGWYGF

SEQ ID NO: 426962 - protein, 9 aa, Influenza virus
SPFRTLMSV

SEQ ID NO: 426963 - protein, 9 aa, Influenza virus
FALGHGTTL

SEQ ID NO: 426964 - protein, 9 aa, Influenza virus
TTAVAVLKY

SEQ ID NO: 426965 - protein, 9 aa, Influenza virus
RRMVQAMRA

SEQ ID NO: 426966 - protein, 9 aa, Influenza virus
PTAPHGLCY

SEQ ID NO: 426967 - protein, 9 aa, Influenza virus
RCMKTFFGW

SEQ ID NO: 426968 - protein, 9 aa, Influenza virus
GPVHFRNQV

SEQ ID NO: 426969 - protein, 9 aa, Influenza virus
YRALVSWPL

SEQ ID NO: 426970 - protein, 9 aa, Influenza virus
RRSYFTAEV

SEQ ID NO: 426971 - protein, 9 aa, Influenza virus
LVLNKSLCK

SEQ ID NO: 426972 - protein, 9 aa, Influenza virus
YPKVYRTYF

SEQ ID NO: 426973 - protein, 9 aa, Influenza virus
MESGGIDKI

SEQ ID NO: 426974 - protein, 9 aa, Influenza virus
WTSNSMVTF

SEQ ID NO: 426975 - protein, 9 aa, Influenza virus
SPYRTLMSV

SEQ ID NO: 426976 - protein, 9 aa, Influenza virus
YQNNFVPVV

SEQ ID NO: 426977 - protein, 9 aa, Influenza virus
GYKDIILWF

SEQ ID NO: 426978 - protein, 9 aa, Influenza virus
REVEVVNAT

SEQ ID NO: 426979 - protein, 9 aa, Influenza virus
SMRWLTLKL

SEQ ID NO: 426980 - protein, 9 aa, Influenza virus
FVRGQQGRM

SEQ ID NO: 426981 - protein, 9 aa, Influenza virus
GFYRNLVWF

SEQ ID NO: 426982 - protein, 9 aa, Influenza virus
GLFGAIAGF

SEQ ID NO: 426983 - protein, 9 aa, Influenza virus
GTIHDRAAF

SEQ ID NO: 426984 - protein, 9 aa, Influenza virus
GLSSRISFY

SEQ ID NO: 426985 - protein, 9 aa, Influenza virus
WTSNSMVTF

SEQ ID NO: 426986 - protein, 9 aa, Influenza virus
RLIQNSITI

SEQ ID NO: 426987 - protein, 9 aa, Influenza virus
GQRSWMKIY

SEQ ID NO: 426988 - protein, 9 aa, Influenza virus
NVWTYNAEL

SEQ ID NO: 426989 - protein, 9 aa, Influenza virus
GQRSWMKLY

SEQ ID NO: 426990 - protein, 9 aa, Influenza virus
VMELIRMVK

SEQ ID NO: 426991 - protein, 9 aa, Influenza virus
YQGRLCNPM

SEQ ID NO: 426992 - protein, 9 aa, Influenza virus
KPQCHITGF

SEQ ID NO: 426993 - protein, 9 aa, Influenza virus
ALTLNTMTK

SEQ ID NO: 426994 - protein, 9 aa, Influenza virus
ITYGVCPRY

SEQ ID NO: 426995 - protein, 9 aa, Influenza virus
GSNRPWLSF

SEQ ID NO: 426996 - protein, 9 aa, Influenza virus
LENQHTIDL

SEQ ID NO: 426997 - protein, 9 aa, Influenza virus
LMDSLKLSI

SEQ ID NO: 426998 - protein, 9 aa, Influenza virus
KCIKTFFGW

SEQ ID NO: 426999 - protein, 9 aa, Influenza virus
YTRLYIWGV

SEQ ID NO: 427000 - protein, 9 aa, Influenza virus
LPFHNVHPL

SEQ ID NO: 427001 - protein, 9 aa, Influenza virus
APLSKDNSI

SEQ ID NO: 427002 - protein, 9 aa, Influenza virus
CTINSWHIF

SEQ ID NO: 427003 - protein, 9 aa, Influenza virus
RREIHIYYL

SEQ ID NO: 427004 - protein, 9 aa, Influenza virus
GRMDYYWAI

SEQ ID NO: 427005 - protein, 9 aa, Influenza virus
IAWSSSSCY

SEQ ID NO: 427006 - protein, 9 aa, Influenza virus
KEMCAAWSS

SEQ ID NO: 427007 - protein, 9 aa, Influenza virus
RVWWTSNSI

SEQ ID NO: 427008 - protein, 9 aa, Influenza virus
ATATVYYNK

SEQ ID NO: 427009 - protein, 9 aa, Influenza virus
KRIENLNKK

SEQ ID NO: 427010 - protein, 9 aa, Influenza virus
HQSGTYPII

SEQ ID NO: 427011 - protein, 9 aa, Influenza virus
ALGDCPKYI

SEQ ID NO: 427012 - protein, 9 aa, Influenza virus
TIINNYYNK

SEQ ID NO: 427013 - protein, 9 aa, Influenza virus
IYSTVASSL

SEQ ID NO: 427014 - protein, 9 aa, Influenza virus
MQFSSLTVS

SEQ ID NO: 427015 - protein, 9 aa, Influenza virus
NPNQKLFAL

SEQ ID NO: 427016 - protein, 9 aa, Influenza virus
WISFSISCF

SEQ ID NO: 427017 - protein, 9 aa, Influenza virus
FSFGASCFL

SEQ ID NO: 427018 - protein, 9 aa, Influenza virus
HHAVANGTV

SEQ ID NO: 427019 - protein, 9 aa, Influenza virus
QTLVANNDW

SEQ ID NO: 427020 - protein, 9 aa, Influenza virus
KQIGNVINW

SEQ ID NO: 427021 - protein, 9 aa, Influenza virus
CSNDTINYY

SEQ ID NO: 427022 - protein, 9 aa, Influenza virus
KAGFIEGGW

SEQ ID NO: 427023 - protein, 9 aa, Influenza virus
FSYKYGNGV

SEQ ID NO: 427024 - protein, 9 aa, Influenza virus
IILWISFSM

SEQ ID NO: 427025 - protein, 9 aa, Influenza virus
QTLVSNNDW

SEQ ID NO: 427026 - protein, 9 aa, Influenza virus
LLAIVMGLV

SEQ ID NO: 427027 - protein, 9 aa, Influenza virus
CPFRGFFPF

SEQ ID NO: 427028 - protein, 9 aa, Influenza virus
VIITREPYV

SEQ ID NO: 427029 - protein, 9 aa, Influenza virus
AVKLSSGYK

SEQ ID NO: 427030 - protein, 9 aa, Influenza virus
ALRELWQCY

SEQ ID NO: 427031 - protein, 9 aa, Influenza virus
YVNVRSLKL

SEQ ID NO: 427032 - protein, 9 aa, Influenza virus
TVLSIIALL

SEQ ID NO: 427033 - protein, 9 aa, Influenza virus
ILKGKFQTA

SEQ ID NO: 427034 - protein, 9 aa, Influenza virus
CHSGICPVV

SEQ ID NO: 427035 - protein, 9 aa, Influenza virus
SFQVDCFLW

SEQ ID NO: 427036 - protein, 9 aa, Influenza virus
APSPYNSKF

SEQ ID NO: 427037 - protein, 9 aa, Influenza virus
LRSLFSSIK

SEQ ID NO: 427038 - protein, 9 aa, Influenza virus
FMYSDFHFI

SEQ ID NO: 427039 - protein, 9 aa, Influenza virus
FGRINFHWL

SEQ ID NO: 427040 - protein, 9 aa, Influenza virus
ITFESNGGF

SEQ ID NO: 427041 - protein, 9 aa, Influenza virus
GQKSWTKIY

SEQ ID NO: 427042 - protein, 9 aa, Influenza virus
TSFFYRYGF

SEQ ID NO: 427043 - protein, 9 aa, Influenza virus
TLDFHDSNV

SEQ ID NO: 427044 - protein, 9 aa, Influenza virus
FFRNMIWLI

SEQ ID NO: 427045 - protein, 9 aa, Influenza virus
GMILSVVSL

SEQ ID NO: 427046 - protein, 9 aa, Influenza virus
HRLCYPGEL

SEQ ID NO: 427047 - protein, 9 aa, Influenza virus
YMNVKSLKL

SEQ ID NO: 427048 - protein, 9 aa, Influenza virus
QVDCFIWHI

SEQ ID NO: 427049 - protein, 9 aa, Influenza virus
KMNTKILVL

SEQ ID NO: 427050 - protein, 9 aa, Influenza virus
VPFSKDNSI

SEQ ID NO: 427051 - protein, 9 aa, Influenza virus
KRLENLNKK

SEQ ID NO: 427052 - protein, 9 aa, Influenza virus
SVKNGTYEY

SEQ ID NO: 427053 - protein, 9 aa, Influenza virus
SMELPSFGV

SEQ ID NO: 427054 - protein, 9 aa, Influenza virus
RIRRDQKSL

SEQ ID NO: 427055 - protein, 9 aa, Influenza virus
NRFQIQGIK

SEQ ID NO: 427056 - protein, 9 aa, Influenza virus
FMQALQLLL

SEQ ID NO: 427057 - protein, 9 aa, Influenza virus
KTGTYDYPK

SEQ ID NO: 427058 - protein, 9 aa, Influenza virus
MVTQRTMGK

SEQ ID NO: 427059 - protein, 9 aa, Influenza virus
WMKLYWHLM

SEQ ID NO: 427060 - protein, 9 aa, Influenza virus
MRPCFWVEL

SEQ ID NO: 427061 - protein, 9 aa, Influenza virus
YKGRLCNPL

SEQ ID NO: 427062 - protein, 9 aa, Influenza virus
GTYCSLNGV

SEQ ID NO: 427063 - protein, 9 aa, Influenza virus
RLFTIRQEM

SEQ ID NO: 427064 - protein, 9 aa, Influenza virus
CTINSWHIY

SEQ ID NO: 427065 - protein, 9 aa, Influenza virus
LIFSARSAL

SEQ ID NO: 427066 - protein, 9 aa, Influenza virus
HIMIWHSNL

SEQ ID NO: 427067 - protein, 9 aa, Influenza virus
LMSCPLGEA

SEQ ID NO: 427068 - protein, 9 aa, Influenza virus
TVSSSLVLV

SEQ ID NO: 427069 - protein, 9 aa, Influenza virus
IMMAGLSFW

SEQ ID NO: 427070 - protein, 9 aa, Influenza virus
IMMAGLSFW

SEQ ID NO: 427071 - protein, 9 aa, Influenza virus
FKSWKGNIM

SEQ ID NO: 427072 - protein, 9 aa, Influenza virus
MIALILVAL

SEQ ID NO: 427073 - protein, 9 aa, Influenza virus
YQAKFESVA

SEQ ID NO: 427074 - protein, 9 aa, Influenza virus
VTFIFNGAF

SEQ ID NO: 427075 - protein, 9 aa, Influenza virus
WTSGSSISF

SEQ ID NO: 427076 - protein, 9 aa, Influenza virus
HLECRTFFL

SEQ ID NO: 427077 - protein, 9 aa, Influenza virus
KTWARNILR

SEQ ID NO: 427078 - protein, 9 aa, Influenza virus
TINYYNETF

SEQ ID NO: 427079 - protein, 9 aa, Influenza virus
NPNQKTITI

SEQ ID NO: 427080 - protein, 9 aa, Influenza virus
LFVQSYFQL

SEQ ID NO: 427081 - protein, 9 aa, Influenza virus
MSIGVTVIK

SEQ ID NO: 427082 - protein, 9 aa, Influenza virus
SRSGFEVLL

SEQ ID NO: 427083 - protein, 9 aa, Influenza virus
TSYKILSIY

SEQ ID NO: 427084 - protein, 9 aa, Influenza virus
RMFALSQGT

SEQ ID NO: 427085 - protein, 9 aa, Influenza virus
GIHHPSSTK

SEQ ID NO: 427086 - protein, 9 aa, Influenza virus
GPTECRTFF

SEQ ID NO: 427087 - protein, 9 aa, Influenza virus
ETFKVIGGW

SEQ ID NO: 427088 - protein, 9 aa, Influenza virus
SRMQFSSLA

SEQ ID NO: 427089 - protein, 9 aa, Influenza virus
HQNGQGSGY

SEQ ID NO: 427090 - protein, 9 aa, Influenza virus
GTKQVCMAW

SEQ ID NO: 427091 - protein, 9 aa, Influenza virus
CSNNTTNYY

SEQ ID NO: 427092 - protein, 9 aa, Influenza virus
WMKIYWHLM

SEQ ID NO: 427093 - protein, 9 aa, Influenza virus
RRNKYLEEH

SEQ ID NO: 427094 - protein, 9 aa, Influenza virus
KRINMISDK

SEQ ID NO: 427095 - protein, 9 aa, Influenza virus
SIHECRTFF

SEQ ID NO: 427096 - protein, 9 aa, Influenza virus
SQYLCTGVL

SEQ ID NO: 427097 - protein, 9 aa, Influenza virus
RSRSGFEVL

SEQ ID NO: 427098 - protein, 9 aa, Influenza virus
HLMIWHSNL

SEQ ID NO: 427099 - protein, 9 aa, Influenza virus
VTKENTGSY

SEQ ID NO: 427100 - protein, 9 aa, Influenza virus
KWWVWLWLV

SEQ ID NO: 427101 - protein, 9 aa, Influenza virus
ALMSVPLGS

SEQ ID NO: 427102 - protein, 9 aa, Influenza virus
TYINNATII

SEQ ID NO: 427103 - protein, 9 aa, Influenza virus
HLTDSEMNK

SEQ ID NO: 427104 - protein, 9 aa, Influenza virus
YVRKASLRL

SEQ ID NO: 427105 - protein, 9 aa, Influenza virus
KLKTEDNIY

SEQ ID NO: 427106 - protein, 9 aa, Influenza virus
VASSGNLEF

SEQ ID NO: 427107 - protein, 9 aa, Influenza virus
AMTHTSQYI

SEQ ID NO: 427108 - protein, 9 aa, Influenza virus
NRFYRTCKL

SEQ ID NO: 427109 - protein, 9 aa, Influenza virus
LIFMARSAL

SEQ ID NO: 427110 - protein, 9 aa, Influenza virus
TTTPTKSYF

SEQ ID NO: 427111 - protein, 9 aa, Influenza virus
SVKNGTYYY

SEQ ID NO: 427112 - protein, 9 aa, Influenza virus
AIAMGLVFI

SEQ ID NO: 427113 - protein, 9 aa, Influenza virus
KILCASATA

SEQ ID NO: 427114 - protein, 9 aa, Influenza virus
WTSNSIISM

SEQ ID NO: 427115 - protein, 9 aa, Influenza virus
KQVDTIMEK

SEQ ID NO: 427116 - protein, 9 aa, Influenza virus
NEDGDIIFL

SEQ ID NO: 427117 - protein, 9 aa, Influenza virus
HRLCYPGEL

SEQ ID NO: 427118 - protein, 9 aa, Influenza virus
YRSLIRFPV

SEQ ID NO: 427119 - protein, 9 aa, Influenza virus
VLKPGQTVK

SEQ ID NO: 427120 - protein, 9 aa, Influenza virus
IITDTIRSW

SEQ ID NO: 427121 - protein, 9 aa, Influenza virus
DVFAIREPF

SEQ ID NO: 427122 - protein, 9 aa, Influenza virus
CIASSTVLV

SEQ ID NO: 427123 - protein, 9 aa, Influenza virus
WMMAMKYPI

SEQ ID NO: 427124 - protein, 9 aa, Influenza virus
FQNVNKITY

SEQ ID NO: 427125 - protein, 9 aa, Influenza virus
SHYREEALL

SEQ ID NO: 427126 - protein, 9 aa, Influenza virus
SLGAISFWM

SEQ ID NO: 427127 - protein, 9 aa, Influenza virus
REQKQEFKM

SEQ ID NO: 427128 - protein, 9 aa, Influenza virus
SINWLTKKK

SEQ ID NO: 427129 - protein, 9 aa, Influenza virus
MSIGITVIK

SEQ ID NO: 427130 - protein, 9 aa, Influenza virus
AQAFYKILK

SEQ ID NO: 427131 - protein, 9 aa, Influenza virus
CSNDTINYY

SEQ ID NO: 427132 - protein, 9 aa, Influenza virus
RPVDGTGSC

SEQ ID NO: 427133 - protein, 9 aa, Influenza virus
TYQNNFVPV

SEQ ID NO: 427134 - protein, 9 aa, Influenza virus
GRVSFYWTI

SEQ ID NO: 427135 - protein, 9 aa, Influenza virus
LQIISLCSI

SEQ ID NO: 427136 - protein, 9 aa, Influenza virus
CQMEKIVLL

SEQ ID NO: 427137 - protein, 9 aa, Influenza virus
SLGAVSFWM

SEQ ID NO: 427138 - protein, 9 aa, Influenza virus
WTGLIDGWY

SEQ ID NO: 427139 - protein, 9 aa, Influenza virus
GSIQSDKPF

SEQ ID NO: 427140 - protein, 9 aa, Influenza virus
EMWSYNAEL

SEQ ID NO: 427141 - protein, 9 aa, Influenza virus
FIEGGWPGL

SEQ ID NO: 427142 - protein, 9 aa, Influenza virus
REEAMQNRV

SEQ ID NO: 427143 - protein, 9 aa, Influenza virus
YRSLIKFPI

SEQ ID NO: 427144 - protein, 9 aa, Influenza virus
IYSTISSSL

SEQ ID NO: 427145 - protein, 9 aa, Influenza virus
PSFYRNLLW

SEQ ID NO: 427146 - protein, 9 aa, Influenza virus
RIGSRGHIF

SEQ ID NO: 427147 - protein, 9 aa, Influenza virus
GYKEIILWF

SEQ ID NO: 427148 - protein, 9 aa, Influenza virus
VLKPGETLK

SEQ ID NO: 427149 - protein, 9 aa, Influenza virus
EPFISCSPL

SEQ ID NO: 427150 - protein, 9 aa, Influenza virus
RLTTTIKTW

SEQ ID NO: 427151 - protein, 9 aa, Influenza virus
CTINSWHIY

SEQ ID NO: 427152 - protein, 9 aa, Influenza virus
QAYTKIMYF

SEQ ID NO: 427153 - protein, 9 aa, Influenza virus
LASCMGLIY

SEQ ID NO: 427154 - protein, 9 aa, Influenza virus
VYQARFESV

SEQ ID NO: 427155 - protein, 9 aa, Influenza virus
RGRGSTLGL

SEQ ID NO: 427156 - protein, 9 aa, Influenza virus
ITDIWTYQA

SEQ ID NO: 427157 - protein, 9 aa, Influenza virus
ASNRPWVSF

SEQ ID NO: 427158 - protein, 9 aa, Influenza virus
HHAVANGTI

SEQ ID NO: 427159 - protein, 9 aa, Influenza virus
RIDYYWSFL

SEQ ID NO: 427160 - protein, 9 aa, Influenza virus
ILVLGLSMV

SEQ ID NO: 427161 - protein, 9 aa, Influenza virus
TLTEKGVEV

SEQ ID NO: 427162 - protein, 9 aa, Influenza virus
TRFTYSGIR

SEQ ID NO: 427163 - protein, 9 aa, Influenza virus
FNMERIKEL

SEQ ID NO: 427164 - protein, 9 aa, Influenza virus
KCIRTFFGW

SEQ ID NO: 427165 - protein, 9 aa, Influenza virus
YSGSFTLPV

SEQ ID NO: 427166 - protein, 9 aa, Influenza virus
LVAPSRVSK

SEQ ID NO: 427167 - protein, 9 aa, Influenza virus
FQNVSRIAI

SEQ ID NO: 427168 - protein, 9 aa, Influenza virus
YNAELLVAL

SEQ ID NO: 427169 - protein, 9 aa, Influenza virus
CPFQGFFPF

SEQ ID NO: 427170 - protein, 9 aa, Influenza virus
TLTERGVEV

SEQ ID NO: 427171 - protein, 9 aa, Influenza virus
SIKNGTYDY

SEQ ID NO: 427172 - protein, 9 aa, Influenza virus
RTYNNTTGR

SEQ ID NO: 427173 - protein, 9 aa, Influenza virus
AEQFTWNGV

SEQ ID NO: 427174 - protein, 9 aa, Influenza virus
IEECSCYGV

SEQ ID NO: 427175 - protein, 9 aa, Influenza virus
KLSQMSKEV

SEQ ID NO: 427176 - protein, 9 aa, Influenza virus
THFEKIKIL

SEQ ID NO: 427177 - protein, 9 aa, Influenza virus
YSLVGIDPF

SEQ ID NO: 427178 - protein, 9 aa, Influenza virus
CPFKGFFPF

SEQ ID NO: 427179 - protein, 9 aa, Influenza virus
FSFGASCFI

SEQ ID NO: 427180 - protein, 9 aa, Influenza virus
GLLLQITSL

SEQ ID NO: 427181 - protein, 9 aa, Influenza virus
MLSLIMRTV

SEQ ID NO: 427182 - protein, 9 aa, Influenza virus
WIGECPKYV

SEQ ID NO: 427183 - protein, 9 aa, Influenza virus
VAWSSTSCF

SEQ ID NO: 427184 - protein, 9 aa, Influenza virus
ALRMKWMMA

SEQ ID NO: 427185 - protein, 9 aa, Influenza virus
CKLNGIPPL

SEQ ID NO: 427186 - protein, 9 aa, Influenza virus
WSGMIDGWY

SEQ ID NO: 427187 - protein, 9 aa, Influenza virus
LRHLFSGIR

SEQ ID NO: 427188 - protein, 9 aa, Influenza virus
YINTALLNA

SEQ ID NO: 427189 - protein, 9 aa, Influenza virus
IAGFIEGGW

SEQ ID NO: 427190 - protein, 9 aa, Influenza virus
NPNQKLFTL

SEQ ID NO: 427191 - protein, 9 aa, Influenza virus
FPIGVAPVL

SEQ ID NO: 427192 - protein, 9 aa, Influenza virus
SGYKDIILW

SEQ ID NO: 427193 - protein, 9 aa, Influenza virus
SLLLATGMK

SEQ ID NO: 427194 - protein, 9 aa, Influenza virus
DQIQDIWAY

SEQ ID NO: 427195 - protein, 9 aa, Influenza virus
GMALSVVSL

SEQ ID NO: 427196 - protein, 9 aa, Influenza virus
IPSIQSRGL

SEQ ID NO: 427197 - protein, 9 aa, Influenza virus
QILAIYSTV

SEQ ID NO: 427198 - protein, 9 aa, Influenza virus
NPSQKLFAL

SEQ ID NO: 427199 - protein, 9 aa, Influenza virus
VVNFVSMEF

SEQ ID NO: 427200 - protein, 9 aa, Influenza virus
GPRNVPAIA

SEQ ID NO: 427201 - protein, 9 aa, Influenza virus
KPFHNISRI

SEQ ID NO: 427202 - protein, 9 aa, Influenza virus
NVIVTREPY

SEQ ID NO: 427203 - protein, 9 aa, Influenza virus
FPFHKDNAL

SEQ ID NO: 427204 - protein, 9 aa, Influenza virus
GRMDYYWAI

SEQ ID NO: 427205 - protein, 9 aa, Influenza virus
YVKSDRLVL

SEQ ID NO: 427206 - protein, 9 aa, Influenza virus
VAWSSSSCF

SEQ ID NO: 427207 - protein, 9 aa, Influenza virus
FVQSYFQLF

SEQ ID NO: 427208 - protein, 9 aa, Influenza virus
QALQLLFEV

SEQ ID NO: 427209 - protein, 9 aa, Influenza virus
GLVDGWYGF

SEQ ID NO: 427210 - protein, 9 aa, Influenza virus
CIASSIVMV

SEQ ID NO: 427211 - protein, 9 aa, Influenza virus
KRINMINDK

SEQ ID NO: 427212 - protein, 9 aa, Influenza virus
HQLLRHFQK

SEQ ID NO: 427213 - protein, 9 aa, Influenza virus
ITGFASFSK

SEQ ID NO: 427214 - protein, 9 aa, Influenza virus
WISFSMSCF

SEQ ID NO: 427215 - protein, 9 aa, Influenza virus
IIDKMNGNY

SEQ ID NO: 427216 - protein, 9 aa, Influenza virus
WIPKRNRSI

SEQ ID NO: 427217 - protein, 9 aa, Influenza virus
VVNFVSMEF

SEQ ID NO: 427218 - protein, 9 aa, Influenza virus
ILKPGQTVK

SEQ ID NO: 427219 - protein, 9 aa, Influenza virus
ELWSYNAEL

SEQ ID NO: 427220 - protein, 9 aa, Influenza virus
SLEPGTFDL

SEQ ID NO: 427221 - protein, 9 aa, Influenza virus
TYGACPKYI

SEQ ID NO: 427222 - protein, 9 aa, Influenza virus
LIEKTSWSY

SEQ ID NO: 427223 - protein, 9 aa, Influenza virus
RIRLFDYSK

SEQ ID NO: 427224 - protein, 9 aa, Influenza virus
IMIDGSASG

SEQ ID NO: 427225 - protein, 9 aa, Influenza virus
MQIRGFVHF

SEQ ID NO: 427226 - protein, 9 aa, Influenza virus
GTLNRLIDK

SEQ ID NO: 427227 - protein, 9 aa, Influenza virus
KSDRICIGY

SEQ ID NO: 427228 - protein, 9 aa, Influenza virus
TTYKILSIY

SEQ ID NO: 427229 - protein, 9 aa, Influenza virus
ASNRPWVSF

SEQ ID NO: 427230 - protein, 9 aa, Influenza virus
ILEENTTYK

SEQ ID NO: 427231 - protein, 9 aa, Influenza virus
EMGQAPSPY

SEQ ID NO: 427232 - protein, 9 aa, Influenza virus
YIVERTKEM

SEQ ID NO: 427233 - protein, 9 aa, Influenza virus
ASNRPWISF

SEQ ID NO: 427234 - protein, 9 aa, Influenza virus
YYLEKASKI

SEQ ID NO: 427235 - protein, 9 aa, Influenza virus
ASYKRVRLF

SEQ ID NO: 427236 - protein, 9 aa, Influenza virus
ARLYIWGVH

SEQ ID NO: 427237 - protein, 9 aa, Influenza virus
IVSLGAISF

SEQ ID NO: 427238 - protein, 9 aa, Influenza virus
LIDGWYGYK

SEQ ID NO: 427239 - protein, 9 aa, Influenza virus
YQMGYICSG

SEQ ID NO: 427240 - protein, 9 aa, Influenza virus
WSGYSGSFM

SEQ ID NO: 427241 - protein, 9 aa, Influenza virus
KFEEIRWMI

SEQ ID NO: 427242 - protein, 9 aa, Influenza virus
IQAGVNRFY

SEQ ID NO: 427243 - protein, 9 aa, Influenza virus
QERGLFGAI

SEQ ID NO: 427244 - protein, 9 aa, Influenza virus
LVSLGAISF

SEQ ID NO: 427245 - protein, 9 aa, Influenza virus
HLKDQAWSY

SEQ ID NO: 427246 - protein, 9 aa, Influenza virus
VMTHTSQYI

SEQ ID NO: 427247 - protein, 9 aa, Influenza virus
SLKLAVGLK

SEQ ID NO: 427248 - protein, 9 aa, Influenza virus
AILATTVTL

SEQ ID NO: 427249 - protein, 9 aa, Influenza virus
GTKQVCAAW

SEQ ID NO: 427250 - protein, 9 aa, Influenza virus
SLIQFPMGT

SEQ ID NO: 427251 - protein, 9 aa, Influenza virus
SLSYSTGAL

SEQ ID NO: 427252 - protein, 9 aa, Influenza virus
LYEKVRMQL

SEQ ID NO: 427253 - protein, 9 aa, Influenza virus
RPRVRNQSG

SEQ ID NO: 427254 - protein, 9 aa, Influenza virus
IYSTVVSSL

SEQ ID NO: 427255 - protein, 9 aa, Influenza virus
FSFGASCFL

SEQ ID NO: 427256 - protein, 9 aa, Influenza virus
EECSCYPNL

SEQ ID NO: 427257 - protein, 9 aa, Influenza virus
RREVHTYYL

SEQ ID NO: 427258 - protein, 9 aa, Influenza virus
VPQMESRGL

SEQ ID NO: 427259 - protein, 9 aa, Influenza virus
KMNTKILVL

SEQ ID NO: 427260 - protein, 9 aa, Influenza virus
FVYFVEALA

SEQ ID NO: 427261 - protein, 9 aa, Influenza virus
STYKILSIY

SEQ ID NO: 427262 - protein, 9 aa, Influenza virus
SWMKIYWYL

SEQ ID NO: 427263 - protein, 9 aa, Influenza virus
YQNSFVPVV

SEQ ID NO: 427264 - protein, 9 aa, Influenza virus
GRMDYYWTL

SEQ ID NO: 427265 - protein, 9 aa, Influenza virus
LQSSDDFAL

SEQ ID NO: 427266 - protein, 9 aa, Influenza virus
GLVDGWYGF

SEQ ID NO: 427267 - protein, 9 aa, Influenza virus
ILKRGETLK

SEQ ID NO: 427268 - protein, 9 aa, Influenza virus
MQNKLNNVI

SEQ ID NO: 427269 - protein, 9 aa, Influenza virus
RRFVQNALS

SEQ ID NO: 427270 - protein, 9 aa, Influenza virus
KLTQGRQTY

SEQ ID NO: 427271 - protein, 9 aa, Influenza virus
DLLENLQAY

SEQ ID NO: 427272 - protein, 9 aa, Influenza virus
ISTASRYGY

SEQ ID NO: 427273 - protein, 9 aa, Influenza virus
STVSSFERF

SEQ ID NO: 427274 - protein, 9 aa, Influenza virus
FFRNVVWLI

SEQ ID NO: 427275 - protein, 9 aa, Influenza virus
RRLTTTIKT

SEQ ID NO: 427276 - protein, 9 aa, Influenza virus
MITQRTIGK

SEQ ID NO: 427277 - protein, 9 aa, Influenza virus
KQTRGLFGA

SEQ ID NO: 427278 - protein, 9 aa, Influenza virus
THFEKVKIL

SEQ ID NO: 427279 - protein, 9 aa, Influenza virus
GLIAPRYGY

SEQ ID NO: 427280 - protein, 9 aa, Influenza virus
VLLKHRFEI

SEQ ID NO: 427281 - protein, 9 aa, Influenza virus
NRFQIQGVR

SEQ ID NO: 427282 - protein, 9 aa, Influenza virus
SIVPSGPLK

SEQ ID NO: 427283 - protein, 9 aa, Influenza virus
LHDANVRNL

SEQ ID NO: 427284 - protein, 9 aa, Influenza virus
CIINSWHIY

SEQ ID NO: 427285 - protein, 9 aa, Influenza virus
RMCNILKGK

SEQ ID NO: 427286 - protein, 9 aa, Influenza virus
KLYIWGIHH

SEQ ID NO: 427287 - protein, 9 aa, Influenza virus
LILAFILWA

SEQ ID NO: 427288 - protein, 9 aa, Influenza virus
SQVERRINM

SEQ ID NO: 427289 - protein, 9 aa, Influenza virus
EMWSYNAEL

SEQ ID NO: 427290 - protein, 9 aa, Influenza virus
YQFALGQGA

SEQ ID NO: 427291 - protein, 9 aa, Influenza virus
SFSMSCFVF

SEQ ID NO: 427292 - protein, 9 aa, Influenza virus
RNMRWLTLK

SEQ ID NO: 427293 - protein, 9 aa, Influenza virus
ILSIYSTAA

SEQ ID NO: 427294 - protein, 9 aa, Influenza virus
NGNMRCTIL

SEQ ID NO: 427295 - protein, 9 aa, Influenza virus
GTFEFTSFF

SEQ ID NO: 427296 - protein, 9 aa, Influenza virus
GTAPILGNY

SEQ ID NO: 427297 - protein, 9 aa, Influenza virus
DLLDNLQAY

SEQ ID NO: 427298 - protein, 9 aa, Influenza virus
MEKFIVLSI

SEQ ID NO: 427299 - protein, 9 aa, Influenza virus
QPEWFRNIL

SEQ ID NO: 427300 - protein, 9 aa, Influenza virus
AIDGITNKV

SEQ ID NO: 427301 - protein, 9 aa, Influenza virus
YYLEKANKI

SEQ ID NO: 427302 - protein, 9 aa, Influenza virus
GRMTFYWAI

SEQ ID NO: 427303 - protein, 9 aa, Influenza virus
KLSQMSREV

SEQ ID NO: 427304 - protein, 9 aa, Influenza virus
YSLVGVDPF

SEQ ID NO: 427305 - protein, 9 aa, Influenza virus
ILCASATAI

SEQ ID NO: 427306 - protein, 9 aa, Influenza virus
RILFVKEGK

SEQ ID NO: 427307 - protein, 9 aa, Influenza virus
ILVTREPYL

SEQ ID NO: 427308 - protein, 9 aa, Influenza virus
TYGACPRYI

SEQ ID NO: 427309 - protein, 9 aa, Influenza virus
RLFTIRQEL

SEQ ID NO: 427310 - protein, 9 aa, Influenza virus
SVKKGTYDY

SEQ ID NO: 427311 - protein, 9 aa, Influenza virus
IIFNMERIK

SEQ ID NO: 427312 - protein, 9 aa, Influenza virus
RGYPGVKGW

SEQ ID NO: 427313 - protein, 9 aa, Influenza virus
KTHNGKLCK

SEQ ID NO: 427314 - protein, 9 aa, Influenza virus
LMNELGVPL

SEQ ID NO: 427315 - protein, 9 aa, Influenza virus
RIAIGNCPK

SEQ ID NO: 427316 - protein, 9 aa, Influenza virus
KSRSIIFNM

SEQ ID NO: 427317 - protein, 9 aa, Influenza virus
TIWTSSSSV

SEQ ID NO: 427318 - protein, 9 aa, Influenza virus
YRALISWEM

SEQ ID NO: 427319 - protein, 9 aa, Influenza virus
SLLTEVETY

SEQ ID NO: 427320 - protein, 9 aa, Influenza virus
VLDTDWSGY

SEQ ID NO: 427321 - protein, 9 aa, Influenza virus
STAASSLAL

SEQ ID NO: 427322 - protein, 9 aa, Influenza virus
ATTHSWIPK

SEQ ID NO: 427323 - protein, 9 aa, Influenza virus
HLECRTFFL

SEQ ID NO: 427324 - protein, 9 aa, Influenza virus
VLVTREPYL

SEQ ID NO: 427325 - protein, 9 aa, Influenza virus
FTLSGVAIA

SEQ ID NO: 427326 - protein, 9 aa, Influenza virus
HHAVTNGTI

SEQ ID NO: 427327 - protein, 9 aa, Influenza virus
STIALLIGI

SEQ ID NO: 427328 - protein, 9 aa, Influenza virus
SSDDFALIL

SEQ ID NO: 427329 - protein, 9 aa, Influenza virus
YISVGTSTL

SEQ ID NO: 427330 - protein, 9 aa, Influenza virus
SVKNGTYDY

SEQ ID NO: 427331 - protein, 9 aa, Influenza virus
WASGSSISF

SEQ ID NO: 427332 - protein, 9 aa, Influenza virus
AVNNRFQIK

SEQ ID NO: 427333 - protein, 9 aa, Influenza virus
SISECRTFF

SEQ ID NO: 427334 - protein, 9 aa, Influenza virus
STVASSLAL

SEQ ID NO: 427335 - protein, 9 aa, Influenza virus
VLSIIALLI

SEQ ID NO: 427336 - protein, 9 aa, Influenza virus
RPGVKGFGF

SEQ ID NO: 427337 - protein, 9 aa, Influenza virus
KLSQMPKEV

SEQ ID NO: 427338 - protein, 9 aa, Influenza virus
KMEAILVVL

SEQ ID NO: 427339 - protein, 9 aa, Influenza virus
GANRPWVSF

SEQ ID NO: 427340 - protein, 9 aa, Influenza virus
YLLFQDILM

SEQ ID NO: 427341 - protein, 9 aa, Influenza virus
AYGVKGFSF

SEQ ID NO: 427342 - protein, 9 aa, Influenza virus
VSHCRATEY

SEQ ID NO: 427343 - protein, 9 aa, Influenza virus
WTSGSIISF

SEQ ID NO: 427344 - protein, 9 aa, Influenza virus
LIALCGSPV

SEQ ID NO: 427345 - protein, 9 aa, Influenza virus
TFQNVSPIW

SEQ ID NO: 427346 - protein, 9 aa, Influenza virus
YYNETFVNV

SEQ ID NO: 427347 - protein, 9 aa, Influenza virus
SQHKSHRQM

SEQ ID NO: 427348 - protein, 9 aa, Influenza virus
FRTLMSCPM

SEQ ID NO: 427349 - protein, 9 aa, Influenza virus
IPSVQSRGL

SEQ ID NO: 427350 - protein, 9 aa, Influenza virus
SPLMVAYML

SEQ ID NO: 427351 - protein, 9 aa, Influenza virus
HLKDQDWSY

SEQ ID NO: 427352 - protein, 9 aa, Influenza virus
RRIDFNWLL

SEQ ID NO: 427353 - protein, 9 aa, Influenza virus
FHRAKEVAL

SEQ ID NO: 427354 - protein, 9 aa, Influenza virus
RRLTTTIRT

SEQ ID NO: 427355 - protein, 9 aa, Influenza virus
ESEFNEIEY

SEQ ID NO: 427356 - protein, 9 aa, Influenza virus
VWMGRTISM

SEQ ID NO: 427357 - protein, 9 aa, Influenza virus
SQYLCTGVL

SEQ ID NO: 427358 - protein, 9 aa, Influenza virus
GALNTTLPF

SEQ ID NO: 427359 - protein, 9 aa, Influenza virus
VSNDNWSGY

SEQ ID NO: 427360 - protein, 9 aa, Influenza virus
YSSSMMWEI

SEQ ID NO: 427361 - protein, 9 aa, Influenza virus
YLNGREWSY

SEQ ID NO: 427362 - protein, 9 aa, Influenza virus
FYAEMEWLL

SEQ ID NO: 427363 - protein, 9 aa, Influenza virus
YSGFVRTLF

SEQ ID NO: 427364 - protein, 9 aa, Influenza virus
RANQRLNTM

SEQ ID NO: 427365 - protein, 9 aa, Influenza virus
MLATGMRNI

SEQ ID NO: 427366 - protein, 9 aa, Influenza virus
LIAPEYGFK

SEQ ID NO: 427367 - protein, 9 aa, Influenza virus
YQSTNSTEI

SEQ ID NO: 427368 - protein, 9 aa, Influenza virus
WSGLVAGWY

SEQ ID NO: 427369 - protein, 9 aa, Influenza virus
RLRSGFEML

SEQ ID NO: 427370 - protein, 9 aa, Influenza virus
LIAPEFGYL

SEQ ID NO: 427371 - protein, 9 aa, Influenza virus
STTHDRTAF

SEQ ID NO: 427372 - protein, 9 aa, Influenza virus
GLANLGLNI

SEQ ID NO: 427373 - protein, 9 aa, Influenza virus
NVYRALSIY

SEQ ID NO: 427374 - protein, 9 aa, Influenza virus
ILRGAVAHK

SEQ ID NO: 427375 - protein, 9 aa, Influenza virus
WPDGADLPF

SEQ ID NO: 427376 - protein, 9 aa, Influenza virus
VASSLVLLF

SEQ ID NO: 427377 - protein, 9 aa, Influenza virus
YQMGYICSG

SEQ ID NO: 427378 - protein, 9 aa, Influenza virus
WEMGLAPSP

SEQ ID NO: 427379 - protein, 9 aa, Influenza virus
LLGAIAGFI

SEQ ID NO: 427380 - protein, 9 aa, Influenza virus
RTLLAKSVF

SEQ ID NO: 427381 - protein, 9 aa, Influenza virus
CSNNTTNYY

SEQ ID NO: 427382 - protein, 9 aa, Influenza virus
GAKEIALSY

SEQ ID NO: 427383 - protein, 9 aa, Influenza virus
TSWSYIVEK

SEQ ID NO: 427384 - protein, 9 aa, Influenza virus
SQYRALVSW

SEQ ID NO: 427385 - protein, 9 aa, Influenza virus
LSVPEWSYI

SEQ ID NO: 427386 - protein, 9 aa, Influenza virus
NYLIRALTL

SEQ ID NO: 427387 - protein, 9 aa, Influenza virus
GQAFYKILK

SEQ ID NO: 427388 - protein, 9 aa, Influenza virus
WTSGSSISF

SEQ ID NO: 427389 - protein, 9 aa, Influenza virus
SVYKALSIY

SEQ ID NO: 427390 - protein, 9 aa, Influenza virus
SGYKDVILW

SEQ ID NO: 427391 - protein, 9 aa, Influenza virus
KRINVINDK

SEQ ID NO: 427392 - protein, 9 aa, Influenza virus
SRTRGILTK

SEQ ID NO: 427393 - protein, 9 aa, Influenza virus
ATSPIVPSF

SEQ ID NO: 427394 - protein, 9 aa, Influenza virus
FPIGTAPIL

SEQ ID NO: 427395 - protein, 9 aa, Influenza virus
LVGPILSFI

SEQ ID NO: 427396 - protein, 9 aa, Influenza virus
YAFGNCSKY

SEQ ID NO: 427397 - protein, 9 aa, Influenza virus
KRQEINGIK

SEQ ID NO: 427398 - protein, 9 aa, Influenza virus
KPFQNVSRI

SEQ ID NO: 427399 - protein, 9 aa, Influenza virus
RMYQKCCNL

SEQ ID NO: 427400 - protein, 9 aa, Influenza virus
KVNSVIEKM

SEQ ID NO: 427401 - protein, 9 aa, Influenza virus
GYLIRALTL

SEQ ID NO: 427402 - protein, 9 aa, Influenza virus
VLVTREPYI

SEQ ID NO: 427403 - protein, 9 aa, Influenza virus
ASNRPWISF

SEQ ID NO: 427404 - protein, 9 aa, Influenza virus
KMNTRILIL

SEQ ID NO: 427405 - protein, 9 aa, Influenza virus
RLEDVFAGK

SEQ ID NO: 427406 - protein, 9 aa, Influenza virus
CHSGVCPVV

SEQ ID NO: 427407 - protein, 9 aa, Influenza virus
YSSSLMWEI

SEQ ID NO: 427408 - protein, 9 aa, Influenza virus
VSRMGVDEY

SEQ ID NO: 427409 - protein, 9 aa, Influenza virus
WPDDAELPL

SEQ ID NO: 427410 - protein, 9 aa, Influenza virus
WTSNSIIVF

SEQ ID NO: 427411 - protein, 9 aa, Influenza virus
WLGRTLNTA

SEQ ID NO: 427412 - protein, 9 aa, Influenza virus
VMELIRMIK

SEQ ID NO: 427413 - protein, 9 aa, Influenza virus
RTSHRTLLM

SEQ ID NO: 427414 - protein, 9 aa, Influenza virus
ALGQGTTLK

SEQ ID NO: 427415 - protein, 9 aa, Influenza virus
VLLGSSPNA

SEQ ID NO: 427416 - protein, 9 aa, Influenza virus
VSFRGRGVF

SEQ ID NO: 427417 - protein, 9 aa, Influenza virus
TYQNSFVPV

SEQ ID NO: 427418 - protein, 9 aa, Influenza virus
FSFRYGNGV

SEQ ID NO: 427419 - protein, 9 aa, Influenza virus
FEATGNLLV

SEQ ID NO: 427420 - protein, 9 aa, Influenza virus
EVEQEIRAF

SEQ ID NO: 427421 - protein, 9 aa, Influenza virus
GQSGRIDFY

SEQ ID NO: 427422 - protein, 9 aa, Influenza virus
RREVHIYYL

SEQ ID NO: 427423 - protein, 9 aa, Influenza virus
LYDKVRMQL

SEQ ID NO: 427424 - protein, 9 aa, Influenza virus
WPLSSPPTV

SEQ ID NO: 427425 - protein, 9 aa, Influenza virus
FPIGTAPVL

SEQ ID NO: 427426 - protein, 9 aa, Influenza virus
ALGECPKYI

SEQ ID NO: 427427 - protein, 9 aa, Influenza virus
AQDRGLFGA

SEQ ID NO: 427428 - protein, 9 aa, Influenza virus
GRMDYYWAV

SEQ ID NO: 427429 - protein, 9 aa, Influenza virus
KMNPNQKIM

SEQ ID NO: 427430 - protein, 9 aa, Influenza virus
NPNQKLFTL

SEQ ID NO: 427431 - protein, 9 aa, Influenza virus
TTYQRTRAL

SEQ ID NO: 427432 - protein, 9 aa, Influenza virus
ESCEGECFY

SEQ ID NO: 427433 - protein, 9 aa, Influenza virus
FSISCFLLI

SEQ ID NO: 427434 - protein, 9 aa, Influenza virus
ATYQRTRAL

SEQ ID NO: 427435 - protein, 9 aa, Influenza virus
FRALISWGM

SEQ ID NO: 427436 - protein, 9 aa, Influenza virus
MVKAVRGDL

SEQ ID NO: 427437 - protein, 9 aa, Influenza virus
FLWMCSNGS

SEQ ID NO: 427438 - protein, 9 aa, Influenza virus
LSNMGVYQI

SEQ ID NO: 427439 - protein, 9 aa, Influenza virus
MPFHNVHPF

SEQ ID NO: 427440 - protein, 9 aa, Influenza virus
RSWRRQILR

SEQ ID NO: 427441 - protein, 9 aa, Influenza virus
LSNMGIYQI

SEQ ID NO: 427442 - protein, 9 aa, Influenza virus
WTSNSIIVF

SEQ ID NO: 427443 - protein, 9 aa, Influenza virus
FQNASRYYM

SEQ ID NO: 427444 - protein, 9 aa, Influenza virus
KGLCIINSW

SEQ ID NO: 427445 - protein, 9 aa, Influenza virus
KLEQSGLPV

SEQ ID NO: 427446 - protein, 9 aa, Influenza virus
ATTITLHFK

SEQ ID NO: 427447 - protein, 9 aa, Influenza virus
LIDGWYGFK

SEQ ID NO: 427448 - protein, 9 aa, Influenza virus
IMFSNKMAR

SEQ ID NO: 427449 - protein, 9 aa, Influenza virus
FFRNIVWLI

SEQ ID NO: 427450 - protein, 9 aa, Influenza virus
SLVGVDPFK

SEQ ID NO: 427451 - protein, 9 aa, Influenza virus
YKMNNQILI

SEQ ID NO: 427452 - protein, 9 aa, Influenza virus
KLEDVFAGK

SEQ ID NO: 427453 - protein, 9 aa, Influenza virus
KQSSLPLAL

SEQ ID NO: 427454 - protein, 9 aa, Influenza virus
GTAPVLGNY

SEQ ID NO: 427455 - protein, 9 aa, Influenza virus
RRFVQNALN

SEQ ID NO: 427456 - protein, 9 aa, Influenza virus
KLYKNTNTL

SEQ ID NO: 427457 - protein, 9 aa, Influenza virus
NRLNINPVR

SEQ ID NO: 427458 - protein, 9 aa, Influenza virus
QAYTKVLYF

SEQ ID NO: 427459 - protein, 9 aa, Influenza virus
WTSGSSIAF

SEQ ID NO: 427460 - protein, 9 aa, Influenza virus
TQDAMTEVW

SEQ ID NO: 427461 - protein, 9 aa, Influenza virus
KLATGPRNV

SEQ ID NO: 427462 - protein, 9 aa, Influenza virus
HMECRTFFL

SEQ ID NO: 427463 - protein, 9 aa, Influenza virus
LPFHNIHPL

SEQ ID NO: 427464 - protein, 9 aa, Influenza virus
VMELVRMIK

SEQ ID NO: 427465 - protein, 9 aa, Influenza virus
SRYVCTGIL

SEQ ID NO: 427466 - protein, 9 aa, Influenza virus
VTDIWSYNA

SEQ ID NO: 427467 - protein, 9 aa, Influenza virus
RGKLKRRAI

SEQ ID NO: 427468 - protein, 9 aa, Influenza virus
YVKKASLRL

SEQ ID NO: 427469 - protein, 9 aa, Influenza virus
QIIVTREPY

SEQ ID NO: 427470 - protein, 9 aa, Influenza virus
ITNKVNSII

SEQ ID NO: 427471 - protein, 9 aa, Influenza virus
SYLIRTLTL

SEQ ID NO: 427472 - protein, 9 aa, Influenza virus
HAQYREEAL

SEQ ID NO: 427473 - protein, 9 aa, Influenza virus
KPFQNISRV

SEQ ID NO: 427474 - protein, 9 aa, Influenza virus
RQIGNVINW

SEQ ID NO: 427475 - protein, 9 aa, Influenza virus
RTRGLFGAI

SEQ ID NO: 427476 - protein, 9 aa, Influenza virus
VENQHTIDL

SEQ ID NO: 427477 - protein, 9 aa, Influenza virus
RILFIKEGK

SEQ ID NO: 427478 - protein, 9 aa, Influenza virus
KRMTRGLFG

SEQ ID NO: 427479 - protein, 9 aa, Influenza virus
KRINMIADR

SEQ ID NO: 427480 - protein, 9 aa, Influenza virus
RTSYRSLIR

SEQ ID NO: 427481 - protein, 9 aa, Influenza virus
SRYWAIRTR

SEQ ID NO: 427482 - protein, 9 aa, Influenza virus
GRIDFHWLM

SEQ ID NO: 427483 - protein, 9 aa, Influenza virus
KMRDSIKSW

SEQ ID NO: 427484 - protein, 9 aa, Influenza virus
VLVNTYQWI

SEQ ID NO: 427485 - protein, 9 aa, Influenza virus
NLIAPRGYY

SEQ ID NO: 427486 - protein, 9 aa, Influenza virus
NERGLFGAI

SEQ ID NO: 427487 - protein, 9 aa, Influenza virus
SLSGSAQHI

SEQ ID NO: 427488 - protein, 9 aa, Influenza virus
MFNMLSTVL

SEQ ID NO: 427489 - protein, 9 aa, Influenza virus
RVKMFDFIK

SEQ ID NO: 427490 - protein, 9 aa, Influenza virus
GTIISNLPF

SEQ ID NO: 427491 - protein, 9 aa, Influenza virus
LMSCPIGEA

SEQ ID NO: 427492 - protein, 9 aa, Influenza virus
RTPYRSLIK

SEQ ID NO: 427493 - protein, 9 aa, Influenza virus
KSLESRSGF

SEQ ID NO: 427494 - protein, 9 aa, Influenza virus
GRIDFHWLL

SEQ ID NO: 427495 - protein, 9 aa, Influenza virus
TTINNITNV

SEQ ID NO: 427496 - protein, 9 aa, Influenza virus
YKMNTQILI

SEQ ID NO: 427497 - protein, 9 aa, Influenza virus
IQTRRAFEL

SEQ ID NO: 427498 - protein, 9 aa, Influenza virus
YAKKASLRL

SEQ ID NO: 427499 - protein, 9 aa, Influenza virus
GTRQVCVAW

SEQ ID NO: 427500 - protein, 9 aa, Influenza virus
WTANSIIVF

SEQ ID NO: 427501 - protein, 9 aa, Influenza virus
RRIDFHWLL

SEQ ID NO: 427502 - protein, 9 aa, Influenza virus
HSGVCPVVF

SEQ ID NO: 427503 - protein, 9 aa, Influenza virus
ITFSFNGAF

SEQ ID NO: 427504 - protein, 9 aa, Influenza virus
SSCHDGKSW

SEQ ID NO: 427505 - protein, 9 aa, Influenza virus
FSVQRNLPF

SEQ ID NO: 427506 - protein, 9 aa, Influenza virus
VLLENQKPL

SEQ ID NO: 427507 - protein, 9 aa, Influenza virus
QVMVDNNNW

SEQ ID NO: 427508 - protein, 9 aa, Influenza virus
KTGGPIYKK

SEQ ID NO: 427509 - protein, 9 aa, Influenza virus
SSSMNNQVF

SEQ ID NO: 427510 - protein, 9 aa, Influenza virus
KAINGVTNK

SEQ ID NO: 427511 - protein, 9 aa, Influenza virus
GTFEFTSFF

SEQ ID NO: 427512 - protein, 9 aa, Influenza virus
VYSTVASSL

SEQ ID NO: 427513 - protein, 9 aa, Influenza virus
YKMNTRILI

SEQ ID NO: 427514 - protein, 9 aa, Influenza virus
FIAPEYAYK

SEQ ID NO: 427515 - protein, 9 aa, Influenza virus
KLYGSGNKL

SEQ ID NO: 427516 - protein, 9 aa, Influenza virus
GSKEQLGSW

SEQ ID NO: 427517 - protein, 9 aa, Influenza virus
YERRLTTTI

SEQ ID NO: 427518 - protein, 9 aa, Influenza virus
GSFIDYWAK

SEQ ID NO: 427519 - protein, 9 aa, Influenza virus
KLYWHLMSP

SEQ ID NO: 427520 - protein, 9 aa, Influenza virus
LHDANVKNL

SEQ ID NO: 427521 - protein, 9 aa, Influenza virus
GLLLQIISL

SEQ ID NO: 427522 - protein, 9 aa, Influenza virus
MMTHTSQYI

SEQ ID NO: 427523 - protein, 9 aa, Influenza virus
VVFCGTSGI

SEQ ID NO: 427524 - protein, 9 aa, Influenza virus
QAYTKILYF

SEQ ID NO: 427525 - protein, 9 aa, Influenza virus
HMECRTFFL

SEQ ID NO: 427526 - protein, 9 aa, Influenza virus
ASYKRIRLF

SEQ ID NO: 427527 - protein, 9 aa, Influenza virus
KRLGSWSWH

SEQ ID NO: 427528 - protein, 9 aa, Influenza virus
TLDKHDSNV

SEQ ID NO: 427529 - protein, 9 aa, Influenza virus
RFLFSSIKK

SEQ ID NO: 427530 - protein, 9 aa, Influenza virus
KTKKMTITF

SEQ ID NO: 427531 - protein, 9 aa, Influenza virus
HSNLNDTTY

SEQ ID NO: 427532 - protein, 9 aa, Influenza virus
FPFHKDNAI

SEQ ID NO: 427533 - protein, 9 aa, Influenza virus
FQNTSRHYI

SEQ ID NO: 427534 - protein, 9 aa, Influenza virus
CHNGTCVVV

SEQ ID NO: 427535 - protein, 9 aa, Influenza virus
MASIRNSTY

SEQ ID NO: 427536 - protein, 9 aa, Influenza virus
GLVAGWYGF

SEQ ID NO: 427537 - protein, 9 aa, Influenza virus
RRTNLYGFI

SEQ ID NO: 427538 - protein, 9 aa, Influenza virus
FSARSALIL

SEQ ID NO: 427539 - protein, 9 aa, Influenza virus
SSCFDGREW

SEQ ID NO: 427540 - protein, 9 aa, Influenza virus
RLTTTVKTW

SEQ ID NO: 427541 - protein, 9 aa, Influenza virus
QVIVTREPY

SEQ ID NO: 427542 - protein, 9 aa, Influenza virus
RIFQSRIRM

SEQ ID NO: 427543 - protein, 9 aa, Influenza virus
VVNYVSMEF

SEQ ID NO: 427544 - protein, 9 aa, Influenza virus
RRLTTTVKT

SEQ ID NO: 427545 - protein, 9 aa, Influenza virus
RREVHVYYL

SEQ ID NO: 427546 - protein, 9 aa, Influenza virus
WMACHSAAF

SEQ ID NO: 427547 - protein, 9 aa, Influenza virus
MTDGSASRK

SEQ ID NO: 427548 - protein, 9 aa, Influenza virus
DQITDIWAY

SEQ ID NO: 427549 - protein, 9 aa, Influenza virus
WPDDAELPL

SEQ ID NO: 427550 - protein, 9 aa, Influenza virus
ATTHSWVPK

SEQ ID NO: 427551 - protein, 9 aa, Influenza virus
SGYSGVFSV

SEQ ID NO: 427552 - protein, 9 aa, Influenza virus
SQFRALISW

SEQ ID NO: 427553 - protein, 9 aa, Influenza virus
KQTRGIFGA

SEQ ID NO: 427554 - protein, 9 aa, Influenza virus
LPFHNIHPL

SEQ ID NO: 427555 - protein, 9 aa, Influenza virus
WWVWLWLVL

SEQ ID NO: 427556 - protein, 9 aa, Influenza virus
TFQNVSPLW

SEQ ID NO: 427557 - protein, 9 aa, Influenza virus
LMWALGENM

SEQ ID NO: 427558 - protein, 9 aa, Influenza virus
SGYSGSFTL

SEQ ID NO: 427559 - protein, 9 aa, Influenza virus
AEDMGGGCF

SEQ ID NO: 427560 - protein, 9 aa, Influenza virus
YISIGTSTL

SEQ ID NO: 427561 - protein, 9 aa, Influenza virus
ITGFAPFSK

SEQ ID NO: 427562 - protein, 9 aa, Influenza virus
SLNDYEELK

SEQ ID NO: 427563 - protein, 9 aa, Influenza virus
AEEMGNGCF

SEQ ID NO: 427564 - protein, 9 aa, Influenza virus
AYQARFESV

SEQ ID NO: 427565 - protein, 9 aa, Influenza virus
CTINSWHIY

SEQ ID NO: 427566 - protein, 9 aa, Influenza virus
RNIVRRATV

SEQ ID NO: 427567 - protein, 9 aa, Influenza virus
KPFQNISRI

SEQ ID NO: 427568 - protein, 9 aa, Influenza virus
DQIQDLWAY

SEQ ID NO: 427569 - protein, 9 aa, Influenza virus
NPRVFLTMI

SEQ ID NO: 427570 - protein, 9 aa, Influenza virus
FQTAAQRAM

SEQ ID NO: 427571 - protein, 9 aa, Influenza virus
YQKQMTRGL

SEQ ID NO: 427572 - protein, 9 aa, Influenza virus
ILSPLTKGI

SEQ ID NO: 427573 - protein, 9 aa, Influenza virus
RMADSIKSW

SEQ ID NO: 427574 - protein, 9 aa, Influenza virus
IAKDNAVRF

SEQ ID NO: 427575 - protein, 9 aa, Influenza virus
NMQNRLNNV

SEQ ID NO: 427576 - protein, 9 aa, Influenza virus
ILAIYSTVA

SEQ ID NO: 427577 - protein, 9 aa, Influenza virus
IICVCRDNW

SEQ ID NO: 427578 - protein, 9 aa, Influenza virus
MLRIPNAGI

SEQ ID NO: 427579 - protein, 9 aa, Influenza virus
KRINMLADR

SEQ ID NO: 427580 - protein, 9 aa, Influenza virus
VVCVCRDNW

SEQ ID NO: 427581 - protein, 9 aa, Influenza virus
SQYRALISW

SEQ ID NO: 427582 - protein, 9 aa, Influenza virus
NPALRMKWM

SEQ ID NO: 427583 - protein, 9 aa, Influenza virus
VTDVWSYNA

SEQ ID NO: 427584 - protein, 9 aa, Influenza virus
SVKTGTYDY

SEQ ID NO: 427585 - protein, 9 aa, Influenza virus
FQNASRHYM

SEQ ID NO: 427586 - protein, 9 aa, Influenza virus
VSFSISCFL

SEQ ID NO: 427587 - protein, 9 aa, Influenza virus
NLIAPWYAY

SEQ ID NO: 427588 - protein, 9 aa, Influenza virus
SRSGFEILL

SEQ ID NO: 427589 - protein, 9 aa, Influenza virus
QILSIYSTV

SEQ ID NO: 427590 - protein, 9 aa, Influenza virus
RMTICVQGK

SEQ ID NO: 427591 - protein, 9 aa, Influenza virus
RMFLAMITY

SEQ ID NO: 427592 - protein, 9 aa, Influenza virus
MLNASCAAM

SEQ ID NO: 427593 - protein, 9 aa, Influenza virus
LILTFIMWA

SEQ ID NO: 427594 - protein, 9 aa, Influenza virus
LILGFVLWA

SEQ ID NO: 427595 - protein, 9 aa, Influenza virus
ATTHSWTPK

SEQ ID NO: 427596 - protein, 9 aa, Influenza virus
ALYKNANTL

SEQ ID NO: 427597 - protein, 9 aa, Influenza virus
NRIRIDPVK

SEQ ID NO: 427598 - protein, 9 aa, Influenza virus
RRRFIQNAL

SEQ ID NO: 427599 - protein, 9 aa, Influenza virus
KMYALHQGT

SEQ ID NO: 427600 - protein, 9 aa, Influenza virus
RANQRLNTM

SEQ ID NO: 427601 - protein, 9 aa, Influenza virus
TWLGRTISI

SEQ ID NO: 427602 - protein, 9 aa, Influenza virus
NLIAPRGHY

SEQ ID NO: 427603 - protein, 9 aa, Influenza virus
AIDEITTKI

SEQ ID NO: 427604 - protein, 9 aa, Influenza virus
GTKQVCVAW

SEQ ID NO: 427605 - protein, 9 aa, Influenza virus
KMEKIVLLL

SEQ ID NO: 427606 - protein, 9 aa, Influenza virus
RLEGVFAGK

SEQ ID NO: 427607 - protein, 9 aa, Influenza virus
LSIYSTVAA

SEQ ID NO: 427608 - protein, 9 aa, Influenza virus
SLSLAIMMA

SEQ ID NO: 427609 - protein, 9 aa, Influenza virus
ITYGVCPRY

SEQ ID NO: 427610 - protein, 9 aa, Influenza virus
TTINNITNV

SEQ ID NO: 427611 - protein, 9 aa, Influenza virus
GTAPILGNY

SEQ ID NO: 427612 - protein, 9 aa, Influenza virus
ALSVLNLLI

SEQ ID NO: 427613 - protein, 9 aa, Influenza virus
GSIITELPF

SEQ ID NO: 427614 - protein, 9 aa, Influenza virus
RTWAKNILR

SEQ ID NO: 427615 - protein, 9 aa, Influenza virus
ALSILNLLI

SEQ ID NO: 427616 - protein, 9 aa, Influenza virus
YNAGLLVAL

SEQ ID NO: 427617 - protein, 9 aa, Influenza virus
TKLGSPLVL

SEQ ID NO: 427618 - protein, 9 aa, Influenza virus
GSSTYQNSF

SEQ ID NO: 427619 - protein, 9 aa, Influenza virus
ISRDSRSGY

SEQ ID NO: 427620 - protein, 9 aa, Influenza virus
CVILLNPFV

SEQ ID NO: 427621 - protein, 9 aa, Influenza virus
CHNGTCPVV

SEQ ID NO: 427622 - protein, 9 aa, Influenza virus
RVKRRPVAK

SEQ ID NO: 427623 - protein, 9 aa, Influenza virus
LLAFMLWAC

SEQ ID NO: 427624 - protein, 9 aa, Influenza virus
VLELIRMIK

SEQ ID NO: 427625 - protein, 9 aa, Influenza virus
LPACVYGPA

SEQ ID NO: 427626 - protein, 9 aa, Influenza virus
RLIQNSLTI

SEQ ID NO: 427627 - protein, 9 aa, Influenza virus
RVDDAVTDV

SEQ ID NO: 427628 - protein, 9 aa, Influenza virus
FQNVHPITI

SEQ ID NO: 427629 - protein, 9 aa, Influenza virus
KYLPDLYDY

SEQ ID NO: 427630 - protein, 9 aa, Influenza virus
NKYVNNTTI

SEQ ID NO: 427631 - protein, 9 aa, Influenza virus
HSMSDIEAM

SEQ ID NO: 427632 - protein, 9 aa, Influenza virus
VPSIQSRGL

SEQ ID NO: 427633 - protein, 9 aa, Influenza virus
IVKTLTSEK

SEQ ID NO: 427634 - protein, 9 aa, Influenza virus
CIINSWHIY

SEQ ID NO: 427635 - protein, 9 aa, Influenza virus
SLVGIDPFK

SEQ ID NO: 427636 - protein, 9 aa, Influenza virus
YAFGNCPMY

SEQ ID NO: 427637 - protein, 9 aa, Influenza virus
RYLPDLYDY

SEQ ID NO: 427638 - protein, 9 aa, Influenza virus
GSSKYQQSF

SEQ ID NO: 427639 - protein, 9 aa, Influenza virus
MARLGKGYM

SEQ ID NO: 427640 - protein, 9 aa, Influenza virus
FQHQNEQGM

SEQ ID NO: 427641 - protein, 9 aa, Influenza virus
RPWIRFNSN

SEQ ID NO: 427642 - protein, 9 aa, Influenza virus
SRINTINSK

SEQ ID NO: 427643 - protein, 9 aa, Influenza virus
VETNHTDEL

SEQ ID NO: 427644 - protein, 9 aa, Influenza virus
MGLRISSSF

SEQ ID NO: 427645 - protein, 9 aa, Influenza virus
FRHQNAQGI

SEQ ID NO: 427646 - protein, 9 aa, Influenza virus
KMKAIIVVL

SEQ ID NO: 427647 - protein, 9 aa, Influenza virus
LASCMGLIY

SEQ ID NO: 427648 - protein, 9 aa, Influenza virus
LSSKDNQVF

SEQ ID NO: 427649 - protein, 9 aa, Influenza virus
RLNPMHQLL

SEQ ID NO: 427650 - protein, 9 aa, Influenza virus
CFQRSKFLL

SEQ ID NO: 427651 - protein, 9 aa, Influenza virus
KISLGHHAV

SEQ ID NO: 427652 - protein, 9 aa, Influenza virus
TLCLGHHAV

SEQ ID NO: 427653 - protein, 9 aa, Influenza virus
RLIEKTNDK

SEQ ID NO: 427654 - protein, 9 aa, Influenza virus
FLHNGGLIA

SEQ ID NO: 427655 - protein, 9 aa, Influenza virus
FQNTSKHYI

SEQ ID NO: 427656 - protein, 9 aa, Influenza virus
FQNVSRIAI

SEQ ID NO: 427657 - protein, 9 aa, Influenza virus
GMFNMLSTV

SEQ ID NO: 427658 - protein, 9 aa, Influenza virus
VTYQILSIY

SEQ ID NO: 427659 - protein, 9 aa, Influenza virus
SVENGTYDY

SEQ ID NO: 427660 - protein, 9 aa, Influenza virus
FLAPRYALE

SEQ ID NO: 427661 - protein, 9 aa, Influenza virus
YMNVKSLKL

SEQ ID NO: 427662 - protein, 9 aa, Influenza virus
ELRSGYWAI

SEQ ID NO: 427663 - protein, 9 aa, Influenza virus
EIRAFSFQL

SEQ ID NO: 427664 - protein, 9 aa, Influenza virus
FVYFVETLA

SEQ ID NO: 427665 - protein, 9 aa, Influenza virus
FRDMRKNTL

SEQ ID NO: 427666 - protein, 9 aa, Influenza virus
RLRRDQKSL

SEQ ID NO: 427667 - protein, 9 aa, Influenza virus
LLQANLCRF

SEQ ID NO: 427668 - protein, 9 aa, Influenza virus
NSCESKCFW

SEQ ID NO: 427669 - protein, 9 aa, Influenza virus
GLVDGWYGY

SEQ ID NO: 427670 - protein, 9 aa, Influenza virus
IADKICIGY

SEQ ID NO: 427671 - protein, 9 aa, Influenza virus
QMTRGLFGA

SEQ ID NO: 427672 - protein, 9 aa, Influenza virus
CIKTFFGWK

SEQ ID NO: 427673 - protein, 9 aa, Influenza virus
FEATGNLLV

SEQ ID NO: 427674 - protein, 9 aa, Influenza virus
IQSRGLFGA

SEQ ID NO: 427675 - protein, 9 aa, Influenza virus
LRFVFSIAA

SEQ ID NO: 427676 - protein, 9 aa, Influenza virus
TRINMINSK

SEQ ID NO: 427677 - protein, 9 aa, Influenza virus
RPVAEINTW

SEQ ID NO: 427678 - protein, 9 aa, Influenza virus
NMSLNISLY

SEQ ID NO: 427679 - protein, 9 aa, Influenza virus
YIKQNTLKL

SEQ ID NO: 427680 - protein, 9 aa, Influenza virus
GMLGFVFTL

SEQ ID NO: 427681 - protein, 9 aa, Influenza virus
KTNTQFELI

SEQ ID NO: 427682 - protein, 9 aa, Influenza virus
KEQLGSWSW

SEQ ID NO: 427683 - protein, 9 aa, Influenza virus
HIAILVTTV

SEQ ID NO: 427684 - protein, 9 aa, Influenza virus
YRKRMTRGL

SEQ ID NO: 427685 - protein, 9 aa, Influenza virus
SPNAYQAQF

SEQ ID NO: 427686 - protein, 9 aa, Influenza virus
YISSGSLKL

SEQ ID NO: 427687 - protein, 9 aa, Influenza virus
RPLVRGQSG

SEQ ID NO: 427688 - protein, 9 aa, Influenza virus
FLAPRYSFE

SEQ ID NO: 427689 - protein, 9 aa, Influenza virus
FQNTSRHYI

SEQ ID NO: 427690 - protein, 9 aa, Influenza virus
SRNGFEMLK

SEQ ID NO: 427691 - protein, 9 aa, Influenza virus
FRGLISTQL

SEQ ID NO: 427692 - protein, 9 aa, Influenza virus
LRFVFSSAA

SEQ ID NO: 427693 - protein, 9 aa, Influenza virus
AMGLVFICV

SEQ ID NO: 427694 - protein, 9 aa, Influenza virus
GTSSIYIEV

SEQ ID NO: 427695 - protein, 9 aa, Influenza virus
LLAKSVFNS

SEQ ID NO: 427696 - protein, 9 aa, Influenza virus
YQSTNSTEI

SEQ ID NO: 427697 - protein, 9 aa, Influenza virus
APLMVAYML

SEQ ID NO: 427698 - protein, 9 aa, Influenza virus
VTDIWAYNA

SEQ ID NO: 427699 - protein, 9 aa, Influenza virus
GIKGFSFRY

SEQ ID NO: 427700 - protein, 9 aa, Influenza virus
ITIGKCSKY

SEQ ID NO: 427701 - protein, 9 aa, Influenza virus
GRIDFHWML

SEQ ID NO: 427702 - protein, 9 aa, Influenza virus
LSSKDNQVF

SEQ ID NO: 427703 - protein, 9 aa, Influenza virus
AEDMGNGCF

SEQ ID NO: 427704 - protein, 9 aa, Influenza virus
LSSVTTNTI

SEQ ID NO: 427705 - protein, 9 aa, Influenza virus
KPFQNVNRI

SEQ ID NO: 427706 - protein, 9 aa, Influenza virus
GLFGAIAGF

SEQ ID NO: 427707 - protein, 9 aa, Influenza virus
GVIVTREPY

SEQ ID NO: 427708 - protein, 9 aa, Influenza virus
LYDRVRMQL

SEQ ID NO: 427709 - protein, 9 aa, Influenza virus
GYKDWFLWI

SEQ ID NO: 427710 - protein, 9 aa, Influenza virus
YRNLIWLVQ

SEQ ID NO: 427711 - protein, 9 aa, Influenza virus
MENEMTLDF

SEQ ID NO: 427712 - protein, 9 aa, Influenza virus
SLFSSIKRY

SEQ ID NO: 427713 - protein, 9 aa, Influenza virus
ITNRVNSII

SEQ ID NO: 427714 - protein, 9 aa, Influenza virus
SSFERFEIF

SEQ ID NO: 427715 - protein, 9 aa, Influenza virus
MANIRNNTY

SEQ ID NO: 427716 - protein, 9 aa, Influenza virus
KMNGNYDSI

SEQ ID NO: 427717 - protein, 9 aa, Influenza virus
IQMCTELQL

SEQ ID NO: 427718 - protein, 9 aa, Influenza virus
DEGDGCFSL

SEQ ID NO: 427719 - protein, 9 aa, Influenza virus
LMENERTLY

SEQ ID NO: 427720 - protein, 9 aa, Influenza virus
GSSTYHNSF

SEQ ID NO: 427721 - protein, 9 aa, Influenza virus
YVKSDRLVL

SEQ ID NO: 427722 - protein, 9 aa, Influenza virus
KMARLGKGY

SEQ ID NO: 427723 - protein, 9 aa, Influenza virus
NLIAPWYGY

SEQ ID NO: 427724 - protein, 9 aa, Influenza virus
GIHHPPNTK

SEQ ID NO: 427725 - protein, 9 aa, Influenza virus
KLYWHLMHP

SEQ ID NO: 427726 - protein, 9 aa, Influenza virus
LVTTVTLHF

SEQ ID NO: 427727 - protein, 9 aa, Influenza virus
LVISPDLSY

SEQ ID NO: 427728 - protein, 9 aa, Influenza virus
GRMDYYWGI

SEQ ID NO: 427729 - protein, 9 aa, Influenza virus
YRICKLVGI

SEQ ID NO: 427730 - protein, 9 aa, Influenza virus
QMALQLFIK

SEQ ID NO: 427731 - protein, 9 aa, Influenza virus
FQTAAQKAM

SEQ ID NO: 427732 - protein, 9 aa, Influenza virus
AEEDGNGCF

SEQ ID NO: 427733 - protein, 9 aa, Influenza virus
LYEKVRLQL

SEQ ID NO: 427734 - protein, 9 aa, Influenza virus
LINTYQWII

SEQ ID NO: 427735 - protein, 9 aa, Influenza virus
KLYGTGNKL

SEQ ID NO: 427736 - protein, 9 aa, Influenza virus
KSRSNIFNM

SEQ ID NO: 427737 - protein, 9 aa, Influenza virus
ALGQGTTLY

SEQ ID NO: 427738 - protein, 9 aa, Influenza virus
GTRQVCIAW

SEQ ID NO: 427739 - protein, 9 aa, Influenza virus
CIRTFFGWK

SEQ ID NO: 427740 - protein, 9 aa, Influenza virus
FHNVSKYAF

SEQ ID NO: 427741 - protein, 9 aa, Influenza virus
CSIHECRTF

SEQ ID NO: 427742 - protein, 9 aa, Influenza virus
YLECRTFFL

SEQ ID NO: 427743 - protein, 9 aa, Influenza virus
GSNRPWVSF

SEQ ID NO: 427744 - protein, 9 aa, Influenza virus
LVISSDLSY

SEQ ID NO: 427745 - protein, 9 aa, Influenza virus
VQSYFQLFL

SEQ ID NO: 427746 - protein, 9 aa, Influenza virus
ETFRVIDGW

SEQ ID NO: 427747 - protein, 9 aa, Influenza virus
KLYVNKNPY

SEQ ID NO: 427748 - protein, 9 aa, Influenza virus
GRIDFHWLI

SEQ ID NO: 427749 - protein, 9 aa, Influenza virus
AQDVIMEVV

SEQ ID NO: 427750 - protein, 9 aa, Influenza virus
TIIYSSSMM

SEQ ID NO: 427751 - protein, 9 aa, Influenza virus
YAFGTCPKY

SEQ ID NO: 427752 - protein, 9 aa, Influenza virus
VQSRGLFGA

SEQ ID NO: 427753 - protein, 9 aa, Influenza virus
GVYKALSIY

SEQ ID NO: 427754 - protein, 9 aa, Influenza virus
SIDRFLRVK

SEQ ID NO: 427755 - protein, 9 aa, Influenza virus
RRVDMNPGH

SEQ ID NO: 427756 - protein, 9 aa, Influenza virus
VQDRGLFGA

SEQ ID NO: 427757 - protein, 9 aa, Influenza virus
RTSHRTLLM

SEQ ID NO: 427758 - protein, 9 aa, Influenza virus
MVTQRTIGK

SEQ ID NO: 427759 - protein, 9 aa, Influenza virus
QPKWFRNVL

SEQ ID NO: 427760 - protein, 9 aa, Influenza virus
TLDLHDSNV

SEQ ID NO: 427761 - protein, 9 aa, Influenza virus
SLQQIESMV

SEQ ID NO: 427762 - protein, 9 aa, Influenza virus
RMDYYWGIL

SEQ ID NO: 427763 - protein, 9 aa, Influenza virus
FSFRYGDGV

SEQ ID NO: 427764 - protein, 9 aa, Influenza virus
RRVDINPGH

SEQ ID NO: 427765 - protein, 9 aa, Influenza virus
TLGLHDANV

SEQ ID NO: 427766 - protein, 9 aa, Influenza virus
IPAQNAIST

SEQ ID NO: 427767 - protein, 9 aa, Influenza virus
WSYNAEFLV

SEQ ID NO: 427768 - protein, 9 aa, Influenza virus
YASPQLEGF

SEQ ID NO: 427769 - protein, 9 aa, Influenza virus
GTKQVCIAW

SEQ ID NO: 427770 - protein, 9 aa, Influenza virus
GTYQILSIY

SEQ ID NO: 427771 - protein, 9 aa, Influenza virus
GTFDIGGLY

SEQ ID NO: 427772 - protein, 9 aa, Influenza virus
TTNTINRSF

SEQ ID NO: 427773 - protein, 9 aa, Influenza virus
GTVKDRSPY

SEQ ID NO: 427774 - protein, 9 aa, Influenza virus
WQGANRPVI

SEQ ID NO: 427775 - protein, 9 aa, Influenza virus
FSLGASCFL

SEQ ID NO: 427776 - protein, 9 aa, Influenza virus
FMQALQLLF

SEQ ID NO: 427777 - protein, 9 aa, Influenza virus
ATGLRNVPK

SEQ ID NO: 427778 - protein, 9 aa, Influenza virus
CEITGFAPF

SEQ ID NO: 427779 - protein, 9 aa, Influenza virus
FIAPNRASF

SEQ ID NO: 427780 - protein, 9 aa, Influenza virus
VSPLAVTWW

SEQ ID NO: 427781 - protein, 9 aa, Influenza virus
SQYLCTGIL

SEQ ID NO: 427782 - protein, 9 aa, Influenza virus
GRADTRILF

SEQ ID NO: 427783 - protein, 9 aa, Influenza virus
EALLNRLSI

SEQ ID NO: 427784 - protein, 9 aa, Influenza virus
LQSRTREIL

SEQ ID NO: 427785 - protein, 9 aa, Influenza virus
NLIAPWYAY

SEQ ID NO: 427786 - protein, 9 aa, Influenza virus
FQNIHPATI

SEQ ID NO: 427787 - protein, 9 aa, Influenza virus
RLIQNSLTI

SEQ ID NO: 427788 - protein, 9 aa, Influenza virus
GSIPNNKPF

SEQ ID NO: 427789 - protein, 9 aa, Influenza virus
YNADVLVAL

SEQ ID NO: 427790 - protein, 9 aa, Influenza virus
FQNVHPVTI

SEQ ID NO: 427791 - protein, 9 aa, Influenza virus
ALLKHRFEI

SEQ ID NO: 427792 - protein, 9 aa, Influenza virus
RRDQMAHCR

SEQ ID NO: 427793 - protein, 9 aa, Influenza virus
GAINSSMPL

SEQ ID NO: 427794 - protein, 9 aa, Influenza virus
TAVDTCYPF

SEQ ID NO: 427795 - protein, 9 aa, Influenza virus
ITIGKCSKY

SEQ ID NO: 427796 - protein, 9 aa, Influenza virus
CPFRGFFPF

SEQ ID NO: 427797 - protein, 9 aa, Influenza virus
AEEDGTGCF

SEQ ID NO: 427798 - protein, 9 aa, Influenza virus
MITDTIKSW

SEQ ID NO: 427799 - protein, 9 aa, Influenza virus
WHGSNRPWL

SEQ ID NO: 427800 - protein, 9 aa, Influenza virus
NNMARAVKL

SEQ ID NO: 427801 - protein, 9 aa, Influenza virus
TTNTINRIF

SEQ ID NO: 427802 - protein, 9 aa, Influenza virus
IQAGVDRFY

SEQ ID NO: 427803 - protein, 9 aa, Influenza virus
QAHTKVLYF

SEQ ID NO: 427804 - protein, 9 aa, Influenza virus
RLYVNKNPY

SEQ ID NO: 427805 - protein, 9 aa, Influenza virus
KLRMVTGLR

SEQ ID NO: 427806 - protein, 9 aa, Influenza virus
NWFGYFGIF

SEQ ID NO: 427807 - protein, 9 aa, Influenza virus
IAKDNAIRF

SEQ ID NO: 427808 - protein, 9 aa, Influenza virus
DLNMGQPFY

SEQ ID NO: 427809 - protein, 9 aa, Influenza virus
CLRGGRNSF

SEQ ID NO: 427810 - protein, 9 aa, Influenza virus
FQNTSRHYI

SEQ ID NO: 427811 - protein, 9 aa, Influenza virus
DRIPHRTLL

SEQ ID NO: 427812 - protein, 9 aa, Influenza virus
IPKRNRSIL

SEQ ID NO: 427813 - protein, 9 aa, Influenza virus
GTFDLGGLY

SEQ ID NO: 427814 - protein, 9 aa, Influenza virus
GRINYYWTL

SEQ ID NO: 427815 - protein, 9 aa, Influenza virus
RTSYRTLLM

SEQ ID NO: 427816 - protein, 9 aa, Influenza virus
GVSFHLGTK

SEQ ID NO: 427817 - protein, 9 aa, Influenza virus
KTWAKNILR

SEQ ID NO: 427818 - protein, 9 aa, Influenza virus
GLLLQVTSL

SEQ ID NO: 427819 - protein, 9 aa, Influenza virus
YNAEFLVAV

SEQ ID NO: 427820 - protein, 9 aa, Influenza virus
IITETIKSW

SEQ ID NO: 427821 - protein, 9 aa, Influenza virus
YLTGTWDTL

SEQ ID NO: 427822 - protein, 9 aa, Influenza virus
NTHIHIFSF

SEQ ID NO: 427823 - protein, 9 aa, Influenza virus
KMKAILVVL

SEQ ID NO: 427824 - protein, 9 aa, Influenza virus
SRISFYWTI

SEQ ID NO: 427825 - protein, 9 aa, Influenza virus
RTSHRTLLM

SEQ ID NO: 427826 - protein, 9 aa, Influenza virus
SGYKEIILW

SEQ ID NO: 427827 - protein, 9 aa, Influenza virus
ETFRVIGGW

SEQ ID NO: 427828 - protein, 9 aa, Influenza virus
KPPLPLCPF

SEQ ID NO: 427829 - protein, 9 aa, Influenza virus
KTNTEFESI

SEQ ID NO: 427830 - protein, 9 aa, Influenza virus
HHAVSNGTI

SEQ ID NO: 427831 - protein, 9 aa, Influenza virus
NRFYRTCKL

SEQ ID NO: 427832 - protein, 9 aa, Influenza virus
MLERELVRK

SEQ ID NO: 427833 - protein, 9 aa, Influenza virus
VWMGRTISK

SEQ ID NO: 427834 - protein, 9 aa, Influenza virus
KAIDQITTK

SEQ ID NO: 427835 - protein, 9 aa, Influenza virus
AIDKITNKV

SEQ ID NO: 427836 - protein, 9 aa, Influenza virus
LHNIHPLTI

SEQ ID NO: 427837 - protein, 9 aa, Influenza virus
IMIAGLSFW

SEQ ID NO: 427838 - protein, 9 aa, Influenza virus
YQILAIYST

SEQ ID NO: 427839 - protein, 9 aa, Influenza virus
MSFQGRGVF

SEQ ID NO: 427840 - protein, 9 aa, Influenza virus
TVASSLALA

SEQ ID NO: 427841 - protein, 9 aa, Influenza virus
QIRGFVYFV

SEQ ID NO: 427842 - protein, 9 aa, Influenza virus
KTNQQFELI

SEQ ID NO: 427843 - protein, 9 aa, Influenza virus
LIAPEYGYL

SEQ ID NO: 427844 - protein, 9 aa, Influenza virus
SVASSLVLL

SEQ ID NO: 427845 - protein, 9 aa, Influenza virus
VVSLGAISF

SEQ ID NO: 427846 - protein, 9 aa, Influenza virus
LSSVSSFEK

SEQ ID NO: 427847 - protein, 9 aa, Influenza virus
ELRHLFSGI

SEQ ID NO: 427848 - protein, 9 aa, Influenza virus
ELRFVFSIA

SEQ ID NO: 427849 - protein, 9 aa, Influenza virus
QMYQKCCSL

SEQ ID NO: 427850 - protein, 9 aa, Influenza virus
ITYGPCPRY

SEQ ID NO: 427851 - protein, 9 aa, Influenza virus
LTGNLQTLK

SEQ ID NO: 427852 - protein, 9 aa, Influenza virus
FFRNMVWLI

SEQ ID NO: 427853 - protein, 9 aa, Influenza virus
IPIGERGLF

SEQ ID NO: 427854 - protein, 9 aa, Influenza virus
RQKWWVWLW

SEQ ID NO: 427855 - protein, 9 aa, Influenza virus
CQIAGFAPF

SEQ ID NO: 427856 - protein, 9 aa, Influenza virus
FLGQWNWPD

SEQ ID NO: 427857 - protein, 9 aa, Influenza virus
CHQRSKFLL

SEQ ID NO: 427858 - protein, 9 aa, Influenza virus
CSNDTINYY

SEQ ID NO: 427859 - protein, 9 aa, Influenza virus
FFRHMVWLI

SEQ ID NO: 427860 - protein, 9 aa, Influenza virus
NTTYRILSI

SEQ ID NO: 427861 - protein, 9 aa, Influenza virus
MTLSVVSLL

SEQ ID NO: 427862 - protein, 9 aa, Influenza virus
GVKGFSFRY

SEQ ID NO: 427863 - protein, 9 aa, Influenza virus
AMKHTSQYI

SEQ ID NO: 427864 - protein, 9 aa, Influenza virus
VMGQASYKI

SEQ ID NO: 427865 - protein, 9 aa, Influenza virus
LLGINMSKK

SEQ ID NO: 427866 - protein, 9 aa, Influenza virus
ELPFTIDKY

SEQ ID NO: 427867 - protein, 9 aa, Influenza virus
RTFQNVSPL

SEQ ID NO: 427868 - protein, 9 aa, Influenza virus
YRTLLMNEL

SEQ ID NO: 427869 - protein, 9 aa, Influenza virus
TSYRSLIRF

SEQ ID NO: 427870 - protein, 9 aa, Influenza virus
RRIWRQANN

SEQ ID NO: 427871 - protein, 9 aa, Influenza virus
CHNGTCAVV

SEQ ID NO: 427872 - protein, 9 aa, Influenza virus
NLIAPWYAF

SEQ ID NO: 427873 - protein, 9 aa, Influenza virus
GMEMRRCLL

SEQ ID NO: 427874 - protein, 9 aa, Influenza virus
GMQIRGFVY

SEQ ID NO: 427875 - protein, 9 aa, Influenza virus
GENMAPEKM

SEQ ID NO: 427876 - protein, 9 aa, Influenza virus
KMRDSIKSW

SEQ ID NO: 427877 - protein, 9 aa, Influenza virus
AMELIRMIK

SEQ ID NO: 427878 - protein, 9 aa, Influenza virus
FQPCFYVEL

SEQ ID NO: 427879 - protein, 9 aa, Influenza virus
KEKEICSVV

SEQ ID NO: 427880 - protein, 9 aa, Influenza virus
SMSGFRSNL

SEQ ID NO: 427881 - protein, 9 aa, Influenza virus
FTIGECPRY

SEQ ID NO: 427882 - protein, 9 aa, Influenza virus
LQIISLCSI

SEQ ID NO: 427883 - protein, 9 aa, Influenza virus
MLKVPNALI

SEQ ID NO: 427884 - protein, 9 aa, Influenza virus
VTGFAPFSK

SEQ ID NO: 427885 - protein, 9 aa, Influenza virus
STVASSSVL

SEQ ID NO: 427886 - protein, 9 aa, Influenza virus
LLAFILWAC

SEQ ID NO: 427887 - protein, 9 aa, Influenza virus
IQMCTELQL

SEQ ID NO: 427888 - protein, 9 aa, Influenza virus
RPKVNGQAG

SEQ ID NO: 427889 - protein, 9 aa, Influenza virus
TYNAELFVL

SEQ ID NO: 427890 - protein, 9 aa, Influenza virus
WTTNSIVVF

SEQ ID NO: 427891 - protein, 9 aa, Influenza virus
GGYKDIILW

SEQ ID NO: 427892 - protein, 9 aa, Influenza virus
APFISCSYL

SEQ ID NO: 427893 - protein, 9 aa, Influenza virus
FEKEGYSLV

SEQ ID NO: 427894 - protein, 9 aa, Influenza virus
ITIGFVSLI

SEQ ID NO: 427895 - protein, 9 aa, Influenza virus
SMCSSTEFL

SEQ ID NO: 427896 - protein, 9 aa, Influenza virus
LRSGYWAIR

SEQ ID NO: 427897 - protein, 9 aa, Influenza virus
FSFGASCVM

SEQ ID NO: 427898 - protein, 9 aa, Influenza virus
VASSLTLAI

SEQ ID NO: 427899 - protein, 9 aa, Influenza virus
ILSMAPIMF

SEQ ID NO: 427900 - protein, 9 aa, Influenza virus
YRNLIWLVN

SEQ ID NO: 427901 - protein, 9 aa, Influenza virus
EGRLIQNSL

SEQ ID NO: 427902 - protein, 9 aa, Influenza virus
WTSNSIVVF

SEQ ID NO: 427903 - protein, 9 aa, Influenza virus
LMENERTLY

SEQ ID NO: 427904 - protein, 9 aa, Influenza virus
NPRIFLAMI

SEQ ID NO: 427905 - protein, 9 aa, Influenza virus
GAYKILTIY

SEQ ID NO: 427906 - protein, 9 aa, Influenza virus
ALSYSTGAL

SEQ ID NO: 427907 - protein, 9 aa, Influenza virus
QVIVDNNSW

SEQ ID NO: 427908 - protein, 9 aa, Influenza virus
WPDGANISF

SEQ ID NO: 427909 - protein, 9 aa, Influenza virus
VLATGPRNV

SEQ ID NO: 427910 - protein, 9 aa, Influenza virus
YKMNIQILI

SEQ ID NO: 427911 - protein, 9 aa, Influenza virus
LPFHNVHPL

SEQ ID NO: 427912 - protein, 9 aa, Influenza virus
RIGEGQRSW

SEQ ID NO: 427913 - protein, 9 aa, Influenza virus
DRDSTQMAI

SEQ ID NO: 427914 - protein, 9 aa, Influenza virus
SVCYNPCFY

SEQ ID NO: 427915 - protein, 9 aa, Influenza virus
LYDKVRLQL

SEQ ID NO: 427916 - protein, 9 aa, Influenza virus
TIREKNVTV

SEQ ID NO: 427917 - protein, 9 aa, Influenza virus
CHNGTCVVI

SEQ ID NO: 427918 - protein, 9 aa, Influenza virus
SVSECRTFF

SEQ ID NO: 427919 - protein, 9 aa, Influenza virus
ATTVTLHFK

SEQ ID NO: 427920 - protein, 9 aa, Influenza virus
FQNIHPITI

SEQ ID NO: 427921 - protein, 9 aa, Influenza virus
NQKILFASA

SEQ ID NO: 427922 - protein, 9 aa, Influenza virus
MVVYAELLV

SEQ ID NO: 427923 - protein, 9 aa, Influenza virus
SLLLLQANL

SEQ ID NO: 427924 - protein, 9 aa, Influenza virus
LTDSEMSKL

SEQ ID NO: 427925 - protein, 9 aa, Influenza virus
GVYQILSIY

SEQ ID NO: 427926 - protein, 9 aa, Influenza virus
GVSGEVPGW

SEQ ID NO: 427927 - protein, 9 aa, Influenza virus
CHNGVCPVV

SEQ ID NO: 427928 - protein, 9 aa, Influenza virus
NTTWVNQTY

SEQ ID NO: 427929 - protein, 9 aa, Influenza virus
SACYNPCFY

SEQ ID NO: 427930 - protein, 9 aa, Influenza virus
LVRGNSPVF

SEQ ID NO: 427931 - protein, 9 aa, Influenza virus
RELCTINSW

SEQ ID NO: 427932 - protein, 9 aa, Influenza virus
LPVAGGTSS

SEQ ID NO: 427933 - protein, 9 aa, Influenza virus
GITTHFQRK

SEQ ID NO: 427934 - protein, 9 aa, Influenza virus
ARQEKNPAL

SEQ ID NO: 427935 - protein, 9 aa, Influenza virus
RMQFSSLAV

SEQ ID NO: 427936 - protein, 9 aa, Influenza virus
TSFQVDCYL

SEQ ID NO: 427937 - protein, 9 aa, Influenza virus
QTLVSNDDW

SEQ ID NO: 427938 - protein, 9 aa, Influenza virus
GSISNDKPF

SEQ ID NO: 427939 - protein, 9 aa, Influenza virus
NVYKVLSIY

SEQ ID NO: 427940 - protein, 9 aa, Influenza virus
LIVPEWSYI

SEQ ID NO: 427941 - protein, 9 aa, Influenza virus
GIFGAIAGF

SEQ ID NO: 427942 - protein, 9 aa, Influenza virus
VTYQILSIY

SEQ ID NO: 427943 - protein, 9 aa, Influenza virus
VPVTSTIDL

SEQ ID NO: 427944 - protein, 9 aa, Influenza virus
RGINDRNFW

SEQ ID NO: 427945 - protein, 9 aa, Influenza virus
WPDDAELPF

SEQ ID NO: 427946 - protein, 9 aa, Influenza virus
VLAIYSCIA

SEQ ID NO: 427947 - protein, 9 aa, Influenza virus
ISKMGVDEY

SEQ ID NO: 427948 - protein, 9 aa, Influenza virus
LIFLARSAL

SEQ ID NO: 427949 - protein, 9 aa, Influenza virus
MGIYQILAI

SEQ ID NO: 427950 - protein, 9 aa, Influenza virus
STKEWSRRY

SEQ ID NO: 427951 - protein, 9 aa, Influenza virus
ETFVNITNV

SEQ ID NO: 427952 - protein, 9 aa, Influenza virus
AEEDGRGCF

SEQ ID NO: 427953 - protein, 9 aa, Influenza virus
ASWFNSFLI

SEQ ID NO: 427954 - protein, 9 aa, Influenza virus
GSWPDGANF

SEQ ID NO: 427955 - protein, 9 aa, Influenza virus
GRQTFDWTL

SEQ ID NO: 427956 - protein, 9 aa, Influenza virus
MAIIKRYTS

SEQ ID NO: 427957 - protein, 9 aa, Influenza virus
ITYGACPRY

SEQ ID NO: 427958 - protein, 9 aa, Influenza virus
GSNRPWISF

SEQ ID NO: 427959 - protein, 9 aa, Influenza virus
IVLGIINLL

SEQ ID NO: 427960 - protein, 9 aa, Influenza virus
ATAVAVLKY

SEQ ID NO: 427961 - protein, 9 aa, Influenza virus
PQCDRFLEF

SEQ ID NO: 427962 - protein, 9 aa, Influenza virus
RRRFVQNAL

SEQ ID NO: 427963 - protein, 9 aa, Influenza virus
KSLMLATGM

SEQ ID NO: 427964 - protein, 9 aa, Influenza virus
NVNRITYGV

SEQ ID NO: 427965 - protein, 9 aa, Influenza virus
YQILSIYST

SEQ ID NO: 427966 - protein, 9 aa, Influenza virus
MQNRLNNVI

SEQ ID NO: 427967 - protein, 9 aa, Influenza virus
VLATGLRNI

SEQ ID NO: 427968 - protein, 9 aa, Influenza virus
EMKWLSSSM

SEQ ID NO: 427969 - protein, 9 aa, Influenza virus
CPIRGWAPL

SEQ ID NO: 427970 - protein, 9 aa, Influenza virus
RSIEEKFEI

SEQ ID NO: 427971 - protein, 9 aa, Influenza virus
WTTNSIVVF

SEQ ID NO: 427972 - protein, 9 aa, Influenza virus
MPLHNIHPL

SEQ ID NO: 427973 - protein, 9 aa, Influenza virus
LIEKTNTEF

SEQ ID NO: 427974 - protein, 9 aa, Influenza virus
SVGGINTNK

SEQ ID NO: 427975 - protein, 9 aa, Influenza virus
IASMRRSYF

SEQ ID NO: 427976 - protein, 9 aa, Influenza virus
PSFYAEMKW

SEQ ID NO: 427977 - protein, 9 aa, Influenza virus
FLTMITYIT

SEQ ID NO: 427978 - protein, 9 aa, Influenza virus
SGYKEVILW

SEQ ID NO: 427979 - protein, 9 aa, Influenza virus
IMGLFFFCL

SEQ ID NO: 427980 - protein, 9 aa, Influenza virus
ALLVGIGNL

SEQ ID NO: 427981 - protein, 9 aa, Influenza virus
KEICIAWSS

SEQ ID NO: 427982 - protein, 9 aa, Influenza virus
IVALCGSKK

SEQ ID NO: 427983 - protein, 9 aa, Influenza virus
GQGDIVLVM

SEQ ID NO: 427984 - protein, 9 aa, Influenza virus
PEVCLKWEL

SEQ ID NO: 427985 - protein, 9 aa, Influenza virus
LEENTSYKI

SEQ ID NO: 427986 - protein, 9 aa, Influenza virus
VERGLFGAI

SEQ ID NO: 427987 - protein, 9 aa, Influenza virus
CFLLVALLI

SEQ ID NO: 427988 - protein, 9 aa, Influenza virus
WMMAMRYPI

SEQ ID NO: 427989 - protein, 9 aa, Influenza virus
SGYSGSFVM

SEQ ID NO: 427990 - protein, 9 aa, Influenza virus
GAINSSMPF

SEQ ID NO: 427991 - protein, 9 aa, Influenza virus
NMARAVKLY

SEQ ID NO: 427992 - protein, 9 aa, Influenza virus
KACELTDSI

SEQ ID NO: 427993 - protein, 9 aa, Influenza virus
HVFVIREPF

SEQ ID NO: 427994 - protein, 9 aa, Influenza virus
LHDSNVRNL

SEQ ID NO: 427995 - protein, 9 aa, Influenza virus
ASCHDGRAW

SEQ ID NO: 427996 - protein, 9 aa, Influenza virus
YQIGYVCSG

SEQ ID NO: 427997 - protein, 9 aa, Influenza virus
HIFVIREPF

SEQ ID NO: 427998 - protein, 9 aa, Influenza virus
GTIHDRSQF

SEQ ID NO: 427999 - protein, 9 aa, Influenza virus
RVFLTMITY

SEQ ID NO: 428000 - protein, 9 aa, Influenza virus
GLYGAIEEC

SEQ ID NO: 428001 - protein, 9 aa, Influenza virus
MLKIHNAGT

SEQ ID NO: 428002 - protein, 9 aa, Influenza virus
MTLSVVSLL

SEQ ID NO: 428003 - protein, 9 aa, Influenza virus
WMACHSAAF

SEQ ID NO: 428004 - protein, 9 aa, Influenza virus
ISTASRSGY

SEQ ID NO: 428005 - protein, 9 aa, Influenza virus
GRMNYYWTI

SEQ ID NO: 428006 - protein, 9 aa, Influenza virus
ATKRIRMAI

SEQ ID NO: 428007 - protein, 9 aa, Influenza virus
LTDSEMNKL

SEQ ID NO: 428008 - protein, 9 aa, Influenza virus
GRMTFYWTI

SEQ ID NO: 428009 - protein, 9 aa, Influenza virus
MDYYWAVLK

SEQ ID NO: 428010 - protein, 9 aa, Influenza virus
STYKILSIY

SEQ ID NO: 428011 - protein, 9 aa, Influenza virus
KLRMATGLR

SEQ ID NO: 428012 - protein, 9 aa, Influenza virus
ITDIWAYNA

SEQ ID NO: 428013 - protein, 9 aa, Influenza virus
GRMTFYWTM

SEQ ID NO: 428014 - protein, 9 aa, Influenza virus
LENGRTLGL

SEQ ID NO: 428015 - protein, 9 aa, Influenza virus
NPRVFLAMI

SEQ ID NO: 428016 - protein, 9 aa, Influenza virus
SIVMCGVNY

SEQ ID NO: 428017 - protein, 9 aa, Influenza virus
SQSRTREIL

SEQ ID NO: 428018 - protein, 9 aa, Influenza virus
RIGSRGDVF

SEQ ID NO: 428019 - protein, 9 aa, Influenza virus
SPFRTLMSV

SEQ ID NO: 428020 - protein, 9 aa, Influenza virus
YSHGTGTGY

SEQ ID NO: 428021 - protein, 9 aa, Influenza virus
VLYFWGIHH

SEQ ID NO: 428022 - protein, 9 aa, Influenza virus
KMNTRILIL

SEQ ID NO: 428023 - protein, 9 aa, Influenza virus
CHSAAFEDL

SEQ ID NO: 428024 - protein, 9 aa, Influenza virus
TLTNEQEEV

SEQ ID NO: 428025 - protein, 9 aa, Influenza virus
FQGRGVFEF

SEQ ID NO: 428026 - protein, 9 aa, Influenza virus
KALNEITTK

SEQ ID NO: 428027 - protein, 9 aa, Influenza virus
FSISCFLLI

SEQ ID NO: 428028 - protein, 9 aa, Influenza virus
KRLENLDKK

SEQ ID NO: 428029 - protein, 9 aa, Influenza virus
NLYVNKNPY

SEQ ID NO: 428030 - protein, 9 aa, Influenza virus
NLSGYSGSF

SEQ ID NO: 428031 - protein, 9 aa, Influenza virus
HTKILYFHK

SEQ ID NO: 428032 - protein, 9 aa, Influenza virus
KMNTRILIL

SEQ ID NO: 428033 - protein, 9 aa, Influenza virus
GTAPVLGNY

SEQ ID NO: 428034 - protein, 9 aa, Influenza virus
WFRNILSIA

SEQ ID NO: 428035 - protein, 9 aa, Influenza virus
IQMCTELQL

SEQ ID NO: 428036 - protein, 9 aa, Influenza virus
FPVGTAPVL

SEQ ID NO: 428037 - protein, 9 aa, Influenza virus
KEICVAWSS

SEQ ID NO: 428038 - protein, 9 aa, Influenza virus
PSFFRNMVW

SEQ ID NO: 428039 - protein, 9 aa, Influenza virus
ESRSNIFNM

SEQ ID NO: 428040 - protein, 9 aa, Influenza virus
VPVTQAMEL

SEQ ID NO: 428041 - protein, 9 aa, Influenza virus
FFGDNAEEF

SEQ ID NO: 428042 - protein, 9 aa, Influenza virus
AEDQGNGCF

SEQ ID NO: 428043 - protein, 9 aa, Influenza virus
VWTYNAELF

SEQ ID NO: 428044 - protein, 9 aa, Influenza virus
AINEITTKI

SEQ ID NO: 428045 - protein, 9 aa, Influenza virus
RLRSGFEML

SEQ ID NO: 428046 - protein, 9 aa, Influenza virus
FSVQRSLPF

SEQ ID NO: 428047 - protein, 9 aa, Influenza virus
TIVEKNVTV

SEQ ID NO: 428048 - protein, 9 aa, Influenza virus
ITDTIKSWK

SEQ ID NO: 428049 - protein, 9 aa, Influenza virus
YAFGNCPKY

SEQ ID NO: 428050 - protein, 9 aa, Influenza virus
LLAFVLWAC

SEQ ID NO: 428051 - protein, 9 aa, Influenza virus
EIRTFSFQL

SEQ ID NO: 428052 - protein, 9 aa, Influenza virus
KTNEKFHQI

SEQ ID NO: 428053 - protein, 9 aa, Influenza virus
MFSNKVARL

SEQ ID NO: 428054 - protein, 9 aa, Influenza virus
ILKIKKGKL

SEQ ID NO: 428055 - protein, 9 aa, Influenza virus
QQIESMIEA

SEQ ID NO: 428056 - protein, 9 aa, Influenza virus
ELVRKTRFL

SEQ ID NO: 428057 - protein, 9 aa, Influenza virus
KILSIYSCI

SEQ ID NO: 428058 - protein, 9 aa, Influenza virus
VRMNNETIL

SEQ ID NO: 428059 - protein, 9 aa, Influenza virus
ITSKVNSII

SEQ ID NO: 428060 - protein, 9 aa, Influenza virus
RMEFFWTLL

SEQ ID NO: 428061 - protein, 9 aa, Influenza virus
NTRLPFQNL

SEQ ID NO: 428062 - protein, 9 aa, Influenza virus
KLRSGFEML

SEQ ID NO: 428063 - protein, 9 aa, Influenza virus
ILAIYATVA

SEQ ID NO: 428064 - protein, 9 aa, Influenza virus
FWMCSNGSL

SEQ ID NO: 428065 - protein, 9 aa, Influenza virus
MENERTLDF

SEQ ID NO: 428066 - protein, 9 aa, Influenza virus
VLTDTSRPK

SEQ ID NO: 428067 - protein, 9 aa, Influenza virus
LRSRYWAIR

SEQ ID NO: 428068 - protein, 9 aa, Influenza virus
MARLGKGYM

SEQ ID NO: 428069 - protein, 9 aa, Influenza virus
GENMAPEKI

SEQ ID NO: 428070 - protein, 9 aa, Influenza virus
IMGLVFFCL

SEQ ID NO: 428071 - protein, 9 aa, Influenza virus
WISFAISCF

SEQ ID NO: 428072 - protein, 9 aa, Influenza virus
SLIASSGTL

SEQ ID NO: 428073 - protein, 9 aa, Influenza virus
RTELISPSK

SEQ ID NO: 428074 - protein, 9 aa, Influenza virus
DRSPYRTLL

SEQ ID NO: 428075 - protein, 9 aa, Influenza virus
QLKLATGLK

SEQ ID NO: 428076 - protein, 9 aa, Influenza virus
IQTKRSFEL

SEQ ID NO: 428077 - protein, 9 aa, Influenza virus
LSSMGVYQI

SEQ ID NO: 428078 - protein, 9 aa, Influenza virus
LRRCLLQSL

SEQ ID NO: 428079 - protein, 9 aa, Influenza virus
EVSWTSNSI

SEQ ID NO: 428080 - protein, 9 aa, Influenza virus
MEWLKTRPI

SEQ ID NO: 428081 - protein, 9 aa, Influenza virus
YVKSERLVL

SEQ ID NO: 428082 - protein, 9 aa, Influenza virus
VSNNDWSGY

SEQ ID NO: 428083 - protein, 9 aa, Influenza virus
KFFPSSSYR

SEQ ID NO: 428084 - protein, 9 aa, Influenza virus
SMIEAESSV

SEQ ID NO: 428085 - protein, 9 aa, Influenza virus
EVEQEMRTF

SEQ ID NO: 428086 - protein, 9 aa, Influenza virus
RNIVRRAIV

SEQ ID NO: 428087 - protein, 9 aa, Influenza virus
QMYQRCCNL

SEQ ID NO: 428088 - protein, 9 aa, Influenza virus
IICTCRDNW

SEQ ID NO: 428089 - protein, 9 aa, Influenza virus
SSFEQITFM

SEQ ID NO: 428090 - protein, 9 aa, Influenza virus
YRTLLMSEL

SEQ ID NO: 428091 - protein, 9 aa, Influenza virus
GSNRPWISF

SEQ ID NO: 428092 - protein, 9 aa, Influenza virus
ASTGGQSFY

SEQ ID NO: 428093 - protein, 9 aa, Influenza virus
GMILSVVSL

SEQ ID NO: 428094 - protein, 9 aa, Influenza virus
GIKGFSFKY

SEQ ID NO: 428095 - protein, 9 aa, Influenza virus
RTSYRTLLM

SEQ ID NO: 428096 - protein, 9 aa, Influenza virus
SQYICSPVL

SEQ ID NO: 428097 - protein, 9 aa, Influenza virus
IITDTLKSW

SEQ ID NO: 428098 - protein, 9 aa, Influenza virus
FQNIDRNAI

SEQ ID NO: 428099 - protein, 9 aa, Influenza virus
ATYQRTRAL

SEQ ID NO: 428100 - protein, 9 aa, Influenza virus
SIKEKDMTK

SEQ ID NO: 428101 - protein, 9 aa, Influenza virus
LRSGFEMLK

SEQ ID NO: 428102 - protein, 9 aa, Influenza virus
LNRLNINPV

SEQ ID NO: 428103 - protein, 9 aa, Influenza virus
IITDTIKSW

SEQ ID NO: 428104 - protein, 9 aa, Influenza virus
IMTIGSVSL

SEQ ID NO: 428105 - protein, 9 aa, Influenza virus
RSIVRRATV

SEQ ID NO: 428106 - protein, 9 aa, Influenza virus
NPNQKTITI

SEQ ID NO: 428107 - protein, 9 aa, Influenza virus
SYNARLLVL

SEQ ID NO: 428108 - protein, 9 aa, Influenza virus
KLATGMRNI

SEQ ID NO: 428109 - protein, 9 aa, Influenza virus
IFNSIGNLI

SEQ ID NO: 428110 - protein, 9 aa, Influenza virus
KLSQMSKNV

SEQ ID NO: 428111 - protein, 9 aa, Influenza virus
LIQLIVSGK

SEQ ID NO: 428112 - protein, 9 aa, Influenza virus
RRKRGLFGA

SEQ ID NO: 428113 - protein, 9 aa, Influenza virus
RISFYWTIV

SEQ ID NO: 428114 - protein, 9 aa, Influenza virus
KVLAIYSCI

SEQ ID NO: 428115 - protein, 9 aa, Influenza virus
GSINTKLPF

SEQ ID NO: 428116 - protein, 9 aa, Influenza virus
MLKIPNAGI

SEQ ID NO: 428117 - protein, 9 aa, Influenza virus
WTSNSIVTF

SEQ ID NO: 428118 - protein, 9 aa, Influenza virus
LTFLARSAL

SEQ ID NO: 428119 - protein, 9 aa, Influenza virus
CIDFRDMRK

SEQ ID NO: 428120 - protein, 9 aa, Influenza virus
QQIESMVEA

SEQ ID NO: 428121 - protein, 9 aa, Influenza virus
DHEGEGIPL

SEQ ID NO: 428122 - protein, 9 aa, Influenza virus
QGYKDIILW

SEQ ID NO: 428123 - protein, 9 aa, Influenza virus
SSCHDGRAW

SEQ ID NO: 428124 - protein, 9 aa, Influenza virus
TTYRILSIY

SEQ ID NO: 428125 - protein, 9 aa, Influenza virus
HTKVLYFHK

SEQ ID NO: 428126 - protein, 9 aa, Influenza virus
KQLGNVINW

SEQ ID NO: 428127 - protein, 9 aa, Influenza virus
LAKSVFNCL

SEQ ID NO: 428128 - protein, 9 aa, Influenza virus
VLTGNLQAL

SEQ ID NO: 428129 - protein, 9 aa, Influenza virus
YRACFYVEL

SEQ ID NO: 428130 - protein, 9 aa, Influenza virus
SISCFLLVA

SEQ ID NO: 428131 - protein, 9 aa, Influenza virus
YNRRLTTTI

SEQ ID NO: 428132 - protein, 9 aa, Influenza virus
WQGANRPII

SEQ ID NO: 428133 - protein, 9 aa, Influenza virus
ELWQCYYLL

SEQ ID NO: 428134 - protein, 9 aa, Influenza virus
WLIYQSGTY

SEQ ID NO: 428135 - protein, 9 aa, Influenza virus
EELRFVFSI

SEQ ID NO: 428136 - protein, 9 aa, Influenza virus
SQGVKGWAF

SEQ ID NO: 428137 - protein, 9 aa, Influenza virus
KFEFIAEDF

SEQ ID NO: 428138 - protein, 9 aa, Influenza virus
LTDSQTATK

SEQ ID NO: 428139 - protein, 9 aa, Influenza virus
LYDRVRLQL

SEQ ID NO: 428140 - protein, 9 aa, Influenza virus
IHECRTFFL

SEQ ID NO: 428141 - protein, 9 aa, Influenza virus
GSNRPWVSF

SEQ ID NO: 428142 - protein, 9 aa, Influenza virus
LAIMIAGIF

SEQ ID NO: 428143 - protein, 9 aa, Influenza virus
CSISECRTF

SEQ ID NO: 428144 - protein, 9 aa, Influenza virus
VSNSDWSGY

SEQ ID NO: 428145 - protein, 9 aa, Influenza virus
KTFQNVSPI

SEQ ID NO: 428146 - protein, 9 aa, Influenza virus
LHLEFKADL

SEQ ID NO: 428147 - protein, 9 aa, Influenza virus
HSNLNDATY

SEQ ID NO: 428148 - protein, 9 aa, Influenza virus
ALISWPLSS

SEQ ID NO: 428149 - protein, 9 aa, Influenza virus
GLLGAIAGF

SEQ ID NO: 428150 - protein, 9 aa, Influenza virus
LSSMGIYQI

SEQ ID NO: 428151 - protein, 9 aa, Influenza virus
KILCTSATA

SEQ ID NO: 428152 - protein, 9 aa, Influenza virus
IKHENRMVL

SEQ ID NO: 428153 - protein, 9 aa, Influenza virus
NLTKGLCTI

SEQ ID NO: 428154 - protein, 9 aa, Influenza virus
DRTNHQFEL

SEQ ID NO: 428155 - protein, 9 aa, Influenza virus
ISIASRSGY

SEQ ID NO: 428156 - protein, 9 aa, Influenza virus
APIEHIASM

SEQ ID NO: 428157 - protein, 9 aa, Influenza virus
SFGASCFTL

SEQ ID NO: 428158 - protein, 9 aa, Influenza virus
KILFASATA

SEQ ID NO: 428159 - protein, 9 aa, Influenza virus
GVKGFGFKK

SEQ ID NO: 428160 - protein, 9 aa, Influenza virus
LMSCPVGEA

SEQ ID NO: 428161 - protein, 9 aa, Influenza virus
LTRTTVDHM

SEQ ID NO: 428162 - protein, 9 aa, Influenza virus
GVWWTSNSI

SEQ ID NO: 428163 - protein, 9 aa, Influenza virus
RMSDSIKSW

SEQ ID NO: 428164 - protein, 9 aa, Influenza virus
TTYRILSIY

SEQ ID NO: 428165 - protein, 9 aa, Influenza virus
NSFEQITFM

SEQ ID NO: 428166 - protein, 9 aa, Influenza virus
LLMDALKLS

SEQ ID NO: 428167 - protein, 9 aa, Influenza virus
FEREGYSLV

SEQ ID NO: 428168 - protein, 9 aa, Influenza virus
FESNGAFIA

SEQ ID NO: 428169 - protein, 9 aa, Influenza virus
ASCAAMDEF

SEQ ID NO: 428170 - protein, 9 aa, Influenza virus
KAIDIMQNK

SEQ ID NO: 428171 - protein, 9 aa, Influenza virus
CSYLECRTF

SEQ ID NO: 428172 - protein, 9 aa, Influenza virus
YQIGYICSG

SEQ ID NO: 428173 - protein, 9 aa, Influenza virus
IKMKWGMEL

SEQ ID NO: 428174 - protein, 9 aa, Influenza virus
NPRIFLAMI

SEQ ID NO: 428175 - protein, 9 aa, Influenza virus
YRTLLMSEL

SEQ ID NO: 428176 - protein, 9 aa, Influenza virus
LLAKSVFNC

SEQ ID NO: 428177 - protein, 9 aa, Influenza virus
RVFLTMITY

SEQ ID NO: 428178 - protein, 9 aa, Influenza virus
WLIHQSGTY

SEQ ID NO: 428179 - protein, 9 aa, Influenza virus
WRGANRPVI

SEQ ID NO: 428180 - protein, 9 aa, Influenza virus
HQLLRHFQK

SEQ ID NO: 428181 - protein, 9 aa, Influenza virus
AIWTSSSSI

SEQ ID NO: 428182 - protein, 9 aa, Influenza virus
SGEVPGWSW

SEQ ID NO: 428183 - protein, 9 aa, Influenza virus
CHITGFAPF

SEQ ID NO: 428184 - protein, 9 aa, Influenza virus
KYHQIEKEF

SEQ ID NO: 428185 - protein, 9 aa, Influenza virus
SPNVYQSRF

SEQ ID NO: 428186 - protein, 9 aa, Influenza virus
YVRSEKLVL

SEQ ID NO: 428187 - protein, 9 aa, Influenza virus
KLYVWGVHH

SEQ ID NO: 428188 - protein, 9 aa, Influenza virus
FMYSDFHFI

SEQ ID NO: 428189 - protein, 9 aa, Influenza virus
IGYVCSGVF

SEQ ID NO: 428190 - protein, 9 aa, Influenza virus
NPIVPSFEM

SEQ ID NO: 428191 - protein, 9 aa, Influenza virus
YQFALGQGA

SEQ ID NO: 428192 - protein, 9 aa, Influenza virus
YAFGNCPMY

SEQ ID NO: 428193 - protein, 9 aa, Influenza virus
RTNMINDKI

SEQ ID NO: 428194 - protein, 9 aa, Influenza virus
WRGGSINTK

SEQ ID NO: 428195 - protein, 9 aa, Influenza virus
NIMASQGTK

SEQ ID NO: 428196 - protein, 9 aa, Influenza virus
GKIAHISPL

SEQ ID NO: 428197 - protein, 9 aa, Influenza virus
KTFQNVSPI

SEQ ID NO: 428198 - protein, 9 aa, Influenza virus
AIAMGFVFI

SEQ ID NO: 428199 - protein, 9 aa, Influenza virus
NYLIRALTL

SEQ ID NO: 428200 - protein, 9 aa, Influenza virus
IMIAGLFFW

SEQ ID NO: 428201 - protein, 9 aa, Influenza virus
LANNGKFEF

SEQ ID NO: 428202 - protein, 9 aa, Influenza virus
FPNEVGAKI

SEQ ID NO: 428203 - protein, 9 aa, Influenza virus
HSNLNDATY

SEQ ID NO: 428204 - protein, 9 aa, Influenza virus
KIDDQIENL

SEQ ID NO: 428205 - protein, 9 aa, Influenza virus
SRSGFEVLF

SEQ ID NO: 428206 - protein, 9 aa, Influenza virus
RLTTTIKPW

SEQ ID NO: 428207 - protein, 9 aa, Influenza virus
STVSSSLVL

SEQ ID NO: 428208 - protein, 9 aa, Influenza virus
EMGLAPSPY

SEQ ID NO: 428209 - protein, 9 aa, Influenza virus
RRCLLQSLQ

SEQ ID NO: 428210 - protein, 9 aa, Influenza virus
HHAVPNGTV

SEQ ID NO: 428211 - protein, 9 aa, Influenza virus
GVKLTQGYK

SEQ ID NO: 428212 - protein, 9 aa, Influenza virus
WVPKRNRSI

SEQ ID NO: 428213 - protein, 9 aa, Influenza virus
CTINSWHIF

SEQ ID NO: 428214 - protein, 9 aa, Influenza virus
QLNEGIMNT

SEQ ID NO: 428215 - protein, 9 aa, Influenza virus
DEGNGCFEL

SEQ ID NO: 428216 - protein, 9 aa, Influenza virus
SYNAQLLVW

SEQ ID NO: 428217 - protein, 9 aa, Influenza virus
WSYIVERPK

SEQ ID NO: 428218 - protein, 9 aa, Influenza virus
IQNRGLFGA

SEQ ID NO: 428219 - protein, 9 aa, Influenza virus
TLTGRGIEV

SEQ ID NO: 428220 - protein, 9 aa, Influenza virus
KIMYFHKGL

SEQ ID NO: 428221 - protein, 9 aa, Influenza virus
ITFESNGGF

SEQ ID NO: 428222 - protein, 9 aa, Influenza virus
AQMALQLFI

SEQ ID NO: 428223 - protein, 9 aa, Influenza virus
YRILSIYST

SEQ ID NO: 428224 - protein, 9 aa, Influenza virus
LSFQVDCFL

SEQ ID NO: 428225 - protein, 9 aa, Influenza virus
KAIDGITNK

SEQ ID NO: 428226 - protein, 9 aa, Influenza virus
ISFYWTIVV

SEQ ID NO: 428227 - protein, 9 aa, Influenza virus
TTYKILSIY

SEQ ID NO: 428228 - protein, 9 aa, Influenza virus
REKDMTKEF

SEQ ID NO: 428229 - protein, 9 aa, Influenza virus
SPNAYQARF

SEQ ID NO: 428230 - protein, 9 aa, Influenza virus
YPLQNLTKI

SEQ ID NO: 428231 - protein, 9 aa, Influenza virus
HLTGIWDTL

SEQ ID NO: 428232 - protein, 9 aa, Influenza virus
IYATVAGSL

SEQ ID NO: 428233 - protein, 9 aa, Influenza virus
FQNVSPIWI

SEQ ID NO: 428234 - protein, 9 aa, Influenza virus
ESKLKRNEI

SEQ ID NO: 428235 - protein, 9 aa, Influenza virus
RTVGQCPKY

SEQ ID NO: 428236 - protein, 9 aa, Influenza virus
YSGSFTLPI

SEQ ID NO: 428237 - protein, 9 aa, Influenza virus
ILCTSAIAI

SEQ ID NO: 428238 - protein, 9 aa, Influenza virus
GTFDIGGLY

SEQ ID NO: 428239 - protein, 9 aa, Influenza virus
GRFYIQMCT

SEQ ID NO: 428240 - protein, 9 aa, Influenza virus
NPNQKIVTI

SEQ ID NO: 428241 - protein, 9 aa, Influenza virus
RLRMATGLR

SEQ ID NO: 428242 - protein, 9 aa, Influenza virus
RGSPGVKGW

SEQ ID NO: 428243 - protein, 9 aa, Influenza virus
IITDTFKSW

SEQ ID NO: 428244 - protein, 9 aa, Influenza virus
VTYQILSIY

SEQ ID NO: 428245 - protein, 9 aa, Influenza virus
ALFIGVGNL

SEQ ID NO: 428246 - protein, 9 aa, Influenza virus
MGLFFFCLK

SEQ ID NO: 428247 - protein, 9 aa, Influenza virus
ILIAGGLIL

SEQ ID NO: 428248 - protein, 9 aa, Influenza virus
RREVHMYYL

SEQ ID NO: 428249 - protein, 9 aa, Influenza virus
AIVMGLVFI

SEQ ID NO: 428250 - protein, 9 aa, Influenza virus
TGRDVLVLW

SEQ ID NO: 428251 - protein, 9 aa, Influenza virus
FIEGGWSGM

SEQ ID NO: 428252 - protein, 9 aa, Influenza virus
LQANLCRFL

SEQ ID NO: 428253 - protein, 9 aa, Influenza virus
FPFHKDNAL

SEQ ID NO: 428254 - protein, 9 aa, Influenza virus
SIVALCGSK

SEQ ID NO: 428255 - protein, 9 aa, Influenza virus
NYVSMEFSL

SEQ ID NO: 428256 - protein, 9 aa, Influenza virus
HLGTRQVCM

SEQ ID NO: 428257 - protein, 9 aa, Influenza virus
RTNEKYHQI

SEQ ID NO: 428258 - protein, 9 aa, Influenza virus
YQARFEAVA

SEQ ID NO: 428259 - protein, 9 aa, Influenza virus
RPWIRFNSN

SEQ ID NO: 428260 - protein, 9 aa, Influenza virus
FHNISKYAF

SEQ ID NO: 428261 - protein, 9 aa, Influenza virus
GGYKDVILW

SEQ ID NO: 428262 - protein, 9 aa, Influenza virus
RERLGSWSW

SEQ ID NO: 428263 - protein, 9 aa, Influenza virus
QMYQKCCTL

SEQ ID NO: 428264 - protein, 9 aa, Influenza virus
SRSGFEMLK

SEQ ID NO: 428265 - protein, 9 aa, Influenza virus
FQPCFYIEL

SEQ ID NO: 428266 - protein, 9 aa, Influenza virus
RREVHTYYL

SEQ ID NO: 428267 - protein, 9 aa, Influenza virus
GLIAGWYGF

SEQ ID NO: 428268 - protein, 9 aa, Influenza virus
NASWFNSFL

SEQ ID NO: 428269 - protein, 9 aa, Influenza virus
SPYRTLMSV

SEQ ID NO: 428270 - protein, 9 aa, Influenza virus
RTNEKFHQI

SEQ ID NO: 428271 - protein, 9 aa, Influenza virus
SYNARLLVL

SEQ ID NO: 428272 - protein, 9 aa, Influenza virus
ILAFILWAC

SEQ ID NO: 428273 - protein, 9 aa, Influenza virus
FGASCLILL

SEQ ID NO: 428274 - protein, 9 aa, Influenza virus
RQKWWVWLW

SEQ ID NO: 428275 - protein, 9 aa, Influenza virus
FVIREPFVA

SEQ ID NO: 428276 - protein, 9 aa, Influenza virus
TTNYYNETF

SEQ ID NO: 428277 - protein, 9 aa, Influenza virus
KLANVVRKM

SEQ ID NO: 428278 - protein, 9 aa, Influenza virus
MEWIKTRPI

SEQ ID NO: 428279 - protein, 9 aa, Influenza virus
FRYGDGVWI

SEQ ID NO: 428280 - protein, 9 aa, Influenza virus
SWMKIYWSL

SEQ ID NO: 428281 - protein, 9 aa, Influenza virus
GSSKYRQSF

SEQ ID NO: 428282 - protein, 9 aa, Influenza virus
YQAKFEAVA

SEQ ID NO: 428283 - protein, 9 aa, Influenza virus
ITYGACPRY

SEQ ID NO: 428284 - protein, 9 aa, Influenza virus
VTRREVHTY

SEQ ID NO: 428285 - protein, 9 aa, Influenza virus
FKYGNGVWI

SEQ ID NO: 428286 - protein, 9 aa, Influenza virus
FRTLMSCPI

SEQ ID NO: 428287 - protein, 9 aa, Influenza virus
LIRMIKRGI

SEQ ID NO: 428288 - protein, 9 aa, Influenza virus
NLVAPWYAY

SEQ ID NO: 428289 - protein, 9 aa, Influenza virus
EIASWAGNI

SEQ ID NO: 428290 - protein, 9 aa, Influenza virus
SVKMEKIVL

SEQ ID NO: 428291 - protein, 9 aa, Influenza virus
IRHENRMVI

SEQ ID NO: 428292 - protein, 9 aa, Influenza virus
LLFMIIGGF

SEQ ID NO: 428293 - protein, 9 aa, Influenza virus
NLLIGISNI

SEQ ID NO: 428294 - protein, 9 aa, Influenza virus
KAIDGVTNK

SEQ ID NO: 428295 - protein, 9 aa, Influenza virus
SRSGYEVLK

SEQ ID NO: 428296 - protein, 9 aa, Influenza virus
KLLKERGFF

SEQ ID NO: 428297 - protein, 9 aa, Influenza virus
TQIIVILVL

SEQ ID NO: 428298 - protein, 9 aa, Influenza virus
KLYIWGVHH

SEQ ID NO: 428299 - protein, 9 aa, Influenza virus
LQSFTPSPG

SEQ ID NO: 428300 - protein, 9 aa, Influenza virus
TSYKILSIY

SEQ ID NO: 428301 - protein, 9 aa, Influenza virus
NRFYRTCKL

SEQ ID NO: 428302 - protein, 9 aa, Influenza virus
FMARSALIL

SEQ ID NO: 428303 - protein, 9 aa, Influenza virus
MVNERTLDF

SEQ ID NO: 428304 - protein, 9 aa, Influenza virus
YESIEECLI

SEQ ID NO: 428305 - protein, 9 aa, Influenza virus
TLTNEHEEV

SEQ ID NO: 428306 - protein, 9 aa, Influenza virus
LAKSVFNNL

SEQ ID NO: 428307 - protein, 9 aa, Influenza virus
NVYKILSIY

SEQ ID NO: 428308 - protein, 9 aa, Influenza virus
MDYYWAILK

SEQ ID NO: 428309 - protein, 9 aa, Influenza virus
SQVEQRINM

SEQ ID NO: 428310 - protein, 9 aa, Influenza virus
KMNIQILIL

SEQ ID NO: 428311 - protein, 9 aa, Influenza virus
RGLQRRRFI

SEQ ID NO: 428312 - protein, 9 aa, Influenza virus
FQNASRHHM

SEQ ID NO: 428313 - protein, 9 aa, Influenza virus
KMKAIIVVL

SEQ ID NO: 428314 - protein, 9 aa, Influenza virus
FVANFSMEL

SEQ ID NO: 428315 - protein, 9 aa, Influenza virus
MVTQRTVGK

SEQ ID NO: 428316 - protein, 9 aa, Influenza virus
ALLPFDIDK

SEQ ID NO: 428317 - protein, 9 aa, Influenza virus
RMATGLRNI

SEQ ID NO: 428318 - protein, 9 aa, Influenza virus
LYKKDSSYI

SEQ ID NO: 428319 - protein, 9 aa, Influenza virus
RRDYFTAEV

SEQ ID NO: 428320 - protein, 9 aa, Influenza virus
SSFERFEMF

SEQ ID NO: 428321 - protein, 9 aa, Influenza virus
RSWRKQILR

SEQ ID NO: 428322 - protein, 9 aa, Influenza virus
ITFMQALQL

SEQ ID NO: 428323 - protein, 9 aa, Influenza virus
QAYTKVMYF

SEQ ID NO: 428324 - protein, 9 aa, Influenza virus
LVISTDLSY

SEQ ID NO: 428325 - protein, 9 aa, Influenza virus
ISKSRATEY

SEQ ID NO: 428326 - protein, 9 aa, Influenza virus
HRTLLMSEL

SEQ ID NO: 428327 - protein, 9 aa, Influenza virus
MSQSRTREI

SEQ ID NO: 428328 - protein, 9 aa, Influenza virus
YEAIEECLI

SEQ ID NO: 428329 - protein, 9 aa, Influenza virus
KILKIRKGK

SEQ ID NO: 428330 - protein, 9 aa, Influenza virus
WLGRTISTA

SEQ ID NO: 428331 - protein, 9 aa, Influenza virus
HHAVPNGTI

SEQ ID NO: 428332 - protein, 9 aa, Influenza virus
HLTGTWDTL

SEQ ID NO: 428333 - protein, 9 aa, Influenza virus
AAIKGVGTM

SEQ ID NO: 428334 - protein, 9 aa, Influenza virus
TTAVAVLKY

SEQ ID NO: 428335 - protein, 9 aa, Influenza virus
KIRVKRRPV

SEQ ID NO: 428336 - protein, 9 aa, Influenza virus
IASVPASRY

SEQ ID NO: 428337 - protein, 9 aa, Influenza virus
KVNTQFEAV

SEQ ID NO: 428338 - protein, 9 aa, Influenza virus
GYKNWILWI

SEQ ID NO: 428339 - protein, 9 aa, Influenza virus
GSINTRLPF

SEQ ID NO: 428340 - protein, 9 aa, Influenza virus
GTFGPVHFR

SEQ ID NO: 428341 - protein, 9 aa, Influenza virus
FPFHKDNAV

SEQ ID NO: 428342 - protein, 9 aa, Influenza virus
WGIHHPSSI

SEQ ID NO: 428343 - protein, 9 aa, Influenza virus
FVRTLFQQM

SEQ ID NO: 428344 - protein, 9 aa, Influenza virus
ATKRIRLAI

SEQ ID NO: 428345 - protein, 9 aa, Influenza virus
SLFSSIKKY

SEQ ID NO: 428346 - protein, 9 aa, Influenza virus
TKMEAILVV

SEQ ID NO: 428347 - protein, 9 aa, Influenza virus
NPKSKLFTL

SEQ ID NO: 428348 - protein, 9 aa, Influenza virus
AEDIGNGCF

SEQ ID NO: 428349 - protein, 9 aa, Influenza virus
QVIVDNSNW

SEQ ID NO: 428350 - protein, 9 aa, Influenza virus
LIGKTSWSY

SEQ ID NO: 428351 - protein, 9 aa, Influenza virus
PSFFRNVVW

SEQ ID NO: 428352 - protein, 9 aa, Influenza virus
QAYTKIMYF

SEQ ID NO: 428353 - protein, 9 aa, Influenza virus
YQSGTYPVI

SEQ ID NO: 428354 - protein, 9 aa, Influenza virus
YVRQNTLKL

SEQ ID NO: 428355 - protein, 9 aa, Influenza virus
AMEHTSQYL

SEQ ID NO: 428356 - protein, 9 aa, Influenza virus
GVKLIQGYK

SEQ ID NO: 428357 - protein, 9 aa, Influenza virus
NILLHIASI

SEQ ID NO: 428358 - protein, 9 aa, Influenza virus
PSAPHGLCY

SEQ ID NO: 428359 - protein, 9 aa, Influenza virus
FTIGECPRY

SEQ ID NO: 428360 - protein, 9 aa, Influenza virus
FSRLNWLTK

SEQ ID NO: 428361 - protein, 9 aa, Influenza virus
ITNKINSII

SEQ ID NO: 428362 - protein, 9 aa, Influenza virus
FALGQGTTL

SEQ ID NO: 428363 - protein, 9 aa, Influenza virus
CPFKGFFPF

SEQ ID NO: 428364 - protein, 9 aa, Influenza virus
STAASSLVL

SEQ ID NO: 428365 - protein, 9 aa, Influenza virus
FVRTLFQQM

SEQ ID NO: 428366 - protein, 9 aa, Influenza virus
GTYKILTIY

SEQ ID NO: 428367 - protein, 9 aa, Influenza virus
RRVDVNPGH

SEQ ID NO: 428368 - protein, 9 aa, Influenza virus
RPQVNGQSG

SEQ ID NO: 428369 - protein, 9 aa, Influenza virus
TQYREEALL

SEQ ID NO: 428370 - protein, 9 aa, Influenza virus
FIIKGRSHL

SEQ ID NO: 428371 - protein, 9 aa, Influenza virus
GVKGFSFKY

SEQ ID NO: 428372 - protein, 9 aa, Influenza virus
FSFNGAFVA

SEQ ID NO: 428373 - protein, 9 aa, Influenza virus
VPQAQNRGL

SEQ ID NO: 428374 - protein, 9 aa, Influenza virus
NMSKKKSYI

SEQ ID NO: 428375 - protein, 9 aa, Influenza virus
QSRFEAVAW

SEQ ID NO: 428376 - protein, 9 aa, Influenza virus
GTSSVYIEV

SEQ ID NO: 428377 - protein, 9 aa, Influenza virus
RILFIEEGK

SEQ ID NO: 428378 - protein, 9 aa, Influenza virus
ASTGGQAFY

SEQ ID NO: 428379 - protein, 9 aa, Influenza virus
WGVHHSSSL

SEQ ID NO: 428380 - protein, 9 aa, Influenza virus
QVKLSSGYK

SEQ ID NO: 428381 - protein, 9 aa, Influenza virus
VQNRGLFGA

SEQ ID NO: 428382 - protein, 9 aa, Influenza virus
RMQLRDNAK

SEQ ID NO: 428383 - protein, 9 aa, Influenza virus
RTSYRTLLM

SEQ ID NO: 428384 - protein, 9 aa, Influenza virus
GTFDLGGLY

SEQ ID NO: 428385 - protein, 9 aa, Influenza virus
FIAPNRASF

SEQ ID NO: 428386 - protein, 9 aa, Influenza virus
SSSSFYAEM

SEQ ID NO: 428387 - protein, 9 aa, Influenza virus
LIFSARSAL

SEQ ID NO: 428388 - protein, 9 aa, Influenza virus
KVMYFHKGL

SEQ ID NO: 428389 - protein, 9 aa, Influenza virus
MKRKRNSSI

SEQ ID NO: 428390 - protein, 9 aa, Influenza virus
FSISCFLLA

SEQ ID NO: 428391 - protein, 9 aa, Influenza virus
AIGDCPKYV

SEQ ID NO: 428392 - protein, 9 aa, Influenza virus
SVRNGTYKY

SEQ ID NO: 428393 - protein, 9 aa, Influenza virus
RISHRTLLM

SEQ ID NO: 428394 - protein, 9 aa, Influenza virus
KTNDKYHQI

SEQ ID NO: 428395 - protein, 9 aa, Influenza virus
VLRPGQTLR

SEQ ID NO: 428396 - protein, 9 aa, Influenza virus
FQNVSPVWI

SEQ ID NO: 428397 - protein, 9 aa, Influenza virus
SPGMMMGMF

SEQ ID NO: 428398 - protein, 9 aa, Influenza virus
WPDGANINL

SEQ ID NO: 428399 - protein, 9 aa, Influenza virus
RLATGLRNI

SEQ ID NO: 428400 - protein, 9 aa, Influenza virus
RSSFYAEMK

SEQ ID NO: 428401 - protein, 9 aa, Influenza virus
YQGRLCNPM

SEQ ID NO: 428402 - protein, 9 aa, Influenza virus
IASMRRSYF

SEQ ID NO: 428403 - protein, 9 aa, Influenza virus
ASYKIFKSY

SEQ ID NO: 428404 - protein, 9 aa, Influenza virus
IFMARSALI

SEQ ID NO: 428405 - protein, 9 aa, Influenza virus
SLSLAIMVA

SEQ ID NO: 428406 - protein, 9 aa, Influenza virus
GRIDFHWML

SEQ ID NO: 428407 - protein, 9 aa, Influenza virus
RTELISPNK

SEQ ID NO: 428408 - protein, 9 aa, Influenza virus
GIYQILSIY

SEQ ID NO: 428409 - protein, 9 aa, Influenza virus
LAMITYITK

SEQ ID NO: 428410 - protein, 9 aa, Influenza virus
APYRSLIRF

SEQ ID NO: 428411 - protein, 9 aa, Influenza virus
GVRLTQGYK

SEQ ID NO: 428412 - protein, 9 aa, Influenza virus
RPLVRSQSG

SEQ ID NO: 428413 - protein, 9 aa, Influenza virus
ENKRYGPAL

SEQ ID NO: 428414 - protein, 9 aa, Influenza virus
LAIMIAGLF

SEQ ID NO: 428415 - protein, 9 aa, Influenza virus
VTRREVHVY

SEQ ID NO: 428416 - protein, 9 aa, Influenza virus
MGYICSGIF

SEQ ID NO: 428417 - protein, 9 aa, Influenza virus
GVDSDTTSW

SEQ ID NO: 428418 - protein, 9 aa, Influenza virus
NRIQIDPVK

SEQ ID NO: 428419 - protein, 9 aa, Influenza virus
TFQNISPVW

SEQ ID NO: 428420 - protein, 9 aa, Influenza virus
ISKDSRSGY

SEQ ID NO: 428421 - protein, 9 aa, Influenza virus
DRSPHRTLL

SEQ ID NO: 428422 - protein, 9 aa, Influenza virus
VAKDNAVRF

SEQ ID NO: 428423 - protein, 9 aa, Influenza virus
KPFQNVNKI

SEQ ID NO: 428424 - protein, 9 aa, Influenza virus
CIASSTVMV

SEQ ID NO: 428425 - protein, 9 aa, Influenza virus
LITVGSSKY

SEQ ID NO: 428426 - protein, 9 aa, Influenza virus
NLVAPRGHY

SEQ ID NO: 428427 - protein, 9 aa, Influenza virus
LWMCSNGSY

SEQ ID NO: 428428 - protein, 9 aa, Influenza virus
FEATGNLVA

SEQ ID NO: 428429 - protein, 9 aa, Influenza virus
IITGTIKSW

SEQ ID NO: 428430 - protein, 9 aa, Influenza virus
KLSSGYKDV

SEQ ID NO: 428431 - protein, 9 aa, Influenza virus
LEENTTYKI

SEQ ID NO: 428432 - protein, 9 aa, Influenza virus
IFMARSALI

SEQ ID NO: 428433 - protein, 9 aa, Influenza virus
VSNSDWSGY

SEQ ID NO: 428434 - protein, 9 aa, Influenza virus
RGLQRRRFV

SEQ ID NO: 428435 - protein, 9 aa, Influenza virus
LHDSNVKNL

SEQ ID NO: 428436 - protein, 9 aa, Influenza virus
MARLGRGYM

SEQ ID NO: 428437 - protein, 9 aa, Influenza virus
NELYGTQSL

SEQ ID NO: 428438 - protein, 9 aa, Influenza virus
YSLVGVDPF

SEQ ID NO: 428439 - protein, 9 aa, Influenza virus
QTAAQRAMM

SEQ ID NO: 428440 - protein, 9 aa, Influenza virus
MGNGCFTIY

SEQ ID NO: 428441 - protein, 9 aa, Influenza virus
SQTVINNYY

SEQ ID NO: 428442 - protein, 9 aa, Influenza virus
YLSGREWSY

SEQ ID NO: 428443 - protein, 9 aa, Influenza virus
NPSLRMKWM

SEQ ID NO: 428444 - protein, 9 aa, Influenza virus
ITDTFKSWK

SEQ ID NO: 428445 - protein, 9 aa, Influenza virus
ISFSMSCFV

SEQ ID NO: 428446 - protein, 9 aa, Influenza virus
SWLGRTISK

SEQ ID NO: 428447 - protein, 9 aa, Influenza virus
FQNTSRHYM

SEQ ID NO: 428448 - protein, 9 aa, Influenza virus
WSWHDGAIL

SEQ ID NO: 428449 - protein, 9 aa, Influenza virus
NPNQKIMCI

SEQ ID NO: 428450 - protein, 9 aa, Influenza virus
TLMDALLGD

SEQ ID NO: 428451 - protein, 9 aa, Influenza virus
CSIDECRTF

SEQ ID NO: 428452 - protein, 9 aa, Influenza virus
ALILVALAL

SEQ ID NO: 428453 - protein, 9 aa, Influenza virus
HSGICPVVF

SEQ ID NO: 428454 - protein, 9 aa, Influenza virus
ALTGGQSFY

SEQ ID NO: 428455 - protein, 9 aa, Influenza virus
QTYDWTLNR

SEQ ID NO: 428456 - protein, 9 aa, Influenza virus
GTYKILTIY

SEQ ID NO: 428457 - protein, 9 aa, Influenza virus
FVYFVEILA

SEQ ID NO: 428458 - protein, 9 aa, Influenza virus
SQYREEALL

SEQ ID NO: 428459 - protein, 9 aa, Influenza virus
RLPLPLCPF

SEQ ID NO: 428460 - protein, 9 aa, Influenza virus
TMDYYWGIL

SEQ ID NO: 428461 - protein, 9 aa, Influenza virus
KSRVDNHSM

SEQ ID NO: 428462 - protein, 9 aa, Influenza virus
MFLAMITYI

SEQ ID NO: 428463 - protein, 9 aa, Influenza virus
VTFSFNGAF

SEQ ID NO: 428464 - protein, 9 aa, Influenza virus
QNRIRIDPV

SEQ ID NO: 428465 - protein, 9 aa, Influenza virus
AEDRGNGCF

SEQ ID NO: 428466 - protein, 9 aa, Influenza virus
IMFESNGGL

SEQ ID NO: 428467 - protein, 9 aa, Influenza virus
VASSLALAI

SEQ ID NO: 428468 - protein, 9 aa, Influenza virus
VLIAGGLIL

SEQ ID NO: 428469 - protein, 9 aa, Influenza virus
KPRPRRGLF

SEQ ID NO: 428470 - protein, 9 aa, Influenza virus
KILFIEEGK

SEQ ID NO: 428471 - protein, 9 aa, Influenza virus
RRGLFGAIA

SEQ ID NO: 428472 - protein, 9 aa, Influenza virus
STAASSLAL

SEQ ID NO: 428473 - protein, 9 aa, Influenza virus
NEEALRQII

SEQ ID NO: 428474 - protein, 9 aa, Influenza virus
IYSTAASSL

SEQ ID NO: 428475 - protein, 9 aa, Influenza virus
ITFLQALQL

SEQ ID NO: 428476 - protein, 9 aa, Influenza virus
MLGFVFTLT

SEQ ID NO: 428477 - protein, 9 aa, Influenza virus
VTTVTLHFK

SEQ ID NO: 428478 - protein, 9 aa, Influenza virus
THNGKLCRL

SEQ ID NO: 428479 - protein, 9 aa, Influenza virus
YLSTNSTET

SEQ ID NO: 428480 - protein, 9 aa, Influenza virus
YVRKASLRL

SEQ ID NO: 428481 - protein, 9 aa, Influenza virus
AIWTSSSSI

SEQ ID NO: 428482 - protein, 9 aa, Influenza virus
RQASPSCLV

SEQ ID NO: 428483 - protein, 9 aa, Influenza virus
MENEMTLDF

SEQ ID NO: 428484 - protein, 9 aa, Influenza virus
SLISWPLSS

SEQ ID NO: 428485 - protein, 9 aa, Influenza virus
TPKRNRSIL

SEQ ID NO: 428486 - protein, 9 aa, Influenza virus
QSYFQLFLV

SEQ ID NO: 428487 - protein, 9 aa, Influenza virus
GVMNTSKPL

SEQ ID NO: 428488 - protein, 9 aa, Influenza virus
QTRRSFELK

SEQ ID NO: 428489 - protein, 9 aa, Influenza virus
QFGRIDFHW

SEQ ID NO: 428490 - protein, 9 aa, Influenza virus
KAVRGDLNF

SEQ ID NO: 428491 - protein, 9 aa, Influenza virus
VTNKVNSII

SEQ ID NO: 428492 - protein, 9 aa, Influenza virus
AIDGVTNKV

SEQ ID NO: 428493 - protein, 9 aa, Influenza virus
LRSKYWAIR

SEQ ID NO: 428494 - protein, 9 aa, Influenza virus
FQNISPVWI

SEQ ID NO: 428495 - protein, 9 aa, Influenza virus
ITYGACPKY

SEQ ID NO: 428496 - protein, 9 aa, Influenza virus
KRNEIKGVK

SEQ ID NO: 428497 - protein, 9 aa, Influenza virus
SVKNGTYNY

SEQ ID NO: 428498 - protein, 9 aa, Influenza virus
KSCVNRCFY

SEQ ID NO: 428499 - protein, 9 aa, Influenza virus
LLNASCAAM

SEQ ID NO: 428500 - protein, 9 aa, Influenza virus
TYVNNTTII

SEQ ID NO: 428501 - protein, 9 aa, Influenza virus
KEGYSLVGV

SEQ ID NO: 428502 - protein, 9 aa, Influenza virus
ALLIGIGNL

SEQ ID NO: 428503 - protein, 9 aa, Influenza virus
FYRNLIWFV

SEQ ID NO: 428504 - protein, 9 aa, Influenza virus
SSFEQITFM

SEQ ID NO: 428505 - protein, 9 aa, Influenza virus
FIEGGWQGL

SEQ ID NO: 428506 - protein, 9 aa, Influenza virus
RSLMLATGM

SEQ ID NO: 428507 - protein, 9 aa, Influenza virus
KMNTQFEAI

SEQ ID NO: 428508 - protein, 9 aa, Influenza virus
RQTRGLFGA

SEQ ID NO: 428509 - protein, 9 aa, Influenza virus
RTLLAKSVF

SEQ ID NO: 428510 - protein, 9 aa, Influenza virus
GRNCTIPCF

SEQ ID NO: 428511 - protein, 9 aa, Influenza virus
LTDAEMNKL

SEQ ID NO: 428512 - protein, 9 aa, Influenza virus
IRMATNECR

SEQ ID NO: 428513 - protein, 9 aa, Influenza virus
KVLSIYSCI

SEQ ID NO: 428514 - protein, 9 aa, Influenza virus
LYGTQPLSI

SEQ ID NO: 428515 - protein, 9 aa, Influenza virus
QAYQKRMGL

SEQ ID NO: 428516 - protein, 9 aa, Influenza virus
KLYGSGSKL

SEQ ID NO: 428517 - protein, 9 aa, Influenza virus
SMGIYQILA

SEQ ID NO: 428518 - protein, 9 aa, Influenza virus
SSFQVDCFI

SEQ ID NO: 428519 - protein, 9 aa, Influenza virus
ELRRQKSLI

SEQ ID NO: 428520 - protein, 9 aa, Influenza virus
VTDSEMNRL

SEQ ID NO: 428521 - protein, 9 aa, Influenza virus
TTYKILSIY

SEQ ID NO: 428522 - protein, 9 aa, Influenza virus
EVCLKWELM

SEQ ID NO: 428523 - protein, 9 aa, Influenza virus
LPVSGGTSS

SEQ ID NO: 428524 - protein, 9 aa, Influenza virus
CSISECRTF

SEQ ID NO: 428525 - protein, 9 aa, Influenza virus
SVRNGTYNY

SEQ ID NO: 428526 - protein, 9 aa, Influenza virus
WFRNVLSVA

SEQ ID NO: 428527 - protein, 9 aa, Influenza virus
RRLTTTIKP

SEQ ID NO: 428528 - protein, 9 aa, Influenza virus
VILEENTTY

SEQ ID NO: 428529 - protein, 9 aa, Influenza virus
ISSMVEAMM

SEQ ID NO: 428530 - protein, 9 aa, Influenza virus
NTFGDCPKY

SEQ ID NO: 428531 - protein, 9 aa, Influenza virus
DSLTEIWSY

SEQ ID NO: 428532 - protein, 9 aa, Influenza virus
EMLKVPNAL

SEQ ID NO: 428533 - protein, 9 aa, Influenza virus
ETGYVCGKF

SEQ ID NO: 428534 - protein, 9 aa, Influenza virus
YLIGKTSWS

SEQ ID NO: 428535 - protein, 9 aa, Influenza virus
LLQSAILSL

SEQ ID NO: 428536 - protein, 9 aa, Influenza virus
YTMDTVNRT

SEQ ID NO: 428537 - protein, 9 aa, Influenza virus
YKMNTQILV

SEQ ID NO: 428538 - protein, 9 aa, Influenza virus
ISSMVEAMI

SEQ ID NO: 428539 - protein, 9 aa, Influenza virus
VETYVLSVI

SEQ ID NO: 428540 - protein, 9 aa, Influenza virus
RGRHANGTI

SEQ ID NO: 428541 - protein, 9 aa, Influenza virus
SRSPGNAEI

SEQ ID NO: 428542 - protein, 9 aa, Influenza virus
GQWNWPDGA

SEQ ID NO: 428543 - protein, 9 aa, Influenza virus
SVREKDMTK

SEQ ID NO: 428544 - protein, 9 aa, Influenza virus
YRGRLCNPL

SEQ ID NO: 428545 - protein, 9 aa, Influenza virus
LNRLNINSV

SEQ ID NO: 428546 - protein, 9 aa, Influenza virus
HSNDQGAGY

SEQ ID NO: 428547 - protein, 9 aa, Influenza virus
FSDNGGLIA

SEQ ID NO: 428548 - protein, 9 aa, Influenza virus
VYQAKFESV

SEQ ID NO: 428549 - protein, 9 aa, Influenza virus
FSFGASCLI

SEQ ID NO: 428550 - protein, 9 aa, Influenza virus
TSCFDGKEW

SEQ ID NO: 428551 - protein, 9 aa, Influenza virus
RPITEINTW

SEQ ID NO: 428552 - protein, 9 aa, Influenza virus
KLAIGPRNV

SEQ ID NO: 428553 - protein, 9 aa, Influenza virus
YIKQGSLKL

SEQ ID NO: 428554 - protein, 9 aa, Influenza virus
NMRCTISLV

SEQ ID NO: 428555 - protein, 9 aa, Influenza virus
ITNKANSII

SEQ ID NO: 428556 - protein, 9 aa, Influenza virus
GQLKLATGL

SEQ ID NO: 428557 - protein, 9 aa, Influenza virus
FIAPENAYK

SEQ ID NO: 428558 - protein, 9 aa, Influenza virus
ILSVYSTVA

SEQ ID NO: 428559 - protein, 9 aa, Influenza virus
ISLVKTTLF

SEQ ID NO: 428560 - protein, 9 aa, Influenza virus
RVSFYWTIV

SEQ ID NO: 428561 - protein, 9 aa, Influenza virus
YQILAIYAT

SEQ ID NO: 428562 - protein, 9 aa, Influenza virus
KSCLPACIY

SEQ ID NO: 428563 - protein, 9 aa, Influenza virus
VPKRNRSIL

SEQ ID NO: 428564 - protein, 9 aa, Influenza virus
YQKRMGVQL

SEQ ID NO: 428565 - protein, 9 aa, Influenza virus
MEWLKTRPI

SEQ ID NO: 428566 - protein, 9 aa, Influenza virus
VMKRKRNSS

SEQ ID NO: 428567 - protein, 9 aa, Influenza virus
TTIKTWAGK

SEQ ID NO: 428568 - protein, 9 aa, Influenza virus
STVSSFERF

SEQ ID NO: 428569 - protein, 9 aa, Influenza virus
FRGLMSTPL

SEQ ID NO: 428570 - protein, 9 aa, Influenza virus
RLIQNSMTI

SEQ ID NO: 428571 - protein, 9 aa, Influenza virus
SECVCHNGV

SEQ ID NO: 428572 - protein, 9 aa, Influenza virus
KTNKQFELI

SEQ ID NO: 428573 - protein, 9 aa, Influenza virus
AQTDCVLEA

SEQ ID NO: 428574 - protein, 9 aa, Influenza virus
IAPNRASFF

SEQ ID NO: 428575 - protein, 9 aa, Influenza virus
RGNPGVKGW

SEQ ID NO: 428576 - protein, 9 aa, Influenza virus
MTRGLFGAI

SEQ ID NO: 428577 - protein, 9 aa, Influenza virus
SPHRSLMSC

SEQ ID NO: 428578 - protein, 9 aa, Influenza virus
MQFSSLTVN

SEQ ID NO: 428579 - protein, 9 aa, Influenza virus
SRLNRNEIK

SEQ ID NO: 428580 - protein, 9 aa, Influenza virus
WTRDSVTEL

SEQ ID NO: 428581 - protein, 9 aa, Influenza virus
GRIDFHWLL

SEQ ID NO: 428582 - protein, 9 aa, Influenza virus
SECVCHKGI

SEQ ID NO: 428583 - protein, 9 aa, Influenza virus
TTYRILSIY

SEQ ID NO: 428584 - protein, 9 aa, Influenza virus
NTGSYVRLY

SEQ ID NO: 428585 - protein, 9 aa, Influenza virus
MSSVKNGTY

SEQ ID NO: 428586 - protein, 9 aa, Influenza virus
FIIKGRSHL

SEQ ID NO: 428587 - protein, 9 aa, Influenza virus
ARNIVRRAI

SEQ ID NO: 428588 - protein, 9 aa, Influenza virus
NPNQKIITI

SEQ ID NO: 428589 - protein, 9 aa, Influenza virus
KPFQNVNKV

SEQ ID NO: 428590 - protein, 9 aa, Influenza virus
RIGDGQRSW

SEQ ID NO: 428591 - protein, 9 aa, Influenza virus
SRMQFSSLT

SEQ ID NO: 428592 - protein, 9 aa, Influenza virus
RSRSGFEML

SEQ ID NO: 428593 - protein, 9 aa, Influenza virus
NSTWVSQTY

SEQ ID NO: 428594 - protein, 9 aa, Influenza virus
ILKIRKGKI

SEQ ID NO: 428595 - protein, 9 aa, Influenza virus
HLTGIWDTL

SEQ ID NO: 428596 - protein, 9 aa, Influenza virus
GAMASQGTK

SEQ ID NO: 428597 - protein, 9 aa, Influenza virus
YTGAINSSK

SEQ ID NO: 428598 - protein, 9 aa, Influenza virus
YAFGNCPKY

SEQ ID NO: 428599 - protein, 9 aa, Influenza virus
VMGLVFFCL

SEQ ID NO: 428600 - protein, 9 aa, Influenza virus
VLATGLRNA

SEQ ID NO: 428601 - protein, 9 aa, Influenza virus
GSIPNDKPF

SEQ ID NO: 428602 - protein, 9 aa, Influenza virus
GSIKTKLPF

SEQ ID NO: 428603 - protein, 9 aa, Influenza virus
AAWSSSSCF

SEQ ID NO: 428604 - protein, 9 aa, Influenza virus
FQNVSPLWI

SEQ ID NO: 428605 - protein, 9 aa, Influenza virus
YINTAMLNA

SEQ ID NO: 428606 - protein, 9 aa, Influenza virus
GTSSVYVEV

SEQ ID NO: 428607 - protein, 9 aa, Influenza virus
KMNTQFTAV

SEQ ID NO: 428608 - protein, 9 aa, Influenza virus
IQHPELTGL

SEQ ID NO: 428609 - protein, 9 aa, Influenza virus
RSWKKQILR

SEQ ID NO: 428610 - protein, 9 aa, Influenza virus
VMTDGPANK

SEQ ID NO: 428611 - protein, 9 aa, Influenza virus
YARLYIWGV

SEQ ID NO: 428612 - protein, 9 aa, Influenza virus
SISCFLLIA

SEQ ID NO: 428613 - protein, 9 aa, Influenza virus
EMKWLLSSK

SEQ ID NO: 428614 - protein, 9 aa, Influenza virus
VINNITTTI

SEQ ID NO: 428615 - protein, 9 aa, Influenza virus
WMRISNETI

SEQ ID NO: 428616 - protein, 9 aa, Influenza virus
KTNLYGFIV

SEQ ID NO: 428617 - protein, 9 aa, Influenza virus
RRGVKGFGF

SEQ ID NO: 428618 - protein, 9 aa, Influenza virus
TTNTINRNF

SEQ ID NO: 428619 - protein, 9 aa, Influenza virus
KAINEITTK

SEQ ID NO: 428620 - protein, 9 aa, Influenza virus
KEKENSYPM

SEQ ID NO: 428621 - protein, 9 aa, Influenza virus
HVLVTREPY

SEQ ID NO: 428622 - protein, 9 aa, Influenza virus
NTKLPFQNL

SEQ ID NO: 428623 - protein, 9 aa, Influenza virus
LRSGYEMLK

SEQ ID NO: 428624 - protein, 9 aa, Influenza virus
FSVQRSLPF

SEQ ID NO: 428625 - protein, 9 aa, Influenza virus
QTKRSFELK

SEQ ID NO: 428626 - protein, 9 aa, Influenza virus
RVFLAMITY

SEQ ID NO: 428627 - protein, 9 aa, Influenza virus
NLIAPRGYY

SEQ ID NO: 428628 - protein, 9 aa, Influenza virus
LLMIIGGFI

SEQ ID NO: 428629 - protein, 9 aa, Influenza virus
SLRGRGSTL

SEQ ID NO: 428630 - protein, 9 aa, Influenza virus
KLRSGFEML

SEQ ID NO: 428631 - protein, 9 aa, Influenza virus
RPFVRGQQG

SEQ ID NO: 428632 - protein, 9 aa, Influenza virus
IPQIESRGL

SEQ ID NO: 428633 - protein, 9 aa, Influenza virus
WASNSLIAL

SEQ ID NO: 428634 - protein, 9 aa, Influenza virus
MVNGWYGFR

SEQ ID NO: 428635 - protein, 9 aa, Influenza virus
WAVGRCPRY

SEQ ID NO: 428636 - protein, 9 aa, Influenza virus
RMTFYWTII

SEQ ID NO: 428637 - protein, 9 aa, Influenza virus
SIGSWSHNI

SEQ ID NO: 428638 - protein, 9 aa, Influenza virus
RAVGKCPRY

SEQ ID NO: 428639 - protein, 9 aa, Influenza virus
DLWAYNAEL

SEQ ID NO: 428640 - protein, 9 aa, Influenza virus
FALSQGTTL

SEQ ID NO: 428641 - protein, 9 aa, Influenza virus
HLKFKADLI

SEQ ID NO: 428642 - protein, 9 aa, Influenza virus
MMAMKYPIT

SEQ ID NO: 428643 - protein, 9 aa, Influenza virus
VSWTSNSII

SEQ ID NO: 428644 - protein, 9 aa, Influenza virus
TTAVAVLKY

SEQ ID NO: 428645 - protein, 9 aa, Influenza virus
SMLKPGETL

SEQ ID NO: 428646 - protein, 9 aa, Influenza virus
SGYSGSFSV

SEQ ID NO: 428647 - protein, 9 aa, Influenza virus
FQIQGVKLI

SEQ ID NO: 428648 - protein, 9 aa, Influenza virus
CPFRGFFPF

SEQ ID NO: 428649 - protein, 9 aa, Influenza virus
HILSKDNAI

SEQ ID NO: 428650 - protein, 9 aa, Influenza virus
SMGVYQILA

SEQ ID NO: 428651 - protein, 9 aa, Influenza virus
SRAGYEMLK

SEQ ID NO: 428652 - protein, 9 aa, Influenza virus
ITYGACPRY

SEQ ID NO: 428653 - protein, 9 aa, Influenza virus
AIGECPKYV

SEQ ID NO: 428654 - protein, 9 aa, Influenza virus
TPRGEDSQF

SEQ ID NO: 428655 - protein, 9 aa, Influenza virus
MASIRNNTY

SEQ ID NO: 428656 - protein, 9 aa, Influenza virus
AINKITNKV

SEQ ID NO: 428657 - protein, 9 aa, Influenza virus
KSLLLATGM

SEQ ID NO: 428658 - protein, 9 aa, Influenza virus
NPGVKGWAF

SEQ ID NO: 428659 - protein, 9 aa, Influenza virus
LTVPEWSYI

SEQ ID NO: 428660 - protein, 9 aa, Influenza virus
RAIDGVTNK

SEQ ID NO: 428661 - protein, 9 aa, Influenza virus
CKIEGWVVV

SEQ ID NO: 428662 - protein, 9 aa, Influenza virus
FHQCDNDCM

SEQ ID NO: 428663 - protein, 9 aa, Influenza virus
MTDGSASGK

SEQ ID NO: 428664 - protein, 9 aa, Influenza virus
RMQLRDNVK

SEQ ID NO: 428665 - protein, 9 aa, Influenza virus
GLSMVRSDK

SEQ ID NO: 428666 - protein, 9 aa, Influenza virus
DSFYAELKW

SEQ ID NO: 428667 - protein, 9 aa, Influenza virus
ENKKYGPAL

SEQ ID NO: 428668 - protein, 9 aa, Influenza virus
LLMDSLKLS

SEQ ID NO: 428669 - protein, 9 aa, Influenza virus
WMACNSAAF

SEQ ID NO: 428670 - protein, 9 aa, Influenza virus
SSCFDGKEW

SEQ ID NO: 428671 - protein, 9 aa, Influenza virus
DRISHRTLL

SEQ ID NO: 428672 - protein, 9 aa, Influenza virus
YNRRPTTTI

SEQ ID NO: 428673 - protein, 9 aa, Influenza virus
AEDKGNGCF

SEQ ID NO: 428674 - protein, 9 aa, Influenza virus
IMWGIHHPS

SEQ ID NO: 428675 - protein, 9 aa, Influenza virus
YVWWASNSL

SEQ ID NO: 428676 - protein, 9 aa, Influenza virus
GRMDYYWAV

SEQ ID NO: 428677 - protein, 9 aa, Influenza virus
LNASWFNSF

SEQ ID NO: 428678 - protein, 9 aa, Influenza virus
EHDANVRNL

SEQ ID NO: 428679 - protein, 9 aa, Influenza virus
GSDIGFMPK

SEQ ID NO: 428680 - protein, 9 aa, Influenza virus
ITFESNGGF

SEQ ID NO: 428681 - protein, 9 aa, Influenza virus
SRSGFEMLR

SEQ ID NO: 428682 - protein, 9 aa, Influenza virus
NSGDYARLY

SEQ ID NO: 428683 - protein, 9 aa, Influenza virus
TQYREESLL

SEQ ID NO: 428684 - protein, 9 aa, Influenza virus
MRWLTLKLG

SEQ ID NO: 428685 - protein, 9 aa, Influenza virus
SLSLAIMIA

SEQ ID NO: 428686 - protein, 9 aa, Influenza virus
LTIGECPRY

SEQ ID NO: 428687 - protein, 9 aa, Influenza virus
FLGQWDWPD

SEQ ID NO: 428688 - protein, 9 aa, Influenza virus
GRQEKNPAL

SEQ ID NO: 428689 - protein, 9 aa, Influenza virus
VLIGQGDVV

SEQ ID NO: 428690 - protein, 9 aa, Influenza virus
YQARFESVA

SEQ ID NO: 428691 - protein, 9 aa, Influenza virus
SLIASSGTL

SEQ ID NO: 428692 - protein, 9 aa, Influenza virus
VWWASNSLI

SEQ ID NO: 428693 - protein, 9 aa, Influenza virus
AAIKGIGTM

SEQ ID NO: 428694 - protein, 9 aa, Influenza virus
IRTWAKNIL

SEQ ID NO: 428695 - protein, 9 aa, Influenza virus
KVWWTSNSI

SEQ ID NO: 428696 - protein, 9 aa, Influenza virus
RMYALHQGT

SEQ ID NO: 428697 - protein, 9 aa, Influenza virus
FWMCPNGSL

SEQ ID NO: 428698 - protein, 9 aa, Influenza virus
LTTTPTKSY

SEQ ID NO: 428699 - protein, 9 aa, Influenza virus
QIVVTREPY

SEQ ID NO: 428700 - protein, 9 aa, Influenza virus
NASAVIWYK

SEQ ID NO: 428701 - protein, 9 aa, Influenza virus
VMEHTSQYL

SEQ ID NO: 428702 - protein, 9 aa, Influenza virus
LTIGECPRY

SEQ ID NO: 428703 - protein, 9 aa, Influenza virus
NPAHKSQLI

SEQ ID NO: 428704 - protein, 9 aa, Influenza virus
MGFRYSGIK

SEQ ID NO: 428705 - protein, 9 aa, Influenza virus
NLIAPRGYF

SEQ ID NO: 428706 - protein, 9 aa, Influenza virus
LINDPWVLL

SEQ ID NO: 428707 - protein, 9 aa, Influenza virus
FQNVHPVTI

SEQ ID NO: 428708 - protein, 9 aa, Influenza virus
LYGAQSLSI

SEQ ID NO: 428709 - protein, 9 aa, Influenza virus
LTKATNGNY

SEQ ID NO: 428710 - protein, 9 aa, Influenza virus
CQITGFAPF

SEQ ID NO: 428711 - protein, 9 aa, Influenza virus
RLYIWGVHH

SEQ ID NO: 428712 - protein, 9 aa, Influenza virus
IVRRATVSA

SEQ ID NO: 428713 - protein, 9 aa, Influenza virus
RKRRVRDSM

SEQ ID NO: 428714 - protein, 9 aa, Influenza virus
SKFLLMDAL

SEQ ID NO: 428715 - protein, 9 aa, Influenza virus
YQSTNSTEI

SEQ ID NO: 428716 - protein, 9 aa, Influenza virus
FRYGNGVWI

SEQ ID NO: 428717 - protein, 9 aa, Influenza virus
SFFSRLNWL

SEQ ID NO: 428718 - protein, 9 aa, Influenza virus
SRSGYEILK

SEQ ID NO: 428719 - protein, 9 aa, Influenza virus
RSRNGFEML

SEQ ID NO: 428720 - protein, 9 aa, Influenza virus
IVMVGLILA

SEQ ID NO: 428721 - protein, 9 aa, Influenza virus
VWLGRTVSI

SEQ ID NO: 428722 - protein, 9 aa, Influenza virus
MENERTLDY

SEQ ID NO: 428723 - protein, 9 aa, Influenza virus
THNGKLCKL

SEQ ID NO: 428724 - protein, 9 aa, Influenza virus
YVNKNPYTL

SEQ ID NO: 428725 - protein, 9 aa, Influenza virus
VETYVLSII

SEQ ID NO: 428726 - protein, 9 aa, Influenza virus
SECVCINGI

SEQ ID NO: 428727 - protein, 9 aa, Influenza virus
CPRYVKQSS

SEQ ID NO: 428728 - protein, 9 aa, Influenza virus
WGVHHSSSL

SEQ ID NO: 428729 - protein, 9 aa, Influenza virus
WMRINNETI

SEQ ID NO: 428730 - protein, 9 aa, Influenza virus
YLSTNSSEK

SEQ ID NO: 428731 - protein, 9 aa, Influenza virus
ETILETRYV

SEQ ID NO: 428732 - protein, 9 aa, Influenza virus
VPAQNAIST

SEQ ID NO: 428733 - protein, 9 aa, Influenza virus
LHEKVRQML

SEQ ID NO: 428734 - protein, 9 aa, Influenza virus
IMVAGLSFW

SEQ ID NO: 428735 - protein, 9 aa, Influenza virus
SPHRALMSC

SEQ ID NO: 428736 - protein, 9 aa, Influenza virus
GRFYVQMCT

SEQ ID NO: 428737 - protein, 9 aa, Influenza virus
RTELIPPSK

SEQ ID NO: 428738 - protein, 9 aa, Influenza virus
TSISCLYKL

SEQ ID NO: 428739 - protein, 9 aa, Influenza virus
YQGRLCNPL

SEQ ID NO: 428740 - protein, 9 aa, Influenza virus
GTIHDRSPY

SEQ ID NO: 428741 - protein, 9 aa, Influenza virus
EKIEKIRPL

SEQ ID NO: 428742 - protein, 9 aa, Influenza virus
EVVDATETV

SEQ ID NO: 428743 - protein, 9 aa, Influenza virus
GMELRRCLL

SEQ ID NO: 428744 - protein, 9 aa, Influenza virus
MVDGWYGFH

SEQ ID NO: 428745 - protein, 9 aa, Influenza virus
GIFGPVHFR

SEQ ID NO: 428746 - protein, 9 aa, Influenza virus
FQNASRYYM

SEQ ID NO: 428747 - protein, 9 aa, Influenza virus
KSRVDNHSM

SEQ ID NO: 428748 - protein, 9 aa, Influenza virus
TTYRILSIY

SEQ ID NO: 428749 - protein, 9 aa, Influenza virus
VLTGNLQTL

SEQ ID NO: 428750 - protein, 9 aa, Influenza virus
SLIRFPIGT

SEQ ID NO: 428751 - protein, 9 aa, Influenza virus
KGNPGVKGW

SEQ ID NO: 428752 - protein, 9 aa, Influenza virus
GYKDIILWI

SEQ ID NO: 428753 - protein, 9 aa, Influenza virus
TSFFYRYGF

SEQ ID NO: 428754 - protein, 9 aa, Influenza virus
YPKIYKTYF

SEQ ID NO: 428755 - protein, 9 aa, Influenza virus
GRYSRADKI

SEQ ID NO: 428756 - protein, 9 aa, Influenza virus
NSTWVSQTY

SEQ ID NO: 428757 - protein, 9 aa, Influenza virus
YAFGICPKY

SEQ ID NO: 428758 - protein, 9 aa, Influenza virus
WPWPDGALL

SEQ ID NO: 428759 - protein, 9 aa, Influenza virus
KLSGGYKDV

SEQ ID NO: 428760 - protein, 9 aa, Influenza virus
IAQRLESVF

SEQ ID NO: 428761 - protein, 9 aa, Influenza virus
SILANNGRF

SEQ ID NO: 428762 - protein, 9 aa, Influenza virus
GLMSTPLGS

SEQ ID NO: 428763 - protein, 9 aa, Influenza virus
VSKMGVDEY

SEQ ID NO: 428764 - protein, 9 aa, Influenza virus
STVASSLVL

SEQ ID NO: 428765 - protein, 9 aa, Influenza virus
VTYQILSIY

SEQ ID NO: 428766 - protein, 9 aa, Influenza virus
REMTFHGAK

SEQ ID NO: 428767 - protein, 9 aa, Influenza virus
GVYQVLAIY

SEQ ID NO: 428768 - protein, 9 aa, Influenza virus
STVASSLTL

SEQ ID NO: 428769 - protein, 9 aa, Influenza virus
FQNIDSWAV

SEQ ID NO: 428770 - protein, 9 aa, Influenza virus
CPIRGWAPL

SEQ ID NO: 428771 - protein, 9 aa, Influenza virus
TACHDGRKW

SEQ ID NO: 428772 - protein, 9 aa, Influenza virus
QLSQKFEEI

SEQ ID NO: 428773 - protein, 9 aa, Influenza virus
LTMGECPKY

SEQ ID NO: 428774 - protein, 9 aa, Influenza virus
FFRHMVWLI

SEQ ID NO: 428775 - protein, 9 aa, Influenza virus
LVAPEYGFK

SEQ ID NO: 428776 - protein, 9 aa, Influenza virus
VFSIAASYK

SEQ ID NO: 428777 - protein, 9 aa, Influenza virus
VLMENERTL

SEQ ID NO: 428778 - protein, 9 aa, Influenza virus
GRISIYWTL

SEQ ID NO: 428779 - protein, 9 aa, Influenza virus
EIWSYNAEF

SEQ ID NO: 428780 - protein, 9 aa, Influenza virus
HILVTREPY

SEQ ID NO: 428781 - protein, 9 aa, Influenza virus
GTIKDRSPY

SEQ ID NO: 428782 - protein, 9 aa, Influenza virus
GRQTFDWTL

SEQ ID NO: 428783 - protein, 9 aa, Influenza virus
QILSLYSTV

SEQ ID NO: 428784 - protein, 9 aa, Influenza virus
NTVKDRSPY

SEQ ID NO: 428785 - protein, 9 aa, Influenza virus
KTWAGNILR

SEQ ID NO: 428786 - protein, 9 aa, Influenza virus
LVQLIVSGK

SEQ ID NO: 428787 - protein, 9 aa, Influenza virus
CSCYPNMGK

SEQ ID NO: 428788 - protein, 9 aa, Influenza virus
GMALSVVSL

SEQ ID NO: 428789 - protein, 9 aa, Influenza virus
TFQNVSPIW

SEQ ID NO: 428790 - protein, 9 aa, Influenza virus
LIWMACHSA

SEQ ID NO: 428791 - protein, 9 aa, Influenza virus
VPVTSSIDL

SEQ ID NO: 428792 - protein, 9 aa, Influenza virus
VTQRTVGKK

SEQ ID NO: 428793 - protein, 9 aa, Influenza virus
WVGECPKYV

SEQ ID NO: 428794 - protein, 9 aa, Influenza virus
ALSIYSCIA

SEQ ID NO: 428795 - protein, 9 aa, Influenza virus
WSGYSGAFM

SEQ ID NO: 428796 - protein, 9 aa, Influenza virus
GLLEVGTRW

SEQ ID NO: 428797 - protein, 9 aa, Influenza virus
LTFLARSAL

SEQ ID NO: 428798 - protein, 9 aa, Influenza virus
LVALCGSPV

SEQ ID NO: 428799 - protein, 9 aa, Influenza virus
TYHNSFVPV

SEQ ID NO: 428800 - protein, 9 aa, Influenza virus
GAVNSSMPF

SEQ ID NO: 428801 - protein, 9 aa, Influenza virus
GTFDIGGLY

SEQ ID NO: 428802 - protein, 9 aa, Influenza virus
HSHYREEAL

SEQ ID NO: 428803 - protein, 9 aa, Influenza virus
MALSVVSLL

SEQ ID NO: 428804 - protein, 9 aa, Influenza virus
FRLLQNSQV

SEQ ID NO: 428805 - protein, 9 aa, Influenza virus
WTGMIDGWY

SEQ ID NO: 428806 - protein, 9 aa, Influenza virus
QADEICIGY

SEQ ID NO: 428807 - protein, 9 aa, Influenza virus
KPQCKITGF

SEQ ID NO: 428808 - protein, 9 aa, Influenza virus
CIASSLVLA

SEQ ID NO: 428809 - protein, 9 aa, Influenza virus
LIRGNSPVF

SEQ ID NO: 428810 - protein, 9 aa, Influenza virus
RTNGTSKIK

SEQ ID NO: 428811 - protein, 9 aa, Influenza virus
GPWVRGQSG

SEQ ID NO: 428812 - protein, 9 aa, Influenza virus
LLATGMRNI

SEQ ID NO: 428813 - protein, 9 aa, Influenza virus
RVWWTTNSI

SEQ ID NO: 428814 - protein, 9 aa, Influenza virus
YVNIKSLKL

SEQ ID NO: 428815 - protein, 9 aa, Influenza virus
LQSSDDFAL

SEQ ID NO: 428816 - protein, 9 aa, Influenza virus
KVNSIIEKM

SEQ ID NO: 428817 - protein, 9 aa, Influenza virus
ITFIQALQL

SEQ ID NO: 428818 - protein, 9 aa, Influenza virus
NILLHIVSI

SEQ ID NO: 428819 - protein, 9 aa, Influenza virus
YVSVGTSTL

SEQ ID NO: 428820 - protein, 9 aa, Influenza virus
GISSMGEAM

SEQ ID NO: 428821 - protein, 9 aa, Influenza virus
GRQTYDWTL

SEQ ID NO: 428822 - protein, 9 aa, Influenza virus
YWMCSNGSL

SEQ ID NO: 428823 - protein, 9 aa, Influenza virus
FSFGASCLI

SEQ ID NO: 428824 - protein, 9 aa, Influenza virus
TFIQALQLL

SEQ ID NO: 428825 - protein, 9 aa, Influenza virus
GSIPNEKPF

SEQ ID NO: 428826 - protein, 9 aa, Influenza virus
MVFSQEDCV

SEQ ID NO: 428827 - protein, 9 aa, Influenza virus
GISSMVEAM

SEQ ID NO: 428828 - protein, 9 aa, Influenza virus
IASMRRNYF

SEQ ID NO: 428829 - protein, 9 aa, Influenza virus
LGLRISSSF

SEQ ID NO: 428830 - protein, 9 aa, Influenza virus
IIAARSIVR

SEQ ID NO: 428831 - protein, 9 aa, Influenza virus
EVVNATETV

SEQ ID NO: 428832 - protein, 9 aa, Influenza virus
SRARIKTRL

SEQ ID NO: 428833 - protein, 9 aa, Influenza virus
HTQYREEAL

SEQ ID NO: 428834 - protein, 9 aa, Influenza virus
QRLNTMHQL

SEQ ID NO: 428835 - protein, 9 aa, Influenza virus
FQNTSKHYI

SEQ ID NO: 428836 - protein, 9 aa, Influenza virus
SFAISCFLI

SEQ ID NO: 428837 - protein, 9 aa, Influenza virus
QVIVTREPY

SEQ ID NO: 428838 - protein, 9 aa, Influenza virus
CSVSECRTF

SEQ ID NO: 428839 - protein, 9 aa, Influenza virus
MRWLTLKSG

SEQ ID NO: 428840 - protein, 9 aa, Influenza virus
IIVTREPYV

SEQ ID NO: 428841 - protein, 9 aa, Influenza virus
RIPHRTLLM

SEQ ID NO: 428842 - protein, 9 aa, Influenza virus
RHFEKVKIL

SEQ ID NO: 428843 - protein, 9 aa, Influenza virus
ILSIYSTVA

SEQ ID NO: 428844 - protein, 9 aa, Influenza virus
LEESHPGIF

SEQ ID NO: 428845 - protein, 9 aa, Influenza virus
WTSNSIVAF

SEQ ID NO: 428846 - protein, 9 aa, Influenza virus
HTQYREESL

SEQ ID NO: 428847 - protein, 9 aa, Influenza virus
TTTIRTWAK

SEQ ID NO: 428848 - protein, 9 aa, Influenza virus
LRRCLLQSL

SEQ ID NO: 428849 - protein, 9 aa, Influenza virus
YMSNNSTEK

SEQ ID NO: 428850 - protein, 9 aa, Influenza virus
GTFDLEGLY

SEQ ID NO: 428851 - protein, 9 aa, Influenza virus
EIAQRLESV

SEQ ID NO: 428852 - protein, 9 aa, Influenza virus
IGYICSGVF

SEQ ID NO: 428853 - protein, 9 aa, Influenza virus
GSNRPWIRF

SEQ ID NO: 428854 - protein, 9 aa, Influenza virus
YVSIGTSTL

SEQ ID NO: 428855 - protein, 9 aa, Influenza virus
IMESGGISK

SEQ ID NO: 428856 - protein, 9 aa, Influenza virus
QLSAGGDIW

SEQ ID NO: 428857 - protein, 9 aa, Influenza virus
TLYKNANTL

SEQ ID NO: 428858 - protein, 9 aa, Influenza virus
RRQKRGLFG

SEQ ID NO: 428859 - protein, 9 aa, Influenza virus
IEKQIGNVI

SEQ ID NO: 428860 - protein, 9 aa, Influenza virus
GRQTYDWTL

SEQ ID NO: 428861 - protein, 9 aa, Influenza virus
YQNNFVPVM

SEQ ID NO: 428862 - protein, 9 aa, Influenza virus
KSLESRRGF

SEQ ID NO: 428863 - protein, 9 aa, Influenza virus
YPKVYKTYF

SEQ ID NO: 428864 - protein, 9 aa, Influenza virus
RSHKICIGY

SEQ ID NO: 428865 - protein, 9 aa, Influenza virus
PSFFRNMIW

SEQ ID NO: 428866 - protein, 9 aa, Influenza virus
WILWISFAI

SEQ ID NO: 428867 - protein, 9 aa, Influenza virus
GTFDIEGLY

SEQ ID NO: 428868 - protein, 9 aa, Influenza virus
RIDFHWLFL

SEQ ID NO: 428869 - protein, 9 aa, Influenza virus
SVKEKDMTK

SEQ ID NO: 428870 - protein, 9 aa, Influenza virus
RTNGTSKVK

SEQ ID NO: 428871 - protein, 9 aa, Influenza virus
LYQKVGTYV

SEQ ID NO: 428872 - protein, 9 aa, Influenza virus
VLLVSLGAI

SEQ ID NO: 428873 - protein, 9 aa, Influenza virus
KQSSLPLAL

SEQ ID NO: 428874 - protein, 9 aa, Influenza virus
IASVPASRY

SEQ ID NO: 428875 - protein, 9 aa, Influenza virus
WFRNVLSIA

SEQ ID NO: 428876 - protein, 9 aa, Influenza virus
SRSGYEMLK

SEQ ID NO: 428877 - protein, 9 aa, Influenza virus
LRDCKVEAV

SEQ ID NO: 428878 - protein, 9 aa, Influenza virus
RYSGFVRTL

SEQ ID NO: 428879 - protein, 9 aa, Influenza virus
HIFGKDNAV

SEQ ID NO: 428880 - protein, 9 aa, Influenza virus
VASSLVLLL

SEQ ID NO: 428881 - protein, 9 aa, Influenza virus
FRGLLSTPL

SEQ ID NO: 428882 - protein, 9 aa, Influenza virus
NVTNVQNNY

SEQ ID NO: 428883 - protein, 9 aa, Influenza virus
GASCFLFLA

SEQ ID NO: 428884 - protein, 9 aa, Influenza virus
DQVTDIWAY

SEQ ID NO: 428885 - protein, 9 aa, Influenza virus
MRRCLLQSL

SEQ ID NO: 428886 - protein, 9 aa, Influenza virus
KSRSNIFNM

SEQ ID NO: 428887 - protein, 9 aa, Influenza virus
DSFYRNLIW

SEQ ID NO: 428888 - protein, 9 aa, Influenza virus
WTSSSSIVM

SEQ ID NO: 428889 - protein, 9 aa, Influenza virus
KTFQNVSPL

SEQ ID NO: 428890 - protein, 9 aa, Influenza virus
VWWTSNSLI

SEQ ID NO: 428891 - protein, 9 aa, Influenza virus
RFLRVRDQL

SEQ ID NO: 428892 - protein, 9 aa, Influenza virus
TMHDRSPFR

SEQ ID NO: 428893 - protein, 9 aa, Influenza virus
SPYRALMSV

SEQ ID NO: 428894 - protein, 9 aa, Influenza virus
ESKLKRQEI

SEQ ID NO: 428895 - protein, 9 aa, Influenza virus
HRTLLMNEL

SEQ ID NO: 428896 - protein, 9 aa, Influenza virus
KLYGNGNKL

SEQ ID NO: 428897 - protein, 9 aa, Influenza virus
TMTHTSQYI

SEQ ID NO: 428898 - protein, 9 aa, Influenza virus
FRGLISTHL

SEQ ID NO: 428899 - protein, 9 aa, Influenza virus
RLNTMHQLL

SEQ ID NO: 428900 - protein, 9 aa, Influenza virus
GSSTYHNSF

SEQ ID NO: 428901 - protein, 9 aa, Influenza virus
QMYQKCCSL

SEQ ID NO: 428902 - protein, 9 aa, Influenza virus
LTIGKCPKY

SEQ ID NO: 428903 - protein, 9 aa, Influenza virus
KSCLPACVY

SEQ ID NO: 428904 - protein, 9 aa, Influenza virus
WTGMVNGWY

SEQ ID NO: 428905 - protein, 9 aa, Influenza virus
WVLWISFAI

SEQ ID NO: 428906 - protein, 9 aa, Influenza virus
VIVTREPYV

SEQ ID NO: 428907 - protein, 9 aa, Influenza virus
ASTGAQSFY

SEQ ID NO: 428908 - protein, 9 aa, Influenza virus
VAKDNAIRF

SEQ ID NO: 428909 - protein, 9 aa, Influenza virus
MSTNAYDRI

SEQ ID NO: 428910 - protein, 9 aa, Influenza virus
TRWMKIIRV

SEQ ID NO: 428911 - protein, 9 aa, Influenza virus
SRSGFEILL

SEQ ID NO: 428912 - protein, 9 aa, Influenza virus
YVKKESLRL

SEQ ID NO: 428913 - protein, 9 aa, Influenza virus
YVKSEKLVL

SEQ ID NO: 428914 - protein, 9 aa, Influenza virus
WQGSNRPVI

SEQ ID NO: 428915 - protein, 9 aa, Influenza virus
LILAFIMWT

SEQ ID NO: 428916 - protein, 9 aa, Influenza virus
FESTGNFIA

SEQ ID NO: 428917 - protein, 9 aa, Influenza virus
HLGTRQVCI

SEQ ID NO: 428918 - protein, 9 aa, Influenza virus
MVRSDKICL

SEQ ID NO: 428919 - protein, 9 aa, Influenza virus
QTFDWTLNR

SEQ ID NO: 428920 - protein, 9 aa, Influenza virus
FQHQNAEGI

SEQ ID NO: 428921 - protein, 9 aa, Influenza virus
YVWWTSNSL

SEQ ID NO: 428922 - protein, 9 aa, Influenza virus
YQAKFEAVA

SEQ ID NO: 428923 - protein, 9 aa, Influenza virus
VEELVHGGI

SEQ ID NO: 428924 - protein, 9 aa, Influenza virus
NIHPLTIGK

SEQ ID NO: 428925 - protein, 9 aa, Influenza virus
ITDTLKSWK

SEQ ID NO: 428926 - protein, 9 aa, Influenza virus
GLLDVWTYN

SEQ ID NO: 428927 - protein, 9 aa, Influenza virus
FQNVHPITI

SEQ ID NO: 428928 - protein, 9 aa, Influenza virus
KLYGSGSKL

SEQ ID NO: 428929 - protein, 9 aa, Influenza virus
APGTKGFGF

SEQ ID NO: 428930 - protein, 9 aa, Influenza virus
CPIKGWAPL

SEQ ID NO: 428931 - protein, 9 aa, Influenza virus
SRNPGNAEI

SEQ ID NO: 428932 - protein, 9 aa, Influenza virus
SGYSGAFTV

SEQ ID NO: 428933 - protein, 9 aa, Influenza virus
VSSFERFEM

SEQ ID NO: 428934 - protein, 9 aa, Influenza virus
GRYSIADKI

SEQ ID NO: 428935 - protein, 9 aa, Influenza virus
SGYFGVFSV

SEQ ID NO: 428936 - protein, 9 aa, Influenza virus
FRALISWEM

SEQ ID NO: 428937 - protein, 9 aa, Influenza virus
GLLGAIAGF

SEQ ID NO: 428938 - protein, 9 aa, Influenza virus
RMYQKCCNL

SEQ ID NO: 428939 - protein, 9 aa, Influenza virus
SQHRSHRQM

SEQ ID NO: 428940 - protein, 9 aa, Influenza virus
CPIKGWAPL

SEQ ID NO: 428941 - protein, 9 aa, Influenza virus
TRLYIWGVH

SEQ ID NO: 428942 - protein, 9 aa, Influenza virus
FYAELKWLV

SEQ ID NO: 428943 - protein, 9 aa, Influenza virus
ITQRTIGKK

SEQ ID NO: 428944 - protein, 9 aa, Influenza virus
EVCLKWDLM

SEQ ID NO: 428945 - protein, 9 aa, Influenza virus
WTYNVELLV

SEQ ID NO: 428946 - protein, 9 aa, Influenza virus
LPVTGGTSS

SEQ ID NO: 428947 - protein, 9 aa, Influenza virus
SPNAYQAKF

SEQ ID NO: 428948 - protein, 9 aa, Influenza virus
MESGGIDKV

SEQ ID NO: 428949 - protein, 9 aa, Influenza virus
RILCTSATA

SEQ ID NO: 428950 - protein, 9 aa, Influenza virus
TTYQRTRAL

SEQ ID NO: 428951 - protein, 9 aa, Influenza virus
CQIAGFAPF

SEQ ID NO: 428952 - protein, 9 aa, Influenza virus
SSQDTELSF

SEQ ID NO: 428953 - protein, 9 aa, Influenza virus
GSSKYQQSF

SEQ ID NO: 428954 - protein, 9 aa, Influenza virus
HIWVTREPY

SEQ ID NO: 428955 - protein, 9 aa, Influenza virus
ILSPLTKGM

SEQ ID NO: 428956 - protein, 9 aa, Influenza virus
FSFGASCLI

SEQ ID NO: 428957 - protein, 9 aa, Influenza virus
YVKQSTLKL

SEQ ID NO: 428958 - protein, 9 aa, Influenza virus
VLGVSILNL

SEQ ID NO: 428959 - protein, 9 aa, Influenza virus
RARIKTRLF

SEQ ID NO: 428960 - protein, 9 aa, Influenza virus
VVNFLSMEF

SEQ ID NO: 428961 - protein, 9 aa, Influenza virus
ELRFVFSNA

SEQ ID NO: 428962 - protein, 9 aa, Influenza virus
YVRQNTLKL

SEQ ID NO: 428963 - protein, 9 aa, Influenza virus
RSNENPAHK

SEQ ID NO: 428964 - protein, 9 aa, Influenza virus
RRQILRTQE

SEQ ID NO: 428965 - protein, 9 aa, Influenza virus
NQASYKIFK

SEQ ID NO: 428966 - protein, 9 aa, Influenza virus
RLVQNSITI

SEQ ID NO: 428967 - protein, 9 aa, Influenza virus
GRFTNEEAL

SEQ ID NO: 428968 - protein, 9 aa, Influenza virus
TLSTIALII

SEQ ID NO: 428969 - protein, 9 aa, Influenza virus
KILKIKKGK

SEQ ID NO: 428970 - protein, 9 aa, Influenza virus
IYCICRDNW

SEQ ID NO: 428971 - protein, 9 aa, Influenza virus
STDKVNTII

SEQ ID NO: 428972 - protein, 9 aa, Influenza virus
YSGAFTVPI

SEQ ID NO: 428973 - protein, 9 aa, Influenza virus
NRIQIDSVK

SEQ ID NO: 428974 - protein, 9 aa, Influenza virus
RSGAAGAAI

SEQ ID NO: 428975 - protein, 9 aa, Influenza virus
TFMQALQLL

SEQ ID NO: 428976 - protein, 9 aa, Influenza virus
DRTPYRTLL

SEQ ID NO: 428977 - protein, 9 aa, Influenza virus
ILTIYSTAA

SEQ ID NO: 428978 - protein, 9 aa, Influenza virus
FKMNPNQKI

SEQ ID NO: 428979 - protein, 9 aa, Influenza virus
FIAPDRASF

SEQ ID NO: 428980 - protein, 9 aa, Influenza virus
ISKDLRSGY

SEQ ID NO: 428981 - protein, 9 aa, Influenza virus
HQSGTYPVV

SEQ ID NO: 428982 - protein, 9 aa, Influenza virus
ETFVNVTHV

SEQ ID NO: 428983 - protein, 9 aa, Influenza virus
VLIVSLGAI

SEQ ID NO: 428984 - protein, 9 aa, Influenza virus
MIEAESSVK

SEQ ID NO: 428985 - protein, 9 aa, Influenza virus
IIGKMNTQF

SEQ ID NO: 428986 - protein, 9 aa, Influenza virus
IFLAMITYI

SEQ ID NO: 428987 - protein, 9 aa, Influenza virus
WPDGAEVPF

SEQ ID NO: 428988 - protein, 9 aa, Influenza virus
WSYIVERTK

SEQ ID NO: 428989 - protein, 9 aa, Influenza virus
EVENEIRTF

SEQ ID NO: 428990 - protein, 9 aa, Influenza virus
FGASCFLFL

SEQ ID NO: 428991 - protein, 9 aa, Influenza virus
LVVSPDLSY

SEQ ID NO: 428992 - protein, 9 aa, Influenza virus
GRWPGLVAG

SEQ ID NO: 428993 - protein, 9 aa, Influenza virus
HSNEQGSGY

SEQ ID NO: 428994 - protein, 9 aa, Influenza virus
MVRSDKICL

SEQ ID NO: 428995 - protein, 9 aa, Influenza virus
SLVKTTLFL

SEQ ID NO: 428996 - protein, 9 aa, Influenza virus
FQHQNAEGI

SEQ ID NO: 428997 - protein, 9 aa, Influenza virus
TSYKILSIY

SEQ ID NO: 428998 - protein, 9 aa, Influenza virus
TPRNGDSSS

SEQ ID NO: 428999 - protein, 9 aa, Influenza virus
RVWWTTNSI

SEQ ID NO: 429000 - protein, 9 aa, Influenza virus
VINNMTTTI

SEQ ID NO: 429001 - protein, 9 aa, Influenza virus
ELREQLSSV

SEQ ID NO: 429002 - protein, 9 aa, Influenza virus
MNNEGSYFF

SEQ ID NO: 429003 - protein, 9 aa, Influenza virus
RTELINPSK

SEQ ID NO: 429004 - protein, 9 aa, Influenza virus
VFSNAASYK

SEQ ID NO: 429005 - protein, 9 aa, Influenza virus
YIQMCTELK

SEQ ID NO: 429006 - protein, 9 aa, Influenza virus
SSVASSLVL

SEQ ID NO: 429007 - protein, 9 aa, Influenza virus
WSWPDGAEV

SEQ ID NO: 429008 - protein, 9 aa, Influenza virus
YVWWTSNSL

SEQ ID NO: 429009 - protein, 9 aa, Influenza virus
KMKAILVVL

SEQ ID NO: 429010 - protein, 9 aa, Influenza virus
IIFEATGNL

SEQ ID NO: 429011 - protein, 9 aa, Influenza virus
LMSCPIGVA

SEQ ID NO: 429012 - protein, 9 aa, Influenza virus
IAQDNAIRF

SEQ ID NO: 429013 - protein, 9 aa, Influenza virus
RLQLRDNAK

SEQ ID NO: 429014 - protein, 9 aa, Influenza virus
WTSGSSIAF

SEQ ID NO: 429015 - protein, 9 aa, Influenza virus
EKIEKIRPL

SEQ ID NO: 429016 - protein, 9 aa, Influenza virus
CHNGICPVA

SEQ ID NO: 429017 - protein, 9 aa, Influenza virus
HLMIWHSNL

SEQ ID NO: 429018 - protein, 9 aa, Influenza virus
LRFVFSNAA

SEQ ID NO: 429019 - protein, 9 aa, Influenza virus
YMNTALLNA

SEQ ID NO: 429020 - protein, 9 aa, Influenza virus
YKYGNGVWI

SEQ ID NO: 429021 - protein, 9 aa, Influenza virus
GVFELSDEK

SEQ ID NO: 429022 - protein, 9 aa, Influenza virus
RRVWRQANN

SEQ ID NO: 429023 - protein, 9 aa, Influenza virus
GLVNLGLNI

SEQ ID NO: 429024 - protein, 9 aa, Influenza virus
SLIWLWLVL

SEQ ID NO: 429025 - protein, 9 aa, Influenza virus
HSRGLFGAI

SEQ ID NO: 429026 - protein, 9 aa, Influenza virus
LIYNRMGAV

SEQ ID NO: 429027 - protein, 9 aa, Influenza virus
KLYWHLMRP

SEQ ID NO: 429028 - protein, 9 aa, Influenza virus
LISDGGPNL

SEQ ID NO: 429029 - protein, 9 aa, Influenza virus
FYAEMEWLL

SEQ ID NO: 429030 - protein, 9 aa, Influenza virus
LIYNRMGTV

SEQ ID NO: 429031 - protein, 9 aa, Influenza virus
QNRMQINPV

SEQ ID NO: 429032 - protein, 9 aa, Influenza virus
MEKFIVLSV

SEQ ID NO: 429033 - protein, 9 aa, Influenza virus
NSRFESVAW

SEQ ID NO: 429034 - protein, 9 aa, Influenza virus
ETIEERFEI

SEQ ID NO: 429035 - protein, 9 aa, Influenza virus
RILTSESQM

SEQ ID NO: 429036 - protein, 9 aa, Influenza virus
LTIGECPRY

SEQ ID NO: 429037 - protein, 9 aa, Influenza virus
LAIMIAGLF

SEQ ID NO: 429038 - protein, 9 aa, Influenza virus
ITYGPCPRY

SEQ ID NO: 429039 - protein, 9 aa, Influenza virus
RMEFSWILL

SEQ ID NO: 429040 - protein, 9 aa, Influenza virus
FQYLLFQDI

SEQ ID NO: 429041 - protein, 9 aa, Influenza virus
YVKQNTLKL

SEQ ID NO: 429042 - protein, 9 aa, Influenza virus
KLDINMADY

SEQ ID NO: 429043 - protein, 9 aa, Influenza virus
TTLSTIALF

SEQ ID NO: 429044 - protein, 9 aa, Influenza virus
YRSLIRFPI

SEQ ID NO: 429045 - protein, 9 aa, Influenza virus
RMDYYWGIL

SEQ ID NO: 429046 - protein, 9 aa, Influenza virus
LLGNPMCDK

SEQ ID NO: 429047 - protein, 9 aa, Influenza virus
NLTRGLCTI

SEQ ID NO: 429048 - protein, 9 aa, Influenza virus
RMVLASTTA

SEQ ID NO: 429049 - protein, 9 aa, Influenza virus
SSCHDGKAW

SEQ ID NO: 429050 - protein, 9 aa, Influenza virus
SLCSVEGWV

SEQ ID NO: 429051 - protein, 9 aa, Influenza virus
TIHDRTTFR

SEQ ID NO: 429052 - protein, 9 aa, Influenza virus
FTIGECPKY

SEQ ID NO: 429053 - protein, 9 aa, Influenza virus
CIASSLILA

SEQ ID NO: 429054 - protein, 9 aa, Influenza virus
AIWVTREPY

SEQ ID NO: 429055 - protein, 9 aa, Influenza virus
LTMGECPKY

SEQ ID NO: 429056 - protein, 9 aa, Influenza virus
LNRLSINPV

SEQ ID NO: 429057 - protein, 9 aa, Influenza virus
SCIASSTVM

SEQ ID NO: 429058 - protein, 9 aa, Influenza virus
NLEPGTFDI

SEQ ID NO: 429059 - protein, 9 aa, Influenza virus
FGRIDFHWL

SEQ ID NO: 429060 - protein, 9 aa, Influenza virus
YQSRFEAVA

SEQ ID NO: 429061 - protein, 9 aa, Influenza virus
SMSGFRSNL

SEQ ID NO: 429062 - protein, 9 aa, Influenza virus
RARIKTRLF

SEQ ID NO: 429063 - protein, 9 aa, Influenza virus
APEYGHLVT

SEQ ID NO: 429064 - protein, 9 aa, Influenza virus
PQCDLFLEF

SEQ ID NO: 429065 - protein, 9 aa, Influenza virus
RIDYYWSVL

SEQ ID NO: 429066 - protein, 9 aa, Influenza virus
YSLVGIDPF

SEQ ID NO: 429067 - protein, 9 aa, Influenza virus
SLIRFPVGT

SEQ ID NO: 429068 - protein, 9 aa, Influenza virus
VLSIYSCIA

SEQ ID NO: 429069 - protein, 9 aa, Influenza virus
SIVSWSQNI

SEQ ID NO: 429070 - protein, 9 aa, Influenza virus
ILSIYSCIA

SEQ ID NO: 429071 - protein, 9 aa, Influenza virus
AIWTSGSSI

SEQ ID NO: 429072 - protein, 9 aa, Influenza virus
YQFALGHGT

SEQ ID NO: 429073 - protein, 9 aa, Influenza virus
FEATGNLIA

SEQ ID NO: 429074 - protein, 9 aa, Influenza virus
RVRNQSGRI

SEQ ID NO: 429075 - protein, 9 aa, Influenza virus
SSVSSFKRF

SEQ ID NO: 429076 - protein, 9 aa, Influenza virus
MQIRGFVYF

SEQ ID NO: 429077 - protein, 9 aa, Influenza virus
AEDMGDGCF

SEQ ID NO: 429078 - protein, 9 aa, Influenza virus
IQTRGLFGA

SEQ ID NO: 429079 - protein, 9 aa, Influenza virus
SQYLCTGIL

SEQ ID NO: 429080 - protein, 9 aa, Influenza virus
GVAPVLGNY

SEQ ID NO: 429081 - protein, 9 aa, Influenza virus
VLIGQGDIV

SEQ ID NO: 429082 - protein, 9 aa, Influenza virus
FESNGNFIA

SEQ ID NO: 429083 - protein, 9 aa, Influenza virus
RPVTEINTW

SEQ ID NO: 429084 - protein, 9 aa, Influenza virus
VQHPELTGL

SEQ ID NO: 429085 - protein, 9 aa, Influenza virus
STDTVNTLT

SEQ ID NO: 429086 - protein, 9 aa, Influenza virus
NTSYKILSI

SEQ ID NO: 429087 - protein, 9 aa, Influenza virus
SYIIRALTL

SEQ ID NO: 429088 - protein, 9 aa, Influenza virus
IAIGNCPKY

SEQ ID NO: 429089 - protein, 9 aa, Influenza virus
RMVTGLRNI

SEQ ID NO: 429090 - protein, 9 aa, Influenza virus
SQYRALVSW

SEQ ID NO: 429091 - protein, 9 aa, Influenza virus
WSWPDGALL

SEQ ID NO: 429092 - protein, 9 aa, Influenza virus
FMCVGWSST

SEQ ID NO: 429093 - protein, 9 aa, Influenza virus
LYNIRNLHI

SEQ ID NO: 429094 - protein, 9 aa, Influenza virus
YQKRMGVQL

SEQ ID NO: 429095 - protein, 9 aa, Influenza virus
GRNCTVPCF

SEQ ID NO: 429096 - protein, 9 aa, Influenza virus
LIFLARSAL

SEQ ID NO: 429097 - protein, 9 aa, Influenza virus
YSGAFTIPI

SEQ ID NO: 429098 - protein, 9 aa, Influenza virus
YQARFESVA

SEQ ID NO: 429099 - protein, 9 aa, Influenza virus
YPIQNLTKV

SEQ ID NO: 429100 - protein, 9 aa, Influenza virus
HSNLNDTTY

SEQ ID NO: 429101 - protein, 9 aa, Influenza virus
VYQARFEAV

SEQ ID NO: 429102 - protein, 9 aa, Influenza virus
RREVHVYYL

SEQ ID NO: 429103 - protein, 9 aa, Influenza virus
KRTNMINDK

SEQ ID NO: 429104 - protein, 9 aa, Influenza virus
RPKVNGQSG

SEQ ID NO: 429105 - protein, 9 aa, Influenza virus
GTYQILSIY

SEQ ID NO: 429106 - protein, 9 aa, Influenza virus
YQILSVYST

SEQ ID NO: 429107 - protein, 9 aa, Influenza virus
CSYLECRTF

SEQ ID NO: 429108 - protein, 9 aa, Influenza virus
HDRSQFRAL

SEQ ID NO: 429109 - protein, 9 aa, Influenza virus
ERTNQQFEL

SEQ ID NO: 429110 - protein, 9 aa, Influenza virus
SRTREILTR

SEQ ID NO: 429111 - protein, 9 aa, Influenza virus
HSNGQGSGY

SEQ ID NO: 429112 - protein, 9 aa, Influenza virus
SWMKIYWSL

SEQ ID NO: 429113 - protein, 9 aa, Influenza virus
LPLCPFRGF

SEQ ID NO: 429114 - protein, 9 aa, Influenza virus
KTNQQFEMI

SEQ ID NO: 429115 - protein, 9 aa, Influenza virus
RMIQLIVSG

SEQ ID NO: 429116 - protein, 9 aa, Influenza virus
RVFLAMITY

SEQ ID NO: 429117 - protein, 9 aa, Influenza virus
LIMRTVIAL

SEQ ID NO: 429118 - protein, 9 aa, Influenza virus
WSWDDGAIL

SEQ ID NO: 429119 - protein, 9 aa, Influenza virus
LSNPKCDLY

SEQ ID NO: 429120 - protein, 9 aa, Influenza virus
LLAIAMGLI

SEQ ID NO: 429121 - protein, 9 aa, Influenza virus
KEECYRACF

SEQ ID NO: 429122 - protein, 9 aa, Influenza virus
KSCLPACAY

SEQ ID NO: 429123 - protein, 9 aa, Influenza virus
NDLYGTQPL

SEQ ID NO: 429124 - protein, 9 aa, Influenza virus
YVKQSTLKL

SEQ ID NO: 429125 - protein, 9 aa, Influenza virus
QIAILAATV

SEQ ID NO: 429126 - protein, 9 aa, Influenza virus
ATAVAVLKY

SEQ ID NO: 429127 - protein, 9 aa, Influenza virus
IPMISKSRT

SEQ ID NO: 429128 - protein, 9 aa, Influenza virus
ILCTSATAL

SEQ ID NO: 429129 - protein, 9 aa, Influenza virus
SGRINFHWL

SEQ ID NO: 429130 - protein, 9 aa, Influenza virus
AYQAQFESV

SEQ ID NO: 429131 - protein, 9 aa, Influenza virus
ATKRLRMAI

SEQ ID NO: 429132 - protein, 9 aa, Influenza virus
LTKTTVDHM

SEQ ID NO: 429133 - protein, 9 aa, Influenza virus
NEFNKACEL

SEQ ID NO: 429134 - protein, 9 aa, Influenza virus
NQDSFYRSM

SEQ ID NO: 429135 - protein, 9 aa, Influenza virus
QVIVDNNNW

SEQ ID NO: 429136 - protein, 9 aa, Influenza virus
YKMNTKILV

SEQ ID NO: 429137 - protein, 9 aa, Influenza virus
KADEICIGY

SEQ ID NO: 429138 - protein, 9 aa, Influenza virus
KTLKLATGM

SEQ ID NO: 429139 - protein, 9 aa, Influenza virus
DVFVIREPF

SEQ ID NO: 429140 - protein, 9 aa, Influenza virus
RSLLLATGM

SEQ ID NO: 429141 - protein, 9 aa, Influenza virus
SVKNGTYYY

SEQ ID NO: 429142 - protein, 9 aa, Influenza virus
LTSVTTNTI

SEQ ID NO: 429143 - protein, 9 aa, Influenza virus
IKSHAYISF

SEQ ID NO: 429144 - protein, 9 aa, Influenza virus
KQSSLPLAL

SEQ ID NO: 429145 - protein, 9 aa, Influenza virus
WMRISNETI

SEQ ID NO: 429146 - protein, 9 aa, Influenza virus
GSSFYAELK

SEQ ID NO: 429147 - protein, 9 aa, Influenza virus
YPKVYKTYF

SEQ ID NO: 429148 - protein, 9 aa, Influenza virus
MMEAMVSRA

SEQ ID NO: 429149 - protein, 9 aa, Influenza virus
NLEPGTFDL

SEQ ID NO: 429150 - protein, 9 aa, Influenza virus
ETYKILTIY

SEQ ID NO: 429151 - protein, 9 aa, Influenza virus
LIGKTNQQF

SEQ ID NO: 429152 - protein, 9 aa, Influenza virus
SPLSRCRET

SEQ ID NO: 429153 - protein, 9 aa, Influenza virus
FIENGWQGL

SEQ ID NO: 429154 - protein, 9 aa, Influenza virus
VITDTIKSW

SEQ ID NO: 429155 - protein, 9 aa, Influenza virus
SSSGNNQVF

SEQ ID NO: 429156 - protein, 9 aa, Influenza virus
FEANGNLIA

SEQ ID NO: 429157 - protein, 9 aa, Influenza virus
SIYIEVLHL

SEQ ID NO: 429158 - protein, 9 aa, Influenza virus
KMNREFGVV

SEQ ID NO: 429159 - protein, 9 aa, Influenza virus
SLTHALREL

SEQ ID NO: 429160 - protein, 9 aa, Influenza virus
NLERRLENL

SEQ ID NO: 429161 - protein, 9 aa, Influenza virus
NIWAYNAEL

SEQ ID NO: 429162 - protein, 9 aa, Influenza virus
ILCTSATAL

SEQ ID NO: 429163 - protein, 9 aa, Influenza virus
VYQSRFEAV

SEQ ID NO: 429164 - protein, 9 aa, Influenza virus
NKDGDIIFL

SEQ ID NO: 429165 - protein, 9 aa, Influenza virus
GADDDAYAV

SEQ ID NO: 429166 - protein, 9 aa, Influenza virus
QMYQKCCSL

SEQ ID NO: 429167 - protein, 9 aa, Influenza virus
ITFSFNGAF

SEQ ID NO: 429168 - protein, 9 aa, Influenza virus
ETFVNVTNV

SEQ ID NO: 429169 - protein, 9 aa, Influenza virus
NPAYCNTDL

SEQ ID NO: 429170 - protein, 9 aa, Influenza virus
FMYSDFHFI

SEQ ID NO: 429171 - protein, 9 aa, Influenza virus
NPRVFLAMI

SEQ ID NO: 429172 - protein, 9 aa, Influenza virus
WMACHSAAF

SEQ ID NO: 429173 - protein, 9 aa, Influenza virus
NMRCTISLV

SEQ ID NO: 429174 - protein, 9 aa, Influenza virus
SADPLASLL

SEQ ID NO: 429175 - protein, 9 aa, Influenza virus
GVKLAQGYK

SEQ ID NO: 429176 - protein, 9 aa, Influenza virus
NGYKDVILW

SEQ ID NO: 429177 - protein, 9 aa, Influenza virus
VTLHFKQHK

SEQ ID NO: 429178 - protein, 9 aa, Influenza virus
SIVMCGVDY

SEQ ID NO: 429179 - protein, 9 aa, Influenza virus
WICMGHHAV

SEQ ID NO: 429180 - protein, 9 aa, Influenza virus
NTTWVNQTY

SEQ ID NO: 429181 - protein, 9 aa, Influenza virus
RLIQNSITI

SEQ ID NO: 429182 - protein, 9 aa, Influenza virus
MQRFRRPDS

SEQ ID NO: 429183 - protein, 9 aa, Influenza virus
YTLVSTSSW

SEQ ID NO: 429184 - protein, 9 aa, Influenza virus
KLFALSGVA

SEQ ID NO: 429185 - protein, 9 aa, Influenza virus
ARQMVQAMR

SEQ ID NO: 429186 - protein, 9 aa, Influenza virus
FTIGECPKY

SEQ ID NO: 429187 - protein, 9 aa, Influenza virus
WRGANRPVI

SEQ ID NO: 429188 - protein, 9 aa, Influenza virus
DQIQDVWAY

SEQ ID NO: 429189 - protein, 9 aa, Influenza virus
GQCGLLGTV

SEQ ID NO: 429190 - protein, 9 aa, Influenza virus
TVSSFYSEM

SEQ ID NO: 429191 - protein, 9 aa, Influenza virus
MPFHNVHPF

SEQ ID NO: 429192 - protein, 9 aa, Influenza virus
RQTRGIFGA

SEQ ID NO: 429193 - protein, 9 aa, Influenza virus
RLYLWGVHH

SEQ ID NO: 429194 - protein, 9 aa, Influenza virus
ITIGFVSLI

SEQ ID NO: 429195 - protein, 9 aa, Influenza virus
VPVTSSVDL

SEQ ID NO: 429196 - protein, 9 aa, Influenza virus
KLNNVIDKM

SEQ ID NO: 429197 - protein, 9 aa, Influenza virus
SLVLAASIM

SEQ ID NO: 429198 - protein, 9 aa, Influenza virus
HSNLNDATY

SEQ ID NO: 429199 - protein, 9 aa, Influenza virus
CFNPMIAEL

SEQ ID NO: 429200 - protein, 9 aa, Influenza virus
NPNQMIITI

SEQ ID NO: 429201 - protein, 9 aa, Influenza virus
YRTCKLLGI

SEQ ID NO: 429202 - protein, 9 aa, Influenza virus
RGRHSNGTI

SEQ ID NO: 429203 - protein, 9 aa, Influenza virus
SFGASCFLL

SEQ ID NO: 429204 - protein, 9 aa, Influenza virus
FSLGASCFL

SEQ ID NO: 429205 - protein, 9 aa, Influenza virus
ISTRSRSGF

SEQ ID NO: 429206 - protein, 9 aa, Influenza virus
FESNGNFIA

SEQ ID NO: 429207 - protein, 9 aa, Influenza virus
ASTGAQSFY

SEQ ID NO: 429208 - protein, 9 aa, Influenza virus
GLLAPRYGY

SEQ ID NO: 429209 - protein, 9 aa, Influenza virus
GIQAGVNRF

SEQ ID NO: 429210 - protein, 9 aa, Influenza virus
GYKDWILWI

SEQ ID NO: 429211 - protein, 9 aa, Influenza virus
GTTHDRTAF

SEQ ID NO: 429212 - protein, 9 aa, Influenza virus
YSGAFTVPI

SEQ ID NO: 429213 - protein, 9 aa, Influenza virus
FLCVGWSST

SEQ ID NO: 429214 - protein, 9 aa, Influenza virus
ISFATSCFL

SEQ ID NO: 429215 - protein, 9 aa, Influenza virus
VVIEKDNAV

SEQ ID NO: 429216 - protein, 9 aa, Influenza virus
FAFKQGNSV

SEQ ID NO: 429217 - protein, 9 aa, Influenza virus
RVWWTTNSI

SEQ ID NO: 429218 - protein, 9 aa, Influenza virus
MEWIKTRPI

SEQ ID NO: 429219 - protein, 9 aa, Influenza virus
FRGLISTPL

SEQ ID NO: 429220 - protein, 9 aa, Influenza virus
VQMCTELKL

SEQ ID NO: 429221 - protein, 9 aa, Influenza virus
RPWMRISNE

SEQ ID NO: 429222 - protein, 9 aa, Influenza virus
QIRGFVHFV

SEQ ID NO: 429223 - protein, 9 aa, Influenza virus
SMREEYRQK

SEQ ID NO: 429224 - protein, 9 aa, Influenza virus
ELRHLFSGV

SEQ ID NO: 429225 - protein, 9 aa, Influenza virus
EQITFMQAL

SEQ ID NO: 429226 - protein, 9 aa, Influenza virus
MIEAESSIK

SEQ ID NO: 429227 - protein, 9 aa, Influenza virus
IASRSGYEM

SEQ ID NO: 429228 - protein, 9 aa, Influenza virus
MIDGWYGFH

SEQ ID NO: 429229 - protein, 9 aa, Influenza virus
RSILANNGK

SEQ ID NO: 429230 - protein, 9 aa, Influenza virus
LIRMIKRGV

SEQ ID NO: 429231 - protein, 9 aa, Influenza virus
WTYNAEVLV

SEQ ID NO: 429232 - protein, 9 aa, Influenza virus
FQNIHPATI

SEQ ID NO: 429233 - protein, 9 aa, Influenza virus
SFYRNLVWI

SEQ ID NO: 429234 - protein, 9 aa, Influenza virus
GKIAHISPL

SEQ ID NO: 429235 - protein, 9 aa, Influenza virus
AIALGIINL

SEQ ID NO: 429236 - protein, 9 aa, Influenza virus
SRSGFEVLL

SEQ ID NO: 429237 - protein, 9 aa, Influenza virus
VFVALILGF

SEQ ID NO: 429238 - protein, 9 aa, Influenza virus
FALGHGTTL

SEQ ID NO: 429239 - protein, 9 aa, Influenza virus
NLVAPWYAY

SEQ ID NO: 429240 - protein, 9 aa, Influenza virus
KLRLATGLR

SEQ ID NO: 429241 - protein, 9 aa, Influenza virus
YQVGYICSG

SEQ ID NO: 429242 - protein, 9 aa, Influenza virus
YNKRLTTTI

SEQ ID NO: 429243 - protein, 9 aa, Influenza virus
LRFVFSNAA

SEQ ID NO: 429244 - protein, 9 aa, Influenza virus
YTMDTVSRT

SEQ ID NO: 429245 - protein, 9 aa, Influenza virus
RPTTEINTW

SEQ ID NO: 429246 - protein, 9 aa, Influenza virus
EGRLIQNSI

SEQ ID NO: 429247 - protein, 9 aa, Influenza virus
STVASSLTL

SEQ ID NO: 429248 - protein, 9 aa, Influenza virus
YRTLLMNEL

SEQ ID NO: 429249 - protein, 9 aa, Influenza virus
HSKEQGSGY

SEQ ID NO: 429250 - protein, 9 aa, Influenza virus
GQQGRMDYY

SEQ ID NO: 429251 - protein, 9 aa, Influenza virus
CINGICTVV

SEQ ID NO: 429252 - protein, 9 aa, Influenza virus
RPLVNGQSG

SEQ ID NO: 429253 - protein, 9 aa, Influenza virus
RACFYVELI

SEQ ID NO: 429254 - protein, 9 aa, Influenza virus
YRIGYICSG

SEQ ID NO: 429255 - protein, 9 aa, Influenza virus
RIFQSGVRV

SEQ ID NO: 429256 - protein, 9 aa, Influenza virus
RVWWTSNSI

SEQ ID NO: 429257 - protein, 9 aa, Influenza virus
RANQRLNTM

SEQ ID NO: 429258 - protein, 9 aa, Influenza virus
RLYGSGNKL

SEQ ID NO: 429259 - protein, 9 aa, Influenza virus
NLEKRLENL

SEQ ID NO: 429260 - protein, 9 aa, Influenza virus
HRTLLMSEL

SEQ ID NO: 429261 - protein, 9 aa, Influenza virus
SAINQITGK

SEQ ID NO: 429262 - protein, 9 aa, Influenza virus
GTYQILSIY

SEQ ID NO: 429263 - protein, 9 aa, Influenza virus
RMVIASTTA

SEQ ID NO: 429264 - protein, 9 aa, Influenza virus
GSSTYQSNF

SEQ ID NO: 429265 - protein, 9 aa, Influenza virus
VLLEDERTL

SEQ ID NO: 429266 - protein, 9 aa, Influenza virus
RIDYYWSML

SEQ ID NO: 429267 - protein, 9 aa, Influenza virus
VTFTFNGAF

SEQ ID NO: 429268 - protein, 9 aa, Influenza virus
VWLGRTVSI

SEQ ID NO: 429269 - protein, 9 aa, Influenza virus
RVWWTSNSI

SEQ ID NO: 429270 - protein, 9 aa, Influenza virus
IAGFAPFSK

SEQ ID NO: 429271 - protein, 9 aa, Influenza virus
CSVSECRTF

SEQ ID NO: 429272 - protein, 9 aa, Influenza virus
GRFTNEEAL

SEQ ID NO: 429273 - protein, 9 aa, Influenza virus
FALGQGATL

SEQ ID NO: 429274 - protein, 9 aa, Influenza virus
RIFLAMITY

SEQ ID NO: 429275 - protein, 9 aa, Influenza virus
RSHKICIGY

SEQ ID NO: 429276 - protein, 9 aa, Influenza virus
FRLLQSSQV

SEQ ID NO: 429277 - protein, 9 aa, Influenza virus
AYQAKFESV

SEQ ID NO: 429278 - protein, 9 aa, Influenza virus
KWSGYSGSF

SEQ ID NO: 429279 - protein, 9 aa, Influenza virus
YVNKNPYTL

SEQ ID NO: 429280 - protein, 9 aa, Influenza virus
REHLSSVSS

SEQ ID NO: 429281 - protein, 9 aa, Influenza virus
WTYNAELLI

SEQ ID NO: 429282 - protein, 9 aa, Influenza virus
YRALISWPQ

SEQ ID NO: 429283 - protein, 9 aa, Influenza virus
YLSGREWSY

SEQ ID NO: 429284 - protein, 9 aa, Influenza virus
LVISSDLSY

SEQ ID NO: 429285 - protein, 9 aa, Influenza virus
RMQLKDNAK

SEQ ID NO: 429286 - protein, 9 aa, Influenza virus
HALKLVVAM

SEQ ID NO: 429287 - protein, 9 aa, Influenza virus
SPGRVTVST

SEQ ID NO: 429288 - protein, 9 aa, Influenza virus
HQNEQGMGM

SEQ ID NO: 429289 - protein, 9 aa, Influenza virus
ATGLRNAHK

SEQ ID NO: 429290 - protein, 9 aa, Influenza virus
LASCMGLIY

SEQ ID NO: 429291 - protein, 9 aa, Influenza virus
IHHPDTEAV

SEQ ID NO: 429292 - protein, 9 aa, Influenza virus
RMQFSSLTV

SEQ ID NO: 429293 - protein, 9 aa, Influenza virus
ILGMQNGSY

SEQ ID NO: 429294 - protein, 9 aa, Influenza virus
AVVMGLVFI

SEQ ID NO: 429295 - protein, 9 aa, Influenza virus
RISHRTLLM

SEQ ID NO: 429296 - protein, 9 aa, Influenza virus
RSLMLATGM

SEQ ID NO: 429297 - protein, 9 aa, Influenza virus
ALISWPQSS

SEQ ID NO: 429298 - protein, 9 aa, Influenza virus
CSIDECRTF

SEQ ID NO: 429299 - protein, 9 aa, Influenza virus
HIFSKDNAI

SEQ ID NO: 429300 - protein, 9 aa, Influenza virus
YVWWTSNSL

SEQ ID NO: 429301 - protein, 9 aa, Influenza virus
ISFAMSCFL

SEQ ID NO: 429302 - protein, 9 aa, Influenza virus
STDSEMNKL

SEQ ID NO: 429303 - protein, 9 aa, Influenza virus
WTYQAELLI

SEQ ID NO: 429304 - protein, 9 aa, Influenza virus
WTYNAELLV

SEQ ID NO: 429305 - protein, 9 aa, Influenza virus
AMLNASCAA

SEQ ID NO: 429306 - protein, 9 aa, Influenza virus
GVYQILAIY

SEQ ID NO: 429307 - protein, 9 aa, Influenza virus
FIEGRWPGL

SEQ ID NO: 429308 - protein, 9 aa, Influenza virus
FIENGWEGL

SEQ ID NO: 429309 - protein, 9 aa, Influenza virus
GMTLSVVSL

SEQ ID NO: 429310 - protein, 9 aa, Influenza virus
YASSQLEGF

SEQ ID NO: 429311 - protein, 9 aa, Influenza virus
SLFEKFFPS

SEQ ID NO: 429312 - protein, 9 aa, Influenza virus
AAIKGIGTM

SEQ ID NO: 429313 - protein, 9 aa, Influenza virus
WFSFGASSF

SEQ ID NO: 429314 - protein, 9 aa, Influenza virus
MTSIRNNTY

SEQ ID NO: 429315 - protein, 9 aa, Influenza virus
HQISNVINW

SEQ ID NO: 429316 - protein, 9 aa, Influenza virus
SMSGFRSNL

SEQ ID NO: 429317 - protein, 9 aa, Influenza virus
ISMDSRSGY

SEQ ID NO: 429318 - protein, 9 aa, Influenza virus
AILPFDIDK

SEQ ID NO: 429319 - protein, 9 aa, Influenza virus
KTWAGKILR

SEQ ID NO: 429320 - protein, 9 aa, Influenza virus
SPLMVAYML

SEQ ID NO: 429321 - protein, 9 aa, Influenza virus
GQNHGICAV

SEQ ID NO: 429322 - protein, 9 aa, Influenza virus
SSFQVDCFL

SEQ ID NO: 429323 - protein, 9 aa, Influenza virus
LYGSGAKLI

SEQ ID NO: 429324 - protein, 9 aa, Influenza virus
LRGFLILGK

SEQ ID NO: 429325 - protein, 9 aa, Influenza virus
NILLHVASI

SEQ ID NO: 429326 - protein, 9 aa, Influenza virus
VRLYLWGVH

SEQ ID NO: 429327 - protein, 9 aa, Influenza virus
GVYQILSIY

SEQ ID NO: 429328 - protein, 9 aa, Influenza virus
ILIAGGLIL

SEQ ID NO: 429329 - protein, 9 aa, Influenza virus
RTFQNVSPL

SEQ ID NO: 429330 - protein, 9 aa, Influenza virus
LMQGSTLPR

SEQ ID NO: 429331 - protein, 9 aa, Influenza virus
SQKILCTSA

SEQ ID NO: 429332 - protein, 9 aa, Influenza virus
HRDEEGTGI

SEQ ID NO: 429333 - protein, 9 aa, Influenza virus
DQVKLSSGY

SEQ ID NO: 429334 - protein, 9 aa, Influenza virus
SIKSWRRDI

SEQ ID NO: 429335 - protein, 9 aa, Influenza virus
LRFVFSSAA

SEQ ID NO: 429336 - protein, 9 aa, Influenza virus
RIDFHWMLL

SEQ ID NO: 429337 - protein, 9 aa, Influenza virus
SSDDFALIL

SEQ ID NO: 429338 - protein, 9 aa, Influenza virus
NYKEICVAW

SEQ ID NO: 429339 - protein, 9 aa, Influenza virus
RIFLAMITY

SEQ ID NO: 429340 - protein, 9 aa, Influenza virus
REQLSSVSS

SEQ ID NO: 429341 - protein, 9 aa, Influenza virus
KRKRNSSIL

SEQ ID NO: 429342 - protein, 9 aa, Influenza virus
GILHLILWI

SEQ ID NO: 429343 - protein, 9 aa, Influenza virus
RTSYRTLLM

SEQ ID NO: 429344 - protein, 9 aa, Influenza virus
ALSYSTGAL

SEQ ID NO: 429345 - protein, 9 aa, Influenza virus
TITYSSSLM

SEQ ID NO: 429346 - protein, 9 aa, Influenza virus
LVADGGPNL

SEQ ID NO: 429347 - protein, 9 aa, Influenza virus
QLRENAEEM

SEQ ID NO: 429348 - protein, 9 aa, Influenza virus
VIMEVVFPN

SEQ ID NO: 429349 - protein, 9 aa, Influenza virus
STVVSSLAL

SEQ ID NO: 429350 - protein, 9 aa, Influenza virus
FALSGVAVA

SEQ ID NO: 429351 - protein, 9 aa, Influenza virus
WSYIVERPL

SEQ ID NO: 429352 - protein, 9 aa, Influenza virus
GTFDLGGLY

SEQ ID NO: 429353 - protein, 9 aa, Influenza virus
MEWLKTRPI

SEQ ID NO: 429354 - protein, 9 aa, Influenza virus
RELWQCYYL

SEQ ID NO: 429355 - protein, 9 aa, Influenza virus
NALTGGQSF

SEQ ID NO: 429356 - protein, 9 aa, Influenza virus
DRTPHRTLL

SEQ ID NO: 429357 - protein, 9 aa, Influenza virus
YSGSFTLPI

SEQ ID NO: 429358 - protein, 9 aa, Influenza virus
SLVASSGTL

SEQ ID NO: 429359 - protein, 9 aa, Influenza virus
KIDLWSYNA

SEQ ID NO: 429360 - protein, 9 aa, Influenza virus
WTSNSIIAF

SEQ ID NO: 429361 - protein, 9 aa, Influenza virus
MEVVFPNEV

SEQ ID NO: 429362 - protein, 9 aa, Influenza virus
SHMECRTFF

SEQ ID NO: 429363 - protein, 9 aa, Influenza virus
YPLQNLTKV

SEQ ID NO: 429364 - protein, 9 aa, Influenza virus
QMYQKCCSL

SEQ ID NO: 429365 - protein, 9 aa, Influenza virus
HIYGKDNAV

SEQ ID NO: 429366 - protein, 9 aa, Influenza virus
KICLGHHAV

SEQ ID NO: 429367 - protein, 9 aa, Influenza virus
NQGSFYRSM

SEQ ID NO: 429368 - protein, 9 aa, Influenza virus
SSSFYAEMK

SEQ ID NO: 429369 - protein, 9 aa, Influenza virus
ILCASATAI

SEQ ID NO: 429370 - protein, 9 aa, Influenza virus
TVMVGLILA

SEQ ID NO: 429371 - protein, 9 aa, Influenza virus
FRRPDSSWL

SEQ ID NO: 429372 - protein, 9 aa, Influenza virus
DLWSYNAEL

SEQ ID NO: 429373 - protein, 9 aa, Influenza virus
GRNSFYAEL

SEQ ID NO: 429374 - protein, 9 aa, Influenza virus
LIRMVKRGI

SEQ ID NO: 429375 - protein, 9 aa, Influenza virus
IMTIGSVSL

SEQ ID NO: 429376 - protein, 9 aa, Influenza virus
SSLVLAALI

SEQ ID NO: 429377 - protein, 9 aa, Influenza virus
LTIGECPKY

SEQ ID NO: 429378 - protein, 9 aa, Influenza virus
SMVEAESSV

SEQ ID NO: 429379 - protein, 9 aa, Influenza virus
FRNQIKIRR

SEQ ID NO: 429380 - protein, 9 aa, Influenza virus
YLIEDPAAP

SEQ ID NO: 429381 - protein, 9 aa, Influenza virus
LRDCKIEAV

SEQ ID NO: 429382 - protein, 9 aa, Influenza virus
IRINNETIL

SEQ ID NO: 429383 - protein, 9 aa, Influenza virus
VPQIQNRGL

SEQ ID NO: 429384 - protein, 9 aa, Influenza virus
WMMAMRYPI

SEQ ID NO: 429385 - protein, 9 aa, Influenza virus
FYRNLVWLV

SEQ ID NO: 429386 - protein, 9 aa, Influenza virus
FSVQRNLPF

SEQ ID NO: 429387 - protein, 9 aa, Influenza virus
ITLKFAFNM

SEQ ID NO: 429388 - protein, 9 aa, Influenza virus
IMIAGLFFW

SEQ ID NO: 429389 - protein, 9 aa, Influenza virus
MFLAMITYI

SEQ ID NO: 429390 - protein, 9 aa, Influenza virus
QARFEAVAW

SEQ ID NO: 429391 - protein, 9 aa, Influenza virus
FVANFSMEL

SEQ ID NO: 429392 - protein, 9 aa, Influenza virus
RSLFSSIKR

SEQ ID NO: 429393 - protein, 9 aa, Influenza virus
SLNITAASL

SEQ ID NO: 429394 - protein, 9 aa, Influenza virus
GLSMVKSDK

SEQ ID NO: 429395 - protein, 9 aa, Influenza virus
VLLENQKTL

SEQ ID NO: 429396 - protein, 9 aa, Influenza virus
LYQNVETYV

SEQ ID NO: 429397 - protein, 9 aa, Influenza virus
VSNSDWSGY

SEQ ID NO: 429398 - protein, 9 aa, Influenza virus
VVLNVSLHL

SEQ ID NO: 429399 - protein, 9 aa, Influenza virus
SPYRALMSC

SEQ ID NO: 429400 - protein, 9 aa, Influenza virus
VLGIINLLI

SEQ ID NO: 429401 - protein, 9 aa, Influenza virus
TSYKILSIY

SEQ ID NO: 429402 - protein, 9 aa, Influenza virus
SLERRLENL

SEQ ID NO: 429403 - protein, 9 aa, Influenza virus
CKVEGWVVV

SEQ ID NO: 429404 - protein, 9 aa, Influenza virus
LIEKTNDKY

SEQ ID NO: 429405 - protein, 9 aa, Influenza virus
VTYQILSIY

SEQ ID NO: 429406 - protein, 9 aa, Influenza virus
FESTGNLVA

SEQ ID NO: 429407 - protein, 9 aa, Influenza virus
VQMCTELKL

SEQ ID NO: 429408 - protein, 9 aa, Influenza virus
FSVQRNLPF

SEQ ID NO: 429409 - protein, 9 aa, Influenza virus
YSKVYKTYF

SEQ ID NO: 429410 - protein, 9 aa, Influenza virus
IVKTLTNEK

SEQ ID NO: 429411 - protein, 9 aa, Influenza virus
SPYNSRFES

SEQ ID NO: 429412 - protein, 9 aa, Influenza virus
MINNDLGPA

SEQ ID NO: 429413 - protein, 9 aa, Influenza virus
KILTIYSTA

SEQ ID NO: 429414 - protein, 9 aa, Influenza virus
EGRLIQNSM

SEQ ID NO: 429415 - protein, 9 aa, Influenza virus
CSIHECRTF

SEQ ID NO: 429416 - protein, 9 aa, Influenza virus
EGIYKILTI

SEQ ID NO: 429417 - protein, 9 aa, Influenza virus
SPRSRSGFE

SEQ ID NO: 429418 - protein, 9 aa, Influenza virus
TTNTINRSF

SEQ ID NO: 429419 - protein, 9 aa, Influenza virus
LIAPWYAYR

SEQ ID NO: 429420 - protein, 9 aa, Influenza virus
GMVNGWYGF

SEQ ID NO: 429421 - protein, 9 aa, Influenza virus
GADDEAYAV

SEQ ID NO: 429422 - protein, 9 aa, Influenza virus
GYGVKGFGF

SEQ ID NO: 429423 - protein, 9 aa, Influenza virus
YIPSGSLKL

SEQ ID NO: 429424 - protein, 9 aa, Influenza virus
KSLKLATGL

SEQ ID NO: 429425 - protein, 9 aa, Influenza virus
RTELINPNK

SEQ ID NO: 429426 - protein, 9 aa, Influenza virus
ISFAISCFL

SEQ ID NO: 429427 - protein, 9 aa, Influenza virus
GTFDLGGLY

SEQ ID NO: 429428 - protein, 9 aa, Influenza virus
FVALILGFV

SEQ ID NO: 429429 - protein, 9 aa, Influenza virus
KMQFSSLTV

SEQ ID NO: 429430 - protein, 9 aa, Influenza virus
SFLTHALRF

SEQ ID NO: 429431 - protein, 9 aa, Influenza virus
YLSNNSTEK

SEQ ID NO: 429432 - protein, 9 aa, Influenza virus
NVTHVQNNY

SEQ ID NO: 429433 - protein, 9 aa, Influenza virus
SRLNWLTKA

SEQ ID NO: 429434 - protein, 9 aa, Influenza virus
HQNEQGVGM

SEQ ID NO: 429435 - protein, 9 aa, Influenza virus
ILYFWGVHH

SEQ ID NO: 429436 - protein, 9 aa, Influenza virus
FESNGAFLA

SEQ ID NO: 429437 - protein, 9 aa, Influenza virus
YLSTNSTEK

SEQ ID NO: 429438 - protein, 9 aa, Influenza virus
MAMKYPITA

SEQ ID NO: 429439 - protein, 9 aa, Influenza virus
MQFSSLAVN

SEQ ID NO: 429440 - protein, 9 aa, Influenza virus
LIAPRYGYI

SEQ ID NO: 429441 - protein, 9 aa, Influenza virus
LPSFGVSGI

SEQ ID NO: 429442 - protein, 9 aa, Influenza virus
EMLKVPNAL

SEQ ID NO: 429443 - protein, 9 aa, Influenza virus
KSLKLASGL

SEQ ID NO: 429444 - protein, 9 aa, Influenza virus
NIGPRPLVM

SEQ ID NO: 429445 - protein, 9 aa, Influenza virus
KVDLWSYNA

SEQ ID NO: 429446 - protein, 9 aa, Influenza virus
PRYGYIIEK

SEQ ID NO: 429447 - protein, 9 aa, Influenza virus
NVYKVLAIY

SEQ ID NO: 429448 - protein, 9 aa, Influenza virus
TFLQALQLL

SEQ ID NO: 429449 - protein, 9 aa, Influenza virus
VTDSEMNKL

SEQ ID NO: 429450 - protein, 9 aa, Influenza virus
YQSTNSTEA

SEQ ID NO: 429451 - protein, 9 aa, Influenza virus
KFASICTHL

SEQ ID NO: 429452 - protein, 9 aa, Influenza virus
HHRSHRQMA

SEQ ID NO: 429453 - protein, 9 aa, Influenza virus
FHNIHPLAI

SEQ ID NO: 429454 - protein, 9 aa, Influenza virus
KVATGRVTV

SEQ ID NO: 429455 - protein, 9 aa, Influenza virus
YVWWASNSL

SEQ ID NO: 429456 - protein, 9 aa, Influenza virus
IEKMVLSAF

SEQ ID NO: 429457 - protein, 9 aa, Influenza virus
DLLENLQTY

SEQ ID NO: 429458 - protein, 9 aa, Influenza virus
RPKEMEGVC

SEQ ID NO: 429459 - protein, 9 aa, Influenza virus
NRVKIDPVK

SEQ ID NO: 429460 - protein, 9 aa, Influenza virus
YMNVKSLKL

SEQ ID NO: 429461 - protein, 9 aa, Influenza virus
LEENTTYRI

SEQ ID NO: 429462 - protein, 9 aa, Influenza virus
MENERTLDL

SEQ ID NO: 429463 - protein, 9 aa, Influenza virus
GSSTYQNSF

SEQ ID NO: 429464 - protein, 9 aa, Influenza virus
SRYVCTGIL

SEQ ID NO: 429465 - protein, 9 aa, Influenza virus
NVIVTREPY

SEQ ID NO: 429466 - protein, 9 aa, Influenza virus
FQNIHPITI

SEQ ID NO: 429467 - protein, 9 aa, Influenza virus
LEKAHNGKL

SEQ ID NO: 429468 - protein, 9 aa, Influenza virus
SKSTKSTVL

SEQ ID NO: 429469 - protein, 9 aa, Influenza virus
MENERILDF

SEQ ID NO: 429470 - protein, 9 aa, Influenza virus
CEKLEQSGL

SEQ ID NO: 429471 - protein, 9 aa, Influenza virus
FVAPDRVSF

SEQ ID NO: 429472 - protein, 9 aa, Influenza virus
WINSPNHVK

SEQ ID NO: 429473 - protein, 9 aa, Influenza virus
SASSQAYTK

SEQ ID NO: 429474 - protein, 9 aa, Influenza virus
NTYDHSTYR

SEQ ID NO: 429475 - protein, 9 aa, Influenza virus
LIMRTVIAL

SEQ ID NO: 429476 - protein, 9 aa, Influenza virus
FSFGASCVM

SEQ ID NO: 429477 - protein, 9 aa, Influenza virus
HRTLLMNEL

SEQ ID NO: 429478 - protein, 9 aa, Influenza virus
CSCYPNLGK

SEQ ID NO: 429479 - protein, 9 aa, Influenza virus
VSNNDWSGY

SEQ ID NO: 429480 - protein, 9 aa, Influenza virus
ITYGVCPRY

SEQ ID NO: 429481 - protein, 9 aa, Influenza virus
SRYSKADKI

SEQ ID NO: 429482 - protein, 9 aa, Influenza virus
MENQHTIDM

SEQ ID NO: 429483 - protein, 9 aa, Influenza virus
LYQNVGTYV

SEQ ID NO: 429484 - protein, 9 aa, Influenza virus
LASTTAKAM

SEQ ID NO: 429485 - protein, 9 aa, Influenza virus
RSLYSGFVR

SEQ ID NO: 429486 - protein, 9 aa, Influenza virus
IRKGLILEY

SEQ ID NO: 429487 - protein, 9 aa, Influenza virus
GLFGAKAGF

SEQ ID NO: 429488 - protein, 9 aa, Influenza virus
IFGAIAGFI

SEQ ID NO: 429489 - protein, 9 aa, Influenza virus
YVNTALLNA

SEQ ID NO: 429490 - protein, 9 aa, Influenza virus
WHSNLNDAT

SEQ ID NO: 429491 - protein, 9 aa, Influenza virus
FPYTGDPPY

SEQ ID NO: 429492 - protein, 9 aa, Influenza virus
FALGHGTTL

SEQ ID NO: 429493 - protein, 9 aa, Influenza virus
CPFQGFFPF

SEQ ID NO: 429494 - protein, 9 aa, Influenza virus
NPNQKIITI

SEQ ID NO: 429495 - protein, 9 aa, Influenza virus
SSVASSLVL

SEQ ID NO: 429496 - protein, 9 aa, Influenza virus
MADSTMLNL

SEQ ID NO: 429497 - protein, 9 aa, Influenza virus
TIGDCPKYV

SEQ ID NO: 429498 - protein, 9 aa, Influenza virus
EFIAEQFTW

SEQ ID NO: 429499 - protein, 9 aa, Influenza virus
FIFILLTHW

SEQ ID NO: 429500 - protein, 9 aa, Influenza virus
RADKICIGY

SEQ ID NO: 429501 - protein, 9 aa, Influenza virus
SSLPLALGM

SEQ ID NO: 429502 - protein, 9 aa, Influenza virus
LVRMIKRGI

SEQ ID NO: 429503 - protein, 9 aa, Influenza virus
AVRGDLNFV

SEQ ID NO: 429504 - protein, 9 aa, Influenza virus
NASTGGQSF

SEQ ID NO: 429505 - protein, 9 aa, Influenza virus
HTRGLFGAI

SEQ ID NO: 429506 - protein, 9 aa, Influenza virus
ISDGGPNLY

SEQ ID NO: 429507 - protein, 9 aa, Influenza virus
MVDGWYGYH

SEQ ID NO: 429508 - protein, 9 aa, Influenza virus
ISTASRSGY

SEQ ID NO: 429509 - protein, 9 aa, Influenza virus
NMDKAVKLY

SEQ ID NO: 429510 - protein, 9 aa, Influenza virus
NPNQKIVTI

SEQ ID NO: 429511 - protein, 9 aa, Influenza virus
SLCNVEGWV

SEQ ID NO: 429512 - protein, 9 aa, Influenza virus
LRSGYETFK

SEQ ID NO: 429513 - protein, 9 aa, Influenza virus
ESIAWSATA

SEQ ID NO: 429514 - protein, 9 aa, Influenza virus
TVASSLTLA

SEQ ID NO: 429515 - protein, 9 aa, Influenza virus
GTIHDRSQY

SEQ ID NO: 429516 - protein, 9 aa, Influenza virus
VPQIESRGL

SEQ ID NO: 429517 - protein, 9 aa, Influenza virus
KRQEIDGIK

SEQ ID NO: 429518 - protein, 9 aa, Influenza virus
LGDCSIAGW

SEQ ID NO: 429519 - protein, 9 aa, Influenza virus
WAVGRCPRY

SEQ ID NO: 429520 - protein, 9 aa, Influenza virus
SPYRALISW

SEQ ID NO: 429521 - protein, 9 aa, Influenza virus
CSLNGISPV

SEQ ID NO: 429522 - protein, 9 aa, Influenza virus
QMYQRCCNL

SEQ ID NO: 429523 - protein, 9 aa, Influenza virus
LENSHPGIF

SEQ ID NO: 429524 - protein, 9 aa, Influenza virus
VSGADNDAY

SEQ ID NO: 429525 - protein, 9 aa, Influenza virus
VVSSLVLAI

SEQ ID NO: 429526 - protein, 9 aa, Influenza virus
AQMALQLFI

SEQ ID NO: 429527 - protein, 9 aa, Influenza virus
RMFLAMITY

SEQ ID NO: 429528 - protein, 9 aa, Influenza virus
GSFCSIDGK

SEQ ID NO: 429529 - protein, 9 aa, Influenza virus
WTGMVDGWY

SEQ ID NO: 429530 - protein, 9 aa, Influenza virus
LIEKTNTQF

SEQ ID NO: 429531 - protein, 9 aa, Influenza virus
SFFYRYGFV

SEQ ID NO: 429532 - protein, 9 aa, Influenza virus
VASMRRNYF

SEQ ID NO: 429533 - protein, 9 aa, Influenza virus
ITYGPCPRY

SEQ ID NO: 429534 - protein, 9 aa, Influenza virus
MKIIRVGCV

SEQ ID NO: 429535 - protein, 9 aa, Influenza virus
GRIDFHWLV

SEQ ID NO: 429536 - protein, 9 aa, Influenza virus
YQKRMTRGL

SEQ ID NO: 429537 - protein, 9 aa, Influenza virus
LTFLARSAL

SEQ ID NO: 429538 - protein, 9 aa, Influenza virus
HSNDQGSGY

SEQ ID NO: 429539 - protein, 9 aa, Influenza virus
FHKCNDSCM

SEQ ID NO: 429540 - protein, 9 aa, Influenza virus
WLWLVLREK

SEQ ID NO: 429541 - protein, 9 aa, Influenza virus
NLIAPWYGY

SEQ ID NO: 429542 - protein, 9 aa, Influenza virus
TPRGEDNQF

SEQ ID NO: 429543 - protein, 9 aa, Influenza virus
NRDITIGSI

SEQ ID NO: 429544 - protein, 9 aa, Influenza virus
IAWSSSSCY

SEQ ID NO: 429545 - protein, 9 aa, Influenza virus
MRINNETIL

SEQ ID NO: 429546 - protein, 9 aa, Influenza virus
YPKVYKPYF

SEQ ID NO: 429547 - protein, 9 aa, Influenza virus
VQMCTELKL

SEQ ID NO: 429548 - protein, 9 aa, Influenza virus
RARIKTRLF

SEQ ID NO: 429549 - protein, 9 aa, Influenza virus
KINPVTLTM

SEQ ID NO: 429550 - protein, 9 aa, Influenza virus
IWSYNAQLL

SEQ ID NO: 429551 - protein, 9 aa, Influenza virus
VEITGINKV

SEQ ID NO: 429552 - protein, 9 aa, Influenza virus
GKIVHVSPL

SEQ ID NO: 429553 - protein, 9 aa, Influenza virus
TTLSTIALF

SEQ ID NO: 429554 - protein, 9 aa, Influenza virus
MTRGLFGAI

SEQ ID NO: 429555 - protein, 9 aa, Influenza virus
VSNDNWSGY

SEQ ID NO: 429556 - protein, 9 aa, Influenza virus
ASTGGQSFY

SEQ ID NO: 429557 - protein, 9 aa, Influenza virus
VFSSAASYK

SEQ ID NO: 429558 - protein, 9 aa, Influenza virus
KWGDVLDGV

SEQ ID NO: 429559 - protein, 9 aa, Influenza virus
IYCVCRDNW

SEQ ID NO: 429560 - protein, 9 aa, Influenza virus
LGDCSVAGW

SEQ ID NO: 429561 - protein, 9 aa, Influenza virus
YRICKLVGI

SEQ ID NO: 429562 - protein, 9 aa, Influenza virus
GAVAVLKYK

SEQ ID NO: 429563 - protein, 9 aa, Influenza virus
CQIAGFAPF

SEQ ID NO: 429564 - protein, 9 aa, Influenza virus
GENMAPEKV

SEQ ID NO: 429565 - protein, 9 aa, Influenza virus
ALQGTKRSY

SEQ ID NO: 429566 - protein, 9 aa, Influenza virus
IAMENQHTI

SEQ ID NO: 429567 - protein, 9 aa, Influenza virus
EKKAKLANV

SEQ ID NO: 429568 - protein, 9 aa, Influenza virus
QMYQKCCTL

SEQ ID NO: 429569 - protein, 9 aa, Influenza virus
YIWTYQAEL

SEQ ID NO: 429570 - protein, 9 aa, Influenza virus
AILVTTVTL

SEQ ID NO: 429571 - protein, 9 aa, Influenza virus
LRIRSNGNL

SEQ ID NO: 429572 - protein, 9 aa, Influenza virus
TMDYYWGIL

SEQ ID NO: 429573 - protein, 9 aa, Influenza virus
RPVDGIGSC

SEQ ID NO: 429574 - protein, 9 aa, Influenza virus
AEEDCTGCF

SEQ ID NO: 429575 - protein, 9 aa, Influenza virus
KTFQNVSPL

SEQ ID NO: 429576 - protein, 9 aa, Influenza virus
SRMSICISG

SEQ ID NO: 429577 - protein, 9 aa, Influenza virus
ASSLVLLLM

SEQ ID NO: 429578 - protein, 9 aa, Influenza virus
RMTDSIKSW

SEQ ID NO: 429579 - protein, 9 aa, Influenza virus
RLNNVIDKM

SEQ ID NO: 429580 - protein, 9 aa, Influenza virus
KRQEIEGIK

SEQ ID NO: 429581 - protein, 9 aa, Influenza virus
WTSSSSVVM

SEQ ID NO: 429582 - protein, 9 aa, Influenza virus
ASSLVLLLM

SEQ ID NO: 429583 - protein, 9 aa, Influenza virus
VRMQLRDNV

SEQ ID NO: 429584 - protein, 9 aa, Influenza virus
LPFHNVHPF

SEQ ID NO: 429585 - protein, 9 aa, Influenza virus
WVRMNNETI

SEQ ID NO: 429586 - protein, 9 aa, Influenza virus
HSMSDIEAM

SEQ ID NO: 429587 - protein, 9 aa, Influenza virus
NSTYKILSI

SEQ ID NO: 429588 - protein, 9 aa, Influenza virus
SASGQAYTK

SEQ ID NO: 429589 - protein, 9 aa, Influenza virus
TGRDVLVIW

SEQ ID NO: 429590 - protein, 9 aa, Influenza virus
LIEKTNEKY

SEQ ID NO: 429591 - protein, 9 aa, Influenza virus
QGVKLTQGY

SEQ ID NO: 429592 - protein, 9 aa, Influenza virus
GSFTLPVEM

SEQ ID NO: 429593 - protein, 9 aa, Influenza virus
EVYNETVRL

SEQ ID NO: 429594 - protein, 9 aa, Influenza virus
EVEQEIRTF

SEQ ID NO: 429595 - protein, 9 aa, Influenza virus
ALGIINLLI

SEQ ID NO: 429596 - protein, 9 aa, Influenza virus
RLYGSENKL

SEQ ID NO: 429597 - protein, 9 aa, Influenza virus
QRLNTMHQL

SEQ ID NO: 429598 - protein, 9 aa, Influenza virus
KFAAICTHL

SEQ ID NO: 429599 - protein, 9 aa, Influenza virus
TFLARSALI

SEQ ID NO: 429600 - protein, 9 aa, Influenza virus
STDTVDTLT

SEQ ID NO: 429601 - protein, 9 aa, Influenza virus
FFCLRNGNM

SEQ ID NO: 429602 - protein, 9 aa, Influenza virus
IIDIWAYNA

SEQ ID NO: 429603 - protein, 9 aa, Influenza virus
YVKQNTLKL

SEQ ID NO: 429604 - protein, 9 aa, Influenza virus
NLTKELCTI

SEQ ID NO: 429605 - protein, 9 aa, Influenza virus
WEINGPESV

SEQ ID NO: 429606 - protein, 9 aa, Influenza virus
VSNDNWSGY

SEQ ID NO: 429607 - protein, 9 aa, Influenza virus
LIIERRNSS

SEQ ID NO: 429608 - protein, 9 aa, Influenza virus
KVTNATETV

SEQ ID NO: 429609 - protein, 9 aa, Influenza virus
TPYRSLIQF

SEQ ID NO: 429610 - protein, 9 aa, Influenza virus
CFNPMTVEL

SEQ ID NO: 429611 - protein, 9 aa, Influenza virus
LKAEIAQKL

SEQ ID NO: 429612 - protein, 9 aa, Influenza virus
RRDYFTAEV

SEQ ID NO: 429613 - protein, 9 aa, Influenza virus
STDKVDTII

SEQ ID NO: 429614 - protein, 9 aa, Influenza virus
RRYELEIGT

SEQ ID NO: 429615 - protein, 9 aa, Influenza virus
LVISTDLSY

SEQ ID NO: 429616 - protein, 9 aa, Influenza virus
RGNSPIFNY

SEQ ID NO: 429617 - protein, 9 aa, Influenza virus
RIQDLERYV

SEQ ID NO: 429618 - protein, 9 aa, Influenza virus
CYPGSFNNY

SEQ ID NO: 429619 - protein, 9 aa, Influenza virus
GKISHISPL

SEQ ID NO: 429620 - protein, 9 aa, Influenza virus
YNAELIVLL

SEQ ID NO: 429621 - protein, 9 aa, Influenza virus
EVWSYNAEL

SEQ ID NO: 429622 - protein, 9 aa, Influenza virus
WSFALAQGV

SEQ ID NO: 429623 - protein, 9 aa, Influenza virus
KMTITFLIL

SEQ ID NO: 429624 - protein, 9 aa, Influenza virus
SQITNGTTG

SEQ ID NO: 429625 - protein, 9 aa, Influenza virus
VWIGRTKSL

SEQ ID NO: 429626 - protein, 9 aa, Influenza virus
FIVKGRSHL

SEQ ID NO: 429627 - protein, 9 aa, Influenza virus
WVRMNNETI

SEQ ID NO: 429628 - protein, 9 aa, Influenza virus
ALLIGVGNL

SEQ ID NO: 429629 - protein, 9 aa, Influenza virus
WTYNTELLV

SEQ ID NO: 429630 - protein, 9 aa, Influenza virus
GIYQILAIY

SEQ ID NO: 429631 - protein, 9 aa, Influenza virus
RIDDAVTDI

SEQ ID NO: 429632 - protein, 9 aa, Influenza virus
VTRREIHIY

SEQ ID NO: 429633 - protein, 9 aa, Influenza virus
RIGSKGDVF

SEQ ID NO: 429634 - protein, 9 aa, Influenza virus
SSMPFHNVH

SEQ ID NO: 429635 - protein, 9 aa, Influenza virus
YHKCNNECI

SEQ ID NO: 429636 - protein, 9 aa, Influenza virus
SRSSFYAEM

SEQ ID NO: 429637 - protein, 9 aa, Influenza virus
GLISTPLGT

SEQ ID NO: 429638 - protein, 9 aa, Influenza virus
IWAYNAELI

SEQ ID NO: 429639 - protein, 9 aa, Influenza virus
FRALVSWEM

SEQ ID NO: 429640 - protein, 9 aa, Influenza virus
IMWACSNGS

SEQ ID NO: 429641 - protein, 9 aa, Influenza virus
YLIEDPTAP

SEQ ID NO: 429642 - protein, 9 aa, Influenza virus
MALSVVSLL

SEQ ID NO: 429643 - protein, 9 aa, Influenza virus
SSCYDGKAW

SEQ ID NO: 429644 - protein, 9 aa, Influenza virus
ARQMVHAMR

SEQ ID NO: 429645 - protein, 9 aa, Influenza virus
YYFVKEGKI

SEQ ID NO: 429646 - protein, 9 aa, Influenza virus
SSSSFYAEM

SEQ ID NO: 429647 - protein, 9 aa, Influenza virus
WILWISFAM

SEQ ID NO: 429648 - protein, 9 aa, Influenza virus
FITPEYAYK

SEQ ID NO: 429649 - protein, 9 aa, Influenza virus
SPQLEGFSA

SEQ ID NO: 429650 - protein, 9 aa, Influenza virus
TIHDRSPYR

SEQ ID NO: 429651 - protein, 9 aa, Influenza virus
GRIFQSPIR

SEQ ID NO: 429652 - protein, 9 aa, Influenza virus
VLGVSVLNL

SEQ ID NO: 429653 - protein, 9 aa, Influenza virus
ITYGACPKY

SEQ ID NO: 429654 - protein, 9 aa, Influenza virus
GSFCSLDGK

SEQ ID NO: 429655 - protein, 9 aa, Influenza virus
APGVKGFGF

SEQ ID NO: 429656 - protein, 9 aa, Influenza virus
EVESEIRTF

SEQ ID NO: 429657 - protein, 9 aa, Influenza virus
SPNVYQARF

SEQ ID NO: 429658 - protein, 9 aa, Influenza virus
MGLRISSSF

SEQ ID NO: 429659 - protein, 9 aa, Influenza virus
SQVERRINM

SEQ ID NO: 429660 - protein, 9 aa, Influenza virus
SGYSGAFTI

SEQ ID NO: 429661 - protein, 9 aa, Influenza virus
CPVKGWAPL

SEQ ID NO: 429662 - protein, 9 aa, Influenza virus
QQIESIIEA

SEQ ID NO: 429663 - protein, 9 aa, Influenza virus
ILNTSQRGV

SEQ ID NO: 429664 - protein, 9 aa, Influenza virus
LEESHPGLF

SEQ ID NO: 429665 - protein, 9 aa, Influenza virus
YQKRMTRGL

SEQ ID NO: 429666 - protein, 9 aa, Influenza virus
FQNVSRYAF

SEQ ID NO: 429667 - protein, 10 aa, Influenza virus
LTDSEMSKLY

SEQ ID NO: 429668 - protein, 10 aa, Influenza virus
FLWCKIVTTV

SEQ ID NO: 429669 - protein, 10 aa, Influenza virus
RLFDYSGWNV

SEQ ID NO: 429670 - protein, 10 aa, Influenza virus
LSFQVDCFLW

SEQ ID NO: 429671 - protein, 10 aa, Influenza virus
VSSEVPGWSW

SEQ ID NO: 429672 - protein, 10 aa, Influenza virus
FQVDCYLWHI

SEQ ID NO: 429673 - protein, 10 aa, Influenza virus
FQVDCFLWHI

SEQ ID NO: 429674 - protein, 10 aa, Influenza virus
MLADWVDDAV

SEQ ID NO: 429675 - protein, 10 aa, Influenza virus
KTFQNVSPVW

SEQ ID NO: 429676 - protein, 10 aa, Influenza virus
KTFQNVSPIW

SEQ ID NO: 429677 - protein, 10 aa, Influenza virus
FIAPEYAYIV

SEQ ID NO: 429678 - protein, 10 aa, Influenza virus
SSFQVDCFLW

SEQ ID NO: 429679 - protein, 10 aa, Influenza virus
TSFQVDCYLW

SEQ ID NO: 429680 - protein, 10 aa, Influenza virus
KACELTDSTW

SEQ ID NO: 429681 - protein, 10 aa, Influenza virus
LADSEMLNLY

SEQ ID NO: 429682 - protein, 10 aa, Influenza virus
WEINGPDSVL

SEQ ID NO: 429683 - protein, 10 aa, Influenza virus
FSMELPSFGV

SEQ ID NO: 429684 - protein, 10 aa, Influenza virus
YQILAIYATV

SEQ ID NO: 429685 - protein, 10 aa, Influenza virus
KACELTDSIW

SEQ ID NO: 429686 - protein, 10 aa, Influenza virus
CPRYIPSGSL

SEQ ID NO: 429687 - protein, 10 aa, Influenza virus
LADSEMNNLY

SEQ ID NO: 429688 - protein, 10 aa, Influenza virus
FIAPEYAYRI

SEQ ID NO: 429689 - protein, 10 aa, Influenza virus
RPRRGLFGAI

SEQ ID NO: 429690 - protein, 10 aa, Influenza virus
YLSNNATDTV

SEQ ID NO: 429691 - protein, 10 aa, Influenza virus
YLSNNSTDTV

SEQ ID NO: 429692 - protein, 10 aa, Influenza virus
REPFISCSHL

SEQ ID NO: 429693 - protein, 10 aa, Influenza virus
MQALQLLFEV

SEQ ID NO: 429694 - protein, 10 aa, Influenza virus
LLMDSLKLSI

SEQ ID NO: 429695 - protein, 10 aa, Influenza virus
ILASSGSLEF

SEQ ID NO: 429696 - protein, 10 aa, Influenza virus
TEIWSYNAEL

SEQ ID NO: 429697 - protein, 10 aa, Influenza virus
YQILSIYSTV

SEQ ID NO: 429698 - protein, 10 aa, Influenza virus
MQFSSLAVNV

SEQ ID NO: 429699 - protein, 10 aa, Influenza virus
REFEVMNHEF

SEQ ID NO: 429700 - protein, 10 aa, Influenza virus
WTQDAMTEVW

SEQ ID NO: 429701 - protein, 10 aa, Influenza virus
CPRYVKQGSL

SEQ ID NO: 429702 - protein, 10 aa, Influenza virus
YEMLKVPNAL

SEQ ID NO: 429703 - protein, 10 aa, Influenza virus
SLRMKWMMAM

SEQ ID NO: 429704 - protein, 10 aa, Influenza virus
RPWIRFNSNL

SEQ ID NO: 429705 - protein, 10 aa, Influenza virus
HTIDVTDSEM

SEQ ID NO: 429706 - protein, 10 aa, Influenza virus
RSQYRALVSW

SEQ ID NO: 429707 - protein, 10 aa, Influenza virus
ILAATVTLHF

SEQ ID NO: 429708 - protein, 10 aa, Influenza virus
REFGVVNHEF

SEQ ID NO: 429709 - protein, 10 aa, Influenza virus
LLNASWFNSF

SEQ ID NO: 429710 - protein, 10 aa, Influenza virus
APRYAFELVF

SEQ ID NO: 429711 - protein, 10 aa, Influenza virus
RSQFRALISW

SEQ ID NO: 429712 - protein, 10 aa, Influenza virus
TEVWSYNAEL

SEQ ID NO: 429713 - protein, 10 aa, Influenza virus
LLMNELGVPL

SEQ ID NO: 429714 - protein, 10 aa, Influenza virus
FPSSSYRRPI

SEQ ID NO: 429715 - protein, 10 aa, Influenza virus
REFEVVDHEF

SEQ ID NO: 429716 - protein, 10 aa, Influenza virus
WTRDSVTELW

SEQ ID NO: 429717 - protein, 10 aa, Influenza virus
KELGNGCFEF

SEQ ID NO: 429718 - protein, 10 aa, Influenza virus
SSSFYAEMKW

SEQ ID NO: 429719 - protein, 10 aa, Influenza virus
KEIGNGCFEF

SEQ ID NO: 429720 - protein, 10 aa, Influenza virus
YLSNNSTDKV

SEQ ID NO: 429721 - protein, 10 aa, Influenza virus
MQNGSYRCMF

SEQ ID NO: 429722 - protein, 10 aa, Influenza virus
FSFGASCFLF

SEQ ID NO: 429723 - protein, 10 aa, Influenza virus
REDKRYGPAL

SEQ ID NO: 429724 - protein, 10 aa, Influenza virus
LLLNKSLCNV

SEQ ID NO: 429725 - protein, 10 aa, Influenza virus
KLSNMGIYQI

SEQ ID NO: 429726 - protein, 10 aa, Influenza virus
ASACHDGTSW

SEQ ID NO: 429727 - protein, 10 aa, Influenza virus
FIAPENAYKI

SEQ ID NO: 429728 - protein, 10 aa, Influenza virus
ILATTITLHF

SEQ ID NO: 429729 - protein, 10 aa, Influenza virus
FQSCFYVELI

SEQ ID NO: 429730 - protein, 10 aa, Influenza virus
ASACHDGASW

SEQ ID NO: 429731 - protein, 10 aa, Influenza virus
KEKEICSVVL

SEQ ID NO: 429732 - protein, 10 aa, Influenza virus
RIAWSSSSCF

SEQ ID NO: 429733 - protein, 10 aa, Influenza virus
REPYVSCDPI

SEQ ID NO: 429734 - protein, 10 aa, Influenza virus
TIYSTVASSF

SEQ ID NO: 429735 - protein, 10 aa, Influenza virus
FIAPDRATFL

SEQ ID NO: 429736 - protein, 10 aa, Influenza virus
IQFEAVGREF

SEQ ID NO: 429737 - protein, 10 aa, Influenza virus
DLIGKTSWSY

SEQ ID NO: 429738 - protein, 10 aa, Influenza virus
LLAKSVFNSL

SEQ ID NO: 429739 - protein, 10 aa, Influenza virus
ILVTTVTLHF

SEQ ID NO: 429740 - protein, 10 aa, Influenza virus
IMRTVIALSY

SEQ ID NO: 429741 - protein, 10 aa, Influenza virus
LMLNKSLCKV

SEQ ID NO: 429742 - protein, 10 aa, Influenza virus
MISPLAVTWW

SEQ ID NO: 429743 - protein, 10 aa, Influenza virus
LVASSGNLEF

SEQ ID NO: 429744 - protein, 10 aa, Influenza virus
SQDTELSFTV

SEQ ID NO: 429745 - protein, 10 aa, Influenza virus
RTELISPNKW

SEQ ID NO: 429746 - protein, 10 aa, Influenza virus
NSDLDYQIGY

SEQ ID NO: 429747 - protein, 10 aa, Influenza virus
LAIMMAGLSF

SEQ ID NO: 429748 - protein, 10 aa, Influenza virus
RVDDAVTDIW

SEQ ID NO: 429749 - protein, 10 aa, Influenza virus
WTRDAMTEIW

SEQ ID NO: 429750 - protein, 10 aa, Influenza virus
CATNINIREW

SEQ ID NO: 429751 - protein, 10 aa, Influenza virus
FVFSSAASYK

SEQ ID NO: 429752 - protein, 10 aa, Influenza virus
RPWVSFNHNL

SEQ ID NO: 429753 - protein, 10 aa, Influenza virus
NSDLNYQIGY

SEQ ID NO: 429754 - protein, 10 aa, Influenza virus
KATCVCRDNW

SEQ ID NO: 429755 - protein, 10 aa, Influenza virus
IQFTAVGKEF

SEQ ID NO: 429756 - protein, 10 aa, Influenza virus
WTRDSITEVW

SEQ ID NO: 429757 - protein, 10 aa, Influenza virus
YVWWASNSLI

SEQ ID NO: 429758 - protein, 10 aa, Influenza virus
SPFPVGSGSF

SEQ ID NO: 429759 - protein, 10 aa, Influenza virus
WTRDAMTEVW

SEQ ID NO: 429760 - protein, 10 aa, Influenza virus
KINDQIEDLW

SEQ ID NO: 429761 - protein, 10 aa, Influenza virus
NIIDKMNGNY

SEQ ID NO: 429762 - protein, 10 aa, Influenza virus
DVVNFVSMEF

SEQ ID NO: 429763 - protein, 10 aa, Influenza virus
CPKYISSGSL

SEQ ID NO: 429764 - protein, 10 aa, Influenza virus
KYNGIITDTF

SEQ ID NO: 429765 - protein, 10 aa, Influenza virus
REHLSSVSSF

SEQ ID NO: 429766 - protein, 10 aa, Influenza virus
EVSHCRATEY

SEQ ID NO: 429767 - protein, 10 aa, Influenza virus
DVVNYVSMEF

SEQ ID NO: 429768 - protein, 10 aa, Influenza virus
ASACHDGTNW

SEQ ID NO: 429769 - protein, 10 aa, Influenza virus
NTIDLTDSEM

SEQ ID NO: 429770 - protein, 10 aa, Influenza virus
RLIEKTNQQF

SEQ ID NO: 429771 - protein, 10 aa, Influenza virus
KLYDRVRLQL

SEQ ID NO: 429772 - protein, 10 aa, Influenza virus
QQMRDILGTF

SEQ ID NO: 429773 - protein, 10 aa, Influenza virus
VMVGLILAFI

SEQ ID NO: 429774 - protein, 10 aa, Influenza virus
FVFSIAASYK

SEQ ID NO: 429775 - protein, 10 aa, Influenza virus
LMSELGVPFY

SEQ ID NO: 429776 - protein, 10 aa, Influenza virus
KYIPSRSLKL

SEQ ID NO: 429777 - protein, 10 aa, Influenza virus
YVWWTSNSLI

SEQ ID NO: 429778 - protein, 10 aa, Influenza virus
DTTAVAVLKY

SEQ ID NO: 429779 - protein, 10 aa, Influenza virus
YYNKRLTTTI

SEQ ID NO: 429780 - protein, 10 aa, Influenza virus
YYNRRLTTTI

SEQ ID NO: 429781 - protein, 10 aa, Influenza virus
HQIEKEFTEV

SEQ ID NO: 429782 - protein, 10 aa, Influenza virus
VAFCGTSGTY

SEQ ID NO: 429783 - protein, 10 aa, Influenza virus
LIAPRGYFKV

SEQ ID NO: 429784 - protein, 10 aa, Influenza virus
SMTEIWSYNA

SEQ ID NO: 429785 - protein, 10 aa, Influenza virus
LLNRLNINPV

SEQ ID NO: 429786 - protein, 10 aa, Influenza virus
EMRRCLLQSL

SEQ ID NO: 429787 - protein, 10 aa, Influenza virus
VLWTSNSIVV

SEQ ID NO: 429788 - protein, 10 aa, Influenza virus
TSGTYGTGSW

SEQ ID NO: 429789 - protein, 10 aa, Influenza virus
KEFGNLERRL

SEQ ID NO: 429790 - protein, 10 aa, Influenza virus
LMLATGMKNV

SEQ ID NO: 429791 - protein, 10 aa, Influenza virus
VVSLGAISFW

SEQ ID NO: 429792 - protein, 10 aa, Influenza virus
AMTEVWSYNA

SEQ ID NO: 429793 - protein, 10 aa, Influenza virus
KLFASSGIAI

SEQ ID NO: 429794 - protein, 10 aa, Influenza virus
GLLGAIAGFI

SEQ ID NO: 429795 - protein, 10 aa, Influenza virus
ESIKNGTYDY

SEQ ID NO: 429796 - protein, 10 aa, Influenza virus
FQYLLFQDIL

SEQ ID NO: 429797 - protein, 10 aa, Influenza virus
LYNKVEFEPF

SEQ ID NO: 429798 - protein, 10 aa, Influenza virus
RAVDGTIAGF

SEQ ID NO: 429799 - protein, 10 aa, Influenza virus
YHANNSTDTI

SEQ ID NO: 429800 - protein, 10 aa, Influenza virus
SLCEVNSWHI

SEQ ID NO: 429801 - protein, 10 aa, Influenza virus
LVSLGAVSFW

SEQ ID NO: 429802 - protein, 10 aa, Influenza virus
NEWSGYSGSF

SEQ ID NO: 429803 - protein, 10 aa, Influenza virus
FQLFLVCVSL

SEQ ID NO: 429804 - protein, 10 aa, Influenza virus
WHIYGKDNAI

SEQ ID NO: 429805 - protein, 10 aa, Influenza virus
GTFEFTSFFY

SEQ ID NO: 429806 - protein, 10 aa, Influenza virus
FSGYKDIILW

SEQ ID NO: 429807 - protein, 10 aa, Influenza virus
SVASSLVLLF

SEQ ID NO: 429808 - protein, 10 aa, Influenza virus
ICAVATTHSW

SEQ ID NO: 429809 - protein, 10 aa, Influenza virus
FHLGTRQVCI

SEQ ID NO: 429810 - protein, 10 aa, Influenza virus
THMMIWHSNL

SEQ ID NO: 429811 - protein, 10 aa, Influenza virus
SMTEVWSYNA

SEQ ID NO: 429812 - protein, 10 aa, Influenza virus
RMDYYWAILK

SEQ ID NO: 429813 - protein, 10 aa, Influenza virus
IEDPAAPHGL

SEQ ID NO: 429814 - protein, 10 aa, Influenza virus
SLYDKVRMQL

SEQ ID NO: 429815 - protein, 10 aa, Influenza virus
KEFSNLEKRL

SEQ ID NO: 429816 - protein, 10 aa, Influenza virus
ATACSDGPGW

SEQ ID NO: 429817 - protein, 10 aa, Influenza virus
RSSSSFYAEM

SEQ ID NO: 429818 - protein, 10 aa, Influenza virus
RLAAGGDIWV

SEQ ID NO: 429819 - protein, 10 aa, Influenza virus
NTYQWVIRNW

SEQ ID NO: 429820 - protein, 10 aa, Influenza virus
KTGTFEFTSF

SEQ ID NO: 429821 - protein, 10 aa, Influenza virus
EIKGVELSSM

SEQ ID NO: 429822 - protein, 10 aa, Influenza virus
LTITYSSSLM

SEQ ID NO: 429823 - protein, 10 aa, Influenza virus
SPVSVGSGSF

SEQ ID NO: 429824 - protein, 10 aa, Influenza virus
LIVSLGAISF

SEQ ID NO: 429825 - protein, 10 aa, Influenza virus
LYNKIEFEPF

SEQ ID NO: 429826 - protein, 10 aa, Influenza virus
SYLECRTFFL

SEQ ID NO: 429827 - protein, 10 aa, Influenza virus
KEFNNLEKRL

SEQ ID NO: 429828 - protein, 10 aa, Influenza virus
SSSCFDGKEW

SEQ ID NO: 429829 - protein, 10 aa, Influenza virus
LPRRSGAAGA

SEQ ID NO: 429830 - protein, 10 aa, Influenza virus
SEVEGRIQDL

SEQ ID NO: 429831 - protein, 10 aa, Influenza virus
FHLGTKQVCM

SEQ ID NO: 429832 - protein, 10 aa, Influenza virus
YRSMRWLTLK

SEQ ID NO: 429833 - protein, 10 aa, Influenza virus
SEFSETEHQI

SEQ ID NO: 429834 - protein, 10 aa, Influenza virus
IVMVGLILAF

SEQ ID NO: 429835 - protein, 10 aa, Influenza virus
IINSWHIYGK

SEQ ID NO: 429836 - protein, 10 aa, Influenza virus
VESAVLRGFL

SEQ ID NO: 429837 - protein, 10 aa, Influenza virus
KIMESGGISK

SEQ ID NO: 429838 - protein, 10 aa, Influenza virus
QADSEMNKLY

SEQ ID NO: 429839 - protein, 10 aa, Influenza virus
FIWAIHHPPT

SEQ ID NO: 429840 - protein, 10 aa, Influenza virus
LTITYSSSLM

SEQ ID NO: 429841 - protein, 10 aa, Influenza virus
FSFGASCFLF

SEQ ID NO: 429842 - protein, 10 aa, Influenza virus
TTGRDVLVIW

SEQ ID NO: 429843 - protein, 10 aa, Influenza virus
KESLRLAIGL

SEQ ID NO: 429844 - protein, 10 aa, Influenza virus
RFIEKTNQQF

SEQ ID NO: 429845 - protein, 10 aa, Influenza virus
RSPYRALISW

SEQ ID NO: 429846 - protein, 10 aa, Influenza virus
SISCFLLAAL

SEQ ID NO: 429847 - protein, 10 aa, Influenza virus
NVINWTQDAM

SEQ ID NO: 429848 - protein, 10 aa, Influenza virus
NRNQPAATAL

SEQ ID NO: 429849 - protein, 10 aa, Influenza virus
NRMQFSSLTV

SEQ ID NO: 429850 - protein, 10 aa, Influenza virus
KEDRRYGPAL

SEQ ID NO: 429851 - protein, 10 aa, Influenza virus
CVAWSSTSCF

SEQ ID NO: 429852 - protein, 10 aa, Influenza virus
FSFGASCFVL

SEQ ID NO: 429853 - protein, 10 aa, Influenza virus
TKMEAILVVL

SEQ ID NO: 429854 - protein, 10 aa, Influenza virus
TSGKQMLIIW

SEQ ID NO: 429855 - protein, 10 aa, Influenza virus
RSPFRALISW

SEQ ID NO: 429856 - protein, 10 aa, Influenza virus
FHLGTKQVCI

SEQ ID NO: 429857 - protein, 10 aa, Influenza virus
FYRSIRWLTL

SEQ ID NO: 429858 - protein, 10 aa, Influenza virus
FQLFLVCVSL

SEQ ID NO: 429859 - protein, 10 aa, Influenza virus
RMGVQMHRFK

SEQ ID NO: 429860 - protein, 10 aa, Influenza virus
KENKRYGPAL

SEQ ID NO: 429861 - protein, 10 aa, Influenza virus
RMGLQMQRFK

SEQ ID NO: 429862 - protein, 10 aa, Influenza virus
FIFLLLTHWA

SEQ ID NO: 429863 - protein, 10 aa, Influenza virus
RECFNPCFYV

SEQ ID NO: 429864 - protein, 10 aa, Influenza virus
GTYDYPKYEK

SEQ ID NO: 429865 - protein, 10 aa, Influenza virus
FTIGECPKYV

SEQ ID NO: 429866 - protein, 10 aa, Influenza virus
ETGNGCFEFY

SEQ ID NO: 429867 - protein, 10 aa, Influenza virus
IIRALTLNTM

SEQ ID NO: 429868 - protein, 10 aa, Influenza virus
VLDDCSLKGL

SEQ ID NO: 429869 - protein, 10 aa, Influenza virus
WHIFGKDNAV

SEQ ID NO: 429870 - protein, 10 aa, Influenza virus
GEVFVIREPF

SEQ ID NO: 429871 - protein, 10 aa, Influenza virus
TGSYVRLYLW

SEQ ID NO: 429872 - protein, 10 aa, Influenza virus
FYRNMRWLTL

SEQ ID NO: 429873 - protein, 10 aa, Influenza virus
SEECSCYVDI

SEQ ID NO: 429874 - protein, 10 aa, Influenza virus
LHLTGKWDTL

SEQ ID NO: 429875 - protein, 10 aa, Influenza virus
RMGVQMQRFK

SEQ ID NO: 429876 - protein, 10 aa, Influenza virus
FHLGTKQVCV

SEQ ID NO: 429877 - protein, 10 aa, Influenza virus
GPAECRTFFL

SEQ ID NO: 429878 - protein, 10 aa, Influenza virus
RAVDGTIAGF

SEQ ID NO: 429879 - protein, 10 aa, Influenza virus
FRNVLSVAPI

SEQ ID NO: 429880 - protein, 10 aa, Influenza virus
YYNGRLTTTI

SEQ ID NO: 429881 - protein, 10 aa, Influenza virus
GTYDHKEFEK

SEQ ID NO: 429882 - protein, 10 aa, Influenza virus
SRFQIQGVKL

SEQ ID NO: 429883 - protein, 10 aa, Influenza virus
CHDGTNWLTI

SEQ ID NO: 429884 - protein, 10 aa, Influenza virus
SRMQFSSLAV

SEQ ID NO: 429885 - protein, 10 aa, Influenza virus
TYQNNFVPVI

SEQ ID NO: 429886 - protein, 10 aa, Influenza virus
YEMLKVPNAL

SEQ ID NO: 429887 - protein, 10 aa, Influenza virus
FSFGASCFIL

SEQ ID NO: 429888 - protein, 10 aa, Influenza virus
IPSGSLKLAI

SEQ ID NO: 429889 - protein, 10 aa, Influenza virus
KMEDGFLDVW

SEQ ID NO: 429890 - protein, 10 aa, Influenza virus
SSSCHDGKSW

SEQ ID NO: 429891 - protein, 10 aa, Influenza virus
LLAVVMGLVF

SEQ ID NO: 429892 - protein, 10 aa, Influenza virus
VVFCGTSGIY

SEQ ID NO: 429893 - protein, 10 aa, Influenza virus
RLSAGGDIWV

SEQ ID NO: 429894 - protein, 10 aa, Influenza virus
SVRGSGMRIL

SEQ ID NO: 429895 - protein, 10 aa, Influenza virus
SEGTGTAADL

SEQ ID NO: 429896 - protein, 10 aa, Influenza virus
KSYINRTGTF

SEQ ID NO: 429897 - protein, 10 aa, Influenza virus
RLQDTTWDVF

SEQ ID NO: 429898 - protein, 10 aa, Influenza virus
WISFSMSCFV

SEQ ID NO: 429899 - protein, 10 aa, Influenza virus
YLMLSKSLCK

SEQ ID NO: 429900 - protein, 10 aa, Influenza virus
FGFRQGNNVW

SEQ ID NO: 429901 - protein, 10 aa, Influenza virus
FQPCFYVELI

SEQ ID NO: 429902 - protein, 10 aa, Influenza virus
RSMRWLTLKL

SEQ ID NO: 429903 - protein, 10 aa, Influenza virus
CHDGISWLTI

SEQ ID NO: 429904 - protein, 10 aa, Influenza virus
LYASKNPYTL

SEQ ID NO: 429905 - protein, 10 aa, Influenza virus
LMENERTLGF

SEQ ID NO: 429906 - protein, 10 aa, Influenza virus
RRATVSADPL

SEQ ID NO: 429907 - protein, 10 aa, Influenza virus
FYRNMRWLTL

SEQ ID NO: 429908 - protein, 10 aa, Influenza virus
SSRSGFEVLF

SEQ ID NO: 429909 - protein, 10 aa, Influenza virus
RPWIRFNSNL

SEQ ID NO: 429910 - protein, 10 aa, Influenza virus
KLFTLSGVAI

SEQ ID NO: 429911 - protein, 10 aa, Influenza virus
ETIKNGTYNH

SEQ ID NO: 429912 - protein, 10 aa, Influenza virus
AIMVAGLSFW

SEQ ID NO: 429913 - protein, 10 aa, Influenza virus
EIAQRLESVF

SEQ ID NO: 429914 - protein, 10 aa, Influenza virus
EVSFQGRGVF

SEQ ID NO: 429915 - protein, 10 aa, Influenza virus
AIYSCIASSI

SEQ ID NO: 429916 - protein, 10 aa, Influenza virus
SMPFHNIHPL

SEQ ID NO: 429917 - protein, 10 aa, Influenza virus
ALISWEMGLA

SEQ ID NO: 429918 - protein, 10 aa, Influenza virus
KYHWNLALDI

SEQ ID NO: 429919 - protein, 10 aa, Influenza virus
EISHCRATEY

SEQ ID NO: 429920 - protein, 10 aa, Influenza virus
CPKYVNVRSL

SEQ ID NO: 429921 - protein, 10 aa, Influenza virus
QLSSVSSFEK

SEQ ID NO: 429922 - protein, 10 aa, Influenza virus
NQNPRMFLAM

SEQ ID NO: 429923 - protein, 10 aa, Influenza virus
KSYINRTGTF

SEQ ID NO: 429924 - protein, 10 aa, Influenza virus
ESVRNGTYNY

SEQ ID NO: 429925 - protein, 10 aa, Influenza virus
GTFEFTSFFY

SEQ ID NO: 429926 - protein, 10 aa, Influenza virus
LEENTSYKIL

SEQ ID NO: 429927 - protein, 10 aa, Influenza virus
VVFCGASGTY

SEQ ID NO: 429928 - protein, 10 aa, Influenza virus
YREESLLNRL

SEQ ID NO: 429929 - protein, 10 aa, Influenza virus
SERLVLATGL

SEQ ID NO: 429930 - protein, 10 aa, Influenza virus
GPNNNASAVI

SEQ ID NO: 429931 - protein, 10 aa, Influenza virus
STSCFDGKEW

SEQ ID NO: 429932 - protein, 10 aa, Influenza virus
LSSSGNNQVF

SEQ ID NO: 429933 - protein, 10 aa, Influenza virus
SIYSCIASSI

SEQ ID NO: 429934 - protein, 10 aa, Influenza virus
LLAPRYGYII

SEQ ID NO: 429935 - protein, 10 aa, Influenza virus
SLCSIWFSHY

SEQ ID NO: 429936 - protein, 10 aa, Influenza virus
TLKIRTNGNL

SEQ ID NO: 429937 - protein, 10 aa, Influenza virus
FRNILSIAPI

SEQ ID NO: 429938 - protein, 10 aa, Influenza virus
KLVGINMSKK

SEQ ID NO: 429939 - protein, 10 aa, Influenza virus
SFFRNIVWLI

SEQ ID NO: 429940 - protein, 10 aa, Influenza virus
CHDGSSWLTI

SEQ ID NO: 429941 - protein, 10 aa, Influenza virus
NQNPRVFLAM

SEQ ID NO: 429942 - protein, 10 aa, Influenza virus
LMLNKSLCKI

SEQ ID NO: 429943 - protein, 10 aa, Influenza virus
FALSGVAVAL

SEQ ID NO: 429944 - protein, 10 aa, Influenza virus
ILANNGKFEF

SEQ ID NO: 429945 - protein, 10 aa, Influenza virus
GTFDTTQIIK

SEQ ID NO: 429946 - protein, 10 aa, Influenza virus
IVDNNSWSGY

SEQ ID NO: 429947 - protein, 10 aa, Influenza virus
ALISWGMGQA

SEQ ID NO: 429948 - protein, 10 aa, Influenza virus
CHDGVNRMTI

SEQ ID NO: 429949 - protein, 10 aa, Influenza virus
CMATIRNGTY

SEQ ID NO: 429950 - protein, 10 aa, Influenza virus
WHILSKDNAV

SEQ ID NO: 429951 - protein, 10 aa, Influenza virus
SFQGRGVFEF

SEQ ID NO: 429952 - protein, 10 aa, Influenza virus
KTNLYGFIIK

SEQ ID NO: 429953 - protein, 10 aa, Influenza virus
EIKGVKLSSM

SEQ ID NO: 429954 - protein, 10 aa, Influenza virus
LEENTTYRIL

SEQ ID NO: 429955 - protein, 10 aa, Influenza virus
NVIDKMNNQF

SEQ ID NO: 429956 - protein, 10 aa, Influenza virus
KRVRLFDYSR

SEQ ID NO: 429957 - protein, 10 aa, Influenza virus
KYIKSGQLKL

SEQ ID NO: 429958 - protein, 10 aa, Influenza virus
YYDRRLTTTI

SEQ ID NO: 429959 - protein, 10 aa, Influenza virus
KVTCVCRDNW

SEQ ID NO: 429960 - protein, 10 aa, Influenza virus
GPSECRTFFL

SEQ ID NO: 429961 - protein, 10 aa, Influenza virus
SVIEKMNTQF

SEQ ID NO: 429962 - protein, 10 aa, Influenza virus
ALAQGVLLGT

SEQ ID NO: 429963 - protein, 10 aa, Influenza virus
CGVDSDTTSW

SEQ ID NO: 429964 - protein, 10 aa, Influenza virus
KLNGIPPLEL

SEQ ID NO: 429965 - protein, 10 aa, Influenza virus
RTNLYGFIIK

SEQ ID NO: 429966 - protein, 10 aa, Influenza virus
SIIEKMNTQF

SEQ ID NO: 429967 - protein, 10 aa, Influenza virus
FSFGASCLIL

SEQ ID NO: 429968 - protein, 10 aa, Influenza virus
SLVGVDPFRL

SEQ ID NO: 429969 - protein, 10 aa, Influenza virus
GLIDGWYGFK

SEQ ID NO: 429970 - protein, 10 aa, Influenza virus
WETTGRNCTV

SEQ ID NO: 429971 - protein, 10 aa, Influenza virus
SEMNNLYERV

SEQ ID NO: 429972 - protein, 10 aa, Influenza virus
IVDNNNWSGY

SEQ ID NO: 429973 - protein, 10 aa, Influenza virus
MIALILVALA

SEQ ID NO: 429974 - protein, 10 aa, Influenza virus
NQVENRINML

SEQ ID NO: 429975 - protein, 10 aa, Influenza virus
LVAGGLILGM

SEQ ID NO: 429976 - protein, 10 aa, Influenza virus
MALQGTKRSY

SEQ ID NO: 429977 - protein, 10 aa, Influenza virus
IVDNSNWSGY

SEQ ID NO: 429978 - protein, 10 aa, Influenza virus
KIDDQIEELW

SEQ ID NO: 429979 - protein, 10 aa, Influenza virus
MASQGTKRSY

SEQ ID NO: 429980 - protein, 10 aa, Influenza virus
MLNLYDRVRK

SEQ ID NO: 429981 - protein, 10 aa, Influenza virus
SLVGVDPFKL

SEQ ID NO: 429982 - protein, 10 aa, Influenza virus
IEIWSYNAEF

SEQ ID NO: 429983 - protein, 10 aa, Influenza virus
MLNLYERVRK

SEQ ID NO: 429984 - protein, 10 aa, Influenza virus
SLRMKWMMAM

SEQ ID NO: 429985 - protein, 10 aa, Influenza virus
YHANNSTEQV

SEQ ID NO: 429986 - protein, 10 aa, Influenza virus
GTFDTVQIIK

SEQ ID NO: 429987 - protein, 10 aa, Influenza virus
SFFRNMVWLI

SEQ ID NO: 429988 - protein, 10 aa, Influenza virus
LAKSVFNSIY

SEQ ID NO: 429989 - protein, 10 aa, Influenza virus
WVRFNSDLDY

SEQ ID NO: 429990 - protein, 10 aa, Influenza virus
RRKRGLFGAI

SEQ ID NO: 429991 - protein, 10 aa, Influenza virus
VLASTTAKAM

SEQ ID NO: 429992 - protein, 10 aa, Influenza virus
RIFLAMITYI

SEQ ID NO: 429993 - protein, 10 aa, Influenza virus
KLKSEDNVYK

SEQ ID NO: 429994 - protein, 10 aa, Influenza virus
NQTKTMTITF

SEQ ID NO: 429995 - protein, 10 aa, Influenza virus
MASQGTKRPY

SEQ ID NO: 429996 - protein, 10 aa, Influenza virus
RSINWLTKKK

SEQ ID NO: 429997 - protein, 10 aa, Influenza virus
GRMDYYWAVL

SEQ ID NO: 429998 - protein, 10 aa, Influenza virus
RRVENLNKKM

SEQ ID NO: 429999 - protein, 10 aa, Influenza virus
SRMQFSSLAV

SEQ ID NO: 430000 - protein, 10 aa, Influenza virus
KYIKQGSLKL

SEQ ID NO: 430001 - protein, 10 aa, Influenza virus
FALSGVAIAL

SEQ ID NO: 430002 - protein, 10 aa, Influenza virus
LRMKWMMAMK

SEQ ID NO: 430003 - protein, 10 aa, Influenza virus
SVIEKMNTQF

SEQ ID NO: 430004 - protein, 10 aa, Influenza virus
DVWMGRTISM

SEQ ID NO: 430005 - protein, 10 aa, Influenza virus
FYRSIRWLTL

SEQ ID NO: 430006 - protein, 10 aa, Influenza virus
SFFRNMIWLI

SEQ ID NO: 430007 - protein, 10 aa, Influenza virus
RVFLAMITYI

SEQ ID NO: 430008 - protein, 10 aa, Influenza virus
EVPSPYNSRF

SEQ ID NO: 430009 - protein, 10 aa, Influenza virus
FALGQGTTLY

SEQ ID NO: 430010 - protein, 10 aa, Influenza virus
RPWISFDQNL

SEQ ID NO: 430011 - protein, 10 aa, Influenza virus
VPEKIRTRGL

SEQ ID NO: 430012 - protein, 10 aa, Influenza virus
EQMYQKCCTL

SEQ ID NO: 430013 - protein, 10 aa, Influenza virus
VLLGSSPNAY

SEQ ID NO: 430014 - protein, 10 aa, Influenza virus
FRNVVWLTKK

SEQ ID NO: 430015 - protein, 10 aa, Influenza virus
YKMNTQILVF

SEQ ID NO: 430016 - protein, 10 aa, Influenza virus
MQLRDNAKEL

SEQ ID NO: 430017 - protein, 10 aa, Influenza virus
NLYDRVRMQL

SEQ ID NO: 430018 - protein, 10 aa, Influenza virus
WHIFSKDNAI

SEQ ID NO: 430019 - protein, 10 aa, Influenza virus
LIKHENRMVL

SEQ ID NO: 430020 - protein, 10 aa, Influenza virus
SVSECRTFFL

SEQ ID NO: 430021 - protein, 10 aa, Influenza virus
WAYNAELLVL

SEQ ID NO: 430022 - protein, 10 aa, Influenza virus
CPKYIKSGQL

SEQ ID NO: 430023 - protein, 10 aa, Influenza virus
VLSCIFCLAF

SEQ ID NO: 430024 - protein, 10 aa, Influenza virus
LELRSRYWAI

SEQ ID NO: 430025 - protein, 10 aa, Influenza virus
CQNGNIRCTF

SEQ ID NO: 430026 - protein, 10 aa, Influenza virus
TLSSVTTNTI

SEQ ID NO: 430027 - protein, 10 aa, Influenza virus
VVYAELLVAM

SEQ ID NO: 430028 - protein, 10 aa, Influenza virus
RVRLFDYSRW

SEQ ID NO: 430029 - protein, 10 aa, Influenza virus
IMFSNKMARL

SEQ ID NO: 430030 - protein, 10 aa, Influenza virus
LANQSLPPNF

SEQ ID NO: 430031 - protein, 10 aa, Influenza virus
NLIAPWYAYK

SEQ ID NO: 430032 - protein, 10 aa, Influenza virus
REPFVACGPA

SEQ ID NO: 430033 - protein, 10 aa, Influenza virus
FRNVVWLIKK

SEQ ID NO: 430034 - protein, 10 aa, Influenza virus
THIMIWHSNL

SEQ ID NO: 430035 - protein, 10 aa, Influenza virus
LLMNELGVPL

SEQ ID NO: 430036 - protein, 10 aa, Influenza virus
LWFSFGASSF

SEQ ID NO: 430037 - protein, 10 aa, Influenza virus
SIIGKMNTQF

SEQ ID NO: 430038 - protein, 10 aa, Influenza virus
LIAPEFGYLL

SEQ ID NO: 430039 - protein, 10 aa, Influenza virus
YPKYSEESKL

SEQ ID NO: 430040 - protein, 10 aa, Influenza virus
STASRSGYEM

SEQ ID NO: 430041 - protein, 10 aa, Influenza virus
GADGVKGFSY

SEQ ID NO: 430042 - protein, 10 aa, Influenza virus
LIAPEYGYLI

SEQ ID NO: 430043 - protein, 10 aa, Influenza virus
RVFLTMITYI

SEQ ID NO: 430044 - protein, 10 aa, Influenza virus
GSLNFVSMEF

SEQ ID NO: 430045 - protein, 10 aa, Influenza virus
RTRALVRTGM

SEQ ID NO: 430046 - protein, 10 aa, Influenza virus
RSSSSFYAEM

SEQ ID NO: 430047 - protein, 10 aa, Influenza virus
NLYDKVRMQL

SEQ ID NO: 430048 - protein, 10 aa, Influenza virus
RLIDFLKDVI

SEQ ID NO: 430049 - protein, 10 aa, Influenza virus
APGTKGFGFL

SEQ ID NO: 430050 - protein, 10 aa, Influenza virus
YFFGDNAEEF

SEQ ID NO: 430051 - protein, 10 aa, Influenza virus
AQIIKLLPFA

SEQ ID NO: 430052 - protein, 10 aa, Influenza virus
CIAWSSSSCY

SEQ ID NO: 430053 - protein, 10 aa, Influenza virus
LTLKSGQFPV

SEQ ID NO: 430054 - protein, 10 aa, Influenza virus
WLTKATNGNY

SEQ ID NO: 430055 - protein, 10 aa, Influenza virus
GTAPVLGNYK

SEQ ID NO: 430056 - protein, 10 aa, Influenza virus
HHAVPNGTVV

SEQ ID NO: 430057 - protein, 10 aa, Influenza virus
SIYSTAASSL

SEQ ID NO: 430058 - protein, 10 aa, Influenza virus
TVMVGLILAF

SEQ ID NO: 430059 - protein, 10 aa, Influenza virus
WIRFNSDLDY

SEQ ID NO: 430060 - protein, 10 aa, Influenza virus
RRTNLYGFII

SEQ ID NO: 430061 - protein, 10 aa, Influenza virus
GVITDTLKSW

SEQ ID NO: 430062 - protein, 10 aa, Influenza virus
RLSGIPPLEL

SEQ ID NO: 430063 - protein, 10 aa, Influenza virus
GRMDYYWAVL

SEQ ID NO: 430064 - protein, 10 aa, Influenza virus
SEMLNLYERV

SEQ ID NO: 430065 - protein, 10 aa, Influenza virus
IMFSNKVARL

SEQ ID NO: 430066 - protein, 10 aa, Influenza virus
KIDTLTETGV

SEQ ID NO: 430067 - protein, 10 aa, Influenza virus
ESNGNLVAPW

SEQ ID NO: 430068 - protein, 10 aa, Influenza virus
SEGMGQAADL

SEQ ID NO: 430069 - protein, 10 aa, Influenza virus
LAIMIAGLFF

SEQ ID NO: 430070 - protein, 10 aa, Influenza virus
FTAEVSYCRA

SEQ ID NO: 430071 - protein, 10 aa, Influenza virus
SWASNSIVTF

SEQ ID NO: 430072 - protein, 10 aa, Influenza virus
WISFAISCFL

SEQ ID NO: 430073 - protein, 10 aa, Influenza virus
GSLNFVSMEF

SEQ ID NO: 430074 - protein, 10 aa, Influenza virus
NIWAYNAELL

SEQ ID NO: 430075 - protein, 10 aa, Influenza virus
SIKSWRRDIL

SEQ ID NO: 430076 - protein, 10 aa, Influenza virus
YRRPIGISSM

SEQ ID NO: 430077 - protein, 10 aa, Influenza virus
NQNPRVFLAM

SEQ ID NO: 430078 - protein, 10 aa, Influenza virus
FLAMITYITK

SEQ ID NO: 430079 - protein, 10 aa, Influenza virus
AIMIAGLFFW

SEQ ID NO: 430080 - protein, 10 aa, Influenza virus
IVDNKNWSGY

SEQ ID NO: 430081 - protein, 10 aa, Influenza virus
KEFSEIEGRI

SEQ ID NO: 430082 - protein, 10 aa, Influenza virus
SMPLHNIHPL

SEQ ID NO: 430083 - protein, 10 aa, Influenza virus
SLNGVSPIHL

SEQ ID NO: 430084 - protein, 10 aa, Influenza virus
GADINLMPIY

SEQ ID NO: 430085 - protein, 10 aa, Influenza virus
KAIDQITTKI

SEQ ID NO: 430086 - protein, 10 aa, Influenza virus
RPWIRINNET

SEQ ID NO: 430087 - protein, 10 aa, Influenza virus
KMTITFLILL

SEQ ID NO: 430088 - protein, 10 aa, Influenza virus
CGVSSEAPGW

SEQ ID NO: 430089 - protein, 10 aa, Influenza virus
KSTQAAVNQI

SEQ ID NO: 430090 - protein, 10 aa, Influenza virus
IHDRSQFRAL

SEQ ID NO: 430091 - protein, 10 aa, Influenza virus
FVFVALILGF

SEQ ID NO: 430092 - protein, 10 aa, Influenza virus
AIMIAGLSFW

SEQ ID NO: 430093 - protein, 10 aa, Influenza virus
SLCSVEGWVV

SEQ ID NO: 430094 - protein, 10 aa, Influenza virus
SLDGKAPISL

SEQ ID NO: 430095 - protein, 10 aa, Influenza virus
CHNGTCVVVM

SEQ ID NO: 430096 - protein, 10 aa, Influenza virus
GMITDTIKSW

SEQ ID NO: 430097 - protein, 10 aa, Influenza virus
IIDNDNWSGY

SEQ ID NO: 430098 - protein, 10 aa, Influenza virus
LLKIRKGKIV

SEQ ID NO: 430099 - protein, 10 aa, Influenza virus
AQHVEECSCY

SEQ ID NO: 430100 - protein, 10 aa, Influenza virus
CTHMEVCFMY

SEQ ID NO: 430101 - protein, 10 aa, Influenza virus
WLGRTISPRL

SEQ ID NO: 430102 - protein, 10 aa, Influenza virus
NLYDRVRLQL

SEQ ID NO: 430103 - protein, 10 aa, Influenza virus
KLFERVKRQL

SEQ ID NO: 430104 - protein, 10 aa, Influenza virus
LTITYSSPMM

SEQ ID NO: 430105 - protein, 10 aa, Influenza virus
GPTECRTFFL

SEQ ID NO: 430106 - protein, 10 aa, Influenza virus
LILRGAVAHK

SEQ ID NO: 430107 - protein, 10 aa, Influenza virus
HHAVENGTSV

SEQ ID NO: 430108 - protein, 10 aa, Influenza virus
IPSIQSRGLF

SEQ ID NO: 430109 - protein, 10 aa, Influenza virus
CPKYVRSEKL

SEQ ID NO: 430110 - protein, 10 aa, Influenza virus
TKMKAIIVVL

SEQ ID NO: 430111 - protein, 10 aa, Influenza virus
HLKFKADLII

SEQ ID NO: 430112 - protein, 10 aa, Influenza virus
FVALILGFVL

SEQ ID NO: 430113 - protein, 10 aa, Influenza virus
TLTEKGIEVV

SEQ ID NO: 430114 - protein, 10 aa, Influenza virus
LAIMMAGLSF

SEQ ID NO: 430115 - protein, 10 aa, Influenza virus
WLGRTISPKL

SEQ ID NO: 430116 - protein, 10 aa, Influenza virus
WSYNAQLLVL

SEQ ID NO: 430117 - protein, 10 aa, Influenza virus
LANQSLPPNF

SEQ ID NO: 430118 - protein, 10 aa, Influenza virus
MQFSSLAVNV

SEQ ID NO: 430119 - protein, 10 aa, Influenza virus
SLRMKWMMAM

SEQ ID NO: 430120 - protein, 10 aa, Influenza virus
LMENEITLDF

SEQ ID NO: 430121 - protein, 10 aa, Influenza virus
QVKIRRRVDV

SEQ ID NO: 430122 - protein, 10 aa, Influenza virus
RVWWTSNSIV

SEQ ID NO: 430123 - protein, 10 aa, Influenza virus
KTGTFEFTSF

SEQ ID NO: 430124 - protein, 10 aa, Influenza virus
EGKISHISPL

SEQ ID NO: 430125 - protein, 10 aa, Influenza virus
IIDNNNWSGY

SEQ ID NO: 430126 - protein, 10 aa, Influenza virus
RTLDFHDLNV

SEQ ID NO: 430127 - protein, 10 aa, Influenza virus
FIEGGWPGLV

SEQ ID NO: 430128 - protein, 10 aa, Influenza virus
RVKMFDFIKW

SEQ ID NO: 430129 - protein, 10 aa, Influenza virus
KTGTYDYPKY

SEQ ID NO: 430130 - protein, 10 aa, Influenza virus
SQDTEVSFTI

SEQ ID NO: 430131 - protein, 10 aa, Influenza virus
KVTCICRDNW

SEQ ID NO: 430132 - protein, 10 aa, Influenza virus
THVQNNYTTI

SEQ ID NO: 430133 - protein, 10 aa, Influenza virus
KLFASSGIAI

SEQ ID NO: 430134 - protein, 10 aa, Influenza virus
NLIAPRGYYK

SEQ ID NO: 430135 - protein, 10 aa, Influenza virus
LSSSGNNQVF

SEQ ID NO: 430136 - protein, 10 aa, Influenza virus
VTDSEMNKLF

SEQ ID NO: 430137 - protein, 10 aa, Influenza virus
LMLATGMRNI

SEQ ID NO: 430138 - protein, 10 aa, Influenza virus
NRFQIQGIKL

SEQ ID NO: 430139 - protein, 10 aa, Influenza virus
TVFCGVSGEV

SEQ ID NO: 430140 - protein, 10 aa, Influenza virus
IEKTNQQFEL

SEQ ID NO: 430141 - protein, 10 aa, Influenza virus
KIDDQIEDLW

SEQ ID NO: 430142 - protein, 10 aa, Influenza virus
KTLDLHDANV

SEQ ID NO: 430143 - protein, 10 aa, Influenza virus
LTLKSEQFPV

SEQ ID NO: 430144 - protein, 10 aa, Influenza virus
FSFGASCVML

SEQ ID NO: 430145 - protein, 10 aa, Influenza virus
NRLNINSVKL

SEQ ID NO: 430146 - protein, 10 aa, Influenza virus
HQIEKEFTEV

SEQ ID NO: 430147 - protein, 10 aa, Influenza virus
GLQSSDDFAL

SEQ ID NO: 430148 - protein, 10 aa, Influenza virus
NLYDRVRMQL

SEQ ID NO: 430149 - protein, 10 aa, Influenza virus
KSTQAAINQI

SEQ ID NO: 430150 - protein, 10 aa, Influenza virus
NRFQIQGIKL

SEQ ID NO: 430151 - protein, 10 aa, Influenza virus
LRMKWMMAMR

SEQ ID NO: 430152 - protein, 10 aa, Influenza virus
ITIGSVSLTI

SEQ ID NO: 430153 - protein, 10 aa, Influenza virus
FTGWILGNPM

SEQ ID NO: 430154 - protein, 10 aa, Influenza virus
TLMSCPIGVA

SEQ ID NO: 430155 - protein, 10 aa, Influenza virus
KMNTQILIFT

SEQ ID NO: 430156 - protein, 10 aa, Influenza virus
LELRSKYWAI

SEQ ID NO: 430157 - protein, 10 aa, Influenza virus
VPQMESRGLF

SEQ ID NO: 430158 - protein, 10 aa, Influenza virus
ILEENTTYKI

SEQ ID NO: 430159 - protein, 10 aa, Influenza virus
SQDTEVSFTI

SEQ ID NO: 430160 - protein, 10 aa, Influenza virus
LHAYISFRNL

SEQ ID NO: 430161 - protein, 10 aa, Influenza virus
YVRTNGTSKI

SEQ ID NO: 430162 - protein, 10 aa, Influenza virus
RRLTTTIKTW

SEQ ID NO: 430163 - protein, 10 aa, Influenza virus
NALLKHRFEI

SEQ ID NO: 430164 - protein, 10 aa, Influenza virus
TPTKSYFANL

SEQ ID NO: 430165 - protein, 10 aa, Influenza virus
YQILAIYATV

SEQ ID NO: 430166 - protein, 10 aa, Influenza virus
KPNIGPRPLV

SEQ ID NO: 430167 - protein, 10 aa, Influenza virus
LAKSVFNNLY

SEQ ID NO: 430168 - protein, 10 aa, Influenza virus
SFFRHMVWLI

SEQ ID NO: 430169 - protein, 10 aa, Influenza virus
EEDGTGCFEL

SEQ ID NO: 430170 - protein, 10 aa, Influenza virus
LWISFATSCF

SEQ ID NO: 430171 - protein, 10 aa, Influenza virus
FVFVALILGF

SEQ ID NO: 430172 - protein, 10 aa, Influenza virus
SPGVKGFGFL

SEQ ID NO: 430173 - protein, 10 aa, Influenza virus
NSFLTHALRF

SEQ ID NO: 430174 - protein, 10 aa, Influenza virus
SLNGISPVHL

SEQ ID NO: 430175 - protein, 10 aa, Influenza virus
SSMGVYQILV

SEQ ID NO: 430176 - protein, 10 aa, Influenza virus
QPTFSVQRSL

SEQ ID NO: 430177 - protein, 10 aa, Influenza virus
RGLLEVGTRW

SEQ ID NO: 430178 - protein, 10 aa, Influenza virus
KEKENSYPMI

SEQ ID NO: 430179 - protein, 10 aa, Influenza virus
WSYNAKLLVL

SEQ ID NO: 430180 - protein, 10 aa, Influenza virus
NLVAPWYAYK

SEQ ID NO: 430181 - protein, 10 aa, Influenza virus
ATACHDGKKW

SEQ ID NO: 430182 - protein, 10 aa, Influenza virus
KRYELEIGAR

SEQ ID NO: 430183 - protein, 10 aa, Influenza virus
EEMGNGCFKI

SEQ ID NO: 430184 - protein, 10 aa, Influenza virus
KTLDMHDANV

SEQ ID NO: 430185 - protein, 10 aa, Influenza virus
SWTSNSIVTF

SEQ ID NO: 430186 - protein, 10 aa, Influenza virus
GIGNLVFNTV

SEQ ID NO: 430187 - protein, 10 aa, Influenza virus
NLYDRVRLQL

SEQ ID NO: 430188 - protein, 10 aa, Influenza virus
GTFEFTSFFY

SEQ ID NO: 430189 - protein, 10 aa, Influenza virus
ETGNGCFEFY

SEQ ID NO: 430190 - protein, 10 aa, Influenza virus
VSSFEKFEIF

SEQ ID NO: 430191 - protein, 10 aa, Influenza virus
WSYNAQLLVL

SEQ ID NO: 430192 - protein, 10 aa, Influenza virus
CFNPCFYVEL

SEQ ID NO: 430193 - protein, 10 aa, Influenza virus
RSNIFNMERI

SEQ ID NO: 430194 - protein, 10 aa, Influenza virus
TLMSCPMGVA

SEQ ID NO: 430195 - protein, 10 aa, Influenza virus
FALSGVAIAL

SEQ ID NO: 430196 - protein, 10 aa, Influenza virus
WGMGQAPSPY

SEQ ID NO: 430197 - protein, 10 aa, Influenza virus
SWTSNSMVTF

SEQ ID NO: 430198 - protein, 10 aa, Influenza virus
HQIEKEFSEI

SEQ ID NO: 430199 - protein, 10 aa, Influenza virus
ISCLYKLSQF

SEQ ID NO: 430200 - protein, 10 aa, Influenza virus
SEGTGQAADL

SEQ ID NO: 430201 - protein, 10 aa, Influenza virus
NQNPRMFLAM

SEQ ID NO: 430202 - protein, 10 aa, Influenza virus
GPNDNASAVV

SEQ ID NO: 430203 - protein, 10 aa, Influenza virus
SMEFSLTDPK

SEQ ID NO: 430204 - protein, 10 aa, Influenza virus
KPFQNVSRIA

SEQ ID NO: 430205 - protein, 10 aa, Influenza virus
SRTELISPSK

SEQ ID NO: 430206 - protein, 10 aa, Influenza virus
MQFSSLAVNV

SEQ ID NO: 430207 - protein, 10 aa, Influenza virus
GRIDFHWMLL

SEQ ID NO: 430208 - protein, 10 aa, Influenza virus
SIRLAAGGAI

SEQ ID NO: 430209 - protein, 10 aa, Influenza virus
CPKYISSGSL

SEQ ID NO: 430210 - protein, 10 aa, Influenza virus
RSWSKPQCQI

SEQ ID NO: 430211 - protein, 10 aa, Influenza virus
NIWITREPYV

SEQ ID NO: 430212 - protein, 10 aa, Influenza virus
IHDRIPHRTL

SEQ ID NO: 430213 - protein, 10 aa, Influenza virus
IMRTVIALSY

SEQ ID NO: 430214 - protein, 10 aa, Influenza virus
EIKGVKLSNM

SEQ ID NO: 430215 - protein, 10 aa, Influenza virus
KLLVLLENEK

SEQ ID NO: 430216 - protein, 10 aa, Influenza virus
TLRVKSNGNL

SEQ ID NO: 430217 - protein, 10 aa, Influenza virus
GTFEFTSFFY

SEQ ID NO: 430218 - protein, 10 aa, Influenza virus
SMIEAESSIK

SEQ ID NO: 430219 - protein, 10 aa, Influenza virus
SIKRYERVKM

SEQ ID NO: 430220 - protein, 10 aa, Influenza virus
NIWSYNAQLL

SEQ ID NO: 430221 - protein, 10 aa, Influenza virus
CMTSIRNNTY

SEQ ID NO: 430222 - protein, 10 aa, Influenza virus
VPEKIHTRGL

SEQ ID NO: 430223 - protein, 10 aa, Influenza virus
SWDDGAILPL

SEQ ID NO: 430224 - protein, 10 aa, Influenza virus
WACNSGNCRF

SEQ ID NO: 430225 - protein, 10 aa, Influenza virus
RSQSGRISFY

SEQ ID NO: 430226 - protein, 10 aa, Influenza virus
NEFSEIEQQI

SEQ ID NO: 430227 - protein, 10 aa, Influenza virus
RVSKTGVDEY

SEQ ID NO: 430228 - protein, 10 aa, Influenza virus
CPRYVKQGSL

SEQ ID NO: 430229 - protein, 10 aa, Influenza virus
GVNRFYRTCK

SEQ ID NO: 430230 - protein, 10 aa, Influenza virus
IHDGTAFRGL

SEQ ID NO: 430231 - protein, 10 aa, Influenza virus
KLYERVKRQL

SEQ ID NO: 430232 - protein, 10 aa, Influenza virus
GSASSQAYTK

SEQ ID NO: 430233 - protein, 10 aa, Influenza virus
GRIDFHWLML

SEQ ID NO: 430234 - protein, 10 aa, Influenza virus
SSGYKDVIIW

SEQ ID NO: 430235 - protein, 10 aa, Influenza virus
SSSNAYQAKF

SEQ ID NO: 430236 - protein, 10 aa, Influenza virus
LMENERTLDY

SEQ ID NO: 430237 - protein, 10 aa, Influenza virus
CGVNSDTTGW

SEQ ID NO: 430238 - protein, 10 aa, Influenza virus
ALLLAFILWA

SEQ ID NO: 430239 - protein, 10 aa, Influenza virus
YPKYSEEAKL

SEQ ID NO: 430240 - protein, 10 aa, Influenza virus
WRGGSINTRL

SEQ ID NO: 430241 - protein, 10 aa, Influenza virus
LVADGGPNLY

SEQ ID NO: 430242 - protein, 10 aa, Influenza virus
QVFPQLNQTY

SEQ ID NO: 430243 - protein, 10 aa, Influenza virus
FKMNPNQKII

SEQ ID NO: 430244 - protein, 10 aa, Influenza virus
NRMQFSSLTV

SEQ ID NO: 430245 - protein, 10 aa, Influenza virus
VPSVQSRGLF

SEQ ID NO: 430246 - protein, 10 aa, Influenza virus
SWPDGALLPF

SEQ ID NO: 430247 - protein, 10 aa, Influenza virus
RRLTVLGKDA

SEQ ID NO: 430248 - protein, 10 aa, Influenza virus
RVSKMGVDEY

SEQ ID NO: 430249 - protein, 10 aa, Influenza virus
ALGMKNVPEK

SEQ ID NO: 430250 - protein, 10 aa, Influenza virus
WGMEMRRCLL

SEQ ID NO: 430251 - protein, 10 aa, Influenza virus
RSFRPNIGPR

SEQ ID NO: 430252 - protein, 10 aa, Influenza virus
NHSMSDIEAM

SEQ ID NO: 430253 - protein, 10 aa, Influenza virus
ALLLAFVLWA

SEQ ID NO: 430254 - protein, 10 aa, Influenza virus
QESLMLATGM

SEQ ID NO: 430255 - protein, 10 aa, Influenza virus
YVNNTTVINK

SEQ ID NO: 430256 - protein, 10 aa, Influenza virus
RTFSFQLILI

SEQ ID NO: 430257 - protein, 10 aa, Influenza virus
NRQEIGGVKL

SEQ ID NO: 430258 - protein, 10 aa, Influenza virus
KVDTLTETGV

SEQ ID NO: 430259 - protein, 10 aa, Influenza virus
STGNFIAPEY

SEQ ID NO: 430260 - protein, 10 aa, Influenza virus
FIMWACSNGS

SEQ ID NO: 430261 - protein, 10 aa, Influenza virus
GRMTFYWAIV

SEQ ID NO: 430262 - protein, 10 aa, Influenza virus
KSTQAAVDQI

SEQ ID NO: 430263 - protein, 10 aa, Influenza virus
WISFATSCFL

SEQ ID NO: 430264 - protein, 10 aa, Influenza virus
IEFEPFQSLV

SEQ ID NO: 430265 - protein, 10 aa, Influenza virus
CGVDSDTTGW

SEQ ID NO: 430266 - protein, 10 aa, Influenza virus
SPIHLGDCSF

SEQ ID NO: 430267 - protein, 10 aa, Influenza virus
LKMTIASDIL

SEQ ID NO: 430268 - protein, 10 aa, Influenza virus
YRKRMTRGLF

SEQ ID NO: 430269 - protein, 10 aa, Influenza virus
YQILSIYSTV

SEQ ID NO: 430270 - protein, 10 aa, Influenza virus
NMQNRLNNVI

SEQ ID NO: 430271 - protein, 10 aa, Influenza virus
LYASPQLEGF

SEQ ID NO: 430272 - protein, 10 aa, Influenza virus
FALSGVAVAL

SEQ ID NO: 430273 - protein, 10 aa, Influenza virus
GEAMVSRARI

SEQ ID NO: 430274 - protein, 10 aa, Influenza virus
MISDKIDDQI

SEQ ID NO: 430275 - protein, 10 aa, Influenza virus
SIRLSAGGAI

SEQ ID NO: 430276 - protein, 10 aa, Influenza virus
NESGRLMDFL

SEQ ID NO: 430277 - protein, 10 aa, Influenza virus
IHDRTPHRTL

SEQ ID NO: 430278 - protein, 10 aa, Influenza virus
YSSVASSLVL

SEQ ID NO: 430279 - protein, 10 aa, Influenza virus
VEYNGKSLGI

SEQ ID NO: 430280 - protein, 10 aa, Influenza virus
SLTSLPFQNI

SEQ ID NO: 430281 - protein, 10 aa, Influenza virus
NKFASICTHL

SEQ ID NO: 430282 - protein, 10 aa, Influenza virus
IRMAINWGRI

SEQ ID NO: 430283 - protein, 10 aa, Influenza virus
VLTGNLQALK

SEQ ID NO: 430284 - protein, 10 aa, Influenza virus
LTKGVLGFVF

SEQ ID NO: 430285 - protein, 10 aa, Influenza virus
EQMYQRCCNL

SEQ ID NO: 430286 - protein, 10 aa, Influenza virus
HRVYWIREGR

SEQ ID NO: 430287 - protein, 10 aa, Influenza virus
ITIGSISLTI

SEQ ID NO: 430288 - protein, 10 aa, Influenza virus
VPNIGSRPRV

SEQ ID NO: 430289 - protein, 10 aa, Influenza virus
FGASCFLFLA

SEQ ID NO: 430290 - protein, 10 aa, Influenza virus
KMTIASDILK

SEQ ID NO: 430291 - protein, 10 aa, Influenza virus
VPQAQNRGLF

SEQ ID NO: 430292 - protein, 10 aa, Influenza virus
SYNAEFLVAL

SEQ ID NO: 430293 - protein, 10 aa, Influenza virus
GLILAFILWA

SEQ ID NO: 430294 - protein, 10 aa, Influenza virus
SRTELINPSK

SEQ ID NO: 430295 - protein, 10 aa, Influenza virus
CSIDECRTFF

SEQ ID NO: 430296 - protein, 10 aa, Influenza virus
FSFGASCFVL

SEQ ID NO: 430297 - protein, 10 aa, Influenza virus
AYNAELLVLI

SEQ ID NO: 430298 - protein, 10 aa, Influenza virus
RIFQPNIGPR

SEQ ID NO: 430299 - protein, 10 aa, Influenza virus
NVILWFSFGA

SEQ ID NO: 430300 - protein, 10 aa, Influenza virus
RTIWTSGSSI

SEQ ID NO: 430301 - protein, 10 aa, Influenza virus
TTINNITNVV

SEQ ID NO: 430302 - protein, 10 aa, Influenza virus
SSSNAYQAKF

SEQ ID NO: 430303 - protein, 10 aa, Influenza virus
NLYERVRKQL

SEQ ID NO: 430304 - protein, 10 aa, Influenza virus
YLCTGILTDT

SEQ ID NO: 430305 - protein, 10 aa, Influenza virus
IHDRSPYRAL

SEQ ID NO: 430306 - protein, 10 aa, Influenza virus
CPKYVRSEKL

SEQ ID NO: 430307 - protein, 10 aa, Influenza virus
NQTKKMTITF

SEQ ID NO: 430308 - protein, 10 aa, Influenza virus
RSFKPNIGPR

SEQ ID NO: 430309 - protein, 10 aa, Influenza virus
MSKKKSYINK

SEQ ID NO: 430310 - protein, 10 aa, Influenza virus
WTCNSGNCRF

SEQ ID NO: 430311 - protein, 10 aa, Influenza virus
TPLGALNTTL

SEQ ID NO: 430312 - protein, 10 aa, Influenza virus
LLQIISLCSI

SEQ ID NO: 430313 - protein, 10 aa, Influenza virus
TLMEQNVPVT

SEQ ID NO: 430314 - protein, 10 aa, Influenza virus
GRNSFYAELK

SEQ ID NO: 430315 - protein, 10 aa, Influenza virus
FHLGTKQVCA

SEQ ID NO: 430316 - protein, 10 aa, Influenza virus
SYNAKLLVLL

SEQ ID NO: 430317 - protein, 10 aa, Influenza virus
MKGVYINTAL

SEQ ID NO: 430318 - protein, 10 aa, Influenza virus
GVGNLIFNTV

SEQ ID NO: 430319 - protein, 10 aa, Influenza virus
SIKKYERVKM

SEQ ID NO: 430320 - protein, 10 aa, Influenza virus
TISKDLRSGY

SEQ ID NO: 430321 - protein, 10 aa, Influenza virus
LMNELGVSFH

SEQ ID NO: 430322 - protein, 10 aa, Influenza virus
QYRALISWPL

SEQ ID NO: 430323 - protein, 10 aa, Influenza virus
GTFEFTSFFY

SEQ ID NO: 430324 - protein, 10 aa, Influenza virus
NMRCTISLVK

SEQ ID NO: 430325 - protein, 10 aa, Influenza virus
CPRYIPSGSL

SEQ ID NO: 430326 - protein, 10 aa, Influenza virus
GMRNIPENPK

SEQ ID NO: 430327 - protein, 10 aa, Influenza virus
CPKYVNVRSL

SEQ ID NO: 430328 - protein, 10 aa, Influenza virus
LLENLQTYQK

SEQ ID NO: 430329 - protein, 10 aa, Influenza virus
FVQHPELTGL

SEQ ID NO: 430330 - protein, 10 aa, Influenza virus
GEFSQVEQRI

SEQ ID NO: 430331 - protein, 10 aa, Influenza virus
LVADGGPNLY

SEQ ID NO: 430332 - protein, 10 aa, Influenza virus
ETIRNGTYDH

SEQ ID NO: 430333 - protein, 10 aa, Influenza virus
WWASNSLIAL

SEQ ID NO: 430334 - protein, 10 aa, Influenza virus
GGWPGLINGW

SEQ ID NO: 430335 - protein, 10 aa, Influenza virus
YIWGVHHPST

SEQ ID NO: 430336 - protein, 10 aa, Influenza virus
SPLTKGMLGF

SEQ ID NO: 430337 - protein, 10 aa, Influenza virus
IRFVNSDCSK

SEQ ID NO: 430338 - protein, 10 aa, Influenza virus
TYVSIGTSTL

SEQ ID NO: 430339 - protein, 10 aa, Influenza virus
CPKYIKSGQL

SEQ ID NO: 430340 - protein, 10 aa, Influenza virus
RTRALVRTGM

SEQ ID NO: 430341 - protein, 10 aa, Influenza virus
LVSNNDWSGY

SEQ ID NO: 430342 - protein, 10 aa, Influenza virus
SVQRNLPFDK

SEQ ID NO: 430343 - protein, 10 aa, Influenza virus
KSLIWLWLVL

SEQ ID NO: 430344 - protein, 10 aa, Influenza virus
SEQNVPVTQV

SEQ ID NO: 430345 - protein, 10 aa, Influenza virus
GVVNTILSTK

SEQ ID NO: 430346 - protein, 10 aa, Influenza virus
REPFVACGPT

SEQ ID NO: 430347 - protein, 10 aa, Influenza virus
GVYQILVIYA

SEQ ID NO: 430348 - protein, 10 aa, Influenza virus
ESSFEQITFM

SEQ ID NO: 430349 - protein, 10 aa, Influenza virus
IWASGSSISF

SEQ ID NO: 430350 - protein, 10 aa, Influenza virus
GIYQILAIYA

SEQ ID NO: 430351 - protein, 10 aa, Influenza virus
YLIEDPAAPH

SEQ ID NO: 430352 - protein, 10 aa, Influenza virus
IFMARSALIL

SEQ ID NO: 430353 - protein, 10 aa, Influenza virus
KLNNVIDKMY

SEQ ID NO: 430354 - protein, 10 aa, Influenza virus
LRMATGLRNV

SEQ ID NO: 430355 - protein, 10 aa, Influenza virus
SYVRLYLWGV

SEQ ID NO: 430356 - protein, 10 aa, Influenza virus
FKNTKGRDVL

SEQ ID NO: 430357 - protein, 10 aa, Influenza virus
LVSNNDWSGY

SEQ ID NO: 430358 - protein, 10 aa, Influenza virus
SRFQIQGVKL

SEQ ID NO: 430359 - protein, 10 aa, Influenza virus
KIITIGSASL

SEQ ID NO: 430360 - protein, 10 aa, Influenza virus
TALANTIEVF

SEQ ID NO: 430361 - protein, 10 aa, Influenza virus
NMGIYQILAI

SEQ ID NO: 430362 - protein, 10 aa, Influenza virus
SWHDGAVLPF

SEQ ID NO: 430363 - protein, 10 aa, Influenza virus
FSNKVARLGK

SEQ ID NO: 430364 - protein, 10 aa, Influenza virus
CSIDECRTFF

SEQ ID NO: 430365 - protein, 10 aa, Influenza virus
GRIDFHWLIL

SEQ ID NO: 430366 - protein, 10 aa, Influenza virus
WHLMHPGERI

SEQ ID NO: 430367 - protein, 10 aa, Influenza virus
DATAVAVLKY

SEQ ID NO: 430368 - protein, 10 aa, Influenza virus
TPLGAINTTL

SEQ ID NO: 430369 - protein, 10 aa, Influenza virus
KAIDRITTKI

SEQ ID NO: 430370 - protein, 10 aa, Influenza virus
YSTVASSLTL

SEQ ID NO: 430371 - protein, 10 aa, Influenza virus
AARNIVRRAI

SEQ ID NO: 430372 - protein, 10 aa, Influenza virus
FRNILSIAPI

SEQ ID NO: 430373 - protein, 10 aa, Influenza virus
RMCNILKGKF

SEQ ID NO: 430374 - protein, 10 aa, Influenza virus
EELRFLFSSI

SEQ ID NO: 430375 - protein, 10 aa, Influenza virus
LTITYSSPMM

SEQ ID NO: 430376 - protein, 10 aa, Influenza virus
NPLIRHENRM

SEQ ID NO: 430377 - protein, 10 aa, Influenza virus
EMWSYNAELL

SEQ ID NO: 430378 - protein, 10 aa, Influenza virus
VTNATELVQI

SEQ ID NO: 430379 - protein, 10 aa, Influenza virus
GPADTRVYYF

SEQ ID NO: 430380 - protein, 10 aa, Influenza virus
SYRTLLMNEL

SEQ ID NO: 430381 - protein, 10 aa, Influenza virus
NRIRIDPVKL

SEQ ID NO: 430382 - protein, 10 aa, Influenza virus
KLFTLSGVAI

SEQ ID NO: 430383 - protein, 10 aa, Influenza virus
LTVNVRGTGM

SEQ ID NO: 430384 - protein, 10 aa, Influenza virus
VLGENMAPEK

SEQ ID NO: 430385 - protein, 10 aa, Influenza virus
KEKENSYPKI

SEQ ID NO: 430386 - protein, 10 aa, Influenza virus
WSYNAQLLVL

SEQ ID NO: 430387 - protein, 10 aa, Influenza virus
GEGIPLYDAI

SEQ ID NO: 430388 - protein, 10 aa, Influenza virus
SWHDGAILPF

SEQ ID NO: 430389 - protein, 10 aa, Influenza virus
LLHKCNDSCM

SEQ ID NO: 430390 - protein, 10 aa, Influenza virus
LWVSFSISCF

SEQ ID NO: 430391 - protein, 10 aa, Influenza virus
VPGYQSLRSI

SEQ ID NO: 430392 - protein, 10 aa, Influenza virus
RTFSFQLILI

SEQ ID NO: 430393 - protein, 10 aa, Influenza virus
LLAKSVFNSL

SEQ ID NO: 430394 - protein, 10 aa, Influenza virus
MQRFRRPDSS

SEQ ID NO: 430395 - protein, 10 aa, Influenza virus
REHLSSVSSF

SEQ ID NO: 430396 - protein, 10 aa, Influenza virus
YNFEKEGYSL

SEQ ID NO: 430397 - protein, 10 aa, Influenza virus
SRISFYWTIV

SEQ ID NO: 430398 - protein, 10 aa, Influenza virus
LEVGTRWMKI

SEQ ID NO: 430399 - protein, 10 aa, Influenza virus
SLCSIWFSHY

SEQ ID NO: 430400 - protein, 10 aa, Influenza virus
LWFSFGASSF

SEQ ID NO: 430401 - protein, 10 aa, Influenza virus
RPLILKDCSV

SEQ ID NO: 430402 - protein, 10 aa, Influenza virus
LAIMIAGLFF

SEQ ID NO: 430403 - protein, 10 aa, Influenza virus
IWTSASSISF

SEQ ID NO: 430404 - protein, 10 aa, Influenza virus
AIALSILNLL

SEQ ID NO: 430405 - protein, 10 aa, Influenza virus
GRLIQNSITI

SEQ ID NO: 430406 - protein, 10 aa, Influenza virus
YTYRCHRGDM

SEQ ID NO: 430407 - protein, 10 aa, Influenza virus
SVASSLVLLF

SEQ ID NO: 430408 - protein, 10 aa, Influenza virus
LLQANLCRFL

SEQ ID NO: 430409 - protein, 10 aa, Influenza virus
GTMDYYWGIL

SEQ ID NO: 430410 - protein, 10 aa, Influenza virus
KIITIGSASL

SEQ ID NO: 430411 - protein, 10 aa, Influenza virus
LLVSDGGPNL

SEQ ID NO: 430412 - protein, 10 aa, Influenza virus
SFGASCFLLI

SEQ ID NO: 430413 - protein, 10 aa, Influenza virus
MEAMVSRARI

SEQ ID NO: 430414 - protein, 10 aa, Influenza virus
LQSSDDFALI

SEQ ID NO: 430415 - protein, 10 aa, Influenza virus
NRIQIDPVKL

SEQ ID NO: 430416 - protein, 10 aa, Influenza virus
IVNNQNWSGY

SEQ ID NO: 430417 - protein, 10 aa, Influenza virus
GYSGAFIDYW

SEQ ID NO: 430418 - protein, 10 aa, Influenza virus
SFYAELKWLI

SEQ ID NO: 430419 - protein, 10 aa, Influenza virus
RVDTIIESNV

SEQ ID NO: 430420 - protein, 10 aa, Influenza virus
GGWSGLVAGW

SEQ ID NO: 430421 - protein, 10 aa, Influenza virus
FVQHPEMTGL

SEQ ID NO: 430422 - protein, 10 aa, Influenza virus
GRIDFHWLIL

SEQ ID NO: 430423 - protein, 10 aa, Influenza virus
LVSDGGPNLY

SEQ ID NO: 430424 - protein, 10 aa, Influenza virus
GASCFLLLAV

SEQ ID NO: 430425 - protein, 10 aa, Influenza virus
GRLIQNSMTI

SEQ ID NO: 430426 - protein, 10 aa, Influenza virus
VHDRIPHRTL

SEQ ID NO: 430427 - protein, 10 aa, Influenza virus
SIIEKMNTQF

SEQ ID NO: 430428 - protein, 10 aa, Influenza virus
FQSCFYVELI

SEQ ID NO: 430429 - protein, 10 aa, Influenza virus
CHDGNAWLHV

SEQ ID NO: 430430 - protein, 10 aa, Influenza virus
YKNANTLSSV

SEQ ID NO: 430431 - protein, 10 aa, Influenza virus
AMGLVFICIK

SEQ ID NO: 430432 - protein, 10 aa, Influenza virus
IWASGSSISF

SEQ ID NO: 430433 - protein, 10 aa, Influenza virus
LMENERTLDY

SEQ ID NO: 430434 - protein, 10 aa, Influenza virus
FSFGASCFIL

SEQ ID NO: 430435 - protein, 10 aa, Influenza virus
HEFSNLEKRI

SEQ ID NO: 430436 - protein, 10 aa, Influenza virus
KPLILRDCSV

SEQ ID NO: 430437 - protein, 10 aa, Influenza virus
TIKNGTYNRK

SEQ ID NO: 430438 - protein, 10 aa, Influenza virus
VIRSWRKQIL

SEQ ID NO: 430439 - protein, 10 aa, Influenza virus
YSTAASSLAL

SEQ ID NO: 430440 - protein, 10 aa, Influenza virus
VSLGAISFWM

SEQ ID NO: 430441 - protein, 10 aa, Influenza virus
FRDYEELKHL

SEQ ID NO: 430442 - protein, 10 aa, Influenza virus
NRLNINSVKL

SEQ ID NO: 430443 - protein, 10 aa, Influenza virus
IMESGGISKM

SEQ ID NO: 430444 - protein, 10 aa, Influenza virus
GPDATAVAVL

SEQ ID NO: 430445 - protein, 10 aa, Influenza virus
GMPESMREEY

SEQ ID NO: 430446 - protein, 10 aa, Influenza virus
ALVSWEMGQA

SEQ ID NO: 430447 - protein, 10 aa, Influenza virus
GVGNLVFNTV

SEQ ID NO: 430448 - protein, 10 aa, Influenza virus
HHAVANGTKV

SEQ ID NO: 430449 - protein, 10 aa, Influenza virus
RTDGATSACK

SEQ ID NO: 430450 - protein, 10 aa, Influenza virus
YLIEDPNAPH

SEQ ID NO: 430451 - protein, 10 aa, Influenza virus
RSLFSSIKKY

SEQ ID NO: 430452 - protein, 10 aa, Influenza virus
NADLEALMEW

SEQ ID NO: 430453 - protein, 10 aa, Influenza virus
LLLAFVLWAC

SEQ ID NO: 430454 - protein, 10 aa, Influenza virus
RLEENTTYKI

SEQ ID NO: 430455 - protein, 10 aa, Influenza virus
SEMDKLFERV

SEQ ID NO: 430456 - protein, 10 aa, Influenza virus
DVSFQGRGVF

SEQ ID NO: 430457 - protein, 10 aa, Influenza virus
SSTKEKNELY

SEQ ID NO: 430458 - protein, 10 aa, Influenza virus
GYSGSFIDYW

SEQ ID NO: 430459 - protein, 10 aa, Influenza virus
HQIEKEFGQV

SEQ ID NO: 430460 - protein, 10 aa, Influenza virus
SQDTELSFTV

SEQ ID NO: 430461 - protein, 10 aa, Influenza virus
RRATVSADPL

SEQ ID NO: 430462 - protein, 10 aa, Influenza virus
RFVFSIAASY

SEQ ID NO: 430463 - protein, 10 aa, Influenza virus
HLKDQSWSYI

SEQ ID NO: 430464 - protein, 10 aa, Influenza virus
SVKMEKIVLL

SEQ ID NO: 430465 - protein, 10 aa, Influenza virus
NRANQRLNPM

SEQ ID NO: 430466 - protein, 10 aa, Influenza virus
FMCVGWSSTT

SEQ ID NO: 430467 - protein, 10 aa, Influenza virus
SQVEQRINML

SEQ ID NO: 430468 - protein, 10 aa, Influenza virus
GYSGAFMDYW

SEQ ID NO: 430469 - protein, 10 aa, Influenza virus
KTDGATSACK

SEQ ID NO: 430470 - protein, 10 aa, Influenza virus
GRMDYYWGIL

SEQ ID NO: 430471 - protein, 10 aa, Influenza virus
AVAKDNAIRF

SEQ ID NO: 430472 - protein, 10 aa, Influenza virus
IFNFILLTHW

SEQ ID NO: 430473 - protein, 10 aa, Influenza virus
NMGVYQVLAI

SEQ ID NO: 430474 - protein, 10 aa, Influenza virus
KRNEIKGVEL

SEQ ID NO: 430475 - protein, 10 aa, Influenza virus
RRIWRQANSG

SEQ ID NO: 430476 - protein, 10 aa, Influenza virus
SYNAEILVAL

SEQ ID NO: 430477 - protein, 10 aa, Influenza virus
SMVEAESSVK

SEQ ID NO: 430478 - protein, 10 aa, Influenza virus
YRRPIGISSM

SEQ ID NO: 430479 - protein, 10 aa, Influenza virus
WEINGPDSVL

SEQ ID NO: 430480 - protein, 10 aa, Influenza virus
SYRTLLMSEL

SEQ ID NO: 430481 - protein, 10 aa, Influenza virus
RIRLFDYSRW

SEQ ID NO: 430482 - protein, 10 aa, Influenza virus
CSCYVDTDVY

SEQ ID NO: 430483 - protein, 10 aa, Influenza virus
LAIAMGLIFM

SEQ ID NO: 430484 - protein, 10 aa, Influenza virus
CPKYVKSEKL

SEQ ID NO: 430485 - protein, 10 aa, Influenza virus
VPQVQNRGLF

SEQ ID NO: 430486 - protein, 10 aa, Influenza virus
NSFLTHALRF

SEQ ID NO: 430487 - protein, 10 aa, Influenza virus
LTKKKNPEAY

SEQ ID NO: 430488 - protein, 10 aa, Influenza virus
TIKNGTYNHK

SEQ ID NO: 430489 - protein, 10 aa, Influenza virus
RLFERVRRQL

SEQ ID NO: 430490 - protein, 10 aa, Influenza virus
VSIDRFLRVK

SEQ ID NO: 430491 - protein, 10 aa, Influenza virus
TESSFEQITF

SEQ ID NO: 430492 - protein, 10 aa, Influenza virus
GRIFQSRIRM

SEQ ID NO: 430493 - protein, 10 aa, Influenza virus
KVDTLTENGV

SEQ ID NO: 430494 - protein, 10 aa, Influenza virus
TQTRGIFGAI

SEQ ID NO: 430495 - protein, 10 aa, Influenza virus
GRMDYYWGIL

SEQ ID NO: 430496 - protein, 10 aa, Influenza virus
RSLVASSGTL

SEQ ID NO: 430497 - protein, 10 aa, Influenza virus
ILDFHDSNVK

SEQ ID NO: 430498 - protein, 10 aa, Influenza virus
FQYLLFQDIL

SEQ ID NO: 430499 - protein, 10 aa, Influenza virus
HQIEKEFSEI

SEQ ID NO: 430500 - protein, 10 aa, Influenza virus
STGNLVAPEY

SEQ ID NO: 430501 - protein, 10 aa, Influenza virus
LVNTYQWIIK

SEQ ID NO: 430502 - protein, 10 aa, Influenza virus
SFFYRYGFVA

SEQ ID NO: 430503 - protein, 10 aa, Influenza virus
LVLAIGLRNV

SEQ ID NO: 430504 - protein, 10 aa, Influenza virus
IMWTCQKGNI

SEQ ID NO: 430505 - protein, 10 aa, Influenza virus
IHSRGLFGAI

SEQ ID NO: 430506 - protein, 10 aa, Influenza virus
GYPGVKGWAF

SEQ ID NO: 430507 - protein, 10 aa, Influenza virus
RSWMKLYWHL

SEQ ID NO: 430508 - protein, 10 aa, Influenza virus
RPRRGLFGAI

SEQ ID NO: 430509 - protein, 10 aa, Influenza virus
CMAWSSSSCH

SEQ ID NO: 430510 - protein, 10 aa, Influenza virus
KIITIGSVSL

SEQ ID NO: 430511 - protein, 10 aa, Influenza virus
GLHDANVRNL

SEQ ID NO: 430512 - protein, 10 aa, Influenza virus
NNLERRLENL

SEQ ID NO: 430513 - protein, 10 aa, Influenza virus
ALSQGALLGT

SEQ ID NO: 430514 - protein, 10 aa, Influenza virus
SSTQEKNDLY

SEQ ID NO: 430515 - protein, 10 aa, Influenza virus
APPEQSRMQF

SEQ ID NO: 430516 - protein, 10 aa, Influenza virus
KVNTIIENNV

SEQ ID NO: 430517 - protein, 10 aa, Influenza virus
MTDGSASSRA

SEQ ID NO: 430518 - protein, 10 aa, Influenza virus
FQTAAQKAMM

SEQ ID NO: 430519 - protein, 10 aa, Influenza virus
SRINTINSKI

SEQ ID NO: 430520 - protein, 10 aa, Influenza virus
RTIWTSGSSI

SEQ ID NO: 430521 - protein, 10 aa, Influenza virus
GQFGRIDFHW

SEQ ID NO: 430522 - protein, 10 aa, Influenza virus
NVWTYNAELL

SEQ ID NO: 430523 - protein, 10 aa, Influenza virus
KLNRNEIKGV

SEQ ID NO: 430524 - protein, 10 aa, Influenza virus
RTHQYSERGK

SEQ ID NO: 430525 - protein, 10 aa, Influenza virus
RLFERVRRQL

SEQ ID NO: 430526 - protein, 10 aa, Influenza virus
KRNEIKGVKL

SEQ ID NO: 430527 - protein, 10 aa, Influenza virus
MEVCFMYSDF

SEQ ID NO: 430528 - protein, 10 aa, Influenza virus
AANNADHRIY

SEQ ID NO: 430529 - protein, 10 aa, Influenza virus
FTWAIHHPPT

SEQ ID NO: 430530 - protein, 10 aa, Influenza virus
RGIFGAIAGF

SEQ ID NO: 430531 - protein, 10 aa, Influenza virus
WETTGRNCTV

SEQ ID NO: 430532 - protein, 10 aa, Influenza virus
SNLERRLENL

SEQ ID NO: 430533 - protein, 10 aa, Influenza virus
KLEFEPFQSL

SEQ ID NO: 430534 - protein, 10 aa, Influenza virus
LSNPKCDLYL

SEQ ID NO: 430535 - protein, 10 aa, Influenza virus
MLSLIMRTVI

SEQ ID NO: 430536 - protein, 10 aa, Influenza virus
LLMDSLKLSI

SEQ ID NO: 430537 - protein, 10 aa, Influenza virus
VIAQDNAIRF

SEQ ID NO: 430538 - protein, 10 aa, Influenza virus
FLVAVENQHT

SEQ ID NO: 430539 - protein, 10 aa, Influenza virus
NRQEIEGVRL

SEQ ID NO: 430540 - protein, 10 aa, Influenza virus
AIYATVAGSL

SEQ ID NO: 430541 - protein, 10 aa, Influenza virus
GYSGSFMDYW

SEQ ID NO: 430542 - protein, 10 aa, Influenza virus
AIGPRNVPQV

SEQ ID NO: 430543 - protein, 10 aa, Influenza virus
SSTKEKNDLY

SEQ ID NO: 430544 - protein, 10 aa, Influenza virus
ELWAYNAELL

SEQ ID NO: 430545 - protein, 10 aa, Influenza virus
LTTTIRTWAK

SEQ ID NO: 430546 - protein, 10 aa, Influenza virus
KVNTIIESNV

SEQ ID NO: 430547 - protein, 10 aa, Influenza virus
EMWSYNAELL

SEQ ID NO: 430548 - protein, 10 aa, Influenza virus
LRSILANNGK

SEQ ID NO: 430549 - protein, 10 aa, Influenza virus
STGNFIAPEY

SEQ ID NO: 430550 - protein, 10 aa, Influenza virus
ILAATVTLHF

SEQ ID NO: 430551 - protein, 10 aa, Influenza virus
HHAVTNGTKV

SEQ ID NO: 430552 - protein, 10 aa, Influenza virus
FLVCVSLLQS

SEQ ID NO: 430553 - protein, 10 aa, Influenza virus
MVTQRTMGKK

SEQ ID NO: 430554 - protein, 10 aa, Influenza virus
SEMDKLFERV

SEQ ID NO: 430555 - protein, 10 aa, Influenza virus
TIWTSSSSVV

SEQ ID NO: 430556 - protein, 10 aa, Influenza virus
MSQSRTRGIL

SEQ ID NO: 430557 - protein, 10 aa, Influenza virus
EVRRRLSANA

SEQ ID NO: 430558 - protein, 10 aa, Influenza virus
TECQLNEGVI

SEQ ID NO: 430559 - protein, 10 aa, Influenza virus
YLLKGESHGK

SEQ ID NO: 430560 - protein, 10 aa, Influenza virus
KNSFYAELKW

SEQ ID NO: 430561 - protein, 10 aa, Influenza virus
GRWPGLVAGW

SEQ ID NO: 430562 - protein, 10 aa, Influenza virus
KQNGKSSACK

SEQ ID NO: 430563 - protein, 10 aa, Influenza virus
GVKLSSMGVY

SEQ ID NO: 430564 - protein, 10 aa, Influenza virus
DTIRNGTYNH

SEQ ID NO: 430565 - protein, 10 aa, Influenza virus
NPLIRHENRM

SEQ ID NO: 430566 - protein, 10 aa, Influenza virus
RVSRMGVDEY

SEQ ID NO: 430567 - protein, 10 aa, Influenza virus
TRTTVDHMAI

SEQ ID NO: 430568 - protein, 10 aa, Influenza virus
KIITIGSVSL

SEQ ID NO: 430569 - protein, 10 aa, Influenza virus
HTDELCPSPL

SEQ ID NO: 430570 - protein, 10 aa, Influenza virus
SRISFYWTIV

SEQ ID NO: 430571 - protein, 10 aa, Influenza virus
GISSMMEAMV

SEQ ID NO: 430572 - protein, 10 aa, Influenza virus
MGAYQILAIY

SEQ ID NO: 430573 - protein, 10 aa, Influenza virus
RTKEMEGICY

SEQ ID NO: 430574 - protein, 10 aa, Influenza virus
GRIDFHWLML

SEQ ID NO: 430575 - protein, 10 aa, Influenza virus
AVLKPGQTVK

SEQ ID NO: 430576 - protein, 10 aa, Influenza virus
GVKLEENTSY

SEQ ID NO: 430577 - protein, 10 aa, Influenza virus
TVMVGLILAF

SEQ ID NO: 430578 - protein, 10 aa, Influenza virus
IQGVRLTQGY

SEQ ID NO: 430579 - protein, 10 aa, Influenza virus
VLSVIPSGPL

SEQ ID NO: 430580 - protein, 10 aa, Influenza virus
GMTLSVVSLL

SEQ ID NO: 430581 - protein, 10 aa, Influenza virus
RYELEIGARI

SEQ ID NO: 430582 - protein, 10 aa, Influenza virus
IWTSGSSISF

SEQ ID NO: 430583 - protein, 10 aa, Influenza virus
GLREQKQEFK

SEQ ID NO: 430584 - protein, 10 aa, Influenza virus
LVADGGPNLY

SEQ ID NO: 430585 - protein, 10 aa, Influenza virus
VASSLVLLFM

SEQ ID NO: 430586 - protein, 10 aa, Influenza virus
REWSYIVERT

SEQ ID NO: 430587 - protein, 10 aa, Influenza virus
ILTKTTVDHM

SEQ ID NO: 430588 - protein, 10 aa, Influenza virus
SGYSGAFVDY

SEQ ID NO: 430589 - protein, 10 aa, Influenza virus
GETTGRNCTV

SEQ ID NO: 430590 - protein, 10 aa, Influenza virus
WMCSGHSCRI

SEQ ID NO: 430591 - protein, 10 aa, Influenza virus
CMGTIRNGTY

SEQ ID NO: 430592 - protein, 10 aa, Influenza virus
VVLNTDWSGY

SEQ ID NO: 430593 - protein, 10 aa, Influenza virus
RRCLLQSLQQ

SEQ ID NO: 430594 - protein, 10 aa, Influenza virus
RPFQNVNKIT

SEQ ID NO: 430595 - protein, 10 aa, Influenza virus
NLYDKVRMQL

SEQ ID NO: 430596 - protein, 10 aa, Influenza virus
MVDGWYGFRH

SEQ ID NO: 430597 - protein, 10 aa, Influenza virus
CGSKERLGSW

SEQ ID NO: 430598 - protein, 10 aa, Influenza virus
YSSVASSLVL

SEQ ID NO: 430599 - protein, 10 aa, Influenza virus
WHLMSPGERI

SEQ ID NO: 430600 - protein, 10 aa, Influenza virus
HIFVIREPFV

SEQ ID NO: 430601 - protein, 10 aa, Influenza virus
TFLARSALIL

SEQ ID NO: 430602 - protein, 10 aa, Influenza virus
RSLFSSIKKY

SEQ ID NO: 430603 - protein, 10 aa, Influenza virus
GRFTNEEALR

SEQ ID NO: 430604 - protein, 10 aa, Influenza virus
RSESSFYAEM

SEQ ID NO: 430605 - protein, 10 aa, Influenza virus
RIAIGNCPKY

SEQ ID NO: 430606 - protein, 10 aa, Influenza virus
KVECICRDNW

SEQ ID NO: 430607 - protein, 10 aa, Influenza virus
VPQIEARGLF

SEQ ID NO: 430608 - protein, 10 aa, Influenza virus
ERMYQKCCNL

SEQ ID NO: 430609 - protein, 10 aa, Influenza virus
YQILSIYSTV

SEQ ID NO: 430610 - protein, 10 aa, Influenza virus
WSYNAGLLVA

SEQ ID NO: 430611 - protein, 10 aa, Influenza virus
LRDCKIEAVI

SEQ ID NO: 430612 - protein, 10 aa, Influenza virus
NASWFNSFLK

SEQ ID NO: 430613 - protein, 10 aa, Influenza virus
IEKTNQQFKL

SEQ ID NO: 430614 - protein, 10 aa, Influenza virus
FQLFLVCVSL

SEQ ID NO: 430615 - protein, 10 aa, Influenza virus
YRQEALQNRI

SEQ ID NO: 430616 - protein, 10 aa, Influenza virus
NSGYKDIILW

SEQ ID NO: 430617 - protein, 10 aa, Influenza virus
WSYNAKLLVL

SEQ ID NO: 430618 - protein, 10 aa, Influenza virus
WAYNAELLVL

SEQ ID NO: 430619 - protein, 10 aa, Influenza virus
IHFESNGNFI

SEQ ID NO: 430620 - protein, 10 aa, Influenza virus
MNWSGYSGSF

SEQ ID NO: 430621 - protein, 10 aa, Influenza virus
GGWTGMVNGW

SEQ ID NO: 430622 - protein, 10 aa, Influenza virus
TVINNITTTI

SEQ ID NO: 430623 - protein, 10 aa, Influenza virus
TVINNITTTI

SEQ ID NO: 430624 - protein, 10 aa, Influenza virus
STASRSGYEM

SEQ ID NO: 430625 - protein, 10 aa, Influenza virus
EQIIVTREPY

SEQ ID NO: 430626 - protein, 10 aa, Influenza virus
SVASSLVLLF

SEQ ID NO: 430627 - protein, 10 aa, Influenza virus
ILEDERMYQK

SEQ ID NO: 430628 - protein, 10 aa, Influenza virus
TKLYKNTNTL

SEQ ID NO: 430629 - protein, 10 aa, Influenza virus
ILETGYVCSK

SEQ ID NO: 430630 - protein, 10 aa, Influenza virus
IITDTLKSWK

SEQ ID NO: 430631 - protein, 10 aa, Influenza virus
TTIWTSGSSI

SEQ ID NO: 430632 - protein, 10 aa, Influenza virus
LLGINMSKKK

SEQ ID NO: 430633 - protein, 10 aa, Influenza virus
REPFVACGPS

SEQ ID NO: 430634 - protein, 10 aa, Influenza virus
QIGNVINWTK

SEQ ID NO: 430635 - protein, 10 aa, Influenza virus
WWTSNSLIAL

SEQ ID NO: 430636 - protein, 10 aa, Influenza virus
VVFCGTSGIY

SEQ ID NO: 430637 - protein, 10 aa, Influenza virus
KRIRLFDYSG

SEQ ID NO: 430638 - protein, 10 aa, Influenza virus
RPVAEINTWA

SEQ ID NO: 430639 - protein, 10 aa, Influenza virus
CHDGRAWLHV

SEQ ID NO: 430640 - protein, 10 aa, Influenza virus
IHTRGLFGAI

SEQ ID NO: 430641 - protein, 10 aa, Influenza virus
SIYSTAASSL

SEQ ID NO: 430642 - protein, 10 aa, Influenza virus
WPDGANIGFM

SEQ ID NO: 430643 - protein, 10 aa, Influenza virus
VLSIIPSGPL

SEQ ID NO: 430644 - protein, 10 aa, Influenza virus
ATAILRKATK

SEQ ID NO: 430645 - protein, 10 aa, Influenza virus
GRIDFHWMLL

SEQ ID NO: 430646 - protein, 10 aa, Influenza virus
SIIEAESSVK

SEQ ID NO: 430647 - protein, 10 aa, Influenza virus
LRLATGMRNI

SEQ ID NO: 430648 - protein, 10 aa, Influenza virus
AICTHMEVCF

SEQ ID NO: 430649 - protein, 10 aa, Influenza virus
CTIPCFWVEM

SEQ ID NO: 430650 - protein, 10 aa, Influenza virus
RRDQRALKGR

SEQ ID NO: 430651 - protein, 10 aa, Influenza virus
RRNYFTTEVS

SEQ ID NO: 430652 - protein, 10 aa, Influenza virus
SWHDGAVLPF

SEQ ID NO: 430653 - protein, 10 aa, Influenza virus
RTLMSCPVGV

SEQ ID NO: 430654 - protein, 10 aa, Influenza virus
VPDYQSIRSI

SEQ ID NO: 430655 - protein, 10 aa, Influenza virus
LQIISLCSIW

SEQ ID NO: 430656 - protein, 10 aa, Influenza virus
VEFEPFQSLV

SEQ ID NO: 430657 - protein, 10 aa, Influenza virus
LIGKTSWSYI

SEQ ID NO: 430658 - protein, 10 aa, Influenza virus
RIGEDSDVLV

SEQ ID NO: 430659 - protein, 10 aa, Influenza virus
HSMSGFRSNL

SEQ ID NO: 430660 - protein, 10 aa, Influenza virus
RSILASSGSL

SEQ ID NO: 430661 - protein, 10 aa, Influenza virus
GIITGTIKSW

SEQ ID NO: 430662 - protein, 10 aa, Influenza virus
LLSPEEVSET

SEQ ID NO: 430663 - protein, 10 aa, Influenza virus
RIAWSSSSCF

SEQ ID NO: 430664 - protein, 10 aa, Influenza virus
SIYSCIASSI

SEQ ID NO: 430665 - protein, 10 aa, Influenza virus
VMTDGNASGK

SEQ ID NO: 430666 - protein, 10 aa, Influenza virus
RSQSGRISFY

SEQ ID NO: 430667 - protein, 10 aa, Influenza virus
HTIDVTDSEM

SEQ ID NO: 430668 - protein, 10 aa, Influenza virus
ILGNPMCDEL

SEQ ID NO: 430669 - protein, 10 aa, Influenza virus
NKLAAICTHL

SEQ ID NO: 430670 - protein, 10 aa, Influenza virus
KSTQEAIEKI

SEQ ID NO: 430671 - protein, 10 aa, Influenza virus
FPSSSYRRPI

SEQ ID NO: 430672 - protein, 10 aa, Influenza virus
IMFSNKVARL

SEQ ID NO: 430673 - protein, 10 aa, Influenza virus
IEVVAAQELV

SEQ ID NO: 430674 - protein, 10 aa, Influenza virus
CSHSECRTFF

SEQ ID NO: 430675 - protein, 10 aa, Influenza virus
KVRNGTYDHK

SEQ ID NO: 430676 - protein, 10 aa, Influenza virus
MMDGWYGFRH

SEQ ID NO: 430677 - protein, 10 aa, Influenza virus
EIKGVKLSSM

SEQ ID NO: 430678 - protein, 10 aa, Influenza virus
TALANTIEVF

SEQ ID NO: 430679 - protein, 10 aa, Influenza virus
ILHKCNDSCM

SEQ ID NO: 430680 - protein, 10 aa, Influenza virus
EVRRRLSTNA

SEQ ID NO: 430681 - protein, 10 aa, Influenza virus
LIFMARSALI

SEQ ID NO: 430682 - protein, 10 aa, Influenza virus
ARILTSESQL

SEQ ID NO: 430683 - protein, 10 aa, Influenza virus
LARGEKANVL

SEQ ID NO: 430684 - protein, 10 aa, Influenza virus
MGVYQILAIY

SEQ ID NO: 430685 - protein, 10 aa, Influenza virus
KSLPDLYDYK

SEQ ID NO: 430686 - protein, 10 aa, Influenza virus
SYFQLFLVCV

SEQ ID NO: 430687 - protein, 10 aa, Influenza virus
ASVPASRYLI

SEQ ID NO: 430688 - protein, 10 aa, Influenza virus
LVSDGGPNLY

SEQ ID NO: 430689 - protein, 10 aa, Influenza virus
YSTGALASCM

SEQ ID NO: 430690 - protein, 10 aa, Influenza virus
IHDRSQYRSL

SEQ ID NO: 430691 - protein, 10 aa, Influenza virus
TVLVGLILAF

SEQ ID NO: 430692 - protein, 10 aa, Influenza virus
EAIEKITNKV

SEQ ID NO: 430693 - protein, 10 aa, Influenza virus
WGMEMRRCLL

SEQ ID NO: 430694 - protein, 10 aa, Influenza virus
EAIGKITNKV

SEQ ID NO: 430695 - protein, 10 aa, Influenza virus
MVIASTTAKA

SEQ ID NO: 430696 - protein, 10 aa, Influenza virus
HIEECSCYGV

SEQ ID NO: 430697 - protein, 10 aa, Influenza virus
TIKPWARNIL

SEQ ID NO: 430698 - protein, 10 aa, Influenza virus
KTLNMHDANV

SEQ ID NO: 430699 - protein, 10 aa, Influenza virus
MQLRDNAKEI

SEQ ID NO: 430700 - protein, 10 aa, Influenza virus
TQGEGTAADY

SEQ ID NO: 430701 - protein, 10 aa, Influenza virus
FRNVLSVAPI

SEQ ID NO: 430702 - protein, 10 aa, Influenza virus
YSTVVSSLAL

SEQ ID NO: 430703 - protein, 10 aa, Influenza virus
AIGNCPKYVK

SEQ ID NO: 430704 - protein, 10 aa, Influenza virus
WPDGANINFM

SEQ ID NO: 430705 - protein, 10 aa, Influenza virus
FVRQCFNPMI

SEQ ID NO: 430706 - protein, 10 aa, Influenza virus
SLYDKVRMQL

SEQ ID NO: 430707 - protein, 10 aa, Influenza virus
WSYNAKLLVL

SEQ ID NO: 430708 - protein, 10 aa, Influenza virus
KVWWTSNSII

SEQ ID NO: 430709 - protein, 10 aa, Influenza virus
YDFEKEGYSL

SEQ ID NO: 430710 - protein, 10 aa, Influenza virus
VAFCGTSGTY

SEQ ID NO: 430711 - protein, 10 aa, Influenza virus
VPSGPLKAEI

SEQ ID NO: 430712 - protein, 10 aa, Influenza virus
TIYSTAASSL

SEQ ID NO: 430713 - protein, 10 aa, Influenza virus
SRSSFYAEMK

SEQ ID NO: 430714 - protein, 10 aa, Influenza virus
FDEVRRRLSV

SEQ ID NO: 430715 - protein, 10 aa, Influenza virus
RSQSGRISFY

SEQ ID NO: 430716 - protein, 10 aa, Influenza virus
YVEDTKIDLW

SEQ ID NO: 430717 - protein, 10 aa, Influenza virus
DEGDGCFSIL

SEQ ID NO: 430718 - protein, 10 aa, Influenza virus
SWHDGAILPF

SEQ ID NO: 430719 - protein, 10 aa, Influenza virus
KQLRENAEEM

SEQ ID NO: 430720 - protein, 10 aa, Influenza virus
CSHMECRTFF

SEQ ID NO: 430721 - protein, 10 aa, Influenza virus
ELWSYNAELL

SEQ ID NO: 430722 - protein, 10 aa, Influenza virus
DFRDMRKNTL

SEQ ID NO: 430723 - protein, 10 aa, Influenza virus
KLYGNGNKLI

SEQ ID NO: 430724 - protein, 10 aa, Influenza virus
GIITDTLKSW

SEQ ID NO: 430725 - protein, 10 aa, Influenza virus
IYSCIASSTV

SEQ ID NO: 430726 - protein, 10 aa, Influenza virus
EIRTFSFQFI

SEQ ID NO: 430727 - protein, 10 aa, Influenza virus
HHAVSNGTKV

SEQ ID NO: 430728 - protein, 10 aa, Influenza virus
VLIGQGDIVL

SEQ ID NO: 430729 - protein, 10 aa, Influenza virus
AFRGLISTPL

SEQ ID NO: 430730 - protein, 10 aa, Influenza virus
LMNELGIPFH

SEQ ID NO: 430731 - protein, 10 aa, Influenza virus
TIGKCPKYVK

SEQ ID NO: 430732 - protein, 10 aa, Influenza virus
TVASSLVLAI

SEQ ID NO: 430733 - protein, 10 aa, Influenza virus
HYGGIPTDVI

SEQ ID NO: 430734 - protein, 10 aa, Influenza virus
CSCYMDIDVY

SEQ ID NO: 430735 - protein, 10 aa, Influenza virus
PFHNVHPFTI

SEQ ID NO: 430736 - protein, 10 aa, Influenza virus
FQVDCFLWHI

SEQ ID NO: 430737 - protein, 10 aa, Influenza virus
FSNAASYKRI

SEQ ID NO: 430738 - protein, 10 aa, Influenza virus
FQTAAQKAMM

SEQ ID NO: 430739 - protein, 10 aa, Influenza virus
HLKDQGWSYI

SEQ ID NO: 430740 - protein, 10 aa, Influenza virus
KQTRGIFGAI

SEQ ID NO: 430741 - protein, 10 aa, Influenza virus
KLANVVRKMM

SEQ ID NO: 430742 - protein, 10 aa, Influenza virus
WAYNAELLVL

SEQ ID NO: 430743 - protein, 10 aa, Influenza virus
CLAILIAGGL

SEQ ID NO: 430744 - protein, 10 aa, Influenza virus
LTHGSLLNDK

SEQ ID NO: 430745 - protein, 10 aa, Influenza virus
SWPDGAELPF

SEQ ID NO: 430746 - protein, 10 aa, Influenza virus
EQFTWNGVKV

SEQ ID NO: 430747 - protein, 10 aa, Influenza virus
GRMTFYWAIV

SEQ ID NO: 430748 - protein, 10 aa, Influenza virus
ISCLYKLSQF

SEQ ID NO: 430749 - protein, 10 aa, Influenza virus
LYDAIEECLI

SEQ ID NO: 430750 - protein, 10 aa, Influenza virus
VSCDPDECRF

SEQ ID NO: 430751 - protein, 10 aa, Influenza virus
SMPLHNIHPL

SEQ ID NO: 430752 - protein, 10 aa, Influenza virus
LTKGVLGFVF

SEQ ID NO: 430753 - protein, 10 aa, Influenza virus
KMKWGMELRR

SEQ ID NO: 430754 - protein, 10 aa, Influenza virus
GGWQGMIDGW

SEQ ID NO: 430755 - protein, 10 aa, Influenza virus
SKMQFSSLTV

SEQ ID NO: 430756 - protein, 10 aa, Influenza virus
RSILASSGSL

SEQ ID NO: 430757 - protein, 10 aa, Influenza virus
RATVSADPLL

SEQ ID NO: 430758 - protein, 10 aa, Influenza virus
TYNAELFVLM

SEQ ID NO: 430759 - protein, 10 aa, Influenza virus
SFSISCFLLI

SEQ ID NO: 430760 - protein, 10 aa, Influenza virus
CSNGSLQCTI

SEQ ID NO: 430761 - protein, 10 aa, Influenza virus
PWMRINNETI

SEQ ID NO: 430762 - protein, 10 aa, Influenza virus
KVWWTSNSII

SEQ ID NO: 430763 - protein, 10 aa, Influenza virus
FLVALENQHT

SEQ ID NO: 430764 - protein, 10 aa, Influenza virus
CSHSECRTFF

SEQ ID NO: 430765 - protein, 10 aa, Influenza virus
KMKWGMEMRR

SEQ ID NO: 430766 - protein, 10 aa, Influenza virus
SLESRRGFEM

SEQ ID NO: 430767 - protein, 10 aa, Influenza virus
LQLRDNAKEL

SEQ ID NO: 430768 - protein, 10 aa, Influenza virus
RPTTEINTWA

SEQ ID NO: 430769 - protein, 10 aa, Influenza virus
AYNAELLVLL

SEQ ID NO: 430770 - protein, 10 aa, Influenza virus
SAFDERRNKY

SEQ ID NO: 430771 - protein, 10 aa, Influenza virus
RTHQYSEKGK

SEQ ID NO: 430772 - protein, 10 aa, Influenza virus
WMCSNGSLHG

SEQ ID NO: 430773 - protein, 10 aa, Influenza virus
HPGLFENSCL

SEQ ID NO: 430774 - protein, 10 aa, Influenza virus
RVRHQLRENA

SEQ ID NO: 430775 - protein, 10 aa, Influenza virus
ESSFYAEMKW

SEQ ID NO: 430776 - protein, 10 aa, Influenza virus
IMFSNKMARL

SEQ ID NO: 430777 - protein, 10 aa, Influenza virus
SRSGFEILLI

SEQ ID NO: 430778 - protein, 10 aa, Influenza virus
HDFEREGYSL

SEQ ID NO: 430779 - protein, 10 aa, Influenza virus
RSWMKLYWHL

SEQ ID NO: 430780 - protein, 10 aa, Influenza virus
GANGVKGFSF

SEQ ID NO: 430781 - protein, 10 aa, Influenza virus
YLIEDPNAPH

SEQ ID NO: 430782 - protein, 10 aa, Influenza virus
LEVCFMYSDF

SEQ ID NO: 430783 - protein, 10 aa, Influenza virus
YRKLKREITF

SEQ ID NO: 430784 - protein, 10 aa, Influenza virus
DATAVAVIKY

SEQ ID NO: 430785 - protein, 10 aa, Influenza virus
KLAQGYKDII

SEQ ID NO: 430786 - protein, 10 aa, Influenza virus
GVDRFYRTCK

SEQ ID NO: 430787 - protein, 10 aa, Influenza virus
LVDGWYGFRH

SEQ ID NO: 430788 - protein, 10 aa, Influenza virus
VRMQLKDNAK

SEQ ID NO: 430789 - protein, 10 aa, Influenza virus
TISKDLRSGY

SEQ ID NO: 430790 - protein, 10 aa, Influenza virus
LMLQSRTREI

SEQ ID NO: 430791 - protein, 10 aa, Influenza virus
SIIGKMNTQF

SEQ ID NO: 430792 - protein, 10 aa, Influenza virus
LPLCPFKGFF

SEQ ID NO: 430793 - protein, 10 aa, Influenza virus
MKIIRVGCVI

SEQ ID NO: 430794 - protein, 10 aa, Influenza virus
CIKPCFWVEL

SEQ ID NO: 430795 - protein, 10 aa, Influenza virus
YLIEDPGAPH

SEQ ID NO: 430796 - protein, 10 aa, Influenza virus
GRIFQSGVRL

SEQ ID NO: 430797 - protein, 10 aa, Influenza virus
RLFTIRQEMA

SEQ ID NO: 430798 - protein, 10 aa, Influenza virus
EMGNGCFEFY

SEQ ID NO: 430799 - protein, 10 aa, Influenza virus
RSLIASSGTL

SEQ ID NO: 430800 - protein, 10 aa, Influenza virus
YRTESLQNRI

SEQ ID NO: 430801 - protein, 10 aa, Influenza virus
VTTNTINRNF

SEQ ID NO: 430802 - protein, 10 aa, Influenza virus
NINIREWSYL

SEQ ID NO: 430803 - protein, 10 aa, Influenza virus
RTPYRSLIKF

SEQ ID NO: 430804 - protein, 10 aa, Influenza virus
MRKKRGLFGA

SEQ ID NO: 430805 - protein, 10 aa, Influenza virus
IVNNQNWSGY

SEQ ID NO: 430806 - protein, 10 aa, Influenza virus
HLKDQSWSYI

SEQ ID NO: 430807 - protein, 10 aa, Influenza virus
NRVKIDPVKL

SEQ ID NO: 430808 - protein, 10 aa, Influenza virus
TISPRSRNGF

SEQ ID NO: 430809 - protein, 10 aa, Influenza virus
CTIPCFWVEM

SEQ ID NO: 430810 - protein, 10 aa, Influenza virus
RTNGTSKVKM

SEQ ID NO: 430811 - protein, 10 aa, Influenza virus
TTIKTWAGNI

SEQ ID NO: 430812 - protein, 10 aa, Influenza virus
GMITDTIKSW

SEQ ID NO: 430813 - protein, 10 aa, Influenza virus
FALGQGTTLY

SEQ ID NO: 430814 - protein, 10 aa, Influenza virus
RIRLFDYSGW

SEQ ID NO: 430815 - protein, 10 aa, Influenza virus
FQVDCFLWHI

SEQ ID NO: 430816 - protein, 10 aa, Influenza virus
RVWWTSNSII

SEQ ID NO: 430817 - protein, 10 aa, Influenza virus
SSDICYPGRF

SEQ ID NO: 430818 - protein, 10 aa, Influenza virus
YLIEDPAAPH

SEQ ID NO: 430819 - protein, 10 aa, Influenza virus
HHAVPNGTKV

SEQ ID NO: 430820 - protein, 10 aa, Influenza virus
SFGASCFLLL

SEQ ID NO: 430821 - protein, 10 aa, Influenza virus
LSIVPSGPLK

SEQ ID NO: 430822 - protein, 10 aa, Influenza virus
KRLTILGKDA

SEQ ID NO: 430823 - protein, 10 aa, Influenza virus
GMTLSVVSLI

SEQ ID NO: 430824 - protein, 10 aa, Influenza virus
KRKTRGLFGA

SEQ ID NO: 430825 - protein, 10 aa, Influenza virus
CINGSCTVVM

SEQ ID NO: 430826 - protein, 10 aa, Influenza virus
NQNPRVFLAM

SEQ ID NO: 430827 - protein, 10 aa, Influenza virus
TIGECPRYVK

SEQ ID NO: 430828 - protein, 10 aa, Influenza virus
RNFPQTTNTY

SEQ ID NO: 430829 - protein, 10 aa, Influenza virus
IHYGGVPTDV

SEQ ID NO: 430830 - protein, 11 aa, Influenza virus
RPRYNGQRSWM

SEQ ID NO: 430831 - protein, 11 aa, Influenza virus
KLLPFAAAPPV

SEQ ID NO: 430832 - protein, 11 aa, Influenza virus
FMQALQLLFEV

SEQ ID NO: 430833 - protein, 11 aa, Influenza virus
FMDVWTYNAEL

SEQ ID NO: 430834 - protein, 11 aa, Influenza virus
FLDVWTYNAEL

SEQ ID NO: 430835 - protein, 11 aa, Influenza virus
EIVDNSNWSGY

SEQ ID NO: 430836 - protein, 11 aa, Influenza virus
MTDGSASSQAY

SEQ ID NO: 430837 - protein, 11 aa, Influenza virus
MMWEINGPESV

SEQ ID NO: 430838 - protein, 11 aa, Influenza virus
MTDGSANSQAY

SEQ ID NO: 430839 - protein, 11 aa, Influenza virus
MMWEVNGPESV

SEQ ID NO: 430840 - protein, 11 aa, Influenza virus
FMQALQLLLEV

SEQ ID NO: 430841 - protein, 11 aa, Influenza virus
FLDIWTYNAEL

SEQ ID NO: 430842 - protein, 11 aa, Influenza virus
MMWEINGPDSV

SEQ ID NO: 430843 - protein, 11 aa, Influenza virus
EIVDNNNWSGY

SEQ ID NO: 430844 - protein, 11 aa, Influenza virus
FIAEQFTWNGV

SEQ ID NO: 430845 - protein, 11 aa, Influenza virus
FLQALQLLLEV

SEQ ID NO: 430846 - protein, 11 aa, Influenza virus
KTAYELTDSSW

SEQ ID NO: 430847 - protein, 11 aa, Influenza virus
EVLNNMNWSGY

SEQ ID NO: 430848 - protein, 11 aa, Influenza virus
DIIDNNNWSGY

SEQ ID NO: 430849 - protein, 11 aa, Influenza virus
MTDGSASGQAY

SEQ ID NO: 430850 - protein, 11 aa, Influenza virus
LMWEINGPESV

SEQ ID NO: 430851 - protein, 11 aa, Influenza virus
FLNNTEPLCEV

SEQ ID NO: 430852 - protein, 11 aa, Influenza virus
MTDGPASSQAY

SEQ ID NO: 430853 - protein, 11 aa, Influenza virus
GMLGFVFTLTV

SEQ ID NO: 430854 - protein, 11 aa, Influenza virus
YLSGREWSYIV

SEQ ID NO: 430855 - protein, 11 aa, Influenza virus
RSQSGRISFYW

SEQ ID NO: 430856 - protein, 11 aa, Influenza virus
DIIDNDNWSGY

SEQ ID NO: 430857 - protein, 11 aa, Influenza virus
EIVGNDNWSGY

SEQ ID NO: 430858 - protein, 11 aa, Influenza virus
FLNVWTYNAEL

SEQ ID NO: 430859 - protein, 11 aa, Influenza virus
YLIGKTSWSYI

SEQ ID NO: 430860 - protein, 11 aa, Influenza virus
LTITYSSSLMW

SEQ ID NO: 430861 - protein, 11 aa, Influenza virus
FLNNTEPLCNV

SEQ ID NO: 430862 - protein, 11 aa, Influenza virus
LMNELGVPFYL

SEQ ID NO: 430863 - protein, 11 aa, Influenza virus
YLNGREWSYIV

SEQ ID NO: 430864 - protein, 11 aa, Influenza virus
LTITYSSPMMW

SEQ ID NO: 430865 - protein, 11 aa, Influenza virus
YIWTYQAELLV

SEQ ID NO: 430866 - protein, 11 aa, Influenza virus
EIVSNDNWSGY

SEQ ID NO: 430867 - protein, 11 aa, Influenza virus
VIMEVVFPNEV

SEQ ID NO: 430868 - protein, 11 aa, Influenza virus
SLLNRLSINPV

SEQ ID NO: 430869 - protein, 11 aa, Influenza virus
EIVDNKNWSGY

SEQ ID NO: 430870 - protein, 11 aa, Influenza virus
LTITYSSSMMW

SEQ ID NO: 430871 - protein, 11 aa, Influenza virus
DTITFSFNGAF

SEQ ID NO: 430872 - protein, 11 aa, Influenza virus
LSSGYKEVILW

SEQ ID NO: 430873 - protein, 11 aa, Influenza virus
ALLNRLNINPV

SEQ ID NO: 430874 - protein, 11 aa, Influenza virus
FVQSYFQLFLV

SEQ ID NO: 430875 - protein, 11 aa, Influenza virus
ALLNRLSINPV

SEQ ID NO: 430876 - protein, 11 aa, Influenza virus
LSSGYKDVILW

SEQ ID NO: 430877 - protein, 11 aa, Influenza virus
FLGVWTYNAEL

SEQ ID NO: 430878 - protein, 11 aa, Influenza virus
TEMWSYNAELL

SEQ ID NO: 430879 - protein, 11 aa, Influenza virus
VEWTSNSLIAL

SEQ ID NO: 430880 - protein, 11 aa, Influenza virus
GLWAYNAELLV

SEQ ID NO: 430881 - protein, 11 aa, Influenza virus
DTVNFSFNGAF

SEQ ID NO: 430882 - protein, 11 aa, Influenza virus
LSSGYKDIILW

SEQ ID NO: 430883 - protein, 11 aa, Influenza virus
WEINGPESVLI

SEQ ID NO: 430884 - protein, 11 aa, Influenza virus
SLLEMCHSTQI

SEQ ID NO: 430885 - protein, 11 aa, Influenza virus
ALLSRLNINPV

SEQ ID NO: 430886 - protein, 11 aa, Influenza virus
LTIYSTVASSF

SEQ ID NO: 430887 - protein, 11 aa, Influenza virus
YQFALGHGTTL

SEQ ID NO: 430888 - protein, 11 aa, Influenza virus
LMSELGVPFHL

SEQ ID NO: 430889 - protein, 11 aa, Influenza virus
REMTFHGAKEV

SEQ ID NO: 430890 - protein, 11 aa, Influenza virus
DTVTFTFNGAF

SEQ ID NO: 430891 - protein, 11 aa, Influenza virus
VSNSDFLCVGW

SEQ ID NO: 430892 - protein, 11 aa, Influenza virus
SASACHDGASW

SEQ ID NO: 430893 - protein, 11 aa, Influenza virus
REITFHGAKEI

SEQ ID NO: 430894 - protein, 11 aa, Influenza virus
ISLGDCSFAGW

SEQ ID NO: 430895 - protein, 11 aa, Influenza virus
AANSADHRVYW

SEQ ID NO: 430896 - protein, 11 aa, Influenza virus
AANSADHRIYW

SEQ ID NO: 430897 - protein, 11 aa, Influenza virus
ISLGDCSFTGW

SEQ ID NO: 430898 - protein, 11 aa, Influenza virus
VSNSEFLCVGW

SEQ ID NO: 430899 - protein, 11 aa, Influenza virus
LTIIYSSSMMW

SEQ ID NO: 430900 - protein, 11 aa, Influenza virus
VSNSDFMCVGW

SEQ ID NO: 430901 - protein, 11 aa, Influenza virus
WLKTRPILSPL

SEQ ID NO: 430902 - protein, 11 aa, Influenza virus
SASACHDGISW

SEQ ID NO: 430903 - protein, 11 aa, Influenza virus
LAIMVAGLSFW

SEQ ID NO: 430904 - protein, 11 aa, Influenza virus
NLWAYNAELLV

SEQ ID NO: 430905 - protein, 11 aa, Influenza virus
AEINTWARNIL

SEQ ID NO: 430906 - protein, 11 aa, Influenza virus
LTMGYKDIILW

SEQ ID NO: 430907 - protein, 11 aa, Influenza virus
LPRRSGAAGAA

SEQ ID NO: 430908 - protein, 11 aa, Influenza virus
SLIASSGTLEF

SEQ ID NO: 430909 - protein, 11 aa, Influenza virus
WEKNCTLIDAL

SEQ ID NO: 430910 - protein, 11 aa, Influenza virus
SPRSRSGFEML

SEQ ID NO: 430911 - protein, 11 aa, Influenza virus
SASACHDGTSW

SEQ ID NO: 430912 - protein, 11 aa, Influenza virus
SSLTHALRELW

SEQ ID NO: 430913 - protein, 11 aa, Influenza virus
AMDEFQLIPMI

SEQ ID NO: 430914 - protein, 11 aa, Influenza virus
AEEDGTGCFEL

SEQ ID NO: 430915 - protein, 11 aa, Influenza virus
REITFYGAKEI

SEQ ID NO: 430916 - protein, 11 aa, Influenza virus
LSSGYKDVIIW

SEQ ID NO: 430917 - protein, 11 aa, Influenza virus
LAIMMAGLSFW

SEQ ID NO: 430918 - protein, 11 aa, Influenza virus
FIDVWTYNAEL

SEQ ID NO: 430919 - protein, 11 aa, Influenza virus
SASACHDGSSW

SEQ ID NO: 430920 - protein, 11 aa, Influenza virus
SIWTSSSSTVF

SEQ ID NO: 430921 - protein, 11 aa, Influenza virus
ALLNRLNINSV

SEQ ID NO: 430922 - protein, 11 aa, Influenza virus
FIQALQLLLEV

SEQ ID NO: 430923 - protein, 11 aa, Influenza virus
RELCTINSWHI

SEQ ID NO: 430924 - protein, 11 aa, Influenza virus
DTVTFSFNGAF

SEQ ID NO: 430925 - protein, 11 aa, Influenza virus
DLIETTHTGTY

SEQ ID NO: 430926 - protein, 11 aa, Influenza virus
AANNADHRVYW

SEQ ID NO: 430927 - protein, 11 aa, Influenza virus
AANNADHRIYW

SEQ ID NO: 430928 - protein, 11 aa, Influenza virus
LMNELGIPFHL

SEQ ID NO: 430929 - protein, 11 aa, Influenza virus
VSNSDFICVGW

SEQ ID NO: 430930 - protein, 11 aa, Influenza virus
TEIASWAGNIL

SEQ ID NO: 430931 - protein, 11 aa, Influenza virus
IEIPSWAGNIL

SEQ ID NO: 430932 - protein, 11 aa, Influenza virus
SPYRALMSVPM

SEQ ID NO: 430933 - protein, 11 aa, Influenza virus
RPGYNGQRSWM

SEQ ID NO: 430934 - protein, 11 aa, Influenza virus
SLLEMCHSTRI

SEQ ID NO: 430935 - protein, 11 aa, Influenza virus
DTVTFIFNGAF

SEQ ID NO: 430936 - protein, 11 aa, Influenza virus
SPRSRNGFEML

SEQ ID NO: 430937 - protein, 11 aa, Influenza virus
LLDVWTYNAEL

SEQ ID NO: 430938 - protein, 11 aa, Influenza virus
SSSSFYAEMKW

SEQ ID NO: 430939 - protein, 11 aa, Influenza virus
AMDDFQLIPMI

SEQ ID NO: 430940 - protein, 11 aa, Influenza virus
MMAYMLERELV

SEQ ID NO: 430941 - protein, 11 aa, Influenza virus
SLLEMCHGTQI

SEQ ID NO: 430942 - protein, 11 aa, Influenza virus
SSFSFGGFTFK

SEQ ID NO: 430943 - protein, 11 aa, Influenza virus
LAIMIAGLFFW

SEQ ID NO: 430944 - protein, 11 aa, Influenza virus
AMDDYQLIPMI

SEQ ID NO: 430945 - protein, 11 aa, Influenza virus
SSTEFLGQWNW

SEQ ID NO: 430946 - protein, 11 aa, Influenza virus
SIISMCSSTEF

SEQ ID NO: 430947 - protein, 11 aa, Influenza virus
FLNNTEPLCDV

SEQ ID NO: 430948 - protein, 11 aa, Influenza virus
LAIMIAGLSFW

SEQ ID NO: 430949 - protein, 11 aa, Influenza virus
ESDGAFLAPRY

SEQ ID NO: 430950 - protein, 11 aa, Influenza virus
ALMEWIKTRPI

SEQ ID NO: 430951 - protein, 11 aa, Influenza virus
SLVASSGTLEF

SEQ ID NO: 430952 - protein, 11 aa, Influenza virus
LMNELGVPFHL

SEQ ID NO: 430953 - protein, 11 aa, Influenza virus
IEIWSYNAEFL

SEQ ID NO: 430954 - protein, 11 aa, Influenza virus
ALMEWLKTRPI

SEQ ID NO: 430955 - protein, 11 aa, Influenza virus
FIDIWTYNAEL

SEQ ID NO: 430956 - protein, 11 aa, Influenza virus
SMSCFVFVALI

SEQ ID NO: 430957 - protein, 11 aa, Influenza virus
YLMLSKSLCKV

SEQ ID NO: 430958 - protein, 11 aa, Influenza virus
YQIGYVCSGVF

SEQ ID NO: 430959 - protein, 11 aa, Influenza virus
WIKTRPILSPL

SEQ ID NO: 430960 - protein, 11 aa, Influenza virus
SPRLRSGFEML

SEQ ID NO: 430961 - protein, 11 aa, Influenza virus
RLQDTTWDVFI

SEQ ID NO: 430962 - protein, 11 aa, Influenza virus
IEMTDSEMLNL

SEQ ID NO: 430963 - protein, 11 aa, Influenza virus
TEIPSWAGNVL

SEQ ID NO: 430964 - protein, 11 aa, Influenza virus
SQYRALISWPL

SEQ ID NO: 430965 - protein, 11 aa, Influenza virus
LMNELGVSFHL

SEQ ID NO: 430966 - protein, 11 aa, Influenza virus
WMMAMKYPITA

SEQ ID NO: 430967 - protein, 11 aa, Influenza virus
FRDVWTYNAEL

SEQ ID NO: 430968 - protein, 11 aa, Influenza virus
LLMSTNAYDRI

SEQ ID NO: 430969 - protein, 11 aa, Influenza virus
TEIWSYNAELL

SEQ ID NO: 430970 - protein, 11 aa, Influenza virus
WEINGPDSVLV

SEQ ID NO: 430971 - protein, 11 aa, Influenza virus
YQFALGHGTTL

SEQ ID NO: 430972 - protein, 11 aa, Influenza virus
RPLVRGQQGTM

SEQ ID NO: 430973 - protein, 11 aa, Influenza virus
DTVTFNFNGAF

SEQ ID NO: 430974 - protein, 11 aa, Influenza virus
EVLDNKNWSGY

SEQ ID NO: 430975 - protein, 11 aa, Influenza virus
KPNIGPRPLVM

SEQ ID NO: 430976 - protein, 11 aa, Influenza virus
SPFRTLMSCPM

SEQ ID NO: 430977 - protein, 11 aa, Influenza virus
REITFHGAKEV

SEQ ID NO: 430978 - protein, 11 aa, Influenza virus
SASACHDGTNW

SEQ ID NO: 430979 - protein, 11 aa, Influenza virus
GSSSFYAEMKW

SEQ ID NO: 430980 - protein, 11 aa, Influenza virus
SQYRALVSWPL

SEQ ID NO: 430981 - protein, 11 aa, Influenza virus
SPYRALMSVPL

SEQ ID NO: 430982 - protein, 11 aa, Influenza virus
REEALLNRLSI

SEQ ID NO: 430983 - protein, 11 aa, Influenza virus
YQIGYICSGVF

SEQ ID NO: 430984 - protein, 11 aa, Influenza virus
WMMAMRYPITA

SEQ ID NO: 430985 - protein, 11 aa, Influenza virus
SSMPFHNIHPF

SEQ ID NO: 430986 - protein, 11 aa, Influenza virus
FPFHKGNSARL

SEQ ID NO: 430987 - protein, 11 aa, Influenza virus
WEINGPESVLV

SEQ ID NO: 430988 - protein, 11 aa, Influenza virus
TEIPSWAGNIL

SEQ ID NO: 430989 - protein, 11 aa, Influenza virus
SYINRTGTFEF

SEQ ID NO: 430990 - protein, 11 aa, Influenza virus
YQFALGQGTTL

SEQ ID NO: 430991 - protein, 11 aa, Influenza virus
YQFALGQGATL

SEQ ID NO: 430992 - protein, 11 aa, Influenza virus
AQNAISTTFPY

SEQ ID NO: 430993 - protein, 11 aa, Influenza virus
ALQNRIMINPV

SEQ ID NO: 430994 - protein, 11 aa, Influenza virus
IEVWSYNAEFL

SEQ ID NO: 430995 - protein, 11 aa, Influenza virus
FLVAVENQHTI

SEQ ID NO: 430996 - protein, 11 aa, Influenza virus
MEMRRCLLQSL

SEQ ID NO: 430997 - protein, 11 aa, Influenza virus
MMGMFNMLSTV

SEQ ID NO: 430998 - protein, 11 aa, Influenza virus
FLGQWDWPDGA

SEQ ID NO: 430999 - protein, 11 aa, Influenza virus
KEWSGYSGSFV

SEQ ID NO: 431000 - protein, 11 aa, Influenza virus
FLVALENQHTI

SEQ ID NO: 431001 - protein, 11 aa, Influenza virus
REESLLNRLSI

SEQ ID NO: 431002 - protein, 11 aa, Influenza virus
ALSGVAIALSV

SEQ ID NO: 431003 - protein, 11 aa, Influenza virus
YQILSIYSTVV

SEQ ID NO: 431004 - protein, 11 aa, Influenza virus
EVLNNKHWSGY

SEQ ID NO: 431005 - protein, 11 aa, Influenza virus
FLGQWNWPDGA

SEQ ID NO: 431006 - protein, 11 aa, Influenza virus
LVMKRKRNSSI

SEQ ID NO: 431007 - protein, 11 aa, Influenza virus
SIVSMCSSTEF

SEQ ID NO: 431008 - protein, 11 aa, Influenza virus
MMKAVRGDLNF

SEQ ID NO: 431009 - protein, 11 aa, Influenza virus
LAIIIAGLSFW

SEQ ID NO: 431010 - protein, 11 aa, Influenza virus
RESGGIDKEPM

SEQ ID NO: 431011 - protein, 11 aa, Influenza virus
SIVASSGTLEF

SEQ ID NO: 431012 - protein, 11 aa, Influenza virus
ITFMQALQLLF

SEQ ID NO: 431013 - protein, 11 aa, Influenza virus
DLIETNHTGTY

SEQ ID NO: 431014 - protein, 11 aa, Influenza virus
ITQTLVSNSDW

SEQ ID NO: 431015 - protein, 11 aa, Influenza virus
RVWWTSNSIAV

SEQ ID NO: 431016 - protein, 11 aa, Influenza virus
LMTELGVPFHL

SEQ ID NO: 431017 - protein, 11 aa, Influenza virus
RPFVRGQQGRM

SEQ ID NO: 431018 - protein, 11 aa, Influenza virus
RQKWWVWLWLV

SEQ ID NO: 431019 - protein, 11 aa, Influenza virus
YRYGFVANFSM

SEQ ID NO: 431020 - protein, 11 aa, Influenza virus
KMNTQILIFAL

SEQ ID NO: 431021 - protein, 11 aa, Influenza virus
KLFASSGIAIV

SEQ ID NO: 431022 - protein, 11 aa, Influenza virus
SLVASSGNLEF

SEQ ID NO: 431023 - protein, 11 aa, Influenza virus
SVAGWLLGNPM

SEQ ID NO: 431024 - protein, 11 aa, Influenza virus
SQYRSLISWPL

SEQ ID NO: 431025 - protein, 11 aa, Influenza virus
FLVCVSLLQSA

SEQ ID NO: 431026 - protein, 11 aa, Influenza virus
RPRRGLFGAIA

SEQ ID NO: 431027 - protein, 11 aa, Influenza virus
RTFSFQLINNK

SEQ ID NO: 431028 - protein, 11 aa, Influenza virus
KMNTQILVFAL

SEQ ID NO: 431029 - protein, 11 aa, Influenza virus
FLWGIHHPPDA

SEQ ID NO: 431030 - protein, 11 aa, Influenza virus
NIWSYNAQLLV

SEQ ID NO: 431031 - protein, 11 aa, Influenza virus
RESGGIDKESM

SEQ ID NO: 431032 - protein, 11 aa, Influenza virus
TEINTWARNIL

SEQ ID NO: 431033 - protein, 11 aa, Influenza virus
TELWSYNAELL

SEQ ID NO: 431034 - protein, 11 aa, Influenza virus
GLYDAIEECLI

SEQ ID NO: 431035 - protein, 11 aa, Influenza virus
TEVWSYNAELL

SEQ ID NO: 431036 - protein, 11 aa, Influenza virus
YQRCCNLFEKF

SEQ ID NO: 431037 - protein, 11 aa, Influenza virus
AMQNRIQIDPV

SEQ ID NO: 431038 - protein, 11 aa, Influenza virus
VSWASNSIVTF

SEQ ID NO: 431039 - protein, 11 aa, Influenza virus
YLIRALTLNTM

SEQ ID NO: 431040 - protein, 11 aa, Influenza virus
VLDDCSLEGLV

SEQ ID NO: 431041 - protein, 11 aa, Influenza virus
GILGFVFTLTV

SEQ ID NO: 431042 - protein, 11 aa, Influenza virus
KLNNVIDKMYK

SEQ ID NO: 431043 - protein, 11 aa, Influenza virus
SATACSDGPGW

SEQ ID NO: 431044 - protein, 11 aa, Influenza virus
SILASSGSLEF

SEQ ID NO: 431045 - protein, 11 aa, Influenza virus
FVFVALILGFV

SEQ ID NO: 431046 - protein, 11 aa, Influenza virus
SSVASSLVLLF

SEQ ID NO: 431047 - protein, 11 aa, Influenza virus
TEIPSWEGNIL

SEQ ID NO: 431048 - protein, 11 aa, Influenza virus
YLMLNKSLCKV

SEQ ID NO: 431049 - protein, 11 aa, Influenza virus
ILAATVTLHFK

SEQ ID NO: 431050 - protein, 11 aa, Influenza virus
REEAMQNRIQI

SEQ ID NO: 431051 - protein, 11 aa, Influenza virus
FSFSISCFLLV

SEQ ID NO: 431052 - protein, 11 aa, Influenza virus
FLAHALKLVVA

SEQ ID NO: 431053 - protein, 11 aa, Influenza virus
TQCQITGFAPF

SEQ ID NO: 431054 - protein, 11 aa, Influenza virus
KMNTQILIFTL

SEQ ID NO: 431055 - protein, 11 aa, Influenza virus
RPRVRNQSGRI

SEQ ID NO: 431056 - protein, 11 aa, Influenza virus
LTQGYKDVILW

SEQ ID NO: 431057 - protein, 11 aa, Influenza virus
SGYSGSFSIRW

SEQ ID NO: 431058 - protein, 11 aa, Influenza virus
SSSSCHDGNAW

SEQ ID NO: 431059 - protein, 11 aa, Influenza virus
VYQILAIYSTI

SEQ ID NO: 431060 - protein, 11 aa, Influenza virus
RMFALSQGTTL

SEQ ID NO: 431061 - protein, 11 aa, Influenza virus
SYINKTGTFEF

SEQ ID NO: 431062 - protein, 11 aa, Influenza virus
MRKKRGLFGAI

SEQ ID NO: 431063 - protein, 11 aa, Influenza virus
SSFKRFEIFPK

SEQ ID NO: 431064 - protein, 11 aa, Influenza virus
SLYASSQLEGF

SEQ ID NO: 431065 - protein, 11 aa, Influenza virus
SLQNRIQIDPV

SEQ ID NO: 431066 - protein, 11 aa, Influenza virus
RPLVRGQQGWM

SEQ ID NO: 431067 - protein, 11 aa, Influenza virus
ALANTIEVFRL

SEQ ID NO: 431068 - protein, 11 aa, Influenza virus
NMNWSGYSGSF

SEQ ID NO: 431069 - protein, 11 aa, Influenza virus
AMDDFQLIPII

SEQ ID NO: 431070 - protein, 11 aa, Influenza virus
FLLMDSLKLSI

SEQ ID NO: 431071 - protein, 11 aa, Influenza virus
LAQGYKDIILW

SEQ ID NO: 431072 - protein, 11 aa, Influenza virus
EVLNNKNWSGY

SEQ ID NO: 431073 - protein, 11 aa, Influenza virus
YQFALGHGTTL

SEQ ID NO: 431074 - protein, 11 aa, Influenza virus
YQFALGQGTTL

SEQ ID NO: 431075 - protein, 11 aa, Influenza virus
YLIRTLTLNTM

SEQ ID NO: 431076 - protein, 11 aa, Influenza virus
ILATTVTLHFK

SEQ ID NO: 431077 - protein, 11 aa, Influenza virus
FLLMDALKLSI

SEQ ID NO: 431078 - protein, 11 aa, Influenza virus
SGYSGAFIDYW

SEQ ID NO: 431079 - protein, 11 aa, Influenza virus
RPLVRGQQGRM

SEQ ID NO: 431080 - protein, 11 aa, Influenza virus
SGYSGSFIDYW

SEQ ID NO: 431081 - protein, 11 aa, Influenza virus
ITQTLVSNNDW

SEQ ID NO: 431082 - protein, 11 aa, Influenza virus
RPGYNGQKSWM

SEQ ID NO: 431083 - protein, 11 aa, Influenza virus
ILATTITLHFK

SEQ ID NO: 431084 - protein, 11 aa, Influenza virus
SATACSDGSGW

SEQ ID NO: 431085 - protein, 11 aa, Influenza virus
GLYEAIEECLI

SEQ ID NO: 431086 - protein, 11 aa, Influenza virus
LMMAYMLEREL

SEQ ID NO: 431087 - protein, 11 aa, Influenza virus
LLLQITSLCSI

SEQ ID NO: 431088 - protein, 11 aa, Influenza virus
LLNASWFNSFL

SEQ ID NO: 431089 - protein, 11 aa, Influenza virus
LLLQVTSLCSI

SEQ ID NO: 431090 - protein, 11 aa, Influenza virus
YQIGYVCSGIF

SEQ ID NO: 431091 - protein, 11 aa, Influenza virus
VPNYQSLRSIL

SEQ ID NO: 431092 - protein, 11 aa, Influenza virus
WSWPDGALLPF

SEQ ID NO: 431093 - protein, 11 aa, Influenza virus
DLADSEMLNLY

SEQ ID NO: 431094 - protein, 11 aa, Influenza virus
NIWAYNAELLV

SEQ ID NO: 431095 - protein, 11 aa, Influenza virus
FLWGIHHPPNT

SEQ ID NO: 431096 - protein, 11 aa, Influenza virus
WEVNGPESVLV

SEQ ID NO: 431097 - protein, 11 aa, Influenza virus
SGYSGAFVDYW

SEQ ID NO: 431098 - protein, 11 aa, Influenza virus
NLIAPEYGHLV

SEQ ID NO: 431099 - protein, 11 aa, Influenza virus
ALSVLNLLIGV

SEQ ID NO: 431100 - protein, 11 aa, Influenza virus
SSTEFLGQWDW

SEQ ID NO: 431101 - protein, 11 aa, Influenza virus
HLRNDTDVVNF

SEQ ID NO: 431102 - protein, 11 aa, Influenza virus
SGYSGSFVDYW

SEQ ID NO: 431103 - protein, 11 aa, Influenza virus
RPLIRGQQGRM

SEQ ID NO: 431104 - protein, 11 aa, Influenza virus
WLSSSGNNQVF

SEQ ID NO: 431105 - protein, 11 aa, Influenza virus
LLNDKHSNETV

SEQ ID NO: 431106 - protein, 11 aa, Influenza virus
SSVASSLVLLF

SEQ ID NO: 431107 - protein, 11 aa, Influenza virus
ITNWSGYSGSF

SEQ ID NO: 431108 - protein, 11 aa, Influenza virus
TEVWSYNADLL

SEQ ID NO: 431109 - protein, 11 aa, Influenza virus
AQNAISITFPY

SEQ ID NO: 431110 - protein, 11 aa, Influenza virus
NQNWSGYSGSF

SEQ ID NO: 431111 - protein, 11 aa, Influenza virus
YRYGFVANFSM

SEQ ID NO: 431112 - protein, 11 aa, Influenza virus
SSMPFHNIHPF

SEQ ID NO: 431113 - protein, 11 aa, Influenza virus
LTQGYKDIILW

SEQ ID NO: 431114 - protein, 11 aa, Influenza virus
NMLSTVLGVSV

SEQ ID NO: 431115 - protein, 11 aa, Influenza virus
SEIEHQISNVI

SEQ ID NO: 431116 - protein, 11 aa, Influenza virus
LLLQIISLCSI

SEQ ID NO: 431117 - protein, 11 aa, Influenza virus
GLYEAVEECLI

SEQ ID NO: 431118 - protein, 11 aa, Influenza virus
SSSSCFDGREW

SEQ ID NO: 431119 - protein, 11 aa, Influenza virus
YQKCCSLFEKF

SEQ ID NO: 431120 - protein, 11 aa, Influenza virus
RTNGNLIAPEF

SEQ ID NO: 431121 - protein, 11 aa, Influenza virus
YQKCCTLFEKF

SEQ ID NO: 431122 - protein, 11 aa, Influenza virus
LLNDKHSNNTV

SEQ ID NO: 431123 - protein, 11 aa, Influenza virus
MVIASTTAKAM

SEQ ID NO: 431124 - protein, 11 aa, Influenza virus
KRMTRGLFGAI

SEQ ID NO: 431125 - protein, 11 aa, Influenza virus
KYVWWASNSLI

SEQ ID NO: 431126 - protein, 11 aa, Influenza virus
SIYSCIASSLV

SEQ ID NO: 431127 - protein, 11 aa, Influenza virus
GAIAGFIENGW

SEQ ID NO: 431128 - protein, 11 aa, Influenza virus
YQFALGQGATL

SEQ ID NO: 431129 - protein, 11 aa, Influenza virus
KPFQNVSRIAI

SEQ ID NO: 431130 - protein, 11 aa, Influenza virus
KMNNQILILAL

SEQ ID NO: 431131 - protein, 11 aa, Influenza virus
SYFFGDNAEEF

SEQ ID NO: 431132 - protein, 11 aa, Influenza virus
WLSSSMNNQVF

SEQ ID NO: 431133 - protein, 11 aa, Influenza virus
RPQMNGQSGRI

SEQ ID NO: 431134 - protein, 11 aa, Influenza virus
ILWFSFGASSF

SEQ ID NO: 431135 - protein, 11 aa, Influenza virus
KYVWWTSNSLI

SEQ ID NO: 431136 - protein, 11 aa, Influenza virus
NQNWSGYSGAF

SEQ ID NO: 431137 - protein, 11 aa, Influenza virus
CSASTGGQSFY

SEQ ID NO: 431138 - protein, 11 aa, Influenza virus
KMYALHQGTTI

SEQ ID NO: 431139 - protein, 11 aa, Influenza virus
LQRRRFIQNAL

SEQ ID NO: 431140 - protein, 11 aa, Influenza virus
KEWSRRYELEI

SEQ ID NO: 431141 - protein, 11 aa, Influenza virus
AMASQGTKRSF

SEQ ID NO: 431142 - protein, 11 aa, Influenza virus
AEDMGNGCFTI

SEQ ID NO: 431143 - protein, 11 aa, Influenza virus
GVSSEAPGWSW

SEQ ID NO: 431144 - protein, 11 aa, Influenza virus
SSFERFEMFPK

SEQ ID NO: 431145 - protein, 11 aa, Influenza virus
MPFHNVHPLTI

SEQ ID NO: 431146 - protein, 11 aa, Influenza virus
VQNAISTTFPY

SEQ ID NO: 431147 - protein, 11 aa, Influenza virus
GLYESIEECLI

SEQ ID NO: 431148 - protein, 11 aa, Influenza virus
AIWTSGSSIAF

SEQ ID NO: 431149 - protein, 11 aa, Influenza virus
TVAGSLSLAIM

SEQ ID NO: 431150 - protein, 11 aa, Influenza virus
KTMTITFLILL

SEQ ID NO: 431151 - protein, 11 aa, Influenza virus
SQYRALVSWPL

SEQ ID NO: 431152 - protein, 11 aa, Influenza virus
AAMGLRISSSF

SEQ ID NO: 431153 - protein, 11 aa, Influenza virus
CYNPCFYVELI

SEQ ID NO: 431154 - protein, 11 aa, Influenza virus
EVSHCRATEYM

SEQ ID NO: 431155 - protein, 11 aa, Influenza virus
TLSGVAIALSV

SEQ ID NO: 431156 - protein, 11 aa, Influenza virus
SGYSGAFMDYW

SEQ ID NO: 431157 - protein, 11 aa, Influenza virus
LSGGYKDVILW

SEQ ID NO: 431158 - protein, 11 aa, Influenza virus
ITQTLVSNDDW

SEQ ID NO: 431159 - protein, 11 aa, Influenza virus
NSDVLVTREPY

SEQ ID NO: 431160 - protein, 11 aa, Influenza virus
GTSGTYGTGTW

SEQ ID NO: 431161 - protein, 11 aa, Influenza virus
RTISPHSRSGF

SEQ ID NO: 431162 - protein, 11 aa, Influenza virus
ITNWSGYSGSF

SEQ ID NO: 431163 - protein, 11 aa, Influenza virus
AAMGMRISSSF

SEQ ID NO: 431164 - protein, 11 aa, Influenza virus
SSSSCHDGKSW

SEQ ID NO: 431165 - protein, 11 aa, Influenza virus
WSWPDDAELPF

SEQ ID NO: 431166 - protein, 11 aa, Influenza virus
RTHQYSERGRW

SEQ ID NO: 431167 - protein, 11 aa, Influenza virus
LQRRRFVQNAL

SEQ ID NO: 431168 - protein, 11 aa, Influenza virus
SQYRALISWPL

SEQ ID NO: 431169 - protein, 11 aa, Influenza virus
SSFERFEIFPK

SEQ ID NO: 431170 - protein, 11 aa, Influenza virus
SGYSGSFMDYW

SEQ ID NO: 431171 - protein, 11 aa, Influenza virus
MPFHNIHPLTI

SEQ ID NO: 431172 - protein, 11 aa, Influenza virus
MTIASDILTRM

SEQ ID NO: 431173 - protein, 11 aa, Influenza virus
GAIAGFIEGRW

SEQ ID NO: 431174 - protein, 11 aa, Influenza virus
KTGTFEFTSFF

SEQ ID NO: 431175 - protein, 11 aa, Influenza virus
GICAVATTHSW

SEQ ID NO: 431176 - protein, 11 aa, Influenza virus
RPWMRISNETI

SEQ ID NO: 431177 - protein, 11 aa, Influenza virus
KMQFSSLTVNV

SEQ ID NO: 431178 - protein, 11 aa, Influenza virus
NQFALGQGTTL

SEQ ID NO: 431179 - protein, 11 aa, Influenza virus
REEALLSRLNI

SEQ ID NO: 431180 - protein, 11 aa, Influenza virus
YLLLNKSLCSV

SEQ ID NO: 431181 - protein, 11 aa, Influenza virus
KLLPFAAAPPK

SEQ ID NO: 431182 - protein, 11 aa, Influenza virus
DLVETSHTGTY

SEQ ID NO: 431183 - protein, 11 aa, Influenza virus
SIYSCIASSTV

SEQ ID NO: 431184 - protein, 11 aa, Influenza virus
LVVSLGAISFW

SEQ ID NO: 431185 - protein, 11 aa, Influenza virus
WSWHDGAVLPF

SEQ ID NO: 431186 - protein, 11 aa, Influenza virus
LQITSLCSIWF

SEQ ID NO: 431187 - protein, 11 aa, Influenza virus
RISSSFSFGGF

SEQ ID NO: 431188 - protein, 11 aa, Influenza virus
WLTLKSEQFPV

SEQ ID NO: 431189 - protein, 11 aa, Influenza virus
SEIEHQIGNVI

SEQ ID NO: 431190 - protein, 11 aa, Influenza virus
REQLSQKFEEI

SEQ ID NO: 431191 - protein, 11 aa, Influenza virus
SLYSSPQLEGF

SEQ ID NO: 431192 - protein, 11 aa, Influenza virus
GVSSEVPGWSW

SEQ ID NO: 431193 - protein, 11 aa, Influenza virus
CQMEKIVLLFA

SEQ ID NO: 431194 - protein, 11 aa, Influenza virus
YQFALGQGTTL

SEQ ID NO: 431195 - protein, 11 aa, Influenza virus
LTQTLVSNNDW

SEQ ID NO: 431196 - protein, 11 aa, Influenza virus
MLLDPGDTVTF

SEQ ID NO: 431197 - protein, 11 aa, Influenza virus
KINPVTLTMGY

SEQ ID NO: 431198 - protein, 11 aa, Influenza virus
LSGGYKDIILW

SEQ ID NO: 431199 - protein, 11 aa, Influenza virus
WSWPDGADLPF

SEQ ID NO: 431200 - protein, 11 aa, Influenza virus
RMQFSSFTVNV

SEQ ID NO: 431201 - protein, 11 aa, Influenza virus
ILASSGSLEFI

SEQ ID NO: 431202 - protein, 11 aa, Influenza virus
DMADSEMLNLY

SEQ ID NO: 431203 - protein, 11 aa, Influenza virus
ILWTSNSIVVF

SEQ ID NO: 431204 - protein, 11 aa, Influenza virus
KMNTQFETVGK

SEQ ID NO: 431205 - protein, 11 aa, Influenza virus
REEALLNRLNI

SEQ ID NO: 431206 - protein, 11 aa, Influenza virus
NHTDELCPSPL

SEQ ID NO: 431207 - protein, 11 aa, Influenza virus
GIDKESMGFRY

SEQ ID NO: 431208 - protein, 11 aa, Influenza virus
RTHQYSEKGRW

SEQ ID NO: 431209 - protein, 11 aa, Influenza virus
RPILSPLTKGM

SEQ ID NO: 431210 - protein, 11 aa, Influenza virus
KMNTQILILAL

SEQ ID NO: 431211 - protein, 11 aa, Influenza virus
FPFHKDNALRL

SEQ ID NO: 431212 - protein, 11 aa, Influenza virus
GQFGRINFHWL

SEQ ID NO: 431213 - protein, 11 aa, Influenza virus
KEWSKRYELEI

SEQ ID NO: 431214 - protein, 11 aa, Influenza virus
RYGPALSINEL

SEQ ID NO: 431215 - protein, 11 aa, Influenza virus
SIAPIMFSNKV

SEQ ID NO: 431216 - protein, 11 aa, Influenza virus
LPFHNVHPLAI

SEQ ID NO: 431217 - protein, 11 aa, Influenza virus
HPSSTQEKNAL

SEQ ID NO: 431218 - protein, 11 aa, Influenza virus
IPHRTLLMSEL

SEQ ID NO: 431219 - protein, 11 aa, Influenza virus
RTHQYSERGKW

SEQ ID NO: 431220 - protein, 11 aa, Influenza virus
HLRNDTDVVNY

SEQ ID NO: 431221 - protein, 11 aa, Influenza virus
AILATTVTLHF

SEQ ID NO: 431222 - protein, 11 aa, Influenza virus
WSWPDGAELPF

SEQ ID NO: 431223 - protein, 11 aa, Influenza virus
RPLVMGQQGRM

SEQ ID NO: 431224 - protein, 11 aa, Influenza virus
SQYRSLISWPL

SEQ ID NO: 431225 - protein, 11 aa, Influenza virus
MLFVQSYFQLF

SEQ ID NO: 431226 - protein, 11 aa, Influenza virus
KMKAIIVVLLY

SEQ ID NO: 431227 - protein, 11 aa, Influenza virus
MMMGMFNMLST

SEQ ID NO: 431228 - protein, 11 aa, Influenza virus
KYERVKMFDFI

SEQ ID NO: 431229 - protein, 11 aa, Influenza virus
LIALCGSPFPV

SEQ ID NO: 431230 - protein, 11 aa, Influenza virus
SPHSRSGFEML

SEQ ID NO: 431231 - protein, 11 aa, Influenza virus
RMFALSQGTTL

SEQ ID NO: 431232 - protein, 11 aa, Influenza virus
SSSSCFDGKEW

SEQ ID NO: 431233 - protein, 11 aa, Influenza virus
LPFHNIHPLAI

SEQ ID NO: 431234 - protein, 11 aa, Influenza virus
ALRDSLEPGTF

SEQ ID NO: 431235 - protein, 11 aa, Influenza virus
REITFHRAKEV

SEQ ID NO: 431236 - protein, 11 aa, Influenza virus
TVVLNTDWSGY

SEQ ID NO: 431237 - protein, 11 aa, Influenza virus
GEETIEERFAI

SEQ ID NO: 431238 - protein, 11 aa, Influenza virus
TMDTVSRTHQY

SEQ ID NO: 431239 - protein, 11 aa, Influenza virus
FMWAIHHPPTS

SEQ ID NO: 431240 - protein, 11 aa, Influenza virus
KMKAILVVLLY

SEQ ID NO: 431241 - protein, 11 aa, Influenza virus
RPWMRINNETI

SEQ ID NO: 431242 - protein, 11 aa, Influenza virus
FLYVRTNGTSK

SEQ ID NO: 431243 - protein, 11 aa, Influenza virus
VYQARFESVAW

SEQ ID NO: 431244 - protein, 11 aa, Influenza virus
AAIGLRISSSF

SEQ ID NO: 431245 - protein, 11 aa, Influenza virus
KISSSFSFGGF

SEQ ID NO: 431246 - protein, 11 aa, Influenza virus
VLLNASWFNSF

SEQ ID NO: 431247 - protein, 11 aa, Influenza virus
RPTAVDTCYPF

SEQ ID NO: 431248 - protein, 11 aa, Influenza virus
YQKCCNLFEKF

SEQ ID NO: 431249 - protein, 11 aa, Influenza virus
RTHQYSEKGKW

SEQ ID NO: 431250 - protein, 11 aa, Influenza virus
AEEDGNGCFEI

SEQ ID NO: 431251 - protein, 11 aa, Influenza virus
SIWFSHYNQMK

SEQ ID NO: 431252 - protein, 11 aa, Influenza virus
QTYAGAVNSSK

SEQ ID NO: 431253 - protein, 11 aa, Influenza virus
DLVETNHTGTY

SEQ ID NO: 431254 - protein, 11 aa, Influenza virus
KMARLGRGYMF

SEQ ID NO: 431255 - protein, 11 aa, Influenza virus
SLYASPQLEGF

SEQ ID NO: 431256 - protein, 11 aa, Influenza virus
VSWTSNSIVTF

SEQ ID NO: 431257 - protein, 11 aa, Influenza virus
GVSSEVPEWSW

SEQ ID NO: 431258 - protein, 11 aa, Influenza virus
GQFGRIDFHWL

SEQ ID NO: 431259 - protein, 11 aa, Influenza virus
YLLLNKSLCNV

SEQ ID NO: 431260 - protein, 11 aa, Influenza virus
WSWPDGAKLPF

SEQ ID NO: 431261 - protein, 11 aa, Influenza virus
VLMENERTLYF

SEQ ID NO: 431262 - protein, 11 aa, Influenza virus
LVMKRKRDSSI

SEQ ID NO: 431263 - protein, 11 aa, Influenza virus
TEWSGYSGSFV

SEQ ID NO: 431264 - protein, 11 aa, Influenza virus
SSSSCHDGRAW

SEQ ID NO: 431265 - protein, 11 aa, Influenza virus
SSASCHDGRAW

SEQ ID NO: 431266 - protein, 11 aa, Influenza virus
KLATGLRNVPI

SEQ ID NO: 431267 - protein, 11 aa, Influenza virus
ALANTIEVFRA

SEQ ID NO: 431268 - protein, 11 aa, Influenza virus
QTYAGAINSSK

SEQ ID NO: 431269 - protein, 11 aa, Influenza virus
AEEDGTGCFEI

SEQ ID NO: 431270 - protein, 11 aa, Influenza virus
AILATTITLHF

SEQ ID NO: 431271 - protein, 11 aa, Influenza virus
NPNWSGYSGAF

SEQ ID NO: 431272 - protein, 11 aa, Influenza virus
EMTDSEMLNLY

SEQ ID NO: 431273 - protein, 11 aa, Influenza virus
VYQSRFEAVAW

SEQ ID NO: 431274 - protein, 11 aa, Influenza virus
WLTLKLGQFPV

SEQ ID NO: 431275 - protein, 11 aa, Influenza virus
CYRACFYVELI

SEQ ID NO: 431276 - protein, 11 aa, Influenza virus
AILAATVTLHF

SEQ ID NO: 431277 - protein, 11 aa, Influenza virus
GVWTYNAELLV

SEQ ID NO: 431278 - protein, 11 aa, Influenza virus
LLAKSVFNSIY

SEQ ID NO: 431279 - protein, 11 aa, Influenza virus
AIYSTVASSLV

SEQ ID NO: 431280 - protein, 11 aa, Influenza virus
VSWTSNSIITF

SEQ ID NO: 431281 - protein, 11 aa, Influenza virus
DAYAVIHYGGM

SEQ ID NO: 431282 - protein, 11 aa, Influenza virus
RTISPRSRSGF

SEQ ID NO: 431283 - protein, 11 aa, Influenza virus
AIYSTVASSSV

SEQ ID NO: 431284 - protein, 11 aa, Influenza virus
APQLNPIDGPL

SEQ ID NO: 431285 - protein, 11 aa, Influenza virus
ALLAKSVFNSL

SEQ ID NO: 431286 - protein, 11 aa, Influenza virus
RTISPRLRSGF

SEQ ID NO: 431287 - protein, 11 aa, Influenza virus
LSMAPIMFSNK

SEQ ID NO: 431288 - protein, 11 aa, Influenza virus
VYQARFEAVAW

SEQ ID NO: 431289 - protein, 11 aa, Influenza virus
SLQNRIQIDSV

SEQ ID NO: 431290 - protein, 11 aa, Influenza virus
IESNVTVTSSI

SEQ ID NO: 431291 - protein, 11 aa, Influenza virus
SQFRALISWEM

SEQ ID NO: 431292 - protein, 11 aa, Influenza virus
KYGPALSINEL

SEQ ID NO: 431293 - protein, 11 aa, Influenza virus
VSWTSNSMVTF

SEQ ID NO: 431294 - protein, 11 aa, Influenza virus
WEQMYNPGGEV

SEQ ID NO: 431295 - protein, 11 aa, Influenza virus
KLNNVIDKMNK

SEQ ID NO: 431296 - protein, 11 aa, Influenza virus
STVMVGLILAF

SEQ ID NO: 431297 - protein, 11 aa, Influenza virus
SSFEKFEIFPK

SEQ ID NO: 431298 - protein, 11 aa, Influenza virus
LVWMACHSAAF

SEQ ID NO: 431299 - protein, 11 aa, Influenza virus
RTISTASRSGY

SEQ ID NO: 431300 - protein, 11 aa, Influenza virus
KLVDGQDCDLI

SEQ ID NO: 431301 - protein, 11 aa, Influenza virus
KMNTQFEAVGK

SEQ ID NO: 431302 - protein, 11 aa, Influenza virus
FEPNGCIESKL

SEQ ID NO: 431303 - protein, 11 aa, Influenza virus
RPSIWTSSSST

SEQ ID NO: 431304 - protein, 11 aa, Influenza virus
LLAKSVFNSLY

SEQ ID NO: 431305 - protein, 11 aa, Influenza virus
ALSGVAIALSI

SEQ ID NO: 431306 - protein, 11 aa, Influenza virus
KQKSLLLATGM

SEQ ID NO: 431307 - protein, 11 aa, Influenza virus
WSWHDGAILPF

SEQ ID NO: 431308 - protein, 11 aa, Influenza virus
AAMGLKISSSF

SEQ ID NO: 431309 - protein, 11 aa, Influenza virus
RYGPALSISEL

SEQ ID NO: 431310 - protein, 11 aa, Influenza virus
MELRRCLLQSL

SEQ ID NO: 431311 - protein, 11 aa, Influenza virus
SPHRTLLMNEL

SEQ ID NO: 431312 - protein, 11 aa, Influenza virus
GTSGTYGTGSW

SEQ ID NO: 431313 - protein, 11 aa, Influenza virus
IMASQGTKRSY

SEQ ID NO: 431314 - protein, 11 aa, Influenza virus
FLYIRTNGTSK

SEQ ID NO: 431315 - protein, 11 aa, Influenza virus
TIWASGSSISF

SEQ ID NO: 431316 - protein, 11 aa, Influenza virus
YIIRALTLNTM

SEQ ID NO: 431317 - protein, 11 aa, Influenza virus
REEVTNATETV

SEQ ID NO: 431318 - protein, 11 aa, Influenza virus
VLWTSNSIVAL

SEQ ID NO: 431319 - protein, 11 aa, Influenza virus
GTIAGFIEGGW

SEQ ID NO: 431320 - protein, 11 aa, Influenza virus
HVRKRFADQEL

SEQ ID NO: 431321 - protein, 11 aa, Influenza virus
MKWMMAMRYPI

SEQ ID NO: 431322 - protein, 11 aa, Influenza virus
LLIAMENQHTI

SEQ ID NO: 431323 - protein, 11 aa, Influenza virus
AEEDGRGCFEI

SEQ ID NO: 431324 - protein, 11 aa, Influenza virus
AMASQGTKRSY

SEQ ID NO: 431325 - protein, 11 aa, Influenza virus
VTQTLVSNNDW

SEQ ID NO: 431326 - protein, 11 aa, Influenza virus
FPFHKDNAIRL

SEQ ID NO: 431327 - protein, 11 aa, Influenza virus
MPLHNIHPLTI

SEQ ID NO: 431328 - protein, 11 aa, Influenza virus
LTRELCTINSW

SEQ ID NO: 431329 - protein, 11 aa, Influenza virus
FRNALSIAPIM

SEQ ID NO: 431330 - protein, 11 aa, Influenza virus
NMLADWVDDAV

SEQ ID NO: 431331 - protein, 11 aa, Influenza virus
SIYSSVASSLV

SEQ ID NO: 431332 - protein, 11 aa, Influenza virus
TYIWTYQAELL

SEQ ID NO: 431333 - protein, 11 aa, Influenza virus
LIWMACHSAAF

SEQ ID NO: 431334 - protein, 11 aa, Influenza virus
LLASTNAYDRI

SEQ ID NO: 431335 - protein, 11 aa, Influenza virus
ESNGNFITPEY

SEQ ID NO: 431336 - protein, 11 aa, Influenza virus
TMDTVNRTHQY

SEQ ID NO: 431337 - protein, 11 aa, Influenza virus
SPFRTLMSCPI

SEQ ID NO: 431338 - protein, 11 aa, Influenza virus
GSKEQLGSWSW

SEQ ID NO: 431339 - protein, 11 aa, Influenza virus
RVRNQSGRISI

SEQ ID NO: 431340 - protein, 11 aa, Influenza virus
KMNTKILVLAL

SEQ ID NO: 431341 - protein, 11 aa, Influenza virus
SLSISVGSSTY

SEQ ID NO: 431342 - protein, 11 aa, Influenza virus
REWSYLIEDPA

SEQ ID NO: 431343 - protein, 11 aa, Influenza virus
GIDKEPMGFRY

SEQ ID NO: 431344 - protein, 11 aa, Influenza virus
RTGTFEFTSFF

SEQ ID NO: 431345 - protein, 11 aa, Influenza virus
WEQMYTPGGEV

SEQ ID NO: 431346 - protein, 11 aa, Influenza virus
LTRGLCTINSW

SEQ ID NO: 431347 - protein, 11 aa, Influenza virus
KVWWTSNSIVV

SEQ ID NO: 431348 - protein, 11 aa, Influenza virus
MRWLTLKSGQF

SEQ ID NO: 431349 - protein, 11 aa, Influenza virus
VLWTSNSIVVF

SEQ ID NO: 431350 - protein, 11 aa, Influenza virus
VLMENERTLGF

SEQ ID NO: 431351 - protein, 11 aa, Influenza virus
YPGATVNEGAL

SEQ ID NO: 431352 - protein, 11 aa, Influenza virus
NKMEFEPFQSL

SEQ ID NO: 431353 - protein, 11 aa, Influenza virus
RMYALHQGTTI

SEQ ID NO: 431354 - protein, 11 aa, Influenza virus
VLIGQGDIVLV

SEQ ID NO: 431355 - protein, 11 aa, Influenza virus
MRWLTLKSEQF

SEQ ID NO: 431356 - protein, 11 aa, Influenza virus
RESRSPGNAEI

SEQ ID NO: 431357 - protein, 11 aa, Influenza virus
SAYERMCNILK

SEQ ID NO: 431358 - protein, 11 aa, Influenza virus
VSFQGRGVFEF

SEQ ID NO: 431359 - protein, 11 aa, Influenza virus
GPATAQMALQL

SEQ ID NO: 431360 - protein, 11 aa, Influenza virus
RLNNVIDKMNK

SEQ ID NO: 431361 - protein, 11 aa, Influenza virus
ILWFSFGASCV

SEQ ID NO: 431362 - protein, 11 aa, Influenza virus
MGMRISSSFSF

SEQ ID NO: 431363 - protein, 11 aa, Influenza virus
SIVMVGLILAF

SEQ ID NO: 431364 - protein, 11 aa, Influenza virus
YPRYPNVRCVC

SEQ ID NO: 431365 - protein, 11 aa, Influenza virus
LTKGLCTINSW

SEQ ID NO: 431366 - protein, 11 aa, Influenza virus
KYVEWTSNSLI

SEQ ID NO: 431367 - protein, 11 aa, Influenza virus
WSYNADLLVAM

SEQ ID NO: 431368 - protein, 11 aa, Influenza virus
FRALISWEMGL

SEQ ID NO: 431369 - protein, 11 aa, Influenza virus
VLSIVPSGPLK

SEQ ID NO: 431370 - protein, 11 aa, Influenza virus
GTMDYYWGILK

SEQ ID NO: 431371 - protein, 11 aa, Influenza virus
MKWMMAMKYPI

SEQ ID NO: 431372 - protein, 11 aa, Influenza virus
AEEMGNGCFKI

SEQ ID NO: 431373 - protein, 11 aa, Influenza virus
FMDVWTYNAEL

SEQ ID NO: 431374 - protein, 11 aa, Influenza virus
RPQVNGQRGRI

SEQ ID NO: 431375 - protein, 11 aa, Influenza virus
KMSLLTEVETY

SEQ ID NO: 431376 - protein, 11 aa, Influenza virus
KIMESGGIDKV

SEQ ID NO: 431377 - protein, 11 aa, Influenza virus
DLADSEMNNLY

SEQ ID NO: 431378 - protein, 11 aa, Influenza virus
SATACHDGRKW

SEQ ID NO: 431379 - protein, 11 aa, Influenza virus
KLASGLRNVPA

SEQ ID NO: 431380 - protein, 11 aa, Influenza virus
GRMDYYWAVLK

SEQ ID NO: 431381 - protein, 11 aa, Influenza virus
KMARLGKGYMF

SEQ ID NO: 431382 - protein, 11 aa, Influenza virus
IPHRTLLMNEL

SEQ ID NO: 431383 - protein, 11 aa, Influenza virus
MELPSFGVSGI

SEQ ID NO: 431384 - protein, 11 aa, Influenza virus
AIYSTAASSLV

SEQ ID NO: 431385 - protein, 11 aa, Influenza virus
GAIAGFIEGGW

SEQ ID NO: 431386 - protein, 11 aa, Influenza virus
SLQNRIQIDQV

SEQ ID NO: 431387 - protein, 11 aa, Influenza virus
LLNRLNINSVK

SEQ ID NO: 431388 - protein, 11 aa, Influenza virus
LLKERGFFGAI

SEQ ID NO: 431389 - protein, 11 aa, Influenza virus
VLSIIPSGPLK

SEQ ID NO: 431390 - protein, 11 aa, Influenza virus
SLSISIGSSTY

SEQ ID NO: 431391 - protein, 11 aa, Influenza virus
RVWWTSNSIVV

SEQ ID NO: 431392 - protein, 11 aa, Influenza virus
FQLFLVCVSLL

SEQ ID NO: 431393 - protein, 11 aa, Influenza virus
QLNPIDGPLPV

SEQ ID NO: 431394 - protein, 11 aa, Influenza virus
VLWTSNSMVAL

SEQ ID NO: 431395 - protein, 11 aa, Influenza virus
SEDGVYKALSI

SEQ ID NO: 431396 - protein, 11 aa, Influenza virus
AEEDCTGCFEI

SEQ ID NO: 431397 - protein, 11 aa, Influenza virus
VLIGQGDVVLV

SEQ ID NO: 431398 - protein, 11 aa, Influenza virus
QTYTGAINSSK

SEQ ID NO: 431399 - protein, 11 aa, Influenza virus
ALRDNLEPGTF

SEQ ID NO: 431400 - protein, 11 aa, Influenza virus
RLATGLRNVPK

SEQ ID NO: 431401 - protein, 11 aa, Influenza virus
LVWMACNSAAF

SEQ ID NO: 431402 - protein, 11 aa, Influenza virus
YQFALGQGATL

SEQ ID NO: 431403 - protein, 11 aa, Influenza virus
NVWTYNAELLV

SEQ ID NO: 431404 - protein, 11 aa, Influenza virus
SSSSCHDGKAW

SEQ ID NO: 431405 - protein, 11 aa, Influenza virus
VMKRKRNSSIL

SEQ ID NO: 431406 - protein, 11 aa, Influenza virus
RESRNPGNAEI

SEQ ID NO: 431407 - protein, 11 aa, Influenza virus
YVLSIIPSGPL

SEQ ID NO: 431408 - protein, 11 aa, Influenza virus
YVLSVIPSGPL

SEQ ID NO: 431409 - protein, 11 aa, Influenza virus
IIYSSSMMWEI

SEQ ID NO: 431410 - protein, 11 aa, Influenza virus
RTISMDSRSGY

SEQ ID NO: 431411 - protein, 11 aa, Influenza virus
MRWLTLKLGQF

SEQ ID NO: 431412 - protein, 11 aa, Influenza virus
RVWWTTNSIVV

SEQ ID NO: 431413 - protein, 11 aa, Influenza virus
ALNTTLPFHNI

SEQ ID NO: 431414 - protein, 11 aa, Influenza virus
KMKAIIVVLLY

SEQ ID NO: 431415 - protein, 11 aa, Influenza virus
WSYNAELLIAM

SEQ ID NO: 431416 - protein, 11 aa, Influenza virus
TIWTSGSSISF

SEQ ID NO: 431417 - protein, 11 aa, Influenza virus
LTQGTCWEQLY

SEQ ID NO: 431418 - protein, 11 aa, Influenza virus
IEELWAYNAEL

SEQ ID NO: 431419 - protein, 11 aa, Influenza virus
WSWQDGAILPF

SEQ ID NO: 431420 - protein, 11 aa, Influenza virus
KQNTLKLATGM

SEQ ID NO: 431421 - protein, 11 aa, Influenza virus
GLYGAIEECLI

SEQ ID NO: 431422 - protein, 11 aa, Influenza virus
DTINFESTGNL

SEQ ID NO: 431423 - protein, 11 aa, Influenza virus
SIKTKLPFQNL

SEQ ID NO: 431424 - protein, 11 aa, Influenza virus
SPYRALISWEM

SEQ ID NO: 431425 - protein, 11 aa, Influenza virus
SLSISVESSTY

SEQ ID NO: 431426 - protein, 11 aa, Influenza virus
KMNTRILILTL

SEQ ID NO: 431427 - protein, 11 aa, Influenza virus
TVWTSGSSISF

SEQ ID NO: 431428 - protein, 11 aa, Influenza virus
RPLVREQQGRM

SEQ ID NO: 431429 - protein, 11 aa, Influenza virus
FEPNGCIEGKL

SEQ ID NO: 431430 - protein, 11 aa, Influenza virus
NEQGSGYAADL

SEQ ID NO: 431431 - protein, 11 aa, Influenza virus
AEDQGNGCFEI

SEQ ID NO: 431432 - protein, 11 aa, Influenza virus
GMQIRGFVYFV

SEQ ID NO: 431433 - protein, 11 aa, Influenza virus
FLWGIHHPPDT

SEQ ID NO: 431434 - protein, 11 aa, Influenza virus
RTISTASRAGY

SEQ ID NO: 431435 - protein, 11 aa, Influenza virus
MMIWHSNLNDA

SEQ ID NO: 431436 - protein, 11 aa, Influenza virus
VLSVIPSGPLK

SEQ ID NO: 431437 - protein, 11 aa, Influenza virus
SVNTNTINRSF

SEQ ID NO: 431438 - protein, 11 aa, Influenza virus
LLNRLSINPVK

SEQ ID NO: 431439 - protein, 11 aa, Influenza virus
WSYNAELLVAM

SEQ ID NO: 431440 - protein, 11 aa, Influenza virus
KQSSLPLALGM

SEQ ID NO: 431441 - protein, 11 aa, Influenza virus
RGLSSRISFYW

SEQ ID NO: 431442 - protein, 11 aa, Influenza virus
REKNVTVTHSV

SEQ ID NO: 431443 - protein, 11 aa, Influenza virus
FPFHKDNAVRL

SEQ ID NO: 431444 - protein, 11 aa, Influenza virus
EEMLTGNLQTL

SEQ ID NO: 431445 - protein, 11 aa, Influenza virus
NLIAPEFGYLL

SEQ ID NO: 431446 - protein, 11 aa, Influenza virus
NTNGEQILIIW

SEQ ID NO: 431447 - protein, 11 aa, Influenza virus
SLMLATGMRNV

SEQ ID NO: 431448 - protein, 11 aa, Influenza virus
SSTSCFDGKEW

SEQ ID NO: 431449 - protein, 11 aa, Influenza virus
NPNWSGYSGSF

SEQ ID NO: 431450 - protein, 11 aa, Influenza virus
MVIASTTAKAM

SEQ ID NO: 431451 - protein, 11 aa, Influenza virus
LSIYSTVSSSL

SEQ ID NO: 431452 - protein, 11 aa, Influenza virus
FEPNGYIEGKL

SEQ ID NO: 431453 - protein, 11 aa, Influenza virus
ALDTGDGCFEI

SEQ ID NO: 431454 - protein, 11 aa, Influenza virus
SVGSSTYHNSF

SEQ ID NO: 431455 - protein, 11 aa, Influenza virus
ILVTTVTLHFK

SEQ ID NO: 431456 - protein, 11 aa, Influenza virus
MGQQGRMDYYW

SEQ ID NO: 431457 - protein, 11 aa, Influenza virus
YLLFQDILMRM

SEQ ID NO: 431458 - protein, 11 aa, Influenza virus
APHRLCYPGEL

SEQ ID NO: 431459 - protein, 11 aa, Influenza virus
GTSGTYGSGSW

SEQ ID NO: 431460 - protein, 11 aa, Influenza virus
LSIYSTVTSSL

SEQ ID NO: 431461 - protein, 11 aa, Influenza virus
KLFALSGVAVA

SEQ ID NO: 431462 - protein, 11 aa, Influenza virus
LLMNELGVPFY

SEQ ID NO: 431463 - protein, 11 aa, Influenza virus
WSWDDGAILPF

SEQ ID NO: 431464 - protein, 11 aa, Influenza virus
ESTGNFIAPEY

SEQ ID NO: 431465 - protein, 11 aa, Influenza virus
KTRPILSPLTK

SEQ ID NO: 431466 - protein, 11 aa, Influenza virus
RPWVRMNNETI

SEQ ID NO: 431467 - protein, 11 aa, Influenza virus
RVWWTSNSIIV

SEQ ID NO: 431468 - protein, 11 aa, Influenza virus
LSIYSTAASSL

SEQ ID NO: 431469 - protein, 11 aa, Influenza virus
TPYRSLIQFPM

SEQ ID NO: 431470 - protein, 11 aa, Influenza virus
KTNEKFHQIEK

SEQ ID NO: 431471 - protein, 11 aa, Influenza virus
TLLAKSVFNSI

SEQ ID NO: 431472 - protein, 11 aa, Influenza virus
IEEGSVYPRFL

SEQ ID NO: 431473 - protein, 11 aa, Influenza virus
CFQPCFYIELI

SEQ ID NO: 431474 - protein, 11 aa, Influenza virus
AIYSTISSSLV

SEQ ID NO: 431475 - protein, 11 aa, Influenza virus
GVSGEVPGWSW

SEQ ID NO: 431476 - protein, 11 aa, Influenza virus
RTISPKLRSGF

SEQ ID NO: 431477 - protein, 11 aa, Influenza virus
RGQQGTMDYYW

SEQ ID NO: 431478 - protein, 11 aa, Influenza virus
YLMLNKSLCKI

SEQ ID NO: 431479 - protein, 11 aa, Influenza virus
RMQFSSLTVSV

SEQ ID NO: 431480 - protein, 11 aa, Influenza virus
NLIAPEYGYLI

SEQ ID NO: 431481 - protein, 11 aa, Influenza virus
SLMLATGMKNV

SEQ ID NO: 431482 - protein, 11 aa, Influenza virus
TIWTSASSISF

SEQ ID NO: 431483 - protein, 11 aa, Influenza virus
KRIRMAINWGR

SEQ ID NO: 431484 - protein, 11 aa, Influenza virus
GTSGTYGAGSW

SEQ ID NO: 431485 - protein, 11 aa, Influenza virus
VLMETERTLDF

SEQ ID NO: 431486 - protein, 11 aa, Influenza virus
WLTLKSGQFPV

SEQ ID NO: 431487 - protein, 11 aa, Influenza virus
AEDKGNGCFEI

SEQ ID NO: 431488 - protein, 11 aa, Influenza virus
VLMENEMTLDF

SEQ ID NO: 431489 - protein, 11 aa, Influenza virus
WSWHDGAVLPF

SEQ ID NO: 431490 - protein, 11 aa, Influenza virus
TIWTSGSSIAF

SEQ ID NO: 431491 - protein, 11 aa, Influenza virus
WSWHDGAILPF

SEQ ID NO: 431492 - protein, 11 aa, Influenza virus
SIYQNSFVPVV

SEQ ID NO: 431493 - protein, 11 aa, Influenza virus
NEWSGYSGSFV

SEQ ID NO: 431494 - protein, 11 aa, Influenza virus
SIAGWLLGNPM

SEQ ID NO: 431495 - protein, 11 aa, Influenza virus
ESTGNLIAPEY

SEQ ID NO: 431496 - protein, 11 aa, Influenza virus
MINPVKLSSGY

SEQ ID NO: 431497 - protein, 11 aa, Influenza virus
WLLSSKANQVF

SEQ ID NO: 431498 - protein, 11 aa, Influenza virus
LTKGLCIINSW

SEQ ID NO: 431499 - protein, 11 aa, Influenza virus
APFSKDNSIQL

SEQ ID NO: 431500 - protein, 11 aa, Influenza virus
KLFASSGIAIA

SEQ ID NO: 431501 - protein, 11 aa, Influenza virus
SVSGWLLGNPM

SEQ ID NO: 431502 - protein, 11 aa, Influenza virus
IENLWAYNAEL

SEQ ID NO: 431503 - protein, 11 aa, Influenza virus
KLFALSGVAIA

SEQ ID NO: 431504 - protein, 11 aa, Influenza virus
LLNRLNINPVK

SEQ ID NO: 431505 - protein, 11 aa, Influenza virus
SEDNVYRALSI

SEQ ID NO: 431506 - protein, 11 aa, Influenza virus
SSSSCYDGKAW

SEQ ID NO: 431507 - protein, 11 aa, Influenza virus
RTISRDSRSGY

SEQ ID NO: 431508 - protein, 11 aa, Influenza virus
RTISIASRSGY

SEQ ID NO: 431509 - protein, 11 aa, Influenza virus
FQHQNAEGTGM

SEQ ID NO: 431510 - protein, 11 aa, Influenza virus
SQYRSLISWPL

SEQ ID NO: 431511 - protein, 11 aa, Influenza virus
KMKAILVVLLY

SEQ ID NO: 431512 - protein, 11 aa, Influenza virus
LAIYSTVSSSL

SEQ ID NO: 431513 - protein, 11 aa, Influenza virus
FEPNGSIEGKL

SEQ ID NO: 431514 - protein, 11 aa, Influenza virus
WSWQDGAILPF

SEQ ID NO: 431515 - protein, 11 aa, Influenza virus
RRLTTTIRTWA

SEQ ID NO: 431516 - protein, 11 aa, Influenza virus
WEQLYTPGGEV

SEQ ID NO: 431517 - protein, 11 aa, Influenza virus
IESMIEAESSI

SEQ ID NO: 431518 - protein, 11 aa, Influenza virus
RPQINGQSGRI

SEQ ID NO: 431519 - protein, 11 aa, Influenza virus
SIYASPQLEGF

SEQ ID NO: 431520 - protein, 11 aa, Influenza virus
LLAKSVFNNLY

SEQ ID NO: 431521 - protein, 11 aa, Influenza virus
SPFRALVSWEM

SEQ ID NO: 431522 - protein, 11 aa, Influenza virus
FHHSNAEGTGM

SEQ ID NO: 431523 - protein, 11 aa, Influenza virus
LAIYSTISSSL

SEQ ID NO: 431524 - protein, 11 aa, Influenza virus
KSDVLVTREPY

SEQ ID NO: 431525 - protein, 11 aa, Influenza virus
GMQIRGFVHFV

SEQ ID NO: 431526 - protein, 11 aa, Influenza virus
RRTNLYGFIIK

SEQ ID NO: 431527 - protein, 11 aa, Influenza virus
VYQAKFESVAW

SEQ ID NO: 431528 - protein, 11 aa, Influenza virus
RTNEKFHQIEK

SEQ ID NO: 431529 - protein, 11 aa, Influenza virus
ESNGNFIAPEY

SEQ ID NO: 431530 - protein, 11 aa, Influenza virus
GRMDYYWAILK

SEQ ID NO: 431531 - protein, 11 aa, Influenza virus
SLGDCSFTGWI

SEQ ID NO: 431532 - protein, 11 aa, Influenza virus
ETVEITGINKV

SEQ ID NO: 431533 - protein, 11 aa, Influenza virus
YVLSIVPSGPL

SEQ ID NO: 431534 - protein, 11 aa, Influenza virus
KLATGLRNIPA

SEQ ID NO: 431535 - protein, 11 aa, Influenza virus
CLVPCFWLEMI

SEQ ID NO: 431536 - protein, 11 aa, Influenza virus
RRKTNLYGFLI

SEQ ID NO: 431537 - protein, 11 aa, Influenza virus
AEEDGKGCFEI

SEQ ID NO: 431538 - protein, 11 aa, Influenza virus
KQMTRGLFGAI

SEQ ID NO: 431539 - protein, 11 aa, Influenza virus
SATACHDGKEW

SEQ ID NO: 431540 - protein, 11 aa, Influenza virus
LIALCGSPFSV

SEQ ID NO: 431541 - protein, 11 aa, Influenza virus
SIADKICIGYL

SEQ ID NO: 431542 - protein, 11 aa, Influenza virus
NTSGEQMLVIW

SEQ ID NO: 431543 - protein, 11 aa, Influenza virus
RQKSLIWLWLV

SEQ ID NO: 431544 - protein, 11 aa, Influenza virus
GRFYIQMCTEL

SEQ ID NO: 431545 - protein, 11 aa, Influenza virus
MVLASTTAKAM

SEQ ID NO: 431546 - protein, 11 aa, Influenza virus
VLLENGRTLGL

SEQ ID NO: 431547 - protein, 11 aa, Influenza virus
SLLTEVETYVL

SEQ ID NO: 431548 - protein, 11 aa, Influenza virus
SPFRTLMSCPV

SEQ ID NO: 431549 - protein, 11 aa, Influenza virus
GQSPNVYQSRF

SEQ ID NO: 431550 - protein, 11 aa, Influenza virus
LLSRLNINPVK

SEQ ID NO: 431551 - protein, 11 aa, Influenza virus
ITYSSSMMWEV

SEQ ID NO: 431552 - protein, 11 aa, Influenza virus
DTISFESTGNL

SEQ ID NO: 431553 - protein, 11 aa, Influenza virus
GMQNGSYRCMF

SEQ ID NO: 431554 - protein, 11 aa, Influenza virus
TVSSFYSEMKW

SEQ ID NO: 431555 - protein, 11 aa, Influenza virus
WSWPDGALLPF

SEQ ID NO: 431556 - protein, 11 aa, Influenza virus
CFQPCFYVELI

SEQ ID NO: 431557 - protein, 11 aa, Influenza virus
SSSFSFGGFTF

SEQ ID NO: 431558 - protein, 11 aa, Influenza virus
LAIYSTAASSL

SEQ ID NO: 431559 - protein, 11 aa, Influenza virus
SQYRALISWPL

SEQ ID NO: 431560 - protein, 11 aa, Influenza virus
KPFQNTSRHYI

SEQ ID NO: 431561 - protein, 11 aa, Influenza virus
NEIEYQIGNVI

SEQ ID NO: 431562 - protein, 11 aa, Influenza virus
IAYERMCNILK

SEQ ID NO: 431563 - protein, 11 aa, Influenza virus
TLLMSELGVPF

SEQ ID NO: 431564 - protein, 11 aa, Influenza virus
RPQVNGQSGRI

SEQ ID NO: 431565 - protein, 11 aa, Influenza virus
KMTITFLILLF

SEQ ID NO: 431566 - protein, 11 aa, Influenza virus
RTISPRSRNGF

SEQ ID NO: 431567 - protein, 11 aa, Influenza virus
SQYRALVSWPL

SEQ ID NO: 431568 - protein, 11 aa, Influenza virus
ESNGNLIAPEY

SEQ ID NO: 431569 - protein, 11 aa, Influenza virus
SEDNVYKALSI

SEQ ID NO: 431570 - protein, 11 aa, Influenza virus
EELWAYNAELL

SEQ ID NO: 431571 - protein, 11 aa, Influenza virus
MPLHNIHPLTI

SEQ ID NO: 431572 - protein, 11 aa, Influenza virus
LTDWSGYSGSF

SEQ ID NO: 431573 - protein, 11 aa, Influenza virus
KLCKLNGIPPL

SEQ ID NO: 431574 - protein, 11 aa, Influenza virus
GYKDVIIWFSF

SEQ ID NO: 431575 - protein, 11 aa, Influenza virus
TMLNLYERVRK

SEQ ID NO: 431576 - protein, 11 aa, Influenza virus
RMQFSSLTVNV

SEQ ID NO: 431577 - protein, 11 aa, Influenza virus
KLFERVRHQLR

SEQ ID NO: 431578 - protein, 11 aa, Influenza virus
FHLGTRQVCVA

SEQ ID NO: 431579 - protein, 11 aa, Influenza virus
LVALALSHTAY

SEQ ID NO: 431580 - protein, 11 aa, Influenza virus
KLYTRVKRQLR

SEQ ID NO: 431581 - protein, 11 aa, Influenza virus
TMHQLLRHFQK

SEQ ID NO: 431582 - protein, 11 aa, Influenza virus
QAYTKIMYFHK

SEQ ID NO: 431583 - protein, 11 aa, Influenza virus
LLAKSVFNCLY

SEQ ID NO: 431584 - protein, 11 aa, Influenza virus
EILNNKNWSGY

SEQ ID NO: 431585 - protein, 11 aa, Influenza virus
RGQQGWMDYYW

SEQ ID NO: 431586 - protein, 11 aa, Influenza virus
GMVDGWYGFRY

SEQ ID NO: 431587 - protein, 11 aa, Influenza virus
AINTTLPFHNV

SEQ ID NO: 431588 - protein, 11 aa, Influenza virus
SIYSCIASSVV

SEQ ID NO: 431589 - protein, 11 aa, Influenza virus
SATACHDGKKW

SEQ ID NO: 431590 - protein, 11 aa, Influenza virus
AMEDFQLIPMI

SEQ ID NO: 431591 - protein, 11 aa, Influenza virus
RTSIWTSSSSM

SEQ ID NO: 431592 - protein, 11 aa, Influenza virus
WSWDDGAILPF

SEQ ID NO: 431593 - protein, 11 aa, Influenza virus
KLATGLKNVPA

SEQ ID NO: 431594 - protein, 11 aa, Influenza virus
SLSLAIMIAGI

SEQ ID NO: 431595 - protein, 11 aa, Influenza virus
VYQAKFEAVAW

SEQ ID NO: 431596 - protein, 11 aa, Influenza virus
KLATGLRNVPA

SEQ ID NO: 431597 - protein, 11 aa, Influenza virus
QAYTKVMYFHK

SEQ ID NO: 431598 - protein, 11 aa, Influenza virus
GYKDVILWFSF

SEQ ID NO: 431599 - protein, 11 aa, Influenza virus
GEVSVIREPFI

SEQ ID NO: 431600 - protein, 11 aa, Influenza virus
RRQKRGLFGAI

SEQ ID NO: 431601 - protein, 11 aa, Influenza virus
VILLNPFVSHK

SEQ ID NO: 431602 - protein, 11 aa, Influenza virus
KLLGINMSKKK

SEQ ID NO: 431603 - protein, 11 aa, Influenza virus
HLSSVSSFERF

SEQ ID NO: 431604 - protein, 11 aa, Influenza virus
AIYSCIASSIV

SEQ ID NO: 431605 - protein, 11 aa, Influenza virus
ALRELWQCYYL

SEQ ID NO: 431606 - protein, 11 aa, Influenza virus
AIYSTVSSSLV

SEQ ID NO: 431607 - protein, 11 aa, Influenza virus
CEPDECRFYAL

SEQ ID NO: 431608 - protein, 11 aa, Influenza virus
RGQSGRVSFYW

SEQ ID NO: 431609 - protein, 11 aa, Influenza virus
APFAKDNSIRL

SEQ ID NO: 431610 - protein, 11 aa, Influenza virus
RRYELEIGTRI

SEQ ID NO: 431611 - protein, 11 aa, Influenza virus
GIRVGSRGHVF

SEQ ID NO: 431612 - protein, 11 aa, Influenza virus
FQLFLVCVSLL

SEQ ID NO: 431613 - protein, 11 aa, Influenza virus
CFQSCFYVELI

SEQ ID NO: 431614 - protein, 11 aa, Influenza virus
SPFRALISWEM

SEQ ID NO: 431615 - protein, 11 aa, Influenza virus
NEIKGVELSSM

SEQ ID NO: 431616 - protein, 11 aa, Influenza virus
VLDDCSLEGLI

SEQ ID NO: 431617 - protein, 11 aa, Influenza virus
ISCSVSECRTF

SEQ ID NO: 431618 - protein, 11 aa, Influenza virus
KLYERVRRQLR

SEQ ID NO: 431619 - protein, 11 aa, Influenza virus
KTNGNLIAPEY

SEQ ID NO: 431620 - protein, 11 aa, Influenza virus
RPWVRINNETI

SEQ ID NO: 431621 - protein, 11 aa, Influenza virus
AEDRGNGCFEI

SEQ ID NO: 431622 - protein, 11 aa, Influenza virus
TLLAKSVFNSL

SEQ ID NO: 431623 - protein, 11 aa, Influenza virus
VYYNRRLTTTI

SEQ ID NO: 431624 - protein, 11 aa, Influenza virus
LSIYSTVVSSL

SEQ ID NO: 431625 - protein, 11 aa, Influenza virus
ISFSISCFLLI

SEQ ID NO: 431626 - protein, 11 aa, Influenza virus
LTKRLCTINSW

SEQ ID NO: 431627 - protein, 11 aa, Influenza virus
LLISDGGPNLY

SEQ ID NO: 431628 - protein, 11 aa, Influenza virus
LTIYSTAASSL

SEQ ID NO: 431629 - protein, 11 aa, Influenza virus
YGKGRIFQSPI

SEQ ID NO: 431630 - protein, 11 aa, Influenza virus
ESTGNLVAPEY

SEQ ID NO: 431631 - protein, 11 aa, Influenza virus
MTIASDILKRM

SEQ ID NO: 431632 - protein, 11 aa, Influenza virus
FQNVNRITYGV

SEQ ID NO: 431633 - protein, 11 aa, Influenza virus
GRFYVQMCTEL

SEQ ID NO: 431634 - protein, 11 aa, Influenza virus
MPFHNIHPLTI

SEQ ID NO: 431635 - protein, 11 aa, Influenza virus
KMNNQILILAL

SEQ ID NO: 431636 - protein, 11 aa, Influenza virus
GYKEVILWFSF

SEQ ID NO: 431637 - protein, 11 aa, Influenza virus
FHHSNSEGTGM

SEQ ID NO: 431638 - protein, 11 aa, Influenza virus
NTSGEQMLIIW

SEQ ID NO: 431639 - protein, 11 aa, Influenza virus
GEETIEERFEI

SEQ ID NO: 431640 - protein, 11 aa, Influenza virus
NQNSTWVSQTY

SEQ ID NO: 431641 - protein, 11 aa, Influenza virus
KMFDFIKWNVT

SEQ ID NO: 431642 - protein, 11 aa, Influenza virus
VAYERMCNILK

SEQ ID NO: 431643 - protein, 11 aa, Influenza virus
SIYSCIASSIV

SEQ ID NO: 431644 - protein, 11 aa, Influenza virus
SSSFSFGGFTF

SEQ ID NO: 431645 - protein, 11 aa, Influenza virus
WSYNAEFLVAM

SEQ ID NO: 431646 - protein, 11 aa, Influenza virus
TEVETYVLSVI

SEQ ID NO: 431647 - protein, 11 aa, Influenza virus
GQWNWPDGAEI

SEQ ID NO: 431648 - protein, 11 aa, Influenza virus
GAQSFYRSINW

SEQ ID NO: 431649 - protein, 11 aa, Influenza virus
RLFDYSGWNVT

SEQ ID NO: 431650 - protein, 11 aa, Influenza virus
AELLVLMENEM

SEQ ID NO: 431651 - protein, 11 aa, Influenza virus
RLGKGYMFESK

SEQ ID NO: 431652 - protein, 11 aa, Influenza virus
RSYNNTSGEQM

SEQ ID NO: 431653 - protein, 11 aa, Influenza virus
SLTKGVLGFVF

SEQ ID NO: 431654 - protein, 11 aa, Influenza virus
MLADWVDDAVT

SEQ ID NO: 431655 - protein, 11 aa, Influenza virus
LSIYSTVASSL

SEQ ID NO: 431656 - protein, 11 aa, Influenza virus
RRQKWWVWLWL

SEQ ID NO: 431657 - protein, 11 aa, Influenza virus
REGKHIVERIL

SEQ ID NO: 431658 - protein, 11 aa, Influenza virus
LSSRISFYWTI

SEQ ID NO: 431659 - protein, 11 aa, Influenza virus
VANFSMELPSF

SEQ ID NO: 431660 - protein, 11 aa, Influenza virus
LIMRTVIALSY

SEQ ID NO: 431661 - protein, 11 aa, Influenza virus
NHVEVVSAKEL

SEQ ID NO: 431662 - protein, 11 aa, Influenza virus
RLTTTIRTWAK

SEQ ID NO: 431663 - protein, 11 aa, Influenza virus
FQQMRDVLGTF

SEQ ID NO: 431664 - protein, 11 aa, Influenza virus
TEVETYVLSII

SEQ ID NO: 431665 - protein, 11 aa, Influenza virus
SVAPIMFSNKM

SEQ ID NO: 431666 - protein, 11 aa, Influenza virus
FRNVLSVAPIM

SEQ ID NO: 431667 - protein, 11 aa, Influenza virus
SVASSLVLLFM

SEQ ID NO: 431668 - protein, 11 aa, Influenza virus
AILVTTVTLHF

SEQ ID NO: 431669 - protein, 11 aa, Influenza virus
YVKQSSLPLAL

SEQ ID NO: 431670 - protein, 11 aa, Influenza virus
SMAPIMFSNKM

SEQ ID NO: 431671 - protein, 11 aa, Influenza virus
VYYNGRLTTTI

SEQ ID NO: 431672 - protein, 11 aa, Influenza virus
APHGLCYPGEL

SEQ ID NO: 431673 - protein, 11 aa, Influenza virus
RTISKDSRSGY

SEQ ID NO: 431674 - protein, 11 aa, Influenza virus
RPWIRINNETI

SEQ ID NO: 431675 - protein, 11 aa, Influenza virus
RGQSGRISFYW

SEQ ID NO: 431676 - protein, 11 aa, Influenza virus
KQSTLKLATGM

SEQ ID NO: 431677 - protein, 11 aa, Influenza virus
LGSSFYAEMKW

SEQ ID NO: 431678 - protein, 11 aa, Influenza virus
LLQSLQQIESI

SEQ ID NO: 431679 - protein, 11 aa, Influenza virus
KLNRLIEKTNK

SEQ ID NO: 431680 - protein, 11 aa, Influenza virus
LSIYSSVASSL

SEQ ID NO: 431681 - protein, 11 aa, Influenza virus
RRQKSLIWLWL

SEQ ID NO: 431682 - protein, 11 aa, Influenza virus
KINPVTLTMGY

SEQ ID NO: 431683 - protein, 11 aa, Influenza virus
DVINFESTGNL

SEQ ID NO: 431684 - protein, 11 aa, Influenza virus
KMNTKILVLAL

SEQ ID NO: 431685 - protein, 11 aa, Influenza virus
LWFSFGASCFF

SEQ ID NO: 431686 - protein, 11 aa, Influenza virus
WSYNAEFLVAL

SEQ ID NO: 431687 - protein, 11 aa, Influenza virus
NELYGTQSLSI

SEQ ID NO: 431688 - protein, 11 aa, Influenza virus
LPFHNVHPLTI

SEQ ID NO: 431689 - protein, 11 aa, Influenza virus
LLNDKHSNGTV

SEQ ID NO: 431690 - protein, 11 aa, Influenza virus
LTIYSTVASSF

SEQ ID NO: 431691 - protein, 11 aa, Influenza virus
DTITFEATGNL

SEQ ID NO: 431692 - protein, 11 aa, Influenza virus
SIRIGSRGDVF

SEQ ID NO: 431693 - protein, 11 aa, Influenza virus
VLMENERTLDF

SEQ ID NO: 431694 - protein, 11 aa, Influenza virus
FFYRYGFVANF

SEQ ID NO: 431695 - protein, 11 aa, Influenza virus
SATACHDGKGW

SEQ ID NO: 431696 - protein, 11 aa, Influenza virus
SPRLRSGFEML

SEQ ID NO: 431697 - protein, 11 aa, Influenza virus
WTYQAELLIAM

SEQ ID NO: 431698 - protein, 11 aa, Influenza virus
SACKRTVSSFY

SEQ ID NO: 431699 - protein, 11 aa, Influenza virus
GRMDYYWGILK

SEQ ID NO: 431700 - protein, 11 aa, Influenza virus
FHLGTRQVCIA

SEQ ID NO: 431701 - protein, 11 aa, Influenza virus
RTISTASRYGY

SEQ ID NO: 431702 - protein, 11 aa, Influenza virus
FHLGTKQVCAA

SEQ ID NO: 431703 - protein, 11 aa, Influenza virus
RLGRGYMFESK

SEQ ID NO: 431704 - protein, 11 aa, Influenza virus
WSWPDGAEVPF

SEQ ID NO: 431705 - protein, 11 aa, Influenza virus
YVWWASNSLIA

SEQ ID NO: 431706 - protein, 11 aa, Influenza virus
AIAMGLIFMCV

SEQ ID NO: 431707 - protein, 11 aa, Influenza virus
GTFEFTSFFYR

SEQ ID NO: 431708 - protein, 11 aa, Influenza virus
MTEVWSYNAEF

SEQ ID NO: 431709 - protein, 11 aa, Influenza virus
WLLGNPECDLL

SEQ ID NO: 431710 - protein, 11 aa, Influenza virus
NRPWVSFNHNL

SEQ ID NO: 431711 - protein, 11 aa, Influenza virus
NLYDKVRLQLK

SEQ ID NO: 431712 - protein, 11 aa, Influenza virus
YVWWTSNSLVA

SEQ ID NO: 431713 - protein, 11 aa, Influenza virus
GAYERMCNILK

SEQ ID NO: 431714 - protein, 11 aa, Influenza virus
LYLSGREWSYI

SEQ ID NO: 431715 - protein, 11 aa, Influenza virus
FGASCFILLAV

SEQ ID NO: 431716 - protein, 11 aa, Influenza virus
SLSLAIMVAGI

SEQ ID NO: 431717 - protein, 11 aa, Influenza virus
KQTSLLLATGM

SEQ ID NO: 431718 - protein, 11 aa, Influenza virus
VLMENERTLDL

SEQ ID NO: 431719 - protein, 11 aa, Influenza virus
KMNIQILILAL

SEQ ID NO: 431720 - protein, 11 aa, Influenza virus
GMQNGSCRCMF

SEQ ID NO: 431721 - protein, 11 aa, Influenza virus
SLGDCSFAGWI

SEQ ID NO: 431722 - protein, 11 aa, Influenza virus
NMLSTVLGVSI

SEQ ID NO: 431723 - protein, 11 aa, Influenza virus
LIVSLGAISFW

SEQ ID NO: 431724 - protein, 11 aa, Influenza virus
VMGQASYKIFK

SEQ ID NO: 431725 - protein, 11 aa, Influenza virus
KTNDKYHQIEK

SEQ ID NO: 431726 - protein, 11 aa, Influenza virus
KLFERVRRQLR

SEQ ID NO: 431727 - protein, 11 aa, Influenza virus
YQILAIYSTAA

SEQ ID NO: 431728 - protein, 11 aa, Influenza virus
VSFQGRGVFEF

SEQ ID NO: 431729 - protein, 11 aa, Influenza virus
RMQFSSLAVNV

SEQ ID NO: 431730 - protein, 11 aa, Influenza virus
APFSKDNSIRL

SEQ ID NO: 431731 - protein, 11 aa, Influenza virus
IVMVGLILAFI

SEQ ID NO: 431732 - protein, 11 aa, Influenza virus
AEDMGNGCFKI

SEQ ID NO: 431733 - protein, 11 aa, Influenza virus
SLGDCSFAGWL

SEQ ID NO: 431734 - protein, 11 aa, Influenza virus
SVGSSTYQNSF

SEQ ID NO: 431735 - protein, 11 aa, Influenza virus
RSYNNTSGEQM

SEQ ID NO: 431736 - protein, 11 aa, Influenza virus
SLRMKWMMAMK

SEQ ID NO: 431737 - protein, 11 aa, Influenza virus
LLNDRHSNGTV

SEQ ID NO: 431738 - protein, 11 aa, Influenza virus
WSWPDGAELPF

SEQ ID NO: 431739 - protein, 11 aa, Influenza virus
FSFGASCFIFL

SEQ ID NO: 431740 - protein, 11 aa, Influenza virus
SPKLRSGFEML

SEQ ID NO: 431741 - protein, 11 aa, Influenza virus
GEETVEERFEI

SEQ ID NO: 431742 - protein, 11 aa, Influenza virus
LTQGACWEQLY

SEQ ID NO: 431743 - protein, 11 aa, Influenza virus
LQIISLCSIWF

SEQ ID NO: 431744 - protein, 11 aa, Influenza virus
SLSLAIMMAGI

SEQ ID NO: 431745 - protein, 11 aa, Influenza virus
MVAYMLERELV

SEQ ID NO: 431746 - protein, 11 aa, Influenza virus
RTISKDTRSGY

SEQ ID NO: 431747 - protein, 11 aa, Influenza virus
SPKLRSGFEML

SEQ ID NO: 431748 - protein, 11 aa, Influenza virus
NLIAPEYGFRI

SEQ ID NO: 431749 - protein, 11 aa, Influenza virus
AVATTHSWIPK

SEQ ID NO: 431750 - protein, 11 aa, Influenza virus
VPEYQSLRSIL

SEQ ID NO: 431751 - protein, 11 aa, Influenza virus
ESNGNLIAPWY

SEQ ID NO: 431752 - protein, 11 aa, Influenza virus
ASYKRVRLFDY

SEQ ID NO: 431753 - protein, 11 aa, Influenza virus
NLYDKVRMQLK

SEQ ID NO: 431754 - protein, 11 aa, Influenza virus
LPFHNIHPLTI

SEQ ID NO: 431755 - protein, 11 aa, Influenza virus
ELWAYNAELLV

SEQ ID NO: 431756 - protein, 11 aa, Influenza virus
VPGYQSLRSIL

SEQ ID NO: 431757 - protein, 11 aa, Influenza virus
KMEFEPFQSLV

SEQ ID NO: 431758 - protein, 11 aa, Influenza virus
FSMSCFVFVAL

SEQ ID NO: 431759 - protein, 11 aa, Influenza virus
LYLNGREWSYI

SEQ ID NO: 431760 - protein, 11 aa, Influenza virus
KQKTLKLATGM

SEQ ID NO: 431761 - protein, 11 aa, Influenza virus
GYKDIILWFSF

SEQ ID NO: 431762 - protein, 11 aa, Influenza virus
ALSVLNLLIGI

SEQ ID NO: 431763 - protein, 11 aa, Influenza virus
CLVPCFWVEMI

SEQ ID NO: 431764 - protein, 11 aa, Influenza virus
NLNWSGYSGSF

SEQ ID NO: 431765 - protein, 11 aa, Influenza virus
FQQMRDILGTF

SEQ ID NO: 431766 - protein, 11 aa, Influenza virus
KTNEKYHQIEK

SEQ ID NO: 431767 - protein, 11 aa, Influenza virus
ITFMQALQLLF

SEQ ID NO: 431768 - protein, 11 aa, Influenza virus
RPKVNGQAGRI

SEQ ID NO: 431769 - protein, 11 aa, Influenza virus
SINPVKLSSGY

SEQ ID NO: 431770 - protein, 11 aa, Influenza virus
MIKAVRGDLNF

SEQ ID NO: 431771 - protein, 11 aa, Influenza virus
QAYTKVLYFHK

SEQ ID NO: 431772 - protein, 11 aa, Influenza virus
YPRYPDVRCVC

SEQ ID NO: 431773 - protein, 11 aa, Influenza virus
MVWDANGWVTA

SEQ ID NO: 431774 - protein, 11 aa, Influenza virus
SFYRSINWLTK

SEQ ID NO: 431775 - protein, 11 aa, Influenza virus
TTFPYTGDPPY

SEQ ID NO: 431776 - protein, 11 aa, Influenza virus
TMKDRSPYRTL

SEQ ID NO: 431777 - protein, 11 aa, Influenza virus
ESNGVFLAPRY

SEQ ID NO: 431778 - protein, 11 aa, Influenza virus
LLASTNAHDRI

SEQ ID NO: 431779 - protein, 11 aa, Influenza virus
ESNGGFLAPRY

SEQ ID NO: 431780 - protein, 11 aa, Influenza virus
FSFGASCVMLL

SEQ ID NO: 431781 - protein, 11 aa, Influenza virus
SSMPFHNVHPL

SEQ ID NO: 431782 - protein, 11 aa, Influenza virus
KPRPRRGLFGA

SEQ ID NO: 431783 - protein, 11 aa, Influenza virus
LLDPGDTVTFT

SEQ ID NO: 431784 - protein, 11 aa, Influenza virus
MILGNGCFEFW

SEQ ID NO: 431785 - protein, 11 aa, Influenza virus
SLSPGMMMGMF

SEQ ID NO: 431786 - protein, 11 aa, Influenza virus
SIAGWLLGNPK

SEQ ID NO: 431787 - protein, 11 aa, Influenza virus
KLCRLSGIPPL

SEQ ID NO: 431788 - protein, 11 aa, Influenza virus
MKWMMAMRYPI

SEQ ID NO: 431789 - protein, 11 aa, Influenza virus
ELWSYNAELLV

SEQ ID NO: 431790 - protein, 11 aa, Influenza virus
MPFHNVHPLTI

SEQ ID NO: 431791 - protein, 11 aa, Influenza virus
YILDEESRARI

SEQ ID NO: 431792 - protein, 11 aa, Influenza virus
FRNVLSIAPIM

SEQ ID NO: 431793 - protein, 11 aa, Influenza virus
VANFSMELPSF

SEQ ID NO: 431794 - protein, 11 aa, Influenza virus
IAVFCGTSGTY

SEQ ID NO: 431795 - protein, 11 aa, Influenza virus
IMWACQKGNIK

SEQ ID NO: 431796 - protein, 11 aa, Influenza virus
ESSGGLLAPRY

SEQ ID NO: 431797 - protein, 11 aa, Influenza virus
TLLAKSVFNNL

SEQ ID NO: 431798 - protein, 11 aa, Influenza virus
RRSGAAGAAVK

SEQ ID NO: 431799 - protein, 11 aa, Influenza virus
IHDRIPHRTLL

SEQ ID NO: 431800 - protein, 11 aa, Influenza virus
YENNTWVNQTF

SEQ ID NO: 431801 - protein, 11 aa, Influenza virus
WLLGNPECDRL

SEQ ID NO: 431802 - protein, 11 aa, Influenza virus
KIMESGGISKM

SEQ ID NO: 431803 - protein, 11 aa, Influenza virus
GSRERLGSWSW

SEQ ID NO: 431804 - protein, 11 aa, Influenza virus
DVISFESTGNL

SEQ ID NO: 431805 - protein, 11 aa, Influenza virus
ESNGGLIAPRY

SEQ ID NO: 431806 - protein, 11 aa, Influenza virus
RTISKDLRSGY

SEQ ID NO: 431807 - protein, 11 aa, Influenza virus
NEIEHQIGNVI

SEQ ID NO: 431808 - protein, 11 aa, Influenza virus
YVWWTSNSLIA

SEQ ID NO: 431809 - protein, 11 aa, Influenza virus
LAIYSTVASSL

SEQ ID NO: 431810 - protein, 11 aa, Influenza virus
FIMWACQKGNI

SEQ ID NO: 431811 - protein, 11 aa, Influenza virus
WSWPDGADLPF

SEQ ID NO: 431812 - protein, 11 aa, Influenza virus
KSLESRSGFEM

SEQ ID NO: 431813 - protein, 11 aa, Influenza virus
YRICKLVGINM

SEQ ID NO: 431814 - protein, 11 aa, Influenza virus
IVAFCGTSGTY

SEQ ID NO: 431815 - protein, 11 aa, Influenza virus
MINPVKLSGGY

SEQ ID NO: 431816 - protein, 11 aa, Influenza virus
AVATTHSWTPK

SEQ ID NO: 431817 - protein, 11 aa, Influenza virus
YPGKFTNEEAL

SEQ ID NO: 431818 - protein, 11 aa, Influenza virus
RTNEKYHQIEK

SEQ ID NO: 431819 - protein, 11 aa, Influenza virus
KLFTLSGVAIA

SEQ ID NO: 431820 - protein, 11 aa, Influenza virus
DLADSEMSKLY

SEQ ID NO: 431821 - protein, 11 aa, Influenza virus
YLIRTLTLNTM

SEQ ID NO: 431822 - protein, 11 aa, Influenza virus
RRATVSADPLL

SEQ ID NO: 431823 - protein, 11 aa, Influenza virus
KLDINMADYSI

SEQ ID NO: 431824 - protein, 11 aa, Influenza virus
RREIHIYYLEK

SEQ ID NO: 431825 - protein, 11 aa, Influenza virus
RRSGAAGAAIK

SEQ ID NO: 431826 - protein, 11 aa, Influenza virus
FRNILSMAPIM

SEQ ID NO: 431827 - protein, 11 aa, Influenza virus
GIRIGSRGHVF

SEQ ID NO: 431828 - protein, 11 aa, Influenza virus
FQPNIGPRPLV

SEQ ID NO: 431829 - protein, 11 aa, Influenza virus
CPKYVKQGSLM

SEQ ID NO: 431830 - protein, 11 aa, Influenza virus
ALKDNLEPGTF

SEQ ID NO: 431831 - protein, 11 aa, Influenza virus
FHLGTKQVCVA

SEQ ID NO: 431832 - protein, 11 aa, Influenza virus
VAKAGFIENGW

SEQ ID NO: 431833 - protein, 11 aa, Influenza virus
KLSNMGIYQIL

SEQ ID NO: 431834 - protein, 11 aa, Influenza virus
NLIAPEYGFKI

SEQ ID NO: 431835 - protein, 11 aa, Influenza virus
NLIAPRGYFKV

SEQ ID NO: 431836 - protein, 11 aa, Influenza virus
VLMENEITLDF

SEQ ID NO: 431837 - protein, 11 aa, Influenza virus
ASYKRIRLFDY

SEQ ID NO: 431838 - protein, 11 aa, Influenza virus
LTIYSTVASSL

SEQ ID NO: 431839 - protein, 11 aa, Influenza virus
YQILSIYSTAA

SEQ ID NO: 431840 - protein, 11 aa, Influenza virus
FSMSCFVFVAL

SEQ ID NO: 431841 - protein, 11 aa, Influenza virus
AINSSMPFHNV

SEQ ID NO: 431842 - protein, 11 aa, Influenza virus
RTLYFHDSNVK

SEQ ID NO: 431843 - protein, 11 aa, Influenza virus
GSSPNAYQARF

SEQ ID NO: 431844 - protein, 11 aa, Influenza virus
SISCFLLIALL

SEQ ID NO: 431845 - protein, 11 aa, Influenza virus
NTGSYVRLYLW

SEQ ID NO: 431846 - protein, 11 aa, Influenza virus
GQSPNVYQARF

SEQ ID NO: 431847 - protein, 11 aa, Influenza virus
RRCLLQSLQQI

SEQ ID NO: 431848 - protein, 11 aa, Influenza virus
YRSMRWLTLKL

SEQ ID NO: 431849 - protein, 11 aa, Influenza virus
FPRTTNTYRNT

SEQ ID NO: 431850 - protein, 11 aa, Influenza virus
WTYQAELLIAM

SEQ ID NO: 431851 - protein, 11 aa, Influenza virus
TENGVPVTSSI

SEQ ID NO: 431852 - protein, 11 aa, Influenza virus
LIAPEFGYLLK

SEQ ID NO: 431853 - protein, 11 aa, Influenza virus
TENSFEQITFL

SEQ ID NO: 431854 - protein, 11 aa, Influenza virus
FQPNIGPRALV

SEQ ID NO: 431855 - protein, 11 aa, Influenza virus
RTISTASRYGY

SEQ ID NO: 431856 - protein, 11 aa, Influenza virus
FIMWACQRGNI

SEQ ID NO: 431857 - protein, 11 aa, Influenza virus
SLCEVNSWHIL

SEQ ID NO: 431858 - protein, 11 aa, Influenza virus
WSWPDGALFPL

SEQ ID NO: 431859 - protein, 11 aa, Influenza virus
KLSSMGIYQIL

SEQ ID NO: 431860 - protein, 11 aa, Influenza virus
STVLVGLILAF

SEQ ID NO: 431861 - protein, 11 aa, Influenza virus
KLYERVRKQLR

SEQ ID NO: 431862 - protein, 11 aa, Influenza virus
LMNELGVSFHL

SEQ ID NO: 431863 - protein, 11 aa, Influenza virus
RPLVNGQRGRI

SEQ ID NO: 431864 - protein, 11 aa, Influenza virus
AVATTHSWVPK

SEQ ID NO: 431865 - protein, 11 aa, Influenza virus
NLDLNMGQPFY

SEQ ID NO: 431866 - protein, 11 aa, Influenza virus
NLIAPEYGHLI

SEQ ID NO: 431867 - protein, 11 aa, Influenza virus
ESNGGLLAPRY

SEQ ID NO: 431868 - protein, 11 aa, Influenza virus
LTIYSTVASSF

SEQ ID NO: 431869 - protein, 11 aa, Influenza virus
KLLKERGFFGA

SEQ ID NO: 431870 - protein, 11 aa, Influenza virus
YVKQSSLPLAL

SEQ ID NO: 431871 - protein, 11 aa, Influenza virus
REWSYLIEDPT

SEQ ID NO: 431872 - protein, 11 aa, Influenza virus
FGASCFVLLAV

SEQ ID NO: 431873 - protein, 11 aa, Influenza virus
APFSKDNSVRL

SEQ ID NO: 431874 - protein, 11 aa, Influenza virus
RTREGRRKTNL

SEQ ID NO: 431875 - protein, 11 aa, Influenza virus
ALSILNLLIGI

SEQ ID NO: 431876 - protein, 11 aa, Influenza virus
RRLTTTIKTWA

SEQ ID NO: 431877 - protein, 11 aa, Influenza virus
ITYSSSLMWEI

SEQ ID NO: 431878 - protein, 11 aa, Influenza virus
MLSTVLGVSVL

SEQ ID NO: 431879 - protein, 11 aa, Influenza virus
WFRNALSIAPI

SEQ ID NO: 431880 - protein, 11 aa, Influenza virus
WTYQAELLVAM

SEQ ID NO: 431881 - protein, 11 aa, Influenza virus
SFPNGAQIQYF

SEQ ID NO: 431882 - protein, 11 aa, Influenza virus
CVKNGNHAVHY

SEQ ID NO: 431883 - protein, 11 aa, Influenza virus
SIRIGSKGDVF

SEQ ID NO: 431884 - protein, 11 aa, Influenza virus
LPFQNIDSRAV

SEQ ID NO: 431885 - protein, 11 aa, Influenza virus
WFSFGASCFLF

SEQ ID NO: 431886 - protein, 11 aa, Influenza virus
WTYQAELLVAM

SEQ ID NO: 431887 - protein, 11 aa, Influenza virus
TIWTSGSIISF

SEQ ID NO: 431888 - protein, 11 aa, Influenza virus
LLVAIENQHTI

SEQ ID NO: 431889 - protein, 11 aa, Influenza virus
WFRNILSIAPI

SEQ ID NO: 431890 - protein, 11 aa, Influenza virus
KVQEWSYIVEK

SEQ ID NO: 431891 - protein, 11 aa, Influenza virus
FIMWTCQKGNI

SEQ ID NO: 431892 - protein, 11 aa, Influenza virus
SEIEQQIGNVI

SEQ ID NO: 431893 - protein, 11 aa, Influenza virus
KMFDFTKWNVT

SEQ ID NO: 431894 - protein, 11 aa, Influenza virus
WMKIIRVGCVI

SEQ ID NO: 431895 - protein, 11 aa, Influenza virus
NTTGRDVLVLW

SEQ ID NO: 431896 - protein, 11 aa, Influenza virus
RSWMKLYWHLM

SEQ ID NO: 431897 - protein, 11 aa, Influenza virus
ISCSISECRTF

SEQ ID NO: 431898 - protein, 11 aa, Influenza virus
RSKFLLMDSLK

SEQ ID NO: 431899 - protein, 11 aa, Influenza virus
VYYDRRLTTTI

SEQ ID NO: 431900 - protein, 11 aa, Influenza virus
RLTTTIKTWAK

SEQ ID NO: 431901 - protein, 11 aa, Influenza virus
RREVHIYYLEK

SEQ ID NO: 431902 - protein, 11 aa, Influenza virus
RLGPSFYAEMK

SEQ ID NO: 431903 - protein, 11 aa, Influenza virus
YPGRFTNEEAL

SEQ ID NO: 431904 - protein, 11 aa, Influenza virus
KMNTRILILTL

SEQ ID NO: 431905 - protein, 11 aa, Influenza virus
FRYGNGVWIGR

SEQ ID NO: 431906 - protein, 11 aa, Influenza virus
LLLQANLCRFL

SEQ ID NO: 431907 - protein, 11 aa, Influenza virus
LSKSLCKVEGW

SEQ ID NO: 431908 - protein, 11 aa, Influenza virus
IEDLWAYNAEL

SEQ ID NO: 431909 - protein, 11 aa, Influenza virus
KQMTRGLFGAI

SEQ ID NO: 431910 - protein, 11 aa, Influenza virus
IHDRTPHRTLL

SEQ ID NO: 431911 - protein, 11 aa, Influenza virus
NPSHEGEGIPL

SEQ ID NO: 431912 - protein, 11 aa, Influenza virus
ITLKFAFNMMF

SEQ ID NO: 431913 - protein, 11 aa, Influenza virus
WEQMYTPGGGV

SEQ ID NO: 431914 - protein, 11 aa, Influenza virus
SQFRALISWEM

SEQ ID NO: 431915 - protein, 11 aa, Influenza virus
LIRGNSPVFNY

SEQ ID NO: 431916 - protein, 11 aa, Influenza virus
NRMVIASTTAK

SEQ ID NO: 431917 - protein, 11 aa, Influenza virus
RSWMKIYWHLM

SEQ ID NO: 431918 - protein, 11 aa, Influenza virus
RLFERVRRQLR

SEQ ID NO: 431919 - protein, 11 aa, Influenza virus
SISCFLLVALL

SEQ ID NO: 431920 - protein, 11 aa, Influenza virus
WLLSSKDNQVF

SEQ ID NO: 431921 - protein, 11 aa, Influenza virus
TAYERMCNILK

SEQ ID NO: 431922 - protein, 11 aa, Influenza virus
RLFTIRQEMAI

SEQ ID NO: 431923 - protein, 11 aa, Influenza virus
SEDNVYKVLSI

SEQ ID NO: 431924 - protein, 11 aa, Influenza virus
TVMVGLILAFI

SEQ ID NO: 431925 - protein, 11 aa, Influenza virus
MLLAIAMGLIF

SEQ ID NO: 431926 - protein, 11 aa, Influenza virus
WEQMYTPGGKV

SEQ ID NO: 431927 - protein, 11 aa, Influenza virus
GQWDWPDGAKI

SEQ ID NO: 431928 - protein, 11 aa, Influenza virus
RLGSSFYAEMK

SEQ ID NO: 431929 - protein, 11 aa, Influenza virus
ESNGNLVAPWY

SEQ ID NO: 431930 - protein, 11 aa, Influenza virus
KLYERVKRQLR

SEQ ID NO: 431931 - protein, 11 aa, Influenza virus
CFVFVALILGF

SEQ ID NO: 431932 - protein, 11 aa, Influenza virus
SRSGYETFRVL

SEQ ID NO: 431933 - protein, 11 aa, Influenza virus
SSMPFHNIHPL

SEQ ID NO: 431934 - protein, 11 aa, Influenza virus
ILWVSFSISCF

SEQ ID NO: 431935 - protein, 11 aa, Influenza virus
IEIITIGSICM

SEQ ID NO: 431936 - protein, 11 aa, Influenza virus
NSGDYARLYIW

SEQ ID NO: 431937 - protein, 11 aa, Influenza virus
FGASCFLLLAV

SEQ ID NO: 431938 - protein, 11 aa, Influenza virus
NRMVLASTTAK

SEQ ID NO: 431939 - protein, 11 aa, Influenza virus
LYIRTNGTSKI

SEQ ID NO: 431940 - protein, 11 aa, Influenza virus
LEPGTFDLGGL

SEQ ID NO: 431941 - protein, 11 aa, Influenza virus
SVASSLVLLLM

SEQ ID NO: 431942 - protein, 11 aa, Influenza virus
LPFQNLSPRTV

SEQ ID NO: 431943 - protein, 11 aa, Influenza virus
SFFSRLNWLTK

SEQ ID NO: 431944 - protein, 11 aa, Influenza virus
FEQVEGRIQNL

SEQ ID NO: 431945 - protein, 11 aa, Influenza virus
HPSSTKEKNEL

SEQ ID NO: 431946 - protein, 11 aa, Influenza virus
VLGDCSIAGWL

SEQ ID NO: 431947 - protein, 11 aa, Influenza virus
KLSNMGVYQIL

SEQ ID NO: 431948 - protein, 11 aa, Influenza virus
IHYGGVPTDVM

SEQ ID NO: 431949 - protein, 11 aa, Influenza virus
STVMVGLILAF

SEQ ID NO: 431950 - protein, 11 aa, Influenza virus
TPHRTLLMNEL

SEQ ID NO: 431951 - protein, 11 aa, Influenza virus
GVWWTSNSIVV

SEQ ID NO: 431952 - protein, 11 aa, Influenza virus
FSFGASCFLLL

SEQ ID NO: 431953 - protein, 11 aa, Influenza virus
IVVFCGTSATY

SEQ ID NO: 431954 - protein, 11 aa, Influenza virus
GEETIEEKFEI

SEQ ID NO: 431955 - protein, 11 aa, Influenza virus
LEPGTFDIGGL

SEQ ID NO: 431956 - protein, 11 aa, Influenza virus
RTKSLESRSGF

SEQ ID NO: 431957 - protein, 11 aa, Influenza virus
SVKNGTYNYPK

SEQ ID NO: 431958 - protein, 11 aa, Influenza virus
KMFDFSKWNVT

SEQ ID NO: 431959 - protein, 11 aa, Influenza virus
QKWWVWLWLVL

SEQ ID NO: 431960 - protein, 11 aa, Influenza virus
ILIAGGLILGM

SEQ ID NO: 431961 - protein, 11 aa, Influenza virus
SMVFCGVSGEV

SEQ ID NO: 431962 - protein, 11 aa, Influenza virus
KLTQGRQTFDW

SEQ ID NO: 431963 - protein, 11 aa, Influenza virus
TVDHMAIIKRY

SEQ ID NO: 431964 - protein, 11 aa, Influenza virus
MLSTVLGVSIL

SEQ ID NO: 431965 - protein, 11 aa, Influenza virus
LLVSDGGPNLY

SEQ ID NO: 431966 - protein, 11 aa, Influenza virus
GGMPTDVVRSW

SEQ ID NO: 431967 - protein, 11 aa, Influenza virus
IQDLWAYNAEL

SEQ ID NO: 431968 - protein, 11 aa, Influenza virus
LMIWHSNLNDA

SEQ ID NO: 431969 - protein, 11 aa, Influenza virus
GTSGTYGKGSW

SEQ ID NO: 431970 - protein, 11 aa, Influenza virus
LTQGTCWEQMY

SEQ ID NO: 431971 - protein, 11 aa, Influenza virus
SISCFLLAALL

SEQ ID NO: 431972 - protein, 11 aa, Influenza virus
GEVFVIREPFI

SEQ ID NO: 431973 - protein, 11 aa, Influenza virus
TLLMNELGVPF

SEQ ID NO: 431974 - protein, 11 aa, Influenza virus
WSYNAELLVAL

SEQ ID NO: 431975 - protein, 11 aa, Influenza virus
SPYNSRFESVA

SEQ ID NO: 431976 - protein, 11 aa, Influenza virus
WISFSMSCFVF

SEQ ID NO: 431977 - protein, 11 aa, Influenza virus
FHLGTKQVCIA

SEQ ID NO: 431978 - protein, 11 aa, Influenza virus
VTNKVNSIINK

SEQ ID NO: 431979 - protein, 11 aa, Influenza virus
LVRGNSPVFNY

SEQ ID NO: 431980 - protein, 11 aa, Influenza virus
AIWTSSSSIVM

SEQ ID NO: 431981 - protein, 11 aa, Influenza virus
TLLAKSVFNSL

SEQ ID NO: 431982 - protein, 11 aa, Influenza virus
IHYGGVPTDVV

SEQ ID NO: 431983 - protein, 11 aa, Influenza virus
WSYNAGLLVAL

SEQ ID NO: 431984 - protein, 11 aa, Influenza virus
IHYGGIPTDVV

SEQ ID NO: 431985 - protein, 11 aa, Influenza virus
TKMEAILVVLL

SEQ ID NO: 431986 - protein, 11 aa, Influenza virus
KLSSMGVYQIL

SEQ ID NO: 431987 - protein, 11 aa, Influenza virus
RRLTTTVKTWA

SEQ ID NO: 431988 - protein, 11 aa, Influenza virus
MIKRGVNDRNF

SEQ ID NO: 431989 - protein, 11 aa, Influenza virus
RRAIATPGMQI

SEQ ID NO: 431990 - protein, 11 aa, Influenza virus
AEQFTWNGVKV

SEQ ID NO: 431991 - protein, 11 aa, Influenza virus
VILVLGLSMVK

SEQ ID NO: 431992 - protein, 11 aa, Influenza virus
RTLDFHDSSVK

SEQ ID NO: 431993 - protein, 11 aa, Influenza virus
FSFGASCFLFL

SEQ ID NO: 431994 - protein, 11 aa, Influenza virus
YLIRALTLNTM

SEQ ID NO: 431995 - protein, 11 aa, Influenza virus
VVMTDGSASRK

SEQ ID NO: 431996 - protein, 11 aa, Influenza virus
FRNILSIAPIM

SEQ ID NO: 431997 - protein, 11 aa, Influenza virus
YPFDVPDYQSL

SEQ ID NO: 431998 - protein, 11 aa, Influenza virus
KLYEKVRRQLR

SEQ ID NO: 431999 - protein, 11 aa, Influenza virus
FEQVEGRIQYL

SEQ ID NO: 432000 - protein, 11 aa, Influenza virus
LISTPLGSPPV

SEQ ID NO: 432001 - protein, 11 aa, Influenza virus
LSLAIMMAGIF

SEQ ID NO: 432002 - protein, 11 aa, Influenza virus
YVDGFEPNGYI

SEQ ID NO: 432003 - protein, 11 aa, Influenza virus
RREVHTYYLEK

SEQ ID NO: 432004 - protein, 11 aa, Influenza virus
KLFERVKRQLR

SEQ ID NO: 432005 - protein, 11 aa, Influenza virus
IESNVTVTSSV

SEQ ID NO: 432006 - protein, 11 aa, Influenza virus
TSMPFHNIHPL

SEQ ID NO: 432007 - protein, 11 aa, Influenza virus
FSFGASCFVLL

SEQ ID NO: 432008 - protein, 11 aa, Influenza virus
YQQSFSPSPGA

SEQ ID NO: 432009 - protein, 11 aa, Influenza virus
ITYSSPMMWEI

SEQ ID NO: 432010 - protein, 11 aa, Influenza virus
RRRTNLYGFII

SEQ ID NO: 432011 - protein, 11 aa, Influenza virus
AEDMGNGCLKI

SEQ ID NO: 432012 - protein, 11 aa, Influenza virus
WTYQEELLVAM

SEQ ID NO: 432013 - protein, 11 aa, Influenza virus
ETVEITGIDKV

SEQ ID NO: 432014 - protein, 11 aa, Influenza virus
RPHPEDLNGMI

SEQ ID NO: 432015 - protein, 11 aa, Influenza virus
GSWPDGANISF

SEQ ID NO: 432016 - protein, 11 aa, Influenza virus
RTISPHSRSGF

SEQ ID NO: 432017 - protein, 11 aa, Influenza virus
VPDYQSLRSIL

SEQ ID NO: 432018 - protein, 11 aa, Influenza virus
CIASSLILAAI

SEQ ID NO: 432019 - protein, 11 aa, Influenza virus
MVKAVRGDLNF

SEQ ID NO: 432020 - protein, 11 aa, Influenza virus
YIIRALTLNTM

SEQ ID NO: 432021 - protein, 11 aa, Influenza virus
WEGMVNGWYGF

SEQ ID NO: 432022 - protein, 11 aa, Influenza virus
STYQNNFVPVM

SEQ ID NO: 432023 - protein, 11 aa, Influenza virus
VTNKVNSIIGK

SEQ ID NO: 432024 - protein, 11 aa, Influenza virus
SLKGLILGNPK

SEQ ID NO: 432025 - protein, 11 aa, Influenza virus
LIRGNSPIFNY

SEQ ID NO: 432026 - protein, 11 aa, Influenza virus
NLIGKTSWSYI

SEQ ID NO: 432027 - protein, 11 aa, Influenza virus
IYQILAIYSTV

SEQ ID NO: 432028 - protein, 11 aa, Influenza virus
MMKAVRGDLNF

SEQ ID NO: 432029 - protein, 11 aa, Influenza virus
GIRIGSKGHVF

SEQ ID NO: 432030 - protein, 11 aa, Influenza virus
QLSSVSSFERF

SEQ ID NO: 432031 - protein, 11 aa, Influenza virus
DTINYYNETFV

SEQ ID NO: 432032 - protein, 11 aa, Influenza virus
SLRGRGSTLGL

SEQ ID NO: 432033 - protein, 11 aa, Influenza virus
TSACKRTVSSF

SEQ ID NO: 432034 - protein, 11 aa, Influenza virus
SVPMGSSPNAY

SEQ ID NO: 432035 - protein, 11 aa, Influenza virus
TLLMNELGIPF

SEQ ID NO: 432036 - protein, 11 aa, Influenza virus
GSSPNAYQAKF

SEQ ID NO: 432037 - protein, 11 aa, Influenza virus
KMNTQILILAL

SEQ ID NO: 432038 - protein, 11 aa, Influenza virus
VELSSMGVYQI

SEQ ID NO: 432039 - protein, 11 aa, Influenza virus
SVVLVGLILAF

SEQ ID NO: 432040 - protein, 11 aa, Influenza virus
AIGAIDSSMPF

SEQ ID NO: 432041 - protein, 11 aa, Influenza virus
WSYNAEILVAL

SEQ ID NO: 432042 - protein, 11 aa, Influenza virus
AVLRGFLILGK

SEQ ID NO: 432043 - protein, 11 aa, Influenza virus
CTISLVKTTLF

SEQ ID NO: 432044 - protein, 11 aa, Influenza virus
LVGPILSFIMW

SEQ ID NO: 432045 - protein, 11 aa, Influenza virus
SQLTEVETYVL

SEQ ID NO: 432046 - protein, 11 aa, Influenza virus
YRSINWLTKKK

SEQ ID NO: 432047 - protein, 11 aa, Influenza virus
WSWPDGALLPL

SEQ ID NO: 432048 - protein, 11 aa, Influenza virus
GSKERLGSWSW

SEQ ID NO: 432049 - protein, 11 aa, Influenza virus
SIYSCIASSLI

SEQ ID NO: 432050 - protein, 11 aa, Influenza virus
KESMGFRYSGI

SEQ ID NO: 432051 - protein, 11 aa, Influenza virus
TPYRSLIRFPI

SEQ ID NO: 432052 - protein, 11 aa, Influenza virus
GQAGRMTFYWI

SEQ ID NO: 432053 - protein, 11 aa, Influenza virus
SVAGWLLGNPL

SEQ ID NO: 432054 - protein, 11 aa, Influenza virus
FYSGGTINSPL

SEQ ID NO: 432055 - protein, 11 aa, Influenza virus
RREVHVYYLEK

SEQ ID NO: 432056 - protein, 11 aa, Influenza virus
MCSSTEFLGQW

SEQ ID NO: 432057 - protein, 11 aa, Influenza virus
IHYGGVPTDVI

SEQ ID NO: 432058 - protein, 11 aa, Influenza virus
LLVADGGPNLY

SEQ ID NO: 432059 - protein, 11 aa, Influenza virus
ELCTINSWHIY

SEQ ID NO: 432060 - protein, 11 aa, Influenza virus
DLADSEMNKLY

SEQ ID NO: 432061 - protein, 11 aa, Influenza virus
ITDWSGYSGSF

SEQ ID NO: 432062 - protein, 11 aa, Influenza virus
ESNGAFLAPRY

SEQ ID NO: 432063 - protein, 11 aa, Influenza virus
ISCSIDECRTF

SEQ ID NO: 432064 - protein, 11 aa, Influenza virus
VYYNKRLTTTI

SEQ ID NO: 432065 - protein, 11 aa, Influenza virus
SPFRTLMSCPI

SEQ ID NO: 432066 - protein, 11 aa, Influenza virus
VMKRKRDSSIL

SEQ ID NO: 432067 - protein, 11 aa, Influenza virus
DSDVLVTREPY

SEQ ID NO: 432068 - protein, 11 aa, Influenza virus
WSWPDGAKLPF

SEQ ID NO: 432069 - protein, 11 aa, Influenza virus
LMMAYMLEREL

SEQ ID NO: 432070 - protein, 11 aa, Influenza virus
IRFNSNLDYQI

SEQ ID NO: 432071 - protein, 11 aa, Influenza virus
WSWHDGAILPL

SEQ ID NO: 432072 - protein, 11 aa, Influenza virus
LSIAPIMFSNK

SEQ ID NO: 432073 - protein, 11 aa, Influenza virus
LEPGTFDLEGL

SEQ ID NO: 432074 - protein, 11 aa, Influenza virus
VLMENERILDF

SEQ ID NO: 432075 - protein, 11 aa, Influenza virus
RMYALHQGTTI

SEQ ID NO: 432076 - protein, 11 aa, Influenza virus
TAFRGLMSTPL

SEQ ID NO: 432077 - protein, 11 aa, Influenza virus
SQLVWMACHSA

SEQ ID NO: 432078 - protein, 11 aa, Influenza virus
IYQILAIYATV

SEQ ID NO: 432079 - protein, 11 aa, Influenza virus
ILWFSFGASCF

SEQ ID NO: 432080 - protein, 11 aa, Influenza virus
NKIEFEPFQSL

SEQ ID NO: 432081 - protein, 11 aa, Influenza virus
TREPYVSCDPL

SEQ ID NO: 432082 - protein, 11 aa, Influenza virus
FEKEGYSLVGI

SEQ ID NO: 432083 - protein, 11 aa, Influenza virus
WILGNPMCDYL

SEQ ID NO: 432084 - protein, 11 aa, Influenza virus
RSKFLLMDALK

SEQ ID NO: 432085 - protein, 11 aa, Influenza virus
EIRTFSFQLIL

SEQ ID NO: 432086 - protein, 11 aa, Influenza virus
LVRGNSPAFNY

SEQ ID NO: 432087 - protein, 11 aa, Influenza virus
LEPGTFDIEGL

SEQ ID NO: 432088 - protein, 11 aa, Influenza virus
RRKTNLYGFII

SEQ ID NO: 432089 - protein, 11 aa, Influenza virus
SSSLDEQNKLY

SEQ ID NO: 432090 - protein, 11 aa, Influenza virus
ILNLLIGISNV

SEQ ID NO: 432091 - protein, 11 aa, Influenza virus
RRLTTTIKPWA

SEQ ID NO: 432092 - protein, 11 aa, Influenza virus
KLEFEPFQSLV

SEQ ID NO: 432093 - protein, 11 aa, Influenza virus
VLVGLILAFIL

SEQ ID NO: 432094 - protein, 11 aa, Influenza virus
CTISLVKTTLF

SEQ ID NO: 432095 - protein, 11 aa, Influenza virus
IESNVTVTNSV

SEQ ID NO: 432096 - protein, 11 aa, Influenza virus
LLVALENQHTI

SEQ ID NO: 432097 - protein, 11 aa, Influenza virus
ESNGGLLAPKY

SEQ ID NO: 432098 - protein, 11 aa, Influenza virus
TLRGRHANGTM

SEQ ID NO: 432099 - protein, 11 aa, Influenza virus
AALGLRISSSF

SEQ ID NO: 432100 - protein, 11 aa, Influenza virus
DTFKSWKGNIM

SEQ ID NO: 432101 - protein, 11 aa, Influenza virus
MARAVKLYKKL

SEQ ID NO: 432102 - protein, 11 aa, Influenza virus
LVLDDCSLEGI

SEQ ID NO: 432103 - protein, 11 aa, Influenza virus
IQDVWAYNAEL

SEQ ID NO: 432104 - protein, 11 aa, Influenza virus
ESSGGLLAPRY

SEQ ID NO: 432105 - protein, 11 aa, Influenza virus
ETKCQTPLGAL

SEQ ID NO: 432106 - protein, 11 aa, Influenza virus
RREVHMYYLEK

SEQ ID NO: 432107 - protein, 11 aa, Influenza virus
ESNGALLAPRY

SEQ ID NO: 432108 - protein, 11 aa, Influenza virus
RPLVNGQSGRI

SEQ ID NO: 432109 - protein, 11 aa, Influenza virus
LLVAMENQHTI

SEQ ID NO: 432110 - protein, 11 aa, Influenza virus
KISKRGSSGVM

SEQ ID NO: 432111 - protein, 11 aa, Influenza virus
GQSPNVYQAKF

SEQ ID NO: 432112 - protein, 11 aa, Influenza virus
LSIYSTVAASL

SEQ ID NO: 432113 - protein, 11 aa, Influenza virus
GIRIGSRGEVF

SEQ ID NO: 432114 - protein, 11 aa, Influenza virus
DSDILVTREPY

SEQ ID NO: 432115 - protein, 11 aa, Influenza virus
GLLEVGTRWMK

SEQ ID NO: 432116 - protein, 11 aa, Influenza virus
GEDTIEERFEI

SEQ ID NO: 432117 - protein, 11 aa, Influenza virus
SVRIGSKGDVF

SEQ ID NO: 432118 - protein, 11 aa, Influenza virus
WFRNVLSVAPI

SEQ ID NO: 432119 - protein, 11 aa, Influenza virus
LSIYSCIASSL

SEQ ID NO: 432120 - protein, 11 aa, Influenza virus
KTMTITFLILL

SEQ ID NO: 432121 - protein, 11 aa, Influenza virus
IHYGGMPTDVV

SEQ ID NO: 432122 - protein, 11 aa, Influenza virus
SIVLVGLILAF

SEQ ID NO: 432123 - protein, 11 aa, Influenza virus
KMNPNQKIMTI

SEQ ID NO: 432124 - protein, 11 aa, Influenza virus
FHFEECSCYPS

SEQ ID NO: 432125 - protein, 11 aa, Influenza virus
ISCSINECRTF

SEQ ID NO: 432126 - protein, 11 aa, Influenza virus
SPDPGVKGFAF

SEQ ID NO: 432127 - protein, 11 aa, Influenza virus
MGLKISSSFSF

SEQ ID NO: 432128 - protein, 11 aa, Influenza virus
RTNGNLIAPEF

SEQ ID NO: 432129 - protein, 11 aa, Influenza virus
MIKRGINDRNF

SEQ ID NO: 432130 - protein, 11 aa, Influenza virus
DSDVLVTRESY

SEQ ID NO: 432131 - protein, 11 aa, Influenza virus
SLLNRLSINPV

SEQ ID NO: 432132 - protein, 11 aa, Influenza virus
KLATGPRNVPA

SEQ ID NO: 432133 - protein, 11 aa, Influenza virus
RMFALSQGTTL

SEQ ID NO: 432134 - protein, 11 aa, Influenza virus
KLVGINMSKRK

SEQ ID NO: 432135 - protein, 11 aa, Influenza virus
SLRSILANNGK

SEQ ID NO: 432136 - protein, 11 aa, Influenza virus
AEDMGNGCFRI

SEQ ID NO: 432137 - protein, 11 aa, Influenza virus
FHLGTRQVCMA

SEQ ID NO: 432138 - protein, 11 aa, Influenza virus
CLYASPQLEGF

SEQ ID NO: 432139 - protein, 11 aa, Influenza virus
LVVFCGTSGTY

SEQ ID NO: 432140 - protein, 11 aa, Influenza virus
LSIYSCVASSL

SEQ ID NO: 432141 - protein, 11 aa, Influenza virus
VPDYQSIRSIL

SEQ ID NO: 432142 - protein, 11 aa, Influenza virus
SIKNGTYDYPK

SEQ ID NO: 432143 - protein, 11 aa, Influenza virus
FGRIDFHWLML

SEQ ID NO: 432144 - protein, 11 aa, Influenza virus
ESNGAFIAPRY

SEQ ID NO: 432145 - protein, 11 aa, Influenza virus
RLFDYSRWNVT

SEQ ID NO: 432146 - protein, 11 aa, Influenza virus
KTSWSYIVEKL

SEQ ID NO: 432147 - protein, 11 aa, Influenza virus
IEGLWAYNAEL

SEQ ID NO: 432148 - protein, 11 aa, Influenza virus
WTYQEELLVAM

SEQ ID NO: 432149 - protein, 11 aa, Influenza virus
EEVLTGNLQAL

SEQ ID NO: 432150 - protein, 11 aa, Influenza virus
KRYERVKMFDF

SEQ ID NO: 432151 - protein, 11 aa, Influenza virus
FFPDGPQIQYF

SEQ ID NO: 432152 - protein, 11 aa, Influenza virus
KPRGLFGAIAG

SEQ ID NO: 432153 - protein, 11 aa, Influenza virus
KRIGSCTSPCL

SEQ ID NO: 432154 - protein, 11 aa, Influenza virus
IVVFCGTSGTY

SEQ ID NO: 432155 - protein, 11 aa, Influenza virus
ITYSSSMMWEI

SEQ ID NO: 432156 - protein, 11 aa, Influenza virus
WTYNVELLVLM

SEQ ID NO: 432157 - protein, 11 aa, Influenza virus
ALRMKWMMAMK

SEQ ID NO: 432158 - protein, 11 aa, Influenza virus
WFRNVLSIAPI

SEQ ID NO: 432159 - protein, 11 aa, Influenza virus
VISGWTTANSK

SEQ ID NO: 432160 - protein, 11 aa, Influenza virus
NRPWIRFNSNL

SEQ ID NO: 432161 - protein, 11 aa, Influenza virus
WEGMMDGWYGF

SEQ ID NO: 432162 - protein, 11 aa, Influenza virus
GVAPSPSNSRF

SEQ ID NO: 432163 - protein, 11 aa, Influenza virus
WSWDDGAILPL

SEQ ID NO: 432164 - protein, 11 aa, Influenza virus
IHDRSPHRTLL

SEQ ID NO: 432165 - protein, 11 aa, Influenza virus
SLDEQNKLYGA

SEQ ID NO: 432166 - protein, 11 aa, Influenza virus
VVMTDGSASGK

SEQ ID NO: 432167 - protein, 11 aa, Influenza virus
LKYNGVITDTL

SEQ ID NO: 432168 - protein, 11 aa, Influenza virus
YVKQSSLPLAL

SEQ ID NO: 432169 - protein, 11 aa, Influenza virus
TMHDRSPFRAL

SEQ ID NO: 432170 - protein, 11 aa, Influenza virus
FRNALSIAPIM

SEQ ID NO: 432171 - protein, 11 aa, Influenza virus
KRIRMATNECR

SEQ ID NO: 432172 - protein, 11 aa, Influenza virus
VLNLLIGISNV

SEQ ID NO: 432173 - protein, 11 aa, Influenza virus
ILANNGRFEFI

SEQ ID NO: 432174 - protein, 11 aa, Influenza virus
QLNPIDGPLPK

SEQ ID NO: 432175 - protein, 11 aa, Influenza virus
CIASSLILAAL

SEQ ID NO: 432176 - protein, 11 aa, Influenza virus
NTSGKQMLIIW

SEQ ID NO: 432177 - protein, 11 aa, Influenza virus
FPSTGNHGSLV

SEQ ID NO: 432178 - protein, 11 aa, Influenza virus
FSFGASCFILL

SEQ ID NO: 432179 - protein, 11 aa, Influenza virus
ATYQRTRALVR

SEQ ID NO: 432180 - protein, 11 aa, Influenza virus
SMAPIMFSNKM

SEQ ID NO: 432181 - protein, 11 aa, Influenza virus
FSFGASSFVLL

SEQ ID NO: 432182 - protein, 11 aa, Influenza virus
RARIKTRLFTI

SEQ ID NO: 432183 - protein, 11 aa, Influenza virus
FQYLLFQDILM

SEQ ID NO: 432184 - protein, 11 aa, Influenza virus
RLFDYSKWNVT

SEQ ID NO: 432185 - protein, 11 aa, Influenza virus
YRSMRWLTLKL

SEQ ID NO: 432186 - protein, 11 aa, Influenza virus
YQNSFVPVVGA

SEQ ID NO: 432187 - protein, 11 aa, Influenza virus
TAFRGLISTPL

SEQ ID NO: 432188 - protein, 11 aa, Influenza virus
CIASSLVLAAI

SEQ ID NO: 432189 - protein, 11 aa, Influenza virus
LTIYSTVASSI

SEQ ID NO: 432190 - protein, 11 aa, Influenza virus
YQILSIYSTVA

SEQ ID NO: 432191 - protein, 11 aa, Influenza virus
NRSGYSGIFSV

SEQ ID NO: 432192 - protein, 11 aa, Influenza virus
GLAPFSKDNGI

SEQ ID NO: 432193 - protein, 11 aa, Influenza virus
IRFNSDLNYQI

SEQ ID NO: 432194 - protein, 11 aa, Influenza virus
ILANNGKFEFI

SEQ ID NO: 432195 - protein, 11 aa, Influenza virus
HLFSGIRSFSR

SEQ ID NO: 432196 - protein, 11 aa, Influenza virus
MREPFISCSHL

SEQ ID NO: 432197 - protein, 11 aa, Influenza virus
LLFMIIGGFIF

SEQ ID NO: 432198 - protein, 11 aa, Influenza virus
YQILSIYSTAA

SEQ ID NO: 432199 - protein, 11 aa, Influenza virus
ISLCSIWFSHY

SEQ ID NO: 432200 - protein, 11 aa, Influenza virus
LVFREQKQEFK

SEQ ID NO: 432201 - protein, 11 aa, Influenza virus
NPAHKSQLIWM

SEQ ID NO: 432202 - protein, 11 aa, Influenza virus
CMRPCFWVELV

SEQ ID NO: 432203 - protein, 11 aa, Influenza virus
GLRNTPSIEPK

SEQ ID NO: 432204 - protein, 11 aa, Influenza virus
FIAPDRASFFK

SEQ ID NO: 432205 - protein, 11 aa, Influenza virus
TIVLNTDWSGY

SEQ ID NO: 432206 - protein, 11 aa, Influenza virus
LMVAYMLEREL

SEQ ID NO: 432207 - protein, 11 aa, Influenza virus
LSLAIMIAGIF

SEQ ID NO: 432208 - protein, 11 aa, Influenza virus
SSKPFQNASRY

SEQ ID NO: 432209 - protein, 11 aa, Influenza virus
SPSNSRFESVA

SEQ ID NO: 432210 - protein, 11 aa, Influenza virus
SETEHQIGNVI

SEQ ID NO: 432211 - protein, 11 aa, Influenza virus
FQHQNEQGMGM

SEQ ID NO: 432212 - protein, 11 aa, Influenza virus
YQILSIYSTVV

SEQ ID NO: 432213 - protein, 11 aa, Influenza virus
WSWPDDAELPF

SEQ ID NO: 432214 - protein, 11 aa, Influenza virus
LRFVFSIAASY

SEQ ID NO: 432215 - protein, 11 aa, Influenza virus
KTVINNITTTI

SEQ ID NO: 432216 - protein, 11 aa, Influenza virus
VHDRIPHRTLL

SEQ ID NO: 432217 - protein, 11 aa, Influenza virus
NEGVMNTSKPL

SEQ ID NO: 432218 - protein, 11 aa, Influenza virus
YQNNFVPVVGA

SEQ ID NO: 432219 - protein, 11 aa, Influenza virus
RILDFHDSNVK

SEQ ID NO: 432220 - protein, 11 aa, Influenza virus
LIGKTSWSYIV

SEQ ID NO: 432221 - protein, 11 aa, Influenza virus
KMYALHQGTTI

SEQ ID NO: 432222 - protein, 11 aa, Influenza virus
WFSFGASCFIF

SEQ ID NO: 432223 - protein, 11 aa, Influenza virus
WSYNAEFLVAV

SEQ ID NO: 432224 - protein, 11 aa, Influenza virus
CTINSWHIFGK

SEQ ID NO: 432225 - protein, 11 aa, Influenza virus
VYYNRRPTTTI

SEQ ID NO: 432226 - protein, 11 aa, Influenza virus
RRKKRGLFGAI

SEQ ID NO: 432227 - protein, 11 aa, Influenza virus
LYLTGTWDTLI

SEQ ID NO: 432228 - protein, 11 aa, Influenza virus
WSYNADVLVAL

SEQ ID NO: 432229 - protein, 11 aa, Influenza virus
MKWMMAMRYPI

SEQ ID NO: 432230 - protein, 11 aa, Influenza virus
GTISPRSRSGF

SEQ ID NO: 432231 - protein, 11 aa, Influenza virus
MKWGMEMRRCL

SEQ ID NO: 432232 - protein, 11 aa, Influenza virus
NPAHKSQLVWM

SEQ ID NO: 432233 - protein, 11 aa, Influenza virus
KLYERVKKQLR

SEQ ID NO: 432234 - protein, 11 aa, Influenza virus
KIMESGGISKI

SEQ ID NO: 432235 - protein, 11 aa, Influenza virus
FEREGYSLVGI

SEQ ID NO: 432236 - protein, 11 aa, Influenza virus
SQRGVLEDEQM

SEQ ID NO: 432237 - protein, 11 aa, Influenza virus
SILTDSQTATK

SEQ ID NO: 432238 - protein, 11 aa, Influenza virus
SVPLGSSSNAY

SEQ ID NO: 432239 - protein, 11 aa, Influenza virus
TTDWSGYSGSF

SEQ ID NO: 432240 - protein, 11 aa, Influenza virus
KEPISLGDCSF

SEQ ID NO: 432241 - protein, 11 aa, Influenza virus
GYKDWFLWISF

SEQ ID NO: 432242 - protein, 11 aa, Influenza virus
SQLIWMACHSA

SEQ ID NO: 432243 - protein, 11 aa, Influenza virus
TLLMNELGVSF

SEQ ID NO: 432244 - protein, 11 aa, Influenza virus
ISCSHSECRTF

SEQ ID NO: 432245 - protein, 11 aa, Influenza virus
ALAQGALLGTK

SEQ ID NO: 432246 - protein, 11 aa, Influenza virus
NLYASKNPYTL

SEQ ID NO: 432247 - protein, 11 aa, Influenza virus
WTYNTELLVLM

SEQ ID NO: 432248 - protein, 11 aa, Influenza virus
MELPSFGVSGV

SEQ ID NO: 432249 - protein, 11 aa, Influenza virus
IYSCIASSVVL

SEQ ID NO: 432250 - protein, 11 aa, Influenza virus
RMCSLMQGSTL

SEQ ID NO: 432251 - protein, 11 aa, Influenza virus
YRDWSKPQCQI

SEQ ID NO: 432252 - protein, 11 aa, Influenza virus
QLSSVSSFKRF

SEQ ID NO: 432253 - protein, 11 aa, Influenza virus
FTSFFYRYGFV

SEQ ID NO: 432254 - protein, 11 aa, Influenza virus
QLSTVSSFERF

SEQ ID NO: 432255 - protein, 11 aa, Influenza virus
GRWPGLVAGWY

SEQ ID NO: 432256 - protein, 11 aa, Influenza virus
RTISPKLRSGF

SEQ ID NO: 432257 - protein, 11 aa, Influenza virus
YSRADKICIGY

SEQ ID NO: 432258 - protein, 11 aa, Influenza virus
STSCHDGMSRM

SEQ ID NO: 432259 - protein, 11 aa, Influenza virus
TLRGRHANGTI

SEQ ID NO: 432260 - protein, 11 aa, Influenza virus
SPFRALISWGM

SEQ ID NO: 432261 - protein, 11 aa, Influenza virus
AFYRSINWLTK

SEQ ID NO: 432262 - protein, 11 aa, Influenza virus
WAYNAELIVLL

SEQ ID NO: 432263 - protein, 11 aa, Influenza virus
NTTGRDVLVIW

SEQ ID NO: 432264 - protein, 11 aa, Influenza virus
KEEVINATETV

SEQ ID NO: 432265 - protein, 11 aa, Influenza virus
LKYNGIITDTL

SEQ ID NO: 432266 - protein, 11 aa, Influenza virus
KRQEINGIKLK

SEQ ID NO: 432267 - protein, 11 aa, Influenza virus
SGSSFYAELKW

SEQ ID NO: 432268 - protein, 11 aa, Influenza virus
ITDWSGYSGSF

SEQ ID NO: 432269 - protein, 11 aa, Influenza virus
ALAQGVLLGTK

SEQ ID NO: 432270 - protein, 11 aa, Influenza virus
WTYNAELFVLM

SEQ ID NO: 432271 - protein, 11 aa, Influenza virus
KPFQNTSKHYI

SEQ ID NO: 432272 - protein, 11 aa, Influenza virus
RPVGISSMGEA

SEQ ID NO: 432273 - protein, 11 aa, Influenza virus
ELVRKTRFLPV

SEQ ID NO: 432274 - protein, 11 aa, Influenza virus
FKMNPNQKIII

SEQ ID NO: 432275 - protein, 11 aa, Influenza virus
MQRFRRPDSSW

SEQ ID NO: 432276 - protein, 11 aa, Influenza virus
RFVFSIAASYK

SEQ ID NO: 432277 - protein, 11 aa, Influenza virus
HMRKKRGLFGA

SEQ ID NO: 432278 - protein, 11 aa, Influenza virus
VSWASNSIVTF

SEQ ID NO: 432279 - protein, 11 aa, Influenza virus
AVLRGFLIIGK

SEQ ID NO: 432280 - protein, 11 aa, Influenza virus
SPYRALMSVPL

SEQ ID NO: 432281 - protein, 11 aa, Influenza virus
EIGEDLAPIEY

SEQ ID NO: 432282 - protein, 11 aa, Influenza virus
SISCFLLVALF

SEQ ID NO: 432283 - protein, 11 aa, Influenza virus
FSFGASCFILL

SEQ ID NO: 432284 - protein, 11 aa, Influenza virus
SSMPLHNIHPL

SEQ ID NO: 432285 - protein, 11 aa, Influenza virus
TVKDRSPFRTL

SEQ ID NO: 432286 - protein, 11 aa, Influenza virus
TILETRYVCSK

SEQ ID NO: 432287 - protein, 11 aa, Influenza virus
WTYNAELLVLM

SEQ ID NO: 432288 - protein, 11 aa, Influenza virus
VWWTSTSIVVF

SEQ ID NO: 432289 - protein, 11 aa, Influenza virus
GYKDIILWVSF

SEQ ID NO: 432290 - protein, 11 aa, Influenza virus
ILVALENQHTI

SEQ ID NO: 432291 - protein, 11 aa, Influenza virus
VLMENERTLDY

SEQ ID NO: 432292 - protein, 11 aa, Influenza virus
NNRIKINPVTL

SEQ ID NO: 432293 - protein, 11 aa, Influenza virus
KLVGINMSKKK

SEQ ID NO: 432294 - protein, 11 aa, Influenza virus
SFPDGAQIQYF

SEQ ID NO: 432295 - protein, 11 aa, Influenza virus
NKVEFEPFQSL

SEQ ID NO: 432296 - protein, 11 aa, Influenza virus
NKLEFEPFQSL

SEQ ID NO: 432297 - protein, 11 aa, Influenza virus
RYVEDTKIDLW

SEQ ID NO: 432298 - protein, 11 aa, Influenza virus
FESIESEFSEI

SEQ ID NO: 432299 - protein, 11 aa, Influenza virus
GGIPTDVIRSW

SEQ ID NO: 432300 - protein, 11 aa, Influenza virus
RGQQGRMDYYW

SEQ ID NO: 432301 - protein, 11 aa, Influenza virus
SLCNVEGWVVV

SEQ ID NO: 432302 - protein, 11 aa, Influenza virus
CSALFVYSLRK

SEQ ID NO: 432303 - protein, 11 aa, Influenza virus
MTDGSASSQAH

SEQ ID NO: 432304 - protein, 11 aa, Influenza virus
SPFRTLMSCPM

SEQ ID NO: 432305 - protein, 11 aa, Influenza virus
KSLCEVNSWHI

SEQ ID NO: 432306 - protein, 11 aa, Influenza virus
SFFRNVVWLTK

SEQ ID NO: 432307 - protein, 11 aa, Influenza virus
MTDGPSDAQAF

SEQ ID NO: 432308 - protein, 11 aa, Influenza virus
LSVYSTVASSL

SEQ ID NO: 432309 - protein, 11 aa, Influenza virus
RFVFSSAASYK

SEQ ID NO: 432310 - protein, 11 aa, Influenza virus
TTFPYTGDPPY

SEQ ID NO: 432311 - protein, 11 aa, Influenza virus
NSNWSGYSGSF

SEQ ID NO: 432312 - protein, 11 aa, Influenza virus
KQGSLMLATGM

SEQ ID NO: 432313 - protein, 11 aa, Influenza virus
VLDDCSLKGLI

SEQ ID NO: 432314 - protein, 11 aa, Influenza virus
RTSIWTSSSSM

SEQ ID NO: 432315 - protein, 11 aa, Influenza virus
SLFEKFFPSSS

SEQ ID NO: 432316 - protein, 11 aa, Influenza virus
AIDEGNGCFEL

SEQ ID NO: 432317 - protein, 11 aa, Influenza virus
GLQSSDDFALI

SEQ ID NO: 432318 - protein, 11 aa, Influenza virus
VLNLLIGVSNV

SEQ ID NO: 432319 - protein, 11 aa, Influenza virus
KIMESGGIDKI

SEQ ID NO: 432320 - protein, 11 aa, Influenza virus
WSFALAQGALL

SEQ ID NO: 432321 - protein, 11 aa, Influenza virus
RTISTASRAGY

SEQ ID NO: 432322 - protein, 11 aa, Influenza virus
GTIVKTLTSEK

SEQ ID NO: 432323 - protein, 11 aa, Influenza virus
KAWLHVCVTGY

SEQ ID NO: 432324 - protein, 11 aa, Influenza virus
RPILSPLTKGI

SEQ ID NO: 432325 - protein, 11 aa, Influenza virus
NEITTKINNII

SEQ ID NO: 432326 - protein, 11 aa, Influenza virus
GAFIAPNRASF

SEQ ID NO: 432327 - protein, 11 aa, Influenza virus
NMLADRIDDAV

SEQ ID NO: 432328 - protein, 11 aa, Influenza virus
RICIDFRDMRK

SEQ ID NO: 432329 - protein, 11 aa, Influenza virus
KIDLWSYNADV

SEQ ID NO: 432330 - protein, 11 aa, Influenza virus
KMEKIVLLLAI

SEQ ID NO: 432331 - protein, 11 aa, Influenza virus
WEGMVDGWYGF

SEQ ID NO: 432332 - protein, 11 aa, Influenza virus
EIGEDIAPIEY

SEQ ID NO: 432333 - protein, 11 aa, Influenza virus
NLHAYISFRNL

SEQ ID NO: 432334 - protein, 11 aa, Influenza virus
MMWEINGPDSV

SEQ ID NO: 432335 - protein, 11 aa, Influenza virus
HVRKRFADQEL

SEQ ID NO: 432336 - protein, 11 aa, Influenza virus
ESNGVFLAPRY

SEQ ID NO: 432337 - protein, 11 aa, Influenza virus
IRWLTLKSGQF

SEQ ID NO: 432338 - protein, 11 aa, Influenza virus
YLEKYVEDTKI

SEQ ID NO: 432339 - protein, 11 aa, Influenza virus
VWWTTNSIVVF

SEQ ID NO: 432340 - protein, 11 aa, Influenza virus
GLRNTPSVEPK

SEQ ID NO: 432341 - protein, 11 aa, Influenza virus
CIASSLVLAAL

SEQ ID NO: 432342 - protein, 11 aa, Influenza virus
LVLDDCSLEGL

SEQ ID NO: 432343 - protein, 11 aa, Influenza virus
ILWISFATSCF

SEQ ID NO: 432344 - protein, 11 aa, Influenza virus
YPGATVNEEAL

SEQ ID NO: 432345 - protein, 11 aa, Influenza virus
IMTIGSVSLAL

SEQ ID NO: 432346 - protein, 11 aa, Influenza virus
IIDIWAYNAEL

SEQ ID NO: 432347 - protein, 11 aa, Influenza virus
RVGCVILLNPF

SEQ ID NO: 432348 - protein, 11 aa, Influenza virus
YQFALGHGTTL

SEQ ID NO: 432349 - protein, 11 aa, Influenza virus
ALILRGSVAHK

SEQ ID NO: 432350 - protein, 11 aa, Influenza virus
WPDGAEIEYFL

SEQ ID NO: 432351 - protein, 11 aa, Influenza virus
WSWPDDAELPL

SEQ ID NO: 432352 - protein, 11 aa, Influenza virus
IIVFCGTSGTY

SEQ ID NO: 432353 - protein, 11 aa, Influenza virus
IYSCIASSLIL

SEQ ID NO: 432354 - protein, 11 aa, Influenza virus
WISFAISCFLL

SEQ ID NO: 432355 - protein, 11 aa, Influenza virus
NLYASKNPYTL

SEQ ID NO: 432356 - protein, 11 aa, Influenza virus
ILVAGGLILGM

SEQ ID NO: 432357 - protein, 11 aa, Influenza virus
RTISPRLRSGF

SEQ ID NO: 432358 - protein, 11 aa, Influenza virus
NLLIGISNMSL

SEQ ID NO: 432359 - protein, 11 aa, Influenza virus
ALILRGSIAHK

SEQ ID NO: 432360 - protein, 11 aa, Influenza virus
YPGATINEEAL

SEQ ID NO: 432361 - protein, 11 aa, Influenza virus
NLLIGISNIGL

SEQ ID NO: 432362 - protein, 11 aa, Influenza virus
KYVEDTKIDLW

SEQ ID NO: 432363 - protein, 11 aa, Influenza virus
ILWISFAISCL

SEQ ID NO: 432364 - protein, 11 aa, Influenza virus
GVIPLTTTPTK

SEQ ID NO: 432365 - protein, 11 aa, Influenza virus
WAYNAELLVLL

SEQ ID NO: 432366 - protein, 11 aa, Influenza virus
WSFALAQGTLL

SEQ ID NO: 432367 - protein, 11 aa, Influenza virus
WISFATSCFLL

SEQ ID NO: 432368 - protein, 11 aa, Influenza virus
TVKDRSPYRAL

SEQ ID NO: 432369 - protein, 11 aa, Influenza virus
KSLGIQSDAQI

SEQ ID NO: 432370 - protein, 11 aa, Influenza virus
RTLNTASRSGY

SEQ ID NO: 432371 - protein, 11 aa, Influenza virus
QLSSVSSFEKF

SEQ ID NO: 432372 - protein, 11 aa, Influenza virus
SIAGWLLGNPM

SEQ ID NO: 432373 - protein, 11 aa, Influenza virus
QAFYKILKIRK

SEQ ID NO: 432374 - protein, 11 aa, Influenza virus
LLVSTNAYDRI

SEQ ID NO: 432375 - protein, 11 aa, Influenza virus
NHEDYREESQL

SEQ ID NO: 432376 - protein, 11 aa, Influenza virus
FPFHKGNSARL

SEQ ID NO: 432377 - protein, 11 aa, Influenza virus
CFNPCFYVELI

SEQ ID NO: 432378 - protein, 11 aa, Influenza virus
SYGRIIQNEDI

SEQ ID NO: 432379 - protein, 11 aa, Influenza virus
NRPWVSFNQNL

SEQ ID NO: 432380 - protein, 11 aa, Influenza virus
TIRNRHSNGTI

SEQ ID NO: 432381 - protein, 11 aa, Influenza virus
KINPVTLTMGY

SEQ ID NO: 432382 - protein, 11 aa, Influenza virus
MKWGMELRRCL

SEQ ID NO: 432383 - protein, 11 aa, Influenza virus
ALAQGALVGTK

SEQ ID NO: 432384 - protein, 11 aa, Influenza virus
GIHHPSSTQEK

SEQ ID NO: 432385 - protein, 11 aa, Influenza virus
FQHQNEQGVGM

SEQ ID NO: 432386 - protein, 11 aa, Influenza virus
NEIKGVKLSSM

SEQ ID NO: 432387 - protein, 11 aa, Influenza virus
FLHNGGLIAPS

SEQ ID NO: 432388 - protein, 11 aa, Influenza virus
ILFNTIGNLIA

SEQ ID NO: 432389 - protein, 11 aa, Influenza virus
ALGQGTTLYNK

SEQ ID NO: 432390 - protein, 11 aa, Influenza virus
SARHVEECSCY

SEQ ID NO: 432391 - protein, 11 aa, Influenza virus
IQDIWAYNAEL

SEQ ID NO: 432392 - protein, 11 aa, Influenza virus
KEECYRACFYV

SEQ ID NO: 432393 - protein, 11 aa, Influenza virus
ISCSYLECRTF

SEQ ID NO: 432394 - protein, 11 aa, Influenza virus
SFYRNLIWLVK

SEQ ID NO: 432395 - protein, 11 aa, Influenza virus
RFVFSNAASYK

SEQ ID NO: 432396 - protein, 11 aa, Influenza virus
TLVNPGDSIIF

SEQ ID NO: 432397 - protein, 11 aa, Influenza virus
AMDAGNGCFDI

SEQ ID NO: 432398 - protein, 11 aa, Influenza virus
STVMVGLILAF

SEQ ID NO: 432399 - protein, 11 aa, Influenza virus
SVRNGTYDYPK

SEQ ID NO: 432400 - protein, 11 aa, Influenza virus
TPYRTLLMNEL

SEQ ID NO: 432401 - protein, 11 aa, Influenza virus
VLIAGGLILGM

SEQ ID NO: 432402 - protein, 11 aa, Influenza virus
KTVVHLNSTTI

SEQ ID NO: 432403 - protein, 11 aa, Influenza virus
RLSAGGDIWVM

SEQ ID NO: 432404 - protein, 11 aa, Influenza virus
RTISIASRSGY

SEQ ID NO: 432405 - protein, 11 aa, Influenza virus
FRYGDGVWIGR

SEQ ID NO: 432406 - protein, 11 aa, Influenza virus
WFRNILSMAPI

SEQ ID NO: 432407 - protein, 11 aa, Influenza virus
SQRGILEDEQM

SEQ ID NO: 432408 - protein, 11 aa, Influenza virus
KIRHLEECSCY

SEQ ID NO: 432409 - protein, 11 aa, Influenza virus
WSWPDGAEVPF

SEQ ID NO: 432410 - protein, 11 aa, Influenza virus
MSFQGRGVFEL

SEQ ID NO: 432411 - protein, 11 aa, Influenza virus
SLQQIESIIEA

SEQ ID NO: 432412 - protein, 11 aa, Influenza virus
REGRNPGNAEI

SEQ ID NO: 432413 - protein, 11 aa, Influenza virus
VMTDGPASNQA

SEQ ID NO: 432414 - protein, 11 aa, Influenza virus
IENNVTVTSSV

SEQ ID NO: 432415 - protein, 11 aa, Influenza virus
LIWLWLVLREK

SEQ ID NO: 432416 - protein, 11 aa, Influenza virus
IMIWHSNLNDA

SEQ ID NO: 432417 - protein, 11 aa, Influenza virus
DSNGNFIAPEY

SEQ ID NO: 432418 - protein, 11 aa, Influenza virus
MKWMMAMKYPI

SEQ ID NO: 432419 - protein, 11 aa, Influenza virus
RFYIQMCTELK

SEQ ID NO: 432420 - protein, 11 aa, Influenza virus
DRIEVTNATEL

SEQ ID NO: 432421 - protein, 11 aa, Influenza virus
KSLESRRGFEM

SEQ ID NO: 432422 - protein, 11 aa, Influenza virus
WEGMIDGWYGF

SEQ ID NO: 432423 - protein, 11 aa, Influenza virus
DLADSEMDKLY

SEQ ID NO: 432424 - protein, 11 aa, Influenza virus
LMNELGVPFHL

SEQ ID NO: 432425 - protein, 11 aa, Influenza virus
TIHLTDSEMNK

SEQ ID NO: 432426 - protein, 11 aa, Influenza virus
IQHLEECSCYM

SEQ ID NO: 432427 - protein, 11 aa, Influenza virus
QQGWMDYYWGI

SEQ ID NO: 432428 - protein, 11 aa, Influenza virus
FSFGASCVMLL

SEQ ID NO: 432429 - protein, 11 aa, Influenza virus
RRGLFGAIAGF

SEQ ID NO: 432430 - protein, 11 aa, Influenza virus
LLVSLGAISFW

SEQ ID NO: 432431 - protein, 11 aa, Influenza virus
NWFGYFGIFFV

SEQ ID NO: 432432 - protein, 11 aa, Influenza virus
MIRGQPKEKAI

SEQ ID NO: 432433 - protein, 11 aa, Influenza virus
SVAGWLLGNPM

SEQ ID NO: 432434 - protein, 11 aa, Influenza virus
YIIEKYGTGRI

SEQ ID NO: 432435 - protein, 11 aa, Influenza virus
LVLGDCSIAGW

SEQ ID NO: 432436 - protein, 11 aa, Influenza virus
WSKPQCHITGF

SEQ ID NO: 432437 - protein, 11 aa, Influenza virus
ISCSHMECRTF

SEQ ID NO: 432438 - protein, 11 aa, Influenza virus
KMNPNQKIITI

SEQ ID NO: 432439 - protein, 11 aa, Influenza virus
FSISCFLLAAL

SEQ ID NO: 432440 - protein, 11 aa, Influenza virus
SFYRNLVWLVK

SEQ ID NO: 432441 - protein, 11 aa, Influenza virus
YIIRALTLNTM

SEQ ID NO: 432442 - protein, 11 aa, Influenza virus
ILWISFSMSCF

SEQ ID NO: 432443 - protein, 11 aa, Influenza virus
YLVLNKSLCKV

SEQ ID NO: 432444 - protein, 11 aa, Influenza virus
LTDSQTATKRI

SEQ ID NO: 432445 - protein, 11 aa, Influenza virus
FMYSDFHFINE

SEQ ID NO: 432446 - protein, 11 aa, Influenza virus
KTFFLTQGSLL

SEQ ID NO: 432447 - protein, 11 aa, Influenza virus
IREPFISCSPL

SEQ ID NO: 432448 - protein, 11 aa, Influenza virus
WISFSISCFLL

SEQ ID NO: 432449 - protein, 11 aa, Influenza virus
KMEAILVVLLY

SEQ ID NO: 432450 - protein, 11 aa, Influenza virus
RIKINPVTLTM

SEQ ID NO: 432451 - protein, 11 aa, Influenza virus
IQSEFNKACEL

SEQ ID NO: 432452 - protein, 11 aa, Influenza virus
KILSIYSTVAA

SEQ ID NO: 432453 - protein, 11 aa, Influenza virus
RYREEAMQNRI

SEQ ID NO: 432454 - protein, 11 aa, Influenza virus
VIGGWTIANSK

SEQ ID NO: 432455 - protein, 11 aa, Influenza virus
RTVSSFYSEMK

SEQ ID NO: 432456 - protein, 11 aa, Influenza virus
YQILAIYSTVA

SEQ ID NO: 432457 - protein, 11 aa, Influenza virus
ILWISFSISCF

SEQ ID NO: 432458 - protein, 11 aa, Influenza virus
SFPDGARIQYF

SEQ ID NO: 432459 - protein, 11 aa, Influenza virus
VLVNTYQWIIK

SEQ ID NO: 432460 - protein, 11 aa, Influenza virus
CSIWFSHYNQM

SEQ ID NO: 432461 - protein, 11 aa, Influenza virus
TLDNKHSNDTV

SEQ ID NO: 432462 - protein, 11 aa, Influenza virus
VSMEFSLTDPK

SEQ ID NO: 432463 - protein, 11 aa, Influenza virus
YISSGSLKLAI

SEQ ID NO: 432464 - protein, 11 aa, Influenza virus
LMNELGIPFHL

SEQ ID NO: 432465 - protein, 11 aa, Influenza virus
MGMRISSSFSF

SEQ ID NO: 432466 - protein, 11 aa, Influenza virus
MPFHNVHPLTI

SEQ ID NO: 432467 - protein, 11 aa, Influenza virus
ESNGGFLAPRY

SEQ ID NO: 432468 - protein, 11 aa, Influenza virus
RWKHVTNTILL

SEQ ID NO: 432469 - protein, 11 aa, Influenza virus
KTFFLTQGALL

SEQ ID NO: 432470 - protein, 11 aa, Influenza virus
RTGTFEFTSFF

SEQ ID NO: 432471 - protein, 11 aa, Influenza virus
MVKRGINDRNF

SEQ ID NO: 432472 - protein, 11 aa, Influenza virus
VILEENTTYKI

SEQ ID NO: 432473 - protein, 11 aa, Influenza virus
GQAGRMTFYWK

SEQ ID NO: 432474 - protein, 11 aa, Influenza virus
ARLLVLLENEK

SEQ ID NO: 432475 - protein, 11 aa, Influenza virus
QTSGNLIAPEY

SEQ ID NO: 432476 - protein, 11 aa, Influenza virus
KIEAVIYGNPK

SEQ ID NO: 432477 - protein, 11 aa, Influenza virus
QMNGQSGRIDF

SEQ ID NO: 432478 - protein, 11 aa, Influenza virus
YRACFYVELIR

SEQ ID NO: 432479 - protein, 11 aa, Influenza virus
GLLVADGGPNL

SEQ ID NO: 432480 - protein, 11 aa, Influenza virus
WTYNAELFVLM

SEQ ID NO: 432481 - protein, 11 aa, Influenza virus
ASICTHLEVCF

SEQ ID NO: 432482 - protein, 11 aa, Influenza virus
RRKTNLYGFIV

SEQ ID NO: 432483 - protein, 11 aa, Influenza virus
ELRRQKWWVWL

SEQ ID NO: 432484 - protein, 11 aa, Influenza virus
ARIKTRLFTIR

SEQ ID NO: 432485 - protein, 11 aa, Influenza virus
RIGEGQRSWMK

SEQ ID NO: 432486 - protein, 11 aa, Influenza virus
WSFALAQGVLL

SEQ ID NO: 432487 - protein, 11 aa, Influenza virus
CSASTGGQSFY

SEQ ID NO: 432488 - protein, 11 aa, Influenza virus
IMTDGSASSQA

SEQ ID NO: 432489 - protein, 11 aa, Influenza virus
FVLWACQNGNI

SEQ ID NO: 432490 - protein, 11 aa, Influenza virus
IYSTVAASLCL

SEQ ID NO: 432491 - protein, 11 aa, Influenza virus
MFALSQGTTLK

SEQ ID NO: 432492 - protein, 11 aa, Influenza virus
LRFVFSSAASY

SEQ ID NO: 432493 - protein, 11 aa, Influenza virus
KEAQDVIMEVV

SEQ ID NO: 432494 - protein, 11 aa, Influenza virus
KLYVNKNPYTL

SEQ ID NO: 432495 - protein, 11 aa, Influenza virus
RMTICVQGNNK

SEQ ID NO: 432496 - protein, 11 aa, Influenza virus
SWHDGAEITYF

SEQ ID NO: 432497 - protein, 11 aa, Influenza virus
SPRSRSGFEML

SEQ ID NO: 432498 - protein, 11 aa, Influenza virus
WEGLINGWYGF

SEQ ID NO: 432499 - protein, 11 aa, Influenza virus
GMIDGWYGYHH

SEQ ID NO: 432500 - protein, 11 aa, Influenza virus
SLDKICLGHHA

SEQ ID NO: 432501 - protein, 11 aa, Influenza virus
GGIPTDVVRSW

SEQ ID NO: 432502 - protein, 11 aa, Influenza virus
ATALANTIEVF

SEQ ID NO: 432503 - protein, 11 aa, Influenza virus
IYSCIASSLVL

SEQ ID NO: 432504 - protein, 11 aa, Influenza virus
KEAQDVIMEIV

SEQ ID NO: 432505 - protein, 11 aa, Influenza virus
FSFGASCFLLL

SEQ ID NO: 432506 - protein, 11 aa, Influenza virus
VMTDGSASSQA

SEQ ID NO: 432507 - protein, 11 aa, Influenza virus
GYKDVILWFSL

SEQ ID NO: 432508 - protein, 11 aa, Influenza virus
KTGTFEFTSFF

SEQ ID NO: 432509 - protein, 11 aa, Influenza virus
RLGSWSWHDGA

SEQ ID NO: 432510 - protein, 11 aa, Influenza virus
AINLYASKNPY

SEQ ID NO: 432511 - protein, 11 aa, Influenza virus
LRFVFSNAASY

SEQ ID NO: 432512 - protein, 11 aa, Influenza virus
WSFALAQGTLL

SEQ ID NO: 432513 - protein, 11 aa, Influenza virus
KIDLWSYNAEL

SEQ ID NO: 432514 - protein, 11 aa, Influenza virus
LLNPFVSHKEI

SEQ ID NO: 432515 - protein, 11 aa, Influenza virus
HLFSGVNSFSR

SEQ ID NO: 432516 - protein, 11 aa, Influenza virus
NMLADRVDDAV

SEQ ID NO: 432517 - protein, 11 aa, Influenza virus
RFYVQMCTELK

SEQ ID NO: 432518 - protein, 11 aa, Influenza virus
GEAPSPYNSKF

SEQ ID NO: 432519 - protein, 11 aa, Influenza virus
FSFGASCFVLL

SEQ ID NO: 432520 - protein, 11 aa, Influenza virus
SARHIEECSCY

SEQ ID NO: 432521 - protein, 11 aa, Influenza virus
VWWTSNSIVVF

SEQ ID NO: 432522 - protein, 11 aa, Influenza virus
KFYIQMCTELK

SEQ ID NO: 432523 - protein, 11 aa, Influenza virus
GRYGVKGFSFR

SEQ ID NO: 432524 - protein, 11 aa, Influenza virus
GLLAPKYGYII

SEQ ID NO: 432525 - protein, 11 aa, Influenza virus
LIDKTNQQFEL

SEQ ID NO: 432526 - protein, 11 aa, Influenza virus
RTISIASRSGY

SEQ ID NO: 432527 - protein, 11 aa, Influenza virus
YHFEECSCYPS

SEQ ID NO: 432528 - protein, 11 aa, Influenza virus
FESIESEFNEI

SEQ ID NO: 432529 - protein, 11 aa, Influenza virus
KLTQGRQTYDW

SEQ ID NO: 432530 - protein, 11 aa, Influenza virus
ILWFSLGASCF

SEQ ID NO: 432531 - protein, 11 aa, Influenza virus
WLLGNPKCDRL

SEQ ID NO: 432532 - protein, 11 aa, Influenza virus
LLAKSVFNSLY

SEQ ID NO: 432533 - protein, 11 aa, Influenza virus
CTINSWHIYGK

SEQ ID NO: 432534 - protein, 11 aa, Influenza virus
LQSSDDFALIL

SEQ ID NO: 432535 - protein, 11 aa, Influenza virus
FHLGTKQVCMA

SEQ ID NO: 432536 - protein, 11 aa, Influenza virus
VYQILAIYSTV

SEQ ID NO: 432537 - protein, 11 aa, Influenza virus
YQILAIYSTAA

SEQ ID NO: 432538 - protein, 11 aa, Influenza virus
NTDLEALMEWI

SEQ ID NO: 432539 - protein, 11 aa, Influenza virus
ATALANTIEVF

SEQ ID NO: 432540 - protein, 11 aa, Influenza virus
TIKDRSPYRTL

SEQ ID NO: 432541 - protein, 11 aa, Influenza virus
VLDDCSLEGII

SEQ ID NO: 432542 - protein, 11 aa, Influenza virus
RTISRDSRSGY

SEQ ID NO: 432543 - protein, 11 aa, Influenza virus
KRLCTINSWHI

SEQ ID NO: 432544 - protein, 11 aa, Influenza virus
YRQEALQNRIM

SEQ ID NO: 432545 - protein, 11 aa, Influenza virus
GIRIGSRGHIF

SEQ ID NO: 432546 - protein, 11 aa, Influenza virus
TLKGRHANGTI

SEQ ID NO: 432547 - protein, 11 aa, Influenza virus
LRDCSVAGWLL

SEQ ID NO: 432548 - protein, 11 aa, Influenza virus
ESNGGLLAPRY

SEQ ID NO: 432549 - protein, 11 aa, Influenza virus
IYSSVASSLVL

SEQ ID NO: 432550 - protein, 11 aa, Influenza virus
NQFALGQGTTL

SEQ ID NO: 432551 - protein, 11 aa, Influenza virus
GVAPSPYNSRF

SEQ ID NO: 432552 - protein, 11 aa, Influenza virus
GQSGRIDFYWL

SEQ ID NO: 432553 - protein, 11 aa, Influenza virus
YQILAIYSTVA

SEQ ID NO: 432554 - protein, 11 aa, Influenza virus
LSIYSCIASSI

SEQ ID NO: 432555 - protein, 11 aa, Influenza virus
CLRNGNMRCTI

SEQ ID NO: 432556 - protein, 11 aa, Influenza virus
VMREPFISCSH

SEQ ID NO: 432557 - protein, 11 aa, Influenza virus
GLRNTPSIDPK

SEQ ID NO: 432558 - protein, 11 aa, Influenza virus
GYKDVILWISF

SEQ ID NO: 432559 - protein, 11 aa, Influenza virus
SICSCIASSLV

SEQ ID NO: 432560 - protein, 11 aa, Influenza virus
TVDHMAIIKKY

SEQ ID NO: 432561 - protein, 11 aa, Influenza virus
EECLINDPWVL

SEQ ID NO: 432562 - protein, 11 aa, Influenza virus
WLLGNPECDIL

SEQ ID NO: 432563 - protein, 11 aa, Influenza virus
DTIIFEATGNL

SEQ ID NO: 432564 - protein, 11 aa, Influenza virus
SVKNGTYDYPK

SEQ ID NO: 432565 - protein, 11 aa, Influenza virus
LVALCGSPVPV

SEQ ID NO: 432566 - protein, 11 aa, Influenza virus
KMNTQILVFAL

SEQ ID NO: 432567 - protein, 11 aa, Influenza virus
VSWTSNSIVTF

SEQ ID NO: 432568 - protein, 11 aa, Influenza virus
GMMDGWYGFRH

SEQ ID NO: 432569 - protein, 11 aa, Influenza virus
TIVLDTDWSGY

SEQ ID NO: 432570 - protein, 11 aa, Influenza virus
LLVSLGAVSFW

SEQ ID NO: 432571 - protein, 11 aa, Influenza virus
IQDIWAYNAEL

SEQ ID NO: 432572 - protein, 11 aa, Influenza virus
LISTPLGSPPM

SEQ ID NO: 432573 - protein, 11 aa, Influenza virus
MTIASDILTRM

SEQ ID NO: 432574 - protein, 11 aa, Influenza virus
WPDGAKIEYFL

SEQ ID NO: 432575 - protein, 11 aa, Influenza virus
STSCHDGIGRM

SEQ ID NO: 432576 - protein, 11 aa, Influenza virus
SWHDGAEIIYF

SEQ ID NO: 432577 - protein, 11 aa, Influenza virus
MPFHNIHPLTI

SEQ ID NO: 432578 - protein, 11 aa, Influenza virus
SLRGRGSTLGL

SEQ ID NO: 432579 - protein, 11 aa, Influenza virus
YSIADKICIGY

SEQ ID NO: 432580 - protein, 11 aa, Influenza virus
RPWMRINNETI

SEQ ID NO: 432581 - protein, 11 aa, Influenza virus
DQIEVTNATEL

SEQ ID NO: 432582 - protein, 11 aa, Influenza virus
NTDWSGYSGSF

SEQ ID NO: 432583 - protein, 11 aa, Influenza virus
FMIIGGFIFGC

SEQ ID NO: 432584 - protein, 11 aa, Influenza virus
TPYRSLIRFPV

SEQ ID NO: 432585 - protein, 11 aa, Influenza virus
ALHQGTTIRNK

SEQ ID NO: 432586 - protein, 11 aa, Influenza virus
RTLDFHDSNVK

SEQ ID NO: 432587 - protein, 11 aa, Influenza virus
NLLIGISNVGL

SEQ ID NO: 432588 - protein, 11 aa, Influenza virus
FSFGASCFLLI

SEQ ID NO: 432589 - protein, 11 aa, Influenza virus
KLIQGYKDIIL

SEQ ID NO: 432590 - protein, 11 aa, Influenza virus
IMTDGPASSQA

SEQ ID NO: 432591 - protein, 11 aa, Influenza virus
VYQILSIYSTV

SEQ ID NO: 432592 - protein, 11 aa, Influenza virus
SLLLATGMRNV

SEQ ID NO: 432593 - protein, 11 aa, Influenza virus
MMWEINGPESV

SEQ ID NO: 432594 - protein, 11 aa, Influenza virus
ILVALALSHTA

SEQ ID NO: 432595 - protein, 11 aa, Influenza virus
YRILSIYSTVA

SEQ ID NO: 432596 - protein, 11 aa, Influenza virus
QLNEGIMNTSK

SEQ ID NO: 432597 - protein, 11 aa, Influenza virus
ILSNPKCDLYL

SEQ ID NO: 432598 - protein, 11 aa, Influenza virus
WMMAMRYPITA

SEQ ID NO: 432599 - protein, 11 aa, Influenza virus
VWWTSNSIVAF

SEQ ID NO: 432600 - protein, 11 aa, Influenza virus
SPFRTLMSCPV

SEQ ID NO: 432601 - protein, 11 aa, Influenza virus
HLFSGIKSFSR

SEQ ID NO: 432602 - protein, 11 aa, Influenza virus
RLTITYSSSMM

SEQ ID NO: 432603 - protein, 11 aa, Influenza virus
KLEKSRINGVK

SEQ ID NO: 432604 - protein, 11 aa, Influenza virus
DLANSEMNKLY

SEQ ID NO: 432605 - protein, 11 aa, Influenza virus
WSFALAQGVLL

SEQ ID NO: 432606 - protein, 11 aa, Influenza virus
VYKALSIYSCI

SEQ ID NO: 432607 - protein, 11 aa, Influenza virus
ISCSHSECRTF

SEQ ID NO: 432608 - protein, 11 aa, Influenza virus
SPYRALMSVPM

SEQ ID NO: 432609 - protein, 11 aa, Influenza virus
ILLENERTLDF

SEQ ID NO: 432610 - protein, 11 aa, Influenza virus
KLNKNEIKGVK

SEQ ID NO: 432611 - protein, 11 aa, Influenza virus
RTFFLTHGALL

SEQ ID NO: 432612 - protein, 11 aa, Influenza virus
KLKSEDNVYKV

SEQ ID NO: 432613 - protein, 11 aa, Influenza virus
QIDSVKLSSGY

SEQ ID NO: 432614 - protein, 11 aa, Influenza virus
RLAAGGAIWVT

SEQ ID NO: 432615 - protein, 11 aa, Influenza virus
IYSCIASSIVL

SEQ ID NO: 432616 - protein, 11 aa, Influenza virus
CIGYHSNNSTK

SEQ ID NO: 432617 - protein, 11 aa, Influenza virus
TLLAKSVFNCL

SEQ ID NO: 432618 - protein, 11 aa, Influenza virus
YQILSIYSTVA

SEQ ID NO: 432619 - protein, 11 aa, Influenza virus
ITGKLNRLISK

SEQ ID NO: 432620 - protein, 11 aa, Influenza virus
STVLVGLILAF

SEQ ID NO: 432621 - protein, 11 aa, Influenza virus
CRLSGIPPLEL

SEQ ID NO: 432622 - protein, 11 aa, Influenza virus
AEIAQRLESVF

SEQ ID NO: 432623 - protein, 11 aa, Influenza virus
RPWMRISNETI

SEQ ID NO: 432624 - protein, 11 aa, Influenza virus
MYSDFHFINEL

SEQ ID NO: 432625 - protein, 11 aa, Influenza virus
SIRNNTYDHSK

SEQ ID NO: 432626 - protein, 11 aa, Influenza virus
SPRSRNGFEML

SEQ ID NO: 432627 - protein, 11 aa, Influenza virus
KLCRLRGIPPL

SEQ ID NO: 432628 - protein, 11 aa, Influenza virus
SISCLYKLSQF

SEQ ID NO: 432629 - protein, 11 aa, Influenza virus
LIGKNSWSYIV

SEQ ID NO: 432630 - protein, 11 aa, Influenza virus
RTFFLTHGSLL

SEQ ID NO: 432631 - protein, 11 aa, Influenza virus
VYQILAIYATV

SEQ ID NO: 432632 - protein, 11 aa, Influenza virus
YGFVANFSMEL

SEQ ID NO: 432633 - protein, 11 aa, Influenza virus
EELLTGNLQTL

SEQ ID NO: 432634 - protein, 11 aa, Influenza virus
DHIEVTNATEL

SEQ ID NO: 432635 - protein, 11 aa, Influenza virus
NLEELRFVFSI

SEQ ID NO: 432636 - protein, 11 aa, Influenza virus
WSFALAQGALL

SEQ ID NO: 432637 - protein, 11 aa, Influenza virus
REWSYLIEDPS

SEQ ID NO: 432638 - protein, 11 aa, Influenza virus
ITNKVNSIIDK

SEQ ID NO: 432639 - protein, 11 aa, Influenza virus
WSYNAGLLVAL

SEQ ID NO: 432640 - protein, 11 aa, Influenza virus
RRFIQNALNGN

SEQ ID NO: 432641 - protein, 11 aa, Influenza virus
NMIADRVDDAV

SEQ ID NO: 432642 - protein, 11 aa, Influenza virus
QTSGNLIAPEY

SEQ ID NO: 432643 - protein, 11 aa, Influenza virus
RLCTINSWHIY

SEQ ID NO: 432644 - protein, 11 aa, Influenza virus
SARHIEEWSCY

SEQ ID NO: 432645 - protein, 11 aa, Influenza virus
TLLAKSVFNSI

SEQ ID NO: 432646 - protein, 11 aa, Influenza virus
MEMRRCLLQSL

SEQ ID NO: 432647 - protein, 11 aa, Influenza virus
VSWTSNSMVTF

SEQ ID NO: 432648 - protein, 11 aa, Influenza virus
YSHGTGTGYTM

SEQ ID NO: 432649 - protein, 11 aa, Influenza virus
AIGDCPKYVNV

SEQ ID NO: 432650 - protein, 11 aa, Influenza virus
IQDLWAYNAEL

SEQ ID NO: 432651 - protein, 11 aa, Influenza virus
WSWPDGALFPL

SEQ ID NO: 432652 - protein, 11 aa, Influenza virus
NINPVTLSSGY

SEQ ID NO: 432653 - protein, 11 aa, Influenza virus
ITNKINSIIDK

SEQ ID NO: 432654 - protein, 11 aa, Influenza virus
KSDVLVTREPY

SEQ ID NO: 432655 - protein, 11 aa, Influenza virus
MIALILVALAL

SEQ ID NO: 432656 - protein, 11 aa, Influenza virus
VLVALENQHTI

SEQ ID NO: 432657 - protein, 11 aa, Influenza virus
WTGMVNGWYGY

SEQ ID NO: 432658 - protein, 11 aa, Influenza virus
WTYNAEVLVLM

SEQ ID NO: 432659 - protein, 11 aa, Influenza virus
ISNETILETGY

SEQ ID NO: 432660 - protein, 11 aa, Influenza virus
CIGYHANNSTK

SEQ ID NO: 432661 - protein, 11 aa, Influenza virus
VLLENQKTLDK

SEQ ID NO: 432662 - protein, 11 aa, Influenza virus
ILGNPMCDYLI

SEQ ID NO: 432663 - protein, 11 aa, Influenza virus
RPVGISSMMEA

SEQ ID NO: 432664 - protein, 11 aa, Influenza virus
VLIAGGLILGM

SEQ ID NO: 432665 - protein, 11 aa, Influenza virus
KRYELEIGTRI

SEQ ID NO: 432666 - protein, 11 aa, Influenza virus
GLLAPRYGYII

SEQ ID NO: 432667 - protein, 11 aa, Influenza virus
TILETGYVCSK

SEQ ID NO: 432668 - protein, 11 aa, Influenza virus
FVMWACQKGNI

SEQ ID NO: 432669 - protein, 11 aa, Influenza virus
GSWPDGANTNF

SEQ ID NO: 432670 - protein, 11 aa, Influenza virus
QLNEGVMNTSK

SEQ ID NO: 432671 - protein, 11 aa, Influenza virus
NVLLKHRFEII

SEQ ID NO: 432672 - protein, 11 aa, Influenza virus
GRMADSIKSWR

SEQ ID NO: 432673 - protein, 11 aa, Influenza virus
LRSLIASSGTL

SEQ ID NO: 432674 - protein, 11 aa, Influenza virus
SIRNNTYDHTK

SEQ ID NO: 432675 - protein, 11 aa, Influenza virus
VIGGWTTANSK

SEQ ID NO: 432676 - protein, 11 aa, Influenza virus
IVDKMNREFEV

SEQ ID NO: 432677 - protein, 11 aa, Influenza virus
DLWSYNAQLLV

SEQ ID NO: 432678 - protein, 11 aa, Influenza virus
WISFAMSCFLL

SEQ ID NO: 432679 - protein, 11 aa, Influenza virus
GPAANSAHHRV

SEQ ID NO: 432680 - protein, 11 aa, Influenza virus
RTISMDSRSGY

SEQ ID NO: 432681 - protein, 11 aa, Influenza virus
CRLRGIPPLEL

SEQ ID NO: 432682 - protein, 11 aa, Influenza virus
ATALANTIEIF

SEQ ID NO: 432683 - protein, 11 aa, Influenza virus
KPLQNTSKHYI

SEQ ID NO: 432684 - protein, 11 aa, Influenza virus
AEIAQRLEGVF

SEQ ID NO: 432685 - protein, 11 aa, Influenza virus
VLGLSMVRSDK

SEQ ID NO: 432686 - protein, 11 aa, Influenza virus
ARSALILRGSI

SEQ ID NO: 432687 - protein, 11 aa, Influenza virus
SVSSFERFEIF

SEQ ID NO: 432688 - protein, 11 aa, Influenza virus
GSWPDGANINF

SEQ ID NO: 432689 - protein, 11 aa, Influenza virus
ISCSHLECRTF

SEQ ID NO: 432690 - protein, 11 aa, Influenza virus
HLKDQDWSYIV

SEQ ID NO: 432691 - protein, 11 aa, Influenza virus
LRDCSIAGWLL

SEQ ID NO: 432692 - protein, 11 aa, Influenza virus
REVEVVNATET

SEQ ID NO: 432693 - protein, 11 aa, Influenza virus
EEVWIGRTKSL

SEQ ID NO: 432694 - protein, 11 aa, Influenza virus
VSWTSNSIITF

SEQ ID NO: 432695 - protein, 11 aa, Influenza virus
CRKTRGLFGAI

SEQ ID NO: 432696 - protein, 11 aa, Influenza virus
YRTCKLLGINM

SEQ ID NO: 432697 - protein, 11 aa, Influenza virus
VVIAKDNAVRF

SEQ ID NO: 432698 - protein, 11 aa, Influenza virus
FSFGASCFLFL

SEQ ID NO: 432699 - protein, 11 aa, Influenza virus
KVDLWSYNAEL

SEQ ID NO: 432700 - protein, 11 aa, Influenza virus
SILANNGRFEF

SEQ ID NO: 432701 - protein, 11 aa, Influenza virus
CIRFVNSDCSK

SEQ ID NO: 432702 - protein, 11 aa, Influenza virus
GYKNWILWISF

SEQ ID NO: 432703 - protein, 11 aa, Influenza virus
KNADLEALMEW

SEQ ID NO: 432704 - protein, 11 aa, Influenza virus
IESMIEAESSV

SEQ ID NO: 432705 - protein, 11 aa, Influenza virus
GGVPTDVIRSW

SEQ ID NO: 432706 - protein, 11 aa, Influenza virus
ILIAGGLILGM

SEQ ID NO: 432707 - protein, 11 aa, Influenza virus
HLKDQSWSYIV

SEQ ID NO: 432708 - protein, 11 aa, Influenza virus
KLNRNEIKGVK

SEQ ID NO: 432709 - protein, 11 aa, Influenza virus
YIIEKYGSGRI

SEQ ID NO: 432710 - protein, 11 aa, Influenza virus
GQAGRMTFYWA

SEQ ID NO: 432711 - protein, 11 aa, Influenza virus
ISCSHMECRTF

SEQ ID NO: 432712 - protein, 11 aa, Influenza virus
FRNILSIAPIM

SEQ ID NO: 432713 - protein, 11 aa, Influenza virus
ISFTITGDNTK

SEQ ID NO: 432714 - protein, 11 aa, Influenza virus
QEFKMNPNQKI

SEQ ID NO: 432715 - protein, 11 aa, Influenza virus
TENGVPVTSSV

SEQ ID NO: 432716 - protein, 11 aa, Influenza virus
SIRIGSKGDIF

SEQ ID NO: 432717 - protein, 11 aa, Influenza virus
KEEVTNATETV

SEQ ID NO: 432718 - protein, 11 aa, Influenza virus
LLRHFQKDAKM

SEQ ID NO: 432719 - protein, 11 aa, Influenza virus
RTISTASRSGY

SEQ ID NO: 432720 - protein, 11 aa, Influenza virus
AIDEGDGCFSI

SEQ ID NO: 432721 - protein, 11 aa, Influenza virus
RRFVQNALSGN

SEQ ID NO: 432722 - protein, 11 aa, Influenza virus
KYVWWTSNSLV

SEQ ID NO: 432723 - protein, 11 aa, Influenza virus
YRRPVGISSMM

SEQ ID NO: 432724 - protein, 11 aa, Influenza virus
QQGRMDYYWAV

SEQ ID NO: 432725 - protein, 11 aa, Influenza virus
LQRRRFVQNAL

SEQ ID NO: 432726 - protein, 11 aa, Influenza virus
GLIAPRYGYII

SEQ ID NO: 432727 - protein, 11 aa, Influenza virus
AIYSTVASSLI

SEQ ID NO: 432728 - protein, 11 aa, Influenza virus
WTGMIDGWYGY

SEQ ID NO: 432729 - protein, 11 aa, Influenza virus
FVNVTHVQNNY

SEQ ID NO: 432730 - protein, 11 aa, Influenza virus
AAICTHLEVCF

SEQ ID NO: 432731 - protein, 11 aa, Influenza virus
IYATVAGSLSL

SEQ ID NO: 432732 - protein, 11 aa, Influenza virus
TILETGYICSK

SEQ ID NO: 432733 - protein, 11 aa, Influenza virus
SLLLATGMKNV

SEQ ID NO: 432734 - protein, 11 aa, Influenza virus
RRKRGLFGAIA

SEQ ID NO: 432735 - protein, 11 aa, Influenza virus
SLCKVEEWVVV

SEQ ID NO: 432736 - protein, 11 aa, Influenza virus
RRIDFHWLLLE

SEQ ID NO: 432737 - protein, 11 aa, Influenza virus
GLSSRISFYWT

SEQ ID NO: 432738 - protein, 11 aa, Influenza virus
VWWTSNSIAVF

SEQ ID NO: 432739 - protein, 11 aa, Influenza virus
NALLKHRFEII

SEQ ID NO: 432740 - protein, 11 aa, Influenza virus
NLYVNKNPYTL

SEQ ID NO: 432741 - protein, 11 aa, Influenza virus
RPIGISSMVEA

SEQ ID NO: 432742 - protein, 11 aa, Influenza virus
SLERRLENLNK

SEQ ID NO: 432743 - protein, 11 aa, Influenza virus
FSISCFLLIAL

SEQ ID NO: 432744 - protein, 11 aa, Influenza virus
TEDNVYKVLAI

SEQ ID NO: 432745 - protein, 11 aa, Influenza virus
WMKLYWHLMSP

SEQ ID NO: 432746 - protein, 11 aa, Influenza virus
TEVETYVLSIV

SEQ ID NO: 432747 - protein, 11 aa, Influenza virus
AIDEGDGCFSL

SEQ ID NO: 432748 - protein, 11 aa, Influenza virus
STYHNSFVPVV

SEQ ID NO: 432749 - protein, 11 aa, Influenza virus
KQMTRGLFGAI

SEQ ID NO: 432750 - protein, 11 aa, Influenza virus
GYKDWILWISF

SEQ ID NO: 432751 - protein, 11 aa, Influenza virus
FQHRNEEGTGV

SEQ ID NO: 432752 - protein, 11 aa, Influenza virus
FEQVEGRIQDL

SEQ ID NO: 432753 - protein, 11 aa, Influenza virus
ILVSTNAYDRI

SEQ ID NO: 432754 - protein, 11 aa, Influenza virus
LRMKWMMAMKY

SEQ ID NO: 432755 - protein, 11 aa, Influenza virus
MMWEVNGPESV

SEQ ID NO: 432756 - protein, 11 aa, Influenza virus
FSFGASSFVLL

SEQ ID NO: 432757 - protein, 11 aa, Influenza virus
RLTQGRQTYDW

SEQ ID NO: 432758 - protein, 11 aa, Influenza virus
EIGEDVAPIEY

SEQ ID NO: 432759 - protein, 11 aa, Influenza virus
RISKRGSSGIM

SEQ ID NO: 432760 - protein, 11 aa, Influenza virus
KLAQGYKDIIL

SEQ ID NO: 432761 - protein, 11 aa, Influenza virus
GSSSNAYQAKF

SEQ ID NO: 432762 - protein, 11 aa, Influenza virus
SIHSRGLFGAI

SEQ ID NO: 432763 - protein, 11 aa, Influenza virus
MLADRIDDAVT

SEQ ID NO: 432764 - protein, 11 aa, Influenza virus
NMSKRKSYINK

SEQ ID NO: 432765 - protein, 11 aa, Influenza virus
ISLCSIWFSHY

SEQ ID NO: 432766 - protein, 11 aa, Influenza virus
IQDVWAYNAEL

SEQ ID NO: 432767 - protein, 11 aa, Influenza virus
TIVLTTDWSGY

SEQ ID NO: 432768 - protein, 11 aa, Influenza virus
SIKRYERVKMF

SEQ ID NO: 432769 - protein, 11 aa, Influenza virus
IESMVEAESSV

SEQ ID NO: 432770 - protein, 11 aa, Influenza virus
TLVSNSDWSGY

SEQ ID NO: 432771 - protein, 11 aa, Influenza virus
AEIAQRLENVF

SEQ ID NO: 432772 - protein, 11 aa, Influenza virus
SPGMMMGMFNM

SEQ ID NO: 432773 - protein, 11 aa, Influenza virus
RIGDGQRSWMK

SEQ ID NO: 432774 - protein, 11 aa, Influenza virus
RRATVSADPLV

SEQ ID NO: 432775 - protein, 11 aa, Influenza virus
HLKDQAWSYIV

SEQ ID NO: 432776 - protein, 11 aa, Influenza virus
ETSHTGTYCSL

SEQ ID NO: 432777 - protein, 11 aa, Influenza virus
TLELRSRYWAI

SEQ ID NO: 432778 - protein, 11 aa, Influenza virus
FRNILSMAPIM

SEQ ID NO: 432779 - protein, 11 aa, Influenza virus
ISSSLVLVGLI

SEQ ID NO: 432780 - protein, 11 aa, Influenza virus
GYKDIILWISF

SEQ ID NO: 432781 - protein, 11 aa, Influenza virus
RLNRNEIKGVK

SEQ ID NO: 432782 - protein, 11 aa, Influenza virus
YPGTTVNEEAL

SEQ ID NO: 432783 - protein, 11 aa, Influenza virus
FVRGQQGRMDY

SEQ ID NO: 432784 - protein, 11 aa, Influenza virus
LPFHNIHPLAI

SEQ ID NO: 432785 - protein, 11 aa, Influenza virus
ISFSMSCFVFV

SEQ ID NO: 432786 - protein, 11 aa, Influenza virus
KEPMGFRYSGI

SEQ ID NO: 432787 - protein, 11 aa, Influenza virus
PSSDNEQTDLY

SEQ ID NO: 432788 - protein, 11 aa, Influenza virus
EEVLTGNLQTL

SEQ ID NO: 432789 - protein, 11 aa, Influenza virus
NTWLGRTISPK

SEQ ID NO: 432790 - protein, 11 aa, Influenza virus
KQGSLRLATGM

SEQ ID NO: 432791 - protein, 11 aa, Influenza virus
WPDGAKIKYFL

SEQ ID NO: 432792 - protein, 11 aa, Influenza virus
KYREEAMQNRI

SEQ ID NO: 432793 - protein, 11 aa, Influenza virus
LSAFDERRNRY

SEQ ID NO: 432794 - protein, 11 aa, Influenza virus
AINEGNGCFEL

SEQ ID NO: 432795 - protein, 11 aa, Influenza virus
NTTGRDVLVMW

SEQ ID NO: 432796 - protein, 11 aa, Influenza virus
CRLRGIPPLEL

SEQ ID NO: 432797 - protein, 11 aa, Influenza virus
ALGIINLLIGI

SEQ ID NO: 432798 - protein, 11 aa, Influenza virus
SLQQVESMIEA

SEQ ID NO: 432799 - protein, 11 aa, Influenza virus
IYSTVASSLIL

SEQ ID NO: 432800 - protein, 11 aa, Influenza virus
LRMKWMMAMRY

SEQ ID NO: 432801 - protein, 11 aa, Influenza virus
TQDAMTEVWSY

SEQ ID NO: 432802 - protein, 11 aa, Influenza virus
ASNQASYKIFK

SEQ ID NO: 432803 - protein, 11 aa, Influenza virus
SFRPNIGPRPL

SEQ ID NO: 432804 - protein, 11 aa, Influenza virus
TLKIRTNGNLI

SEQ ID NO: 432805 - protein, 11 aa, Influenza virus
ISCSHLECRTF

SEQ ID NO: 432806 - protein, 11 aa, Influenza virus
VLLENDRTLDL

SEQ ID NO: 432807 - protein, 11 aa, Influenza virus
GLDKICLGHHA

SEQ ID NO: 432808 - protein, 11 aa, Influenza virus
AAICTHLEICF

SEQ ID NO: 432809 - protein, 11 aa, Influenza virus
YQILAIYATVA

SEQ ID NO: 432810 - protein, 11 aa, Influenza virus
QAFYKILKIKK

SEQ ID NO: 432811 - protein, 11 aa, Influenza virus
KLVLATGLRNV

SEQ ID NO: 432812 - protein, 11 aa, Influenza virus
MINPVKLSGGY

SEQ ID NO: 432813 - protein, 11 aa, Influenza virus
SLQQIESMIEA

SEQ ID NO: 432814 - protein, 11 aa, Influenza virus
IRIAWSSSSCF

SEQ ID NO: 432815 - protein, 11 aa, Influenza virus
LQRRRFIQNAL

SEQ ID NO: 432816 - protein, 11 aa, Influenza virus
KRYELEIGARI

SEQ ID NO: 432817 - protein, 11 aa, Influenza virus
MKDRSPYRTLM

SEQ ID NO: 432818 - protein, 11 aa, Influenza virus
AAMDEFQLIPM

SEQ ID NO: 432819 - protein, 11 aa, Influenza virus
STSCHDGISRM

SEQ ID NO: 432820 - protein, 11 aa, Influenza virus
FEQVEGRTQDL

SEQ ID NO: 432821 - protein, 11 aa, Influenza virus
VLSAFDERRNK

SEQ ID NO: 432822 - protein, 11 aa, Influenza virus
KNSDLEALMEW

SEQ ID NO: 432823 - protein, 11 aa, Influenza virus
ALLAKSVFNSL

SEQ ID NO: 432824 - protein, 11 aa, Influenza virus
LAIYSCIASSI

SEQ ID NO: 432825 - protein, 11 aa, Influenza virus
ITGKSHGRILK

SEQ ID NO: 432826 - protein, 11 aa, Influenza virus
SVTTNTINRSF

SEQ ID NO: 432827 - protein, 11 aa, Influenza virus
YLITGKSHGRI

SEQ ID NO: 432828 - protein, 11 aa, Influenza virus
YPGELNNNGEL

SEQ ID NO: 432829 - protein, 11 aa, Influenza virus
RTISPRSRSGF

SEQ ID NO: 432830 - protein, 11 aa, Influenza virus
GSKKRLGSWSW

SEQ ID NO: 432831 - protein, 11 aa, Influenza virus
TSLCSIWFSHY

SEQ ID NO: 432832 - protein, 11 aa, Influenza virus
SFYRNLVWIVK

SEQ ID NO: 432833 - protein, 11 aa, Influenza virus
VTDIWSYNARL

SEQ ID NO: 432834 - protein, 11 aa, Influenza virus
GIHHPSSAQEK

SEQ ID NO: 432835 - protein, 11 aa, Influenza virus
WTYNTELLVLM

SEQ ID NO: 432836 - protein, 11 aa, Influenza virus
VGYLSTNSSEK

SEQ ID NO: 432837 - protein, 11 aa, Influenza virus
KIDLWSYNAGL

SEQ ID NO: 432838 - protein, 11 aa, Influenza virus
VYQVLAIYATV

SEQ ID NO: 432839 - protein, 11 aa, Influenza virus
VTNKVNSIIDK

SEQ ID NO: 432840 - protein, 11 aa, Influenza virus
DTCYPFDVPDY

SEQ ID NO: 432841 - protein, 11 aa, Influenza virus
LLRHFQKNAKV

SEQ ID NO: 432842 - protein, 11 aa, Influenza virus
SGSSFYAEMKW

SEQ ID NO: 432843 - protein, 11 aa, Influenza virus
HRFEIIEGRDR

SEQ ID NO: 432844 - protein, 11 aa, Influenza virus
SVPLGSSPNAY

SEQ ID NO: 432845 - protein, 11 aa, Influenza virus
LMTDGPSDAQA

SEQ ID NO: 432846 - protein, 11 aa, Influenza virus
IVLVGLILAFI

SEQ ID NO: 432847 - protein, 11 aa, Influenza virus
SSSIVMCGVDY

SEQ ID NO: 432848 - protein, 11 aa, Influenza virus
LMSELGVPFHL

SEQ ID NO: 432849 - protein, 11 aa, Influenza virus
GEAPSPYNSRF

SEQ ID NO: 432850 - protein, 11 aa, Influenza virus
SIGSSTYQNNF

SEQ ID NO: 432851 - protein, 11 aa, Influenza virus
LLGNPECDLFL

SEQ ID NO: 432852 - protein, 11 aa, Influenza virus
DLADSEMKKLY

SEQ ID NO: 432853 - protein, 11 aa, Influenza virus
LLVALENQNTI

SEQ ID NO: 432854 - protein, 11 aa, Influenza virus
KVARLGKGYMF

SEQ ID NO: 432855 - protein, 11 aa, Influenza virus
YGRGRIFQSRI

SEQ ID NO: 432856 - protein, 11 aa, Influenza virus
RTFFLTQGALL

SEQ ID NO: 432857 - protein, 11 aa, Influenza virus
FVALILGFVLW

SEQ ID NO: 432858 - protein, 11 aa, Influenza virus
TVNRTHQYSEK

SEQ ID NO: 432859 - protein, 11 aa, Influenza virus
TETGVPVTSSV

SEQ ID NO: 432860 - protein, 11 aa, Influenza virus
YPGSTVNEEAL

SEQ ID NO: 432861 - protein, 11 aa, Influenza virus
WEGLVDGWYGF

SEQ ID NO: 432862 - protein, 11 aa, Influenza virus
GSWPDGADINF

SEQ ID NO: 432863 - protein, 11 aa, Influenza virus
AAMDDFQLIPM

SEQ ID NO: 432864 - protein, 11 aa, Influenza virus
LRSLVASSGTL

SEQ ID NO: 432865 - protein, 11 aa, Influenza virus
TIWTSSSSVVM

SEQ ID NO: 432866 - protein, 11 aa, Influenza virus
AAICTHMEVCF

SEQ ID NO: 432867 - protein, 11 aa, Influenza virus
GQSGRINFHWL

SEQ ID NO: 432868 - protein, 11 aa, Influenza virus
TRVWWTSNSIV

SEQ ID NO: 432869 - protein, 11 aa, Influenza virus
VVMTDGNASGK

SEQ ID NO: 432870 - protein, 11 aa, Influenza virus
FVNVTNVQNNY

SEQ ID NO: 432871 - protein, 11 aa, Influenza virus
YVKSKRLVLAT

SEQ ID NO: 432872 - protein, 11 aa, Influenza virus
RPVGISSMVEA

SEQ ID NO: 432873 - protein, 11 aa, Influenza virus
WTGMVDGWYGY

SEQ ID NO: 432874 - protein, 11 aa, Influenza virus
WSYNARLLVLL

SEQ ID NO: 432875 - protein, 11 aa, Influenza virus
FSFGASCFIFL

SEQ ID NO: 432876 - protein, 11 aa, Influenza virus
GPVHFRSQVKI

SEQ ID NO: 432877 - protein, 11 aa, Influenza virus
VIGGWATANSK

SEQ ID NO: 432878 - protein, 11 aa, Influenza virus
SQLVWMACNSA

SEQ ID NO: 432879 - protein, 11 aa, Influenza virus
ILLENERTLDL

SEQ ID NO: 432880 - protein, 11 aa, Influenza virus
SLVGIDPFKLL

SEQ ID NO: 432881 - protein, 11 aa, Influenza virus
RTFFLTQGSLL

SEQ ID NO: 432882 - protein, 11 aa, Influenza virus
RTLNTASRSGY

SEQ ID NO: 432883 - protein, 11 aa, Influenza virus
GRYSRADKICI

SEQ ID NO: 432884 - protein, 11 aa, Influenza virus
RTISTASRAGY

SEQ ID NO: 432885 - protein, 11 aa, Influenza virus
SPYNSKFESVA

SEQ ID NO: 432886 - protein, 11 aa, Influenza virus
KIKHLEECSCY

SEQ ID NO: 432887 - protein, 11 aa, Influenza virus
IQNEFNKACEL

SEQ ID NO: 432888 - protein, 11 aa, Influenza virus
KMNTQILIFAL

SEQ ID NO: 432889 - protein, 11 aa, Influenza virus
ITDIWTYQAEL

SEQ ID NO: 432890 - protein, 11 aa, Influenza virus
QTNGNLIAPEY

SEQ ID NO: 432891 - protein, 11 aa, Influenza virus
VLLFMIIGGFI

SEQ ID NO: 432892 - protein, 11 aa, Influenza virus
QPAATALANTI

SEQ ID NO: 432893 - protein, 11 aa, Influenza virus
KIMTIGSVSLA

SEQ ID NO: 432894 - protein, 11 aa, Influenza virus
EQAVDICKAAL

SEQ ID NO: 432895 - protein, 11 aa, Influenza virus
TAMDDFQLIPM

SEQ ID NO: 432896 - protein, 11 aa, Influenza virus
ISFSISCFLLV

SEQ ID NO: 432897 - protein, 11 aa, Influenza virus
WMMAMRYPITA

SEQ ID NO: 432898 - protein, 11 aa, Influenza virus
DTIIFEASGNL

SEQ ID NO: 432899 - protein, 11 aa, Influenza virus
GMIDGWYGFHH

SEQ ID NO: 432900 - protein, 11 aa, Influenza virus
DLWAYNAELLV

SEQ ID NO: 432901 - protein, 11 aa, Influenza virus
VVIAKDNAIRF

SEQ ID NO: 432902 - protein, 11 aa, Influenza virus
ITGKSHGRVLK

SEQ ID NO: 432903 - protein, 11 aa, Influenza virus
REWSYIVERPK

SEQ ID NO: 432904 - protein, 11 aa, Influenza virus
KLERSKINGVK

SEQ ID NO: 432905 - protein, 11 aa, Influenza virus
GQAGRIDFHWM

SEQ ID NO: 432906 - protein, 11 aa, Influenza virus
ISNETILETGY

SEQ ID NO: 432907 - protein, 11 aa, Influenza virus
VLGIINLLIGI

SEQ ID NO: 432908 - protein, 11 aa, Influenza virus
KYVEDTKVDLW

SEQ ID NO: 432909 - protein, 11 aa, Influenza virus
TTYQRTRALVR

SEQ ID NO: 432910 - protein, 11 aa, Influenza virus
MEMRRCLLQSL

SEQ ID NO: 432911 - protein, 11 aa, Influenza virus
SLEGLILSNPK

SEQ ID NO: 432912 - protein, 11 aa, Influenza virus
LHLTGTWDTLI

SEQ ID NO: 432913 - protein, 11 aa, Influenza virus
KEDSRSGYETF

SEQ ID NO: 432914 - protein, 11 aa, Influenza virus
RGNHGVKGWAF

SEQ ID NO: 432915 - protein, 11 aa, Influenza virus
ILDQNFRNIRK

SEQ ID NO: 432916 - protein, 11 aa, Influenza virus
RISKRGSSGIM

SEQ ID NO: 432917 - protein, 11 aa, Influenza virus
CVASSLVLAAI

SEQ ID NO: 432918 - protein, 11 aa, Influenza virus
ERNDLYGTQSL

SEQ ID NO: 432919 - protein, 11 aa, Influenza virus
CLKNGNMRCTI

SEQ ID NO: 432920 - protein, 11 aa, Influenza virus
MKWMMAMKYPI

SEQ ID NO: 432921 - protein, 11 aa, Influenza virus
KLATGLRNVPT

SEQ ID NO: 432922 - protein, 11 aa, Influenza virus
NLVAPEYGFKI

SEQ ID NO: 432923 - protein, 11 aa, Influenza virus
SFYRNVVWLIK

SEQ ID NO: 432924 - protein, 11 aa, Influenza virus
VLLENDKTLDL

SEQ ID NO: 432925 - protein, 11 aa, Influenza virus
KRQEIEGIRLK

SEQ ID NO: 432926 - protein, 11 aa, Influenza virus
SACLRGGRNSF

SEQ ID NO: 432927 - protein, 11 aa, Influenza virus
KGRYGVKGFSF

SEQ ID NO: 432928 - protein, 11 aa, Influenza virus
ALILRGAVAHK

SEQ ID NO: 432929 - protein, 11 aa, Influenza virus
VMTDGPANNQA

SEQ ID NO: 432930 - protein, 11 aa, Influenza virus
MGLRISSSFSF

SEQ ID NO: 432931 - protein, 11 aa, Influenza virus
SVSSFERFEMF

SEQ ID NO: 432932 - protein, 11 aa, Influenza virus
QESECVCHSGI

SEQ ID NO: 432933 - protein, 11 aa, Influenza virus
TPYRSLIQFPI

SEQ ID NO: 432934 - protein, 11 aa, Influenza virus
LQSSDDFALIV

SEQ ID NO: 432935 - protein, 11 aa, Influenza virus
GEVPSPYNSRF

SEQ ID NO: 432936 - protein, 11 aa, Influenza virus
GIITDTFKSWK

SEQ ID NO: 432937 - protein, 11 aa, Influenza virus
CRLSGIPPLEL

SEQ ID NO: 432938 - protein, 11 aa, Influenza virus
EKLTITYSSSL

SEQ ID NO: 432939 - protein, 11 aa, Influenza virus
SLVGIDPFRLL

SEQ ID NO: 432940 - protein, 11 aa, Influenza virus
TEIEQQIGNVI

SEQ ID NO: 432941 - protein, 11 aa, Influenza virus
SLCKIEGWVVV

SEQ ID NO: 432942 - protein, 11 aa, Influenza virus
KQPISLGDCSF

SEQ ID NO: 432943 - protein, 11 aa, Influenza virus
FPFHKDNALRL

SEQ ID NO: 432944 - protein, 11 aa, Influenza virus
VLGLSMVKSDK

SEQ ID NO: 432945 - protein, 11 aa, Influenza virus
SLVGVDPFKLL

SEQ ID NO: 432946 - protein, 11 aa, Influenza virus
ESNGNFITPEY

SEQ ID NO: 432947 - protein, 11 aa, Influenza virus
NLLIGVSNVGL

SEQ ID NO: 432948 - protein, 11 aa, Influenza virus
TMTITFLILLF

SEQ ID NO: 432949 - protein, 11 aa, Influenza virus
ELRRQKSLIWL

SEQ ID NO: 432950 - protein, 11 aa, Influenza virus
FPFHKDNAVRL

SEQ ID NO: 432951 - protein, 11 aa, Influenza virus
GLICATCEQIA

SEQ ID NO: 432952 - protein, 11 aa, Influenza virus
LSVAPIMFSNK

SEQ ID NO: 432953 - protein, 11 aa, Influenza virus
VLLENERTLDL

SEQ ID NO: 432954 - protein, 11 aa, Influenza virus
SFFRNVVWLVK

SEQ ID NO: 432955 - protein, 11 aa, Influenza virus
AINNRIKINPV

SEQ ID NO: 432956 - protein, 11 aa, Influenza virus
NLIIGISNVGL

SEQ ID NO: 432957 - protein, 11 aa, Influenza virus
KIRTRGLFGAI

SEQ ID NO: 432958 - protein, 11 aa, Influenza virus
LAHALKLVVAM

SEQ ID NO: 432959 - protein, 11 aa, Influenza virus
YPFDVPDYQSL

SEQ ID NO: 432960 - protein, 11 aa, Influenza virus
WEGLIDGWYGF

SEQ ID NO: 432961 - protein, 11 aa, Influenza virus
YRIWSKPQCQI

SEQ ID NO: 432962 - protein, 11 aa, Influenza virus
FYIQMCTELQL

SEQ ID NO: 432963 - protein, 11 aa, Influenza virus
KQESLMLATGM

SEQ ID NO: 432964 - protein, 11 aa, Influenza virus
VLMENERTLYF

SEQ ID NO: 432965 - protein, 11 aa, Influenza virus
SLMLATGMRNI

SEQ ID NO: 432966 - protein, 11 aa, Influenza virus
KIRTRGLFGAI

SEQ ID NO: 432967 - protein, 11 aa, Influenza virus
SFKPNIGPRPL

SEQ ID NO: 432968 - protein, 11 aa, Influenza virus
GGVPTDVVRSW

SEQ ID NO: 432969 - protein, 11 aa, Influenza virus
KLKTEDNVYKV

SEQ ID NO: 432970 - protein, 11 aa, Influenza virus
VPEKIRTRGLF

SEQ ID NO: 432971 - protein, 11 aa, Influenza virus
EVWSYNAEFLV

SEQ ID NO: 432972 - protein, 11 aa, Influenza virus
GRYSIADKICI

SEQ ID NO: 432973 - protein, 11 aa, Influenza virus
ITYSSSMMWEI

SEQ ID NO: 432974 - protein, 11 aa, Influenza virus
SSMPFHNVHPL

SEQ ID NO: 432975 - protein, 11 aa, Influenza virus
STSCHDGVGRM

SEQ ID NO: 432976 - protein, 11 aa, Influenza virus
WTYNAELLVLM

SEQ ID NO: 432977 - protein, 11 aa, Influenza virus
YQFALGHGTTL

SEQ ID NO: 432978 - protein, 11 aa, Influenza virus
IVDKMNREFGV

SEQ ID NO: 432979 - protein, 11 aa, Influenza virus
IENTYVNNTTI

SEQ ID NO: 432980 - protein, 11 aa, Influenza virus
SFPDGAKIQYF

SEQ ID NO: 432981 - protein, 11 aa, Influenza virus
WLTKKKNPEAY

SEQ ID NO: 432982 - protein, 11 aa, Influenza virus
QLNEGVINTSK

SEQ ID NO: 432983 - protein, 11 aa, Influenza virus
SMDSRSGYETF

SEQ ID NO: 432984 - protein, 11 aa, Influenza virus
NMSKKKSYINK

SEQ ID NO: 432985 - protein, 11 aa, Influenza virus
FPFHKDNALRL

SEQ ID NO: 432986 - protein, 11 aa, Influenza virus
KAWLHVCVTGY

SEQ ID NO: 432987 - protein, 11 aa, Influenza virus
GEVFVIREPFV

SEQ ID NO: 432988 - protein, 11 aa, Influenza virus
STTCHDGIGRM

SEQ ID NO: 432989 - protein, 11 aa, Influenza virus
SVSSFKRFEIF

SEQ ID NO: 432990 - protein, 11 aa, Influenza virus
LSFTITGDNTK

SEQ ID NO: 432991 - protein, 11 aa, Influenza virus
MSFQGRGVFEL

SEQ ID NO: 432992 - protein, 11 aa, Influenza virus
NQTKTMTITFL

SEQ ID NO: 432993 - protein, 11 aa, Influenza virus
QRSKFLLMDAL

SEQ ID NO: 432994 - protein, 11 aa, Influenza virus
GGNSFYAELKW

SEQ ID NO: 432995 - protein, 11 aa, Influenza virus
IYKILSIYSCI

SEQ ID NO: 432996 - protein, 11 aa, Influenza virus
GMCYPGFVENL

SEQ ID NO: 432997 - protein, 11 aa, Influenza virus
FSAESRKLLLV

SEQ ID NO: 432998 - protein, 11 aa, Influenza virus
YLIRALTLNTM

SEQ ID NO: 432999 - protein, 11 aa, Influenza virus
SLVGVDPFRLL

SEQ ID NO: 433000 - protein, 11 aa, Influenza virus
CINRCFYVELV

SEQ ID NO: 433001 - protein, 11 aa, Influenza virus
NLIAPRGYFRI

SEQ ID NO: 433002 - protein, 11 aa, Influenza virus
TIHDRSQFRAL

SEQ ID NO: 433003 - protein, 11 aa, Influenza virus
ALGQGTTLNNK

SEQ ID NO: 433004 - protein, 11 aa, Influenza virus
KTNGNLIAPEY

SEQ ID NO: 433005 - protein, 11 aa, Influenza virus
GAFIAPDRASF

SEQ ID NO: 433006 - protein, 11 aa, Influenza virus
RTLDLHDSNVK

SEQ ID NO: 433007 - protein, 11 aa, Influenza virus
SLYDKVRMQLR

SEQ ID NO: 433008 - protein, 11 aa, Influenza virus
GLSPNVYQARF

SEQ ID NO: 433009 - protein, 11 aa, Influenza virus
SMGVYQILAIY

SEQ ID NO: 433010 - protein, 11 aa, Influenza virus
RTNGTSKIKMK

SEQ ID NO: 433011 - protein, 11 aa, Influenza virus
RTISPRSRNGF

SEQ ID NO: 433012 - protein, 11 aa, Influenza virus
LPFHNVHPLAI

SEQ ID NO: 433013 - protein, 11 aa, Influenza virus
FSISCFLLVAL

SEQ ID NO: 433014 - protein, 11 aa, Influenza virus
TKMKAILVVLL

SEQ ID NO: 433015 - protein, 11 aa, Influenza virus
GYKDWVLWISF

SEQ ID NO: 433016 - protein, 11 aa, Influenza virus
WSYNAQLLVLL

SEQ ID NO: 433017 - protein, 11 aa, Influenza virus
QRLNTMHQLLR

SEQ ID NO: 433018 - protein, 11 aa, Influenza virus
RYNGQRSWMKI

SEQ ID NO: 433019 - protein, 11 aa, Influenza virus
CISATGMILSV

SEQ ID NO: 433020 - protein, 11 aa, Influenza virus
WSWPDGALFPL

SEQ ID NO: 433021 - protein, 11 aa, Influenza virus
KLAIGPRNVPA

SEQ ID NO: 433022 - protein, 11 aa, Influenza virus
GTIIKTLTNEK

SEQ ID NO: 433023 - protein, 11 aa, Influenza virus
VLLSPEEVSEA

SEQ ID NO: 433024 - protein, 11 aa, Influenza virus
TVWTSSSSIVM

SEQ ID NO: 433025 - protein, 11 aa, Influenza virus
VLLENEKTLDL

SEQ ID NO: 433026 - protein, 11 aa, Influenza virus
RLCTINSWHIY

SEQ ID NO: 433027 - protein, 11 aa, Influenza virus
NGQAGRMTFYW

SEQ ID NO: 433028 - protein, 11 aa, Influenza virus
KRQEIEGIKLK

SEQ ID NO: 433029 - protein, 11 aa, Influenza virus
CIESKLSQMSK

SEQ ID NO: 433030 - protein, 11 aa, Influenza virus
VQSEFNKACEL

SEQ ID NO: 433031 - protein, 11 aa, Influenza virus
GLCKINSWHIF

SEQ ID NO: 433032 - protein, 11 aa, Influenza virus
ESNGALLAPRY

SEQ ID NO: 433033 - protein, 11 aa, Influenza virus
GSYNNTSGEQM

SEQ ID NO: 433034 - protein, 11 aa, Influenza virus
ETTHTGTYCSL

SEQ ID NO: 433035 - protein, 11 aa, Influenza virus
REGLILEYYFV

SEQ ID NO: 433036 - protein, 11 aa, Influenza virus
TIGDCPKYMNV

SEQ ID NO: 433037 - protein, 11 aa, Influenza virus
IGYMSNNSTEK

SEQ ID NO: 433038 - protein, 11 aa, Influenza virus
KQTKTMTITFL

SEQ ID NO: 433039 - protein, 11 aa, Influenza virus
ESNGAFLAPRY

SEQ ID NO: 433040 - protein, 11 aa, Influenza virus
LRSIVASSGTL

SEQ ID NO: 433041 - protein, 11 aa, Influenza virus
MSLLTEVETYV

SEQ ID NO: 433042 - protein, 11 aa, Influenza virus
GRQTFDWTLNR

SEQ ID NO: 433043 - protein, 11 aa, Influenza virus
RPLILRDCSVA

SEQ ID NO: 433044 - protein, 11 aa, Influenza virus
MTIASDILTRM

SEQ ID NO: 433045 - protein, 11 aa, Influenza virus
SFRPNIGPRPL

SEQ ID NO: 433046 - protein, 11 aa, Influenza virus
GIRIGSKGDVF

SEQ ID NO: 433047 - protein, 11 aa, Influenza virus
NHEDYKEESQL

SEQ ID NO: 433048 - protein, 11 aa, Influenza virus
GAKAGFIENGW

SEQ ID NO: 433049 - protein, 11 aa, Influenza virus
WSGYSGSFMDY

SEQ ID NO: 433050 - protein, 11 aa, Influenza virus
VGYLSTNSTEK

SEQ ID NO: 433051 - protein, 11 aa, Influenza virus
KGVELSSMGVY

SEQ ID NO: 433052 - protein, 11 aa, Influenza virus
IASDILTRMSK

SEQ ID NO: 433053 - protein, 11 aa, Influenza virus
FQYLLFQDILM

SEQ ID NO: 433054 - protein, 11 aa, Influenza virus
AARNIVRRAAV

SEQ ID NO: 433055 - protein, 11 aa, Influenza virus
DQVEVTNATEL

SEQ ID NO: 433056 - protein, 11 aa, Influenza virus
VTDIWAYNAEL

SEQ ID NO: 433057 - protein, 11 aa, Influenza virus
GLLVSDGGPNL

SEQ ID NO: 433058 - protein, 11 aa, Influenza virus
VYRALSIYSCI

SEQ ID NO: 433059 - protein, 11 aa, Influenza virus
ITGKLNRLIGK

SEQ ID NO: 433060 - protein, 11 aa, Influenza virus
DLWSYNAELLV

SEQ ID NO: 433061 - protein, 11 aa, Influenza virus
AVDEGNGCFEL

SEQ ID NO: 433062 - protein, 11 aa, Influenza virus
RRAAVSADPLA

SEQ ID NO: 433063 - protein, 11 aa, Influenza virus
VSCSIHECRTF

SEQ ID NO: 433064 - protein, 11 aa, Influenza virus
YQILSIYSTVV

SEQ ID NO: 433065 - protein, 11 aa, Influenza virus
IYSTVSSSLVL

SEQ ID NO: 433066 - protein, 11 aa, Influenza virus
YRTCKLVGINM

SEQ ID NO: 433067 - protein, 11 aa, Influenza virus
FSISCFLLAAL

SEQ ID NO: 433068 - protein, 11 aa, Influenza virus
SAASYKRVRLF

SEQ ID NO: 433069 - protein, 11 aa, Influenza virus
CVGYHANNSTK

SEQ ID NO: 433070 - protein, 11 aa, Influenza virus
IMRTVIALSYI

SEQ ID NO: 433071 - protein, 11 aa, Influenza virus
MMMGMFNMLST

SEQ ID NO: 433072 - protein, 11 aa, Influenza virus
QKILCTSATAL

SEQ ID NO: 433073 - protein, 11 aa, Influenza virus
SLQQIESMVEA

SEQ ID NO: 433074 - protein, 11 aa, Influenza virus
IASRSGYEMLK

SEQ ID NO: 433075 - protein, 11 aa, Influenza virus
SLCKVEGWVVV

SEQ ID NO: 433076 - protein, 11 aa, Influenza virus
AIDAGDGCFEI

SEQ ID NO: 433077 - protein, 11 aa, Influenza virus
KLTITYSSSLM

SEQ ID NO: 433078 - protein, 11 aa, Influenza virus
LTDWSGYSGSF

SEQ ID NO: 433079 - protein, 11 aa, Influenza virus
IMTDGPANSQA

SEQ ID NO: 433080 - protein, 11 aa, Influenza virus
LEKNVTVTHSI

SEQ ID NO: 433081 - protein, 11 aa, Influenza virus
SQFRALISWEM

SEQ ID NO: 433082 - protein, 11 aa, Influenza virus
YLIRTLTLNTM

SEQ ID NO: 433083 - protein, 11 aa, Influenza virus
LLGSSPNAYQA

SEQ ID NO: 433084 - protein, 11 aa, Influenza virus
CIGYHANNSKK

SEQ ID NO: 433085 - protein, 11 aa, Influenza virus
TLLMNELGVPL

SEQ ID NO: 433086 - protein, 11 aa, Influenza virus
ITRKLNRLIEK

SEQ ID NO: 433087 - protein, 11 aa, Influenza virus
LTDSQTATKRL

SEQ ID NO: 433088 - protein, 11 aa, Influenza virus
GPDPGVKGFAF

SEQ ID NO: 433089 - protein, 11 aa, Influenza virus
KEIILWFSFGA

SEQ ID NO: 433090 - protein, 11 aa, Influenza virus
AIDEGDGCFNL

SEQ ID NO: 433091 - protein, 11 aa, Influenza virus
RTISKDLRSGY

SEQ ID NO: 433092 - protein, 11 aa, Influenza virus
SSSIVMCGVNY

SEQ ID NO: 433093 - protein, 11 aa, Influenza virus
KLTITYSSSMM

SEQ ID NO: 433094 - protein, 11 aa, Influenza virus
SVAGWLLGNPL

SEQ ID NO: 433095 - protein, 11 aa, Influenza virus
LIMRTVIALSY

SEQ ID NO: 433096 - protein, 11 aa, Influenza virus
RTNGTSKVKMK

SEQ ID NO: 433097 - protein, 11 aa, Influenza virus
GYHANNSTDTI

SEQ ID NO: 433098 - protein, 11 aa, Influenza virus
GAFVAPDRVSF

SEQ ID NO: 433099 - protein, 11 aa, Influenza virus
SVPMGSSPNAY

SEQ ID NO: 433100 - protein, 11 aa, Influenza virus
FPFHKDNAIRL

SEQ ID NO: 433101 - protein, 11 aa, Influenza virus
ITEWSGYSGSF

SEQ ID NO: 433102 - protein, 11 aa, Influenza virus
RLSAGGDIWAT

SEQ ID NO: 433103 - protein, 11 aa, Influenza virus
TEDNIYKILSI

SEQ ID NO: 433104 - protein, 11 aa, Influenza virus
LEGFSAESRKL

SEQ ID NO: 433105 - protein, 11 aa, Influenza virus
YRILSIYSTVA

SEQ ID NO: 433106 - protein, 11 aa, Influenza virus
LRSRYWAIRTR

SEQ ID NO: 433107 - protein, 11 aa, Influenza virus
RTKSLESRRGF

SEQ ID NO: 433108 - protein, 11 aa, Influenza virus
IYSTVASSLVL

SEQ ID NO: 433109 - protein, 11 aa, Influenza virus
KTLDMHDANVK

SEQ ID NO: 433110 - protein, 11 aa, Influenza virus
GQFGRINFHWL

SEQ ID NO: 433111 - protein, 11 aa, Influenza virus
HLGDCSFEGWI

SEQ ID NO: 433112 - protein, 11 aa, Influenza virus
AYQKRMTRGLF

SEQ ID NO: 433113 - protein, 11 aa, Influenza virus
EMLTGNLQTLK

SEQ ID NO: 433114 - protein, 11 aa, Influenza virus
SQYRALVSWPL

SEQ ID NO: 433115 - protein, 11 aa, Influenza virus
ITGKLNRFIEK

SEQ ID NO: 433116 - protein, 11 aa, Influenza virus
NLIAPRGYFKI

SEQ ID NO: 433117 - protein, 11 aa, Influenza virus
TAKHIEECSSY

SEQ ID NO: 433118 - protein, 11 aa, Influenza virus
TIWTSSSSIVM

SEQ ID NO: 433119 - protein, 11 aa, Influenza virus
ILWISFAMSCF

SEQ ID NO: 433120 - protein, 11 aa, Influenza virus
ASYKRVRLFDY

SEQ ID NO: 433121 - protein, 11 aa, Influenza virus
LSFTVTGDNTK

SEQ ID NO: 433122 - protein, 11 aa, Influenza virus
MTEVWSYNAEF

SEQ ID NO: 433123 - protein, 11 aa, Influenza virus
PQCQVTGFAPF

SEQ ID NO: 433124 - protein, 11 aa, Influenza virus
ESNGNLIAPWY

SEQ ID NO: 433125 - protein, 11 aa, Influenza virus
LMEWIKTRPIL

SEQ ID NO: 433126 - protein, 11 aa, Influenza virus
IRALTLNTMTK

SEQ ID NO: 433127 - protein, 11 aa, Influenza virus
FEMLRIPNAGI

SEQ ID NO: 433128 - protein, 11 aa, Influenza virus
LSLAIMMAGIF

SEQ ID NO: 433129 - protein, 11 aa, Influenza virus
GLLISDGGPNL

SEQ ID NO: 433130 - protein, 11 aa, Influenza virus
AAMDDYQLIPM

SEQ ID NO: 433131 - protein, 11 aa, Influenza virus
WFSFGASSFVL

SEQ ID NO: 433132 - protein, 11 aa, Influenza virus
FRTLMSCPMGV

SEQ ID NO: 433133 - protein, 11 aa, Influenza virus
LRSGYWAIRTR

SEQ ID NO: 433134 - protein, 11 aa, Influenza virus
GLILGMQNGSY

SEQ ID NO: 433135 - protein, 11 aa, Influenza virus
TKMKAIIVVLL

SEQ ID NO: 433136 - protein, 11 aa, Influenza virus
VTGKSHGRILK

SEQ ID NO: 433137 - protein, 11 aa, Influenza virus
KGVKLSSMGVY

SEQ ID NO: 433138 - protein, 11 aa, Influenza virus
GRTSISCLYKL

SEQ ID NO: 433139 - protein, 11 aa, Influenza virus
GQWNWPDGAKI

SEQ ID NO: 433140 - protein, 11 aa, Influenza virus
LYVRTNGTSKI

SEQ ID NO: 433141 - protein, 11 aa, Influenza virus
TIRGRHSNGTI

SEQ ID NO: 433142 - protein, 11 aa, Influenza virus
VMTDGPANSQA

SEQ ID NO: 433143 - protein, 11 aa, Influenza virus
REFEVMNHEFS

SEQ ID NO: 433144 - protein, 11 aa, Influenza virus
CIASSIVLVGL

SEQ ID NO: 433145 - protein, 11 aa, Influenza virus
RTQESSCTCIK

SEQ ID NO: 433146 - protein, 11 aa, Influenza virus
QEIKMNPNQKI

SEQ ID NO: 433147 - protein, 11 aa, Influenza virus
SGRIDFHWLVL

SEQ ID NO: 433148 - protein, 11 aa, Influenza virus
MVGLILAFIMW

SEQ ID NO: 433149 - protein, 11 aa, Influenza virus
HTGTFCSINGK

SEQ ID NO: 433150 - protein, 11 aa, Influenza virus
SINTRLPFQNL

SEQ ID NO: 433151 - protein, 11 aa, Influenza virus
IEEPSHEGEGI

SEQ ID NO: 433152 - protein, 11 aa, Influenza virus
FLWISFAISCF

SEQ ID NO: 433153 - protein, 11 aa, Influenza virus
ERLTITYSSSM

SEQ ID NO: 433154 - protein, 11 aa, Influenza virus
YMLERELVRKT

SEQ ID NO: 433155 - protein, 11 aa, Influenza virus
NQVFPQLNQTY

SEQ ID NO: 433156 - protein, 11 aa, Influenza virus
TQVEELVHGGV

SEQ ID NO: 433157 - protein, 11 aa, Influenza virus
LRNDTDVVNFL

SEQ ID NO: 433158 - protein, 11 aa, Influenza virus
MIKAVRGDLNF

SEQ ID NO: 433159 - protein, 11 aa, Influenza virus
KRKTRGLFGAI

SEQ ID NO: 433160 - protein, 11 aa, Influenza virus
AIVSADPLASL

SEQ ID NO: 433161 - protein, 11 aa, Influenza virus
CIEGKLSQMPK

SEQ ID NO: 433162 - protein, 11 aa, Influenza virus
GQSGRIDFHWL

SEQ ID NO: 433163 - protein, 11 aa, Influenza virus
DLHDSNVKNLY

SEQ ID NO: 433164 - protein, 11 aa, Influenza virus
MTDSEMLNLYE

SEQ ID NO: 433165 - protein, 11 aa, Influenza virus
CIGYHANKSTK

SEQ ID NO: 433166 - protein, 11 aa, Influenza virus
HTGSFCSINGK

SEQ ID NO: 433167 - protein, 11 aa, Influenza virus
YVRQNTLKLAT

SEQ ID NO: 433168 - protein, 11 aa, Influenza virus
WMMAMKYPITA

SEQ ID NO: 433169 - protein, 11 aa, Influenza virus
IYSTISSSLVL

SEQ ID NO: 433170 - protein, 11 aa, Influenza virus
ILWISFAISCF

SEQ ID NO: 433171 - protein, 11 aa, Influenza virus
MLADRVDDAVT

SEQ ID NO: 433172 - protein, 11 aa, Influenza virus
IYSCIASSTVL

SEQ ID NO: 433173 - protein, 11 aa, Influenza virus
MTLDFHDSNVK

SEQ ID NO: 433174 - protein, 11 aa, Influenza virus
GTIVKTLTNEK

SEQ ID NO: 433175 - protein, 11 aa, Influenza virus
NPVHKSQLVWM

SEQ ID NO: 433176 - protein, 11 aa, Influenza virus
IQNEFNKACEL

SEQ ID NO: 433177 - protein, 11 aa, Influenza virus
RRYGPALSISE

SEQ ID NO: 433178 - protein, 11 aa, Influenza virus
SVGSSTYQNNF

SEQ ID NO: 433179 - protein, 11 aa, Influenza virus
LLRHFQKDAKM

SEQ ID NO: 433180 - protein, 11 aa, Influenza virus
NLQAYQKRMGV

SEQ ID NO: 433181 - protein, 11 aa, Influenza virus
SHPGIFGNSCL

SEQ ID NO: 433182 - protein, 11 aa, Influenza virus
ITYSSSLMWEI

SEQ ID NO: 433183 - protein, 11 aa, Influenza virus
TVSRTHQYSEK

SEQ ID NO: 433184 - protein, 11 aa, Influenza virus
KQTKTMTITFL

SEQ ID NO: 433185 - protein, 11 aa, Influenza virus
GLCTINSWHIF

SEQ ID NO: 433186 - protein, 11 aa, Influenza virus
VTDIWSYNAKL

SEQ ID NO: 433187 - protein, 11 aa, Influenza virus
QTNGNLIAPEY

SEQ ID NO: 433188 - protein, 11 aa, Influenza virus
LLNDRHSNGTI

SEQ ID NO: 433189 - protein, 11 aa, Influenza virus
KVEAVIYGNPK

SEQ ID NO: 433190 - protein, 11 aa, Influenza virus
STYQNSFVPVV

SEQ ID NO: 433191 - protein, 11 aa, Influenza virus
GRMTDSIKSWR

SEQ ID NO: 433192 - protein, 11 aa, Influenza virus
LPFQNIDSWAV

SEQ ID NO: 433193 - protein, 11 aa, Influenza virus
TLRGRHANGTM

SEQ ID NO: 433194 - protein, 11 aa, Influenza virus
NHTTINNITNV

SEQ ID NO: 433195 - protein, 11 aa, Influenza virus
KTLDKHDSNVK

SEQ ID NO: 433196 - protein, 11 aa, Influenza virus
SQYRALISWPL

SEQ ID NO: 433197 - protein, 11 aa, Influenza virus
VLLENGRTLDL

SEQ ID NO: 433198 - protein, 11 aa, Influenza virus
AISNRFQIQGV

SEQ ID NO: 433199 - protein, 11 aa, Influenza virus
APFSEDNSIRL

SEQ ID NO: 433200 - protein, 11 aa, Influenza virus
QLLRHFQKNAK

SEQ ID NO: 433201 - protein, 11 aa, Influenza virus
RTQESSCVCMK

SEQ ID NO: 433202 - protein, 11 aa, Influenza virus
CQITGFAPFSK

SEQ ID NO: 433203 - protein, 11 aa, Influenza virus
LAIYATVAGSL

SEQ ID NO: 433204 - protein, 11 aa, Influenza virus
WTGMIDGWYGY

SEQ ID NO: 433205 - protein, 11 aa, Influenza virus
ASYKRIRLFDY

SEQ ID NO: 433206 - protein, 11 aa, Influenza virus
TLVSNNDWSGY

SEQ ID NO: 433207 - protein, 11 aa, Influenza virus
LLNDKHSNGTI

SEQ ID NO: 433208 - protein, 11 aa, Influenza virus
KRQEIDGIKLK

SEQ ID NO: 433209 - protein, 11 aa, Influenza virus
AARNIVRRAAV

SEQ ID NO: 433210 - protein, 11 aa, Influenza virus
NPVHKSQLIWM

SEQ ID NO: 433211 - protein, 11 aa, Influenza virus
FIWAIHHPPTS

SEQ ID NO: 433212 - protein, 11 aa, Influenza virus
WMMAMRYPITA

SEQ ID NO: 433213 - protein, 11 aa, Influenza virus
ASICTHLEVCF

SEQ ID NO: 433214 - protein, 11 aa, Influenza virus
ETNHTGTYCSL

SEQ ID NO: 433215 - protein, 11 aa, Influenza virus
REESQLKRQEI

SEQ ID NO: 433216 - protein, 11 aa, Influenza virus
RTFFITQGSLL

SEQ ID NO: 433217 - protein, 11 aa, Influenza virus
RMFALSQGTTL

SEQ ID NO: 433218 - protein, 11 aa, Influenza virus
LLQSLQQIESM

SEQ ID NO: 433219 - protein, 11 aa, Influenza virus
WSWHDGAEITY

SEQ ID NO: 433220 - protein, 11 aa, Influenza virus
TVLVGLILAFI

SEQ ID NO: 433221 - protein, 11 aa, Influenza virus
SVSGWLLGNPM

SEQ ID NO: 433222 - protein, 11 aa, Influenza virus
QESECVCHNGI

SEQ ID NO: 433223 - protein, 11 aa, Influenza virus
GVRIGSKGDVF

SEQ ID NO: 433224 - protein, 11 aa, Influenza virus
RVAYERMCNIL

SEQ ID NO: 433225 - protein, 11 aa, Influenza virus
EQITFLQALQL

SEQ ID NO: 433226 - protein, 11 aa, Influenza virus
SLMWEINGPES

SEQ ID NO: 433227 - protein, 11 aa, Influenza virus
GSYVRLYLWGV

SEQ ID NO: 433228 - protein, 11 aa, Influenza virus
TSYRSLIRFPI

SEQ ID NO: 433229 - protein, 11 aa, Influenza virus
KHDRIPHRTLL

SEQ ID NO: 433230 - protein, 11 aa, Influenza virus
RSSSSFYAEMK

SEQ ID NO: 433231 - protein, 11 aa, Influenza virus
MFDFTKWNVTY

SEQ ID NO: 433232 - protein, 11 aa, Influenza virus
HQILAIYSTVA

SEQ ID NO: 433233 - protein, 11 aa, Influenza virus
YRALSIYSCIA

SEQ ID NO: 433234 - protein, 11 aa, Influenza virus
IATPGMQIRGF

SEQ ID NO: 433235 - protein, 11 aa, Influenza virus
WMMAMKYPITA

SEQ ID NO: 433236 - protein, 11 aa, Influenza virus
FLDVWTYNAEL

SEQ ID NO: 433237 - protein, 11 aa, Influenza virus
VLLENERTLDF

SEQ ID NO: 433238 - protein, 11 aa, Influenza virus
QTNTTLIENTY

SEQ ID NO: 433239 - protein, 11 aa, Influenza virus
RRATVSADPLA

SEQ ID NO: 433240 - protein, 11 aa, Influenza virus
SFFRNIVWLIK

SEQ ID NO: 433241 - protein, 11 aa, Influenza virus
TLVANNDWSGY

SEQ ID NO: 433242 - protein, 11 aa, Influenza virus
VAVAKDNAIRF

SEQ ID NO: 433243 - protein, 11 aa, Influenza virus
CISATGMTLSV

SEQ ID NO: 433244 - protein, 11 aa, Influenza virus
SGYSGSFTLPV

SEQ ID NO: 433245 - protein, 11 aa, Influenza virus
LMSELGVPFHL

SEQ ID NO: 433246 - protein, 11 aa, Influenza virus
TVKDRSPYRTL

SEQ ID NO: 433247 - protein, 11 aa, Influenza virus
SMEFSLTDPRF

SEQ ID NO: 433248 - protein, 11 aa, Influenza virus
LMSTPLGTPPT

SEQ ID NO: 433249 - protein, 11 aa, Influenza virus
TPDPGVKGFAF

SEQ ID NO: 433250 - protein, 11 aa, Influenza virus
RSNIFNMERIK

SEQ ID NO: 433251 - protein, 11 aa, Influenza virus
SVSSFEKFEIF

SEQ ID NO: 433252 - protein, 11 aa, Influenza virus
RTLDLHDANVK

SEQ ID NO: 433253 - protein, 11 aa, Influenza virus
FSISCFLLVAL

SEQ ID NO: 433254 - protein, 11 aa, Influenza virus
IYSTVASSSVL

SEQ ID NO: 433255 - protein, 11 aa, Influenza virus
VELSSGYKDVI

SEQ ID NO: 433256 - protein, 11 aa, Influenza virus
GLIAPSRVTKL

SEQ ID NO: 433257 - protein, 11 aa, Influenza virus
LMEWLKTRPIL

SEQ ID NO: 433258 - protein, 11 aa, Influenza virus
NINPVTLSSGY

SEQ ID NO: 433259 - protein, 11 aa, Influenza virus
WSYNAKLLVLI

SEQ ID NO: 433260 - protein, 11 aa, Influenza virus
GAHILVTREPY

SEQ ID NO: 433261 - protein, 11 aa, Influenza virus
VMVGLILAFIM

SEQ ID NO: 433262 - protein, 11 aa, Influenza virus
SRHCSKYHWNL

SEQ ID NO: 433263 - protein, 11 aa, Influenza virus
FRTLMSCPVGV

SEQ ID NO: 433264 - protein, 11 aa, Influenza virus
GSIENLEELRF

SEQ ID NO: 433265 - protein, 11 aa, Influenza virus
HLGDCNFEGWI

SEQ ID NO: 433266 - protein, 11 aa, Influenza virus
QIDQVKLSSGY

SEQ ID NO: 433267 - protein, 11 aa, Influenza virus
ALSQGTTIRGK

SEQ ID NO: 433268 - protein, 11 aa, Influenza virus
GAFIAPDRVSF

SEQ ID NO: 433269 - protein, 11 aa, Influenza virus
LSRCRETRGLF

SEQ ID NO: 433270 - protein, 11 aa, Influenza virus
ETCSALFVYSL

SEQ ID NO: 433271 - protein, 11 aa, Influenza virus
FEMLKIPNAGI

SEQ ID NO: 433272 - protein, 11 aa, Influenza virus
TEDNVYKVLSI

SEQ ID NO: 433273 - protein, 11 aa, Influenza virus
CISATGVTLSV

SEQ ID NO: 433274 - protein, 11 aa, Influenza virus
NWSGYSGSFTL

SEQ ID NO: 433275 - protein, 11 aa, Influenza virus
QLNQTYRNTRK

SEQ ID NO: 433276 - protein, 11 aa, Influenza virus
TIRNKHSNGTI

SEQ ID NO: 433277 - protein, 11 aa, Influenza virus
MCAAWSSSSCF

SEQ ID NO: 433278 - protein, 11 aa, Influenza virus
FVPVIGARPQV

SEQ ID NO: 433279 - protein, 11 aa, Influenza virus
YQILAIYATVA

SEQ ID NO: 433280 - protein, 11 aa, Influenza virus
LLAKSVFNCLY

SEQ ID NO: 433281 - protein, 11 aa, Influenza virus
FQHQNAEGTGM

SEQ ID NO: 433282 - protein, 11 aa, Influenza virus
WILGNPMCDEL

SEQ ID NO: 433283 - protein, 11 aa, Influenza virus
NRPWIRFNSDL

SEQ ID NO: 433284 - protein, 11 aa, Influenza virus
GESPSPYNSRF

SEQ ID NO: 433285 - protein, 11 aa, Influenza virus
LMNELGVPFYL

SEQ ID NO: 433286 - protein, 11 aa, Influenza virus
STVLVGLILAF

SEQ ID NO: 433287 - protein, 11 aa, Influenza virus
SRYSKADKICI

SEQ ID NO: 433288 - protein, 11 aa, Influenza virus
SIKKYERVKMF

SEQ ID NO: 433289 - protein, 11 aa, Influenza virus
LSLYSTVASSL

SEQ ID NO: 433290 - protein, 11 aa, Influenza virus
SHMECRTFFLT

SEQ ID NO: 433291 - protein, 11 aa, Influenza virus
RTISTASRSGY

SEQ ID NO: 433292 - protein, 11 aa, Influenza virus
SGYSGAFTIPV

SEQ ID NO: 433293 - protein, 11 aa, Influenza virus
WSKPQCQITGF

SEQ ID NO: 433294 - protein, 11 aa, Influenza virus
TRLPFQNLSPR

SEQ ID NO: 433295 - protein, 11 aa, Influenza virus
MINPVKLSSGY

SEQ ID NO: 433296 - protein, 11 aa, Influenza virus
EQITFIQALQL

SEQ ID NO: 433297 - protein, 11 aa, Influenza virus
IRFNSDLDYQI

SEQ ID NO: 433298 - protein, 11 aa, Influenza virus
TLIENTYVNNT

SEQ ID NO: 433299 - protein, 11 aa, Influenza virus
PQCEITGFAPF

SEQ ID NO: 433300 - protein, 11 aa, Influenza virus
FIFLLLTHWAY

SEQ ID NO: 433301 - protein, 11 aa, Influenza virus
ESNGGLIAPRY

SEQ ID NO: 433302 - protein, 11 aa, Influenza virus
WSYNAKLLVLL

SEQ ID NO: 433303 - protein, 11 aa, Influenza virus
VVIAQDNAIRF

SEQ ID NO: 433304 - protein, 11 aa, Influenza virus
MFDFIKWNVTY

SEQ ID NO: 433305 - protein, 11 aa, Influenza virus
VESAVLRGFLI

SEQ ID NO: 433306 - protein, 11 aa, Influenza virus
GMVDGWYGYHH

SEQ ID NO: 433307 - protein, 11 aa, Influenza virus
EAHILVTREPY

SEQ ID NO: 433308 - protein, 11 aa, Influenza virus
RRFVQNALNGN

SEQ ID NO: 433309 - protein, 11 aa, Influenza virus
ESNGGLLAPKY

SEQ ID NO: 433310 - protein, 11 aa, Influenza virus
TEDNVYKILSI

SEQ ID NO: 433311 - protein, 11 aa, Influenza virus
VMVGLILAFIM

SEQ ID NO: 433312 - protein, 11 aa, Influenza virus
RSRSSFYAEMK

SEQ ID NO: 433313 - protein, 11 aa, Influenza virus
KQFELIDNEFT

SEQ ID NO: 433314 - protein, 11 aa, Influenza virus
AINSRFQIQGV

SEQ ID NO: 433315 - protein, 11 aa, Influenza virus
KLITVGSSKYR

SEQ ID NO: 433316 - protein, 11 aa, Influenza virus
SSMPFHNVHPL

SEQ ID NO: 433317 - protein, 11 aa, Influenza virus
LVALCGSPISV

SEQ ID NO: 433318 - protein, 11 aa, Influenza virus
ITYSSPMMWEI

SEQ ID NO: 433319 - protein, 11 aa, Influenza virus
MMSRARIDARI

SEQ ID NO: 433320 - protein, 11 aa, Influenza virus
TLFEKFFPSSS

SEQ ID NO: 433321 - protein, 11 aa, Influenza virus
ISCFLLVALLI

SEQ ID NO: 433322 - protein, 11 aa, Influenza virus
EVILWFSFGAS

SEQ ID NO: 433323 - protein, 11 aa, Influenza virus
STSCHDGVSRM

SEQ ID NO: 433324 - protein, 11 aa, Influenza virus
FQHQNAEGTGI

SEQ ID NO: 433325 - protein, 11 aa, Influenza virus
SIQTRGLFGAI

SEQ ID NO: 433326 - protein, 11 aa, Influenza virus
GPVHFRNQVKI

SEQ ID NO: 433327 - protein, 11 aa, Influenza virus
TLVSNSDWSGY

SEQ ID NO: 433328 - protein, 11 aa, Influenza virus
ITDIWAYNAEL

SEQ ID NO: 433329 - protein, 11 aa, Influenza virus
VSFSISCFLLV

SEQ ID NO: 433330 - protein, 11 aa, Influenza virus
TTGKSHGRILK

SEQ ID NO: 433331 - protein, 11 aa, Influenza virus
AYQILAIYATV

SEQ ID NO: 433332 - protein, 11 aa, Influenza virus
FSFGASCFLLI

SEQ ID NO: 433333 - protein, 11 aa, Influenza virus
VLIENDRTLDL

SEQ ID NO: 433334 - protein, 11 aa, Influenza virus
WHASNRPWISF

SEQ ID NO: 433335 - protein, 11 aa, Influenza virus
FVPVVGDRPLV

SEQ ID NO: 433336 - protein, 11 aa, Influenza virus
YESTQAAIDQI

SEQ ID NO: 433337 - protein, 11 aa, Influenza virus
KTNGNLIAPEY

SEQ ID NO: 433338 - protein, 11 aa, Influenza virus
IENPSHEGEGI

SEQ ID NO: 433339 - protein, 11 aa, Influenza virus
KMNIQILILAL

SEQ ID NO: 433340 - protein, 11 aa, Influenza virus
KQGSLKLATGM

SEQ ID NO: 433341 - protein, 11 aa, Influenza virus
YVDGFEPNGSI

SEQ ID NO: 433342 - protein, 11 aa, Influenza virus
SPYRALMSVPL

SEQ ID NO: 433343 - protein, 11 aa, Influenza virus
RILSIYSTVAA

SEQ ID NO: 433344 - protein, 11 aa, Influenza virus
SFFRNVVWLIK

SEQ ID NO: 433345 - protein, 11 aa, Influenza virus
RPPVNGQSGRI

SEQ ID NO: 433346 - protein, 11 aa, Influenza virus
WHASNRPWVSF

SEQ ID NO: 433347 - protein, 11 aa, Influenza virus
EVVNATETVEI

SEQ ID NO: 433348 - protein, 11 aa, Influenza virus
SSMPFHNIHPL

SEQ ID NO: 433349 - protein, 11 aa, Influenza virus
YRIWSKPQCQI

SEQ ID NO: 433350 - protein, 11 aa, Influenza virus
KLSGGYKDIIL

SEQ ID NO: 433351 - protein, 11 aa, Influenza virus
RFRRPDSSWLF

SEQ ID NO: 433352 - protein, 11 aa, Influenza virus
TGYEKNATASF

SEQ ID NO: 433353 - protein, 11 aa, Influenza virus
IHDRTAFRGLM

SEQ ID NO: 433354 - protein, 11 aa, Influenza virus
GPVHFRNQIKI

SEQ ID NO: 433355 - protein, 11 aa, Influenza virus
NTDLEALMEWL

SEQ ID NO: 433356 - protein, 11 aa, Influenza virus
GIHHPSSTKEK

SEQ ID NO: 433357 - protein, 11 aa, Influenza virus
FQNVNRITYGV

SEQ ID NO: 433358 - protein, 11 aa, Influenza virus
SIKKYERVKMF

SEQ ID NO: 433359 - protein, 11 aa, Influenza virus
SQYRSLISWPL

SEQ ID NO: 433360 - protein, 11 aa, Influenza virus
KQESLLLATGM

SEQ ID NO: 433361 - protein, 11 aa, Influenza virus
GYLSNNSTDKI

SEQ ID NO: 433362 - protein, 11 aa, Influenza virus
RIRMATNECRI

SEQ ID NO: 433363 - protein, 11 aa, Influenza virus
EQMYQKCCSLF

SEQ ID NO: 433364 - protein, 11 aa, Influenza virus
QEELRFLFSSI

SEQ ID NO: 433365 - protein, 11 aa, Influenza virus
SAKHVEECSCY

SEQ ID NO: 433366 - protein, 11 aa, Influenza virus
DLWSYNAGLLV

SEQ ID NO: 433367 - protein, 11 aa, Influenza virus
KIITIGSVSLI

SEQ ID NO: 433368 - protein, 11 aa, Influenza virus
WTGMVNGWYGY

SEQ ID NO: 433369 - protein, 11 aa, Influenza virus
LWISFAMSCFL

SEQ ID NO: 433370 - protein, 11 aa, Influenza virus
LISKTNQQFEL

SEQ ID NO: 433371 - protein, 11 aa, Influenza virus
SMMWEINGPES

SEQ ID NO: 433372 - protein, 11 aa, Influenza virus
WSGYSGAFMDY

SEQ ID NO: 433373 - protein, 11 aa, Influenza virus
RTISMDSRSGY

SEQ ID NO: 433374 - protein, 11 aa, Influenza virus
KLKRQEINGIK

SEQ ID NO: 433375 - protein, 11 aa, Influenza virus
YHNSFVPVVGA

SEQ ID NO: 433376 - protein, 11 aa, Influenza virus
YQFALGQGTTL

SEQ ID NO: 433377 - protein, 11 aa, Influenza virus
SQLKRQEIEGI

SEQ ID NO: 433378 - protein, 11 aa, Influenza virus
WVSFSISCFLL

SEQ ID NO: 433379 - protein, 11 aa, Influenza virus
IGYHANNSTEM

SEQ ID NO: 433380 - protein, 11 aa, Influenza virus
REFEVVNHEFS

SEQ ID NO: 433381 - protein, 11 aa, Influenza virus
VTDVWSYNAKL

SEQ ID NO: 433382 - protein, 11 aa, Influenza virus
VYKVLAIYSCI

SEQ ID NO: 433383 - protein, 11 aa, Influenza virus
VVLVGLILAFI

SEQ ID NO: 433384 - protein, 11 aa, Influenza virus
NPNQKILFASA

SEQ ID NO: 433385 - protein, 11 aa, Influenza virus
VVIEKDNAVRF

SEQ ID NO: 433386 - protein, 11 aa, Influenza virus
ITGKLNRLIEK

SEQ ID NO: 433387 - protein, 11 aa, Influenza virus
RRQLRENAEDK

SEQ ID NO: 433388 - protein, 11 aa, Influenza virus
LRSILASSGSL

SEQ ID NO: 433389 - protein, 11 aa, Influenza virus
FIFILLTHWAY

SEQ ID NO: 433390 - protein, 11 aa, Influenza virus
VWWTSNSIIVF

SEQ ID NO: 433391 - protein, 11 aa, Influenza virus
SIAPIMFSNKM

SEQ ID NO: 433392 - protein, 11 aa, Influenza virus
WTGLIDGWYGY

SEQ ID NO: 433393 - protein, 11 aa, Influenza virus
KIIRVGCVILL

SEQ ID NO: 433394 - protein, 11 aa, Influenza virus
IEKTNTEFESI

SEQ ID NO: 433395 - protein, 11 aa, Influenza virus
SIRGEFNQVEK

SEQ ID NO: 433396 - protein, 11 aa, Influenza virus
RTISKDSRSGY

SEQ ID NO: 433397 - protein, 11 aa, Influenza virus
HPSSAQEKNDL

SEQ ID NO: 433398 - protein, 11 aa, Influenza virus
STKEWSRRYEL

SEQ ID NO: 433399 - protein, 11 aa, Influenza virus
MIWDANGWVST

SEQ ID NO: 433400 - protein, 11 aa, Influenza virus
GIITDTLKSWK

SEQ ID NO: 433401 - protein, 11 aa, Influenza virus
AAMEDFQLIPM

SEQ ID NO: 433402 - protein, 11 aa, Influenza virus
KISKRGSSGIM

SEQ ID NO: 433403 - protein, 11 aa, Influenza virus
YIIEKYGTGRI

SEQ ID NO: 433404 - protein, 11 aa, Influenza virus
GIAADKVSTQK

SEQ ID NO: 433405 - protein, 11 aa, Influenza virus
YQFALGQGTTL

SEQ ID NO: 433406 - protein, 11 aa, Influenza virus
PQCKITGFAPF

SEQ ID NO: 433407 - protein, 11 aa, Influenza virus
AEIAQRLEDVF

SEQ ID NO: 433408 - protein, 11 aa, Influenza virus
RMQFSSLTVSV

SEQ ID NO: 433409 - protein, 11 aa, Influenza virus
LVALCGSPVSV

SEQ ID NO: 433410 - protein, 11 aa, Influenza virus
ISKSTKSTVLK

SEQ ID NO: 433411 - protein, 11 aa, Influenza virus
RSIIFNMERIK

SEQ ID NO: 433412 - protein, 11 aa, Influenza virus
LKDCSVAGWLL

SEQ ID NO: 433413 - protein, 11 aa, Influenza virus
SLFSSIKRYER

SEQ ID NO: 433414 - protein, 11 aa, Influenza virus
FLDIWTYNAEL

SEQ ID NO: 433415 - protein, 11 aa, Influenza virus
VMVVYAELLVA

SEQ ID NO: 433416 - protein, 11 aa, Influenza virus
STYQNNFVPVM

SEQ ID NO: 433417 - protein, 11 aa, Influenza virus
GAFVAPDRVSF

SEQ ID NO: 433418 - protein, 11 aa, Influenza virus
RLSAGGHIWVT

SEQ ID NO: 433419 - protein, 11 aa, Influenza virus
TILETGYVCGK

SEQ ID NO: 433420 - protein, 11 aa, Influenza virus
KSYFANLKGTR

SEQ ID NO: 433421 - protein, 11 aa, Influenza virus
LRFLFSSIKKY

SEQ ID NO: 433422 - protein, 11 aa, Influenza virus
ITFMQALQLLL

SEQ ID NO: 433423 - protein, 11 aa, Influenza virus
ESIAWSATACH

SEQ ID NO: 433424 - protein, 11 aa, Influenza virus
IASVPASRYLI

SEQ ID NO: 433425 - protein, 11 aa, Influenza virus
MSCFVFVALIL

SEQ ID NO: 433426 - protein, 11 aa, Influenza virus
RLAAGGDIWVT

SEQ ID NO: 433427 - protein, 11 aa, Influenza virus
APFSKDNGIRI

SEQ ID NO: 433428 - protein, 11 aa, Influenza virus
RRKKRGLFGAI

SEQ ID NO: 433429 - protein, 11 aa, Influenza virus
IMTIGSVSLAL

SEQ ID NO: 433430 - protein, 11 aa, Influenza virus
ETKCQTPLGAI

SEQ ID NO: 433431 - protein, 11 aa, Influenza virus
CVLEAMAFLEK

SEQ ID NO: 433432 - protein, 11 aa, Influenza virus
RQCFNPMIIEL

SEQ ID NO: 433433 - protein, 11 aa, Influenza virus
MINPVKLSSGY

SEQ ID NO: 433434 - protein, 11 aa, Influenza virus
ISCSVSECRTF

SEQ ID NO: 433435 - protein, 11 aa, Influenza virus
CIASSVVLVGL

SEQ ID NO: 433436 - protein, 11 aa, Influenza virus
YTIDEESRARI

SEQ ID NO: 433437 - protein, 11 aa, Influenza virus
LLAIAMGLIFM

SEQ ID NO: 433438 - protein, 11 aa, Influenza virus
LMVAYMLEREL

SEQ ID NO: 433439 - protein, 11 aa, Influenza virus
YVKQKTLKLAT

SEQ ID NO: 433440 - protein, 11 aa, Influenza virus
IRMAINWGRIV

SEQ ID NO: 433441 - protein, 11 aa, Influenza virus
FVENLEELRFV

SEQ ID NO: 433442 - protein, 11 aa, Influenza virus
MIRGQPKEKTI

SEQ ID NO: 433443 - protein, 11 aa, Influenza virus
HLKDQGWSYIV

SEQ ID NO: 433444 - protein, 11 aa, Influenza virus
AYQKQMTRGLF

SEQ ID NO: 433445 - protein, 11 aa, Influenza virus
ATNLYVNKNPY

SEQ ID NO: 433446 - protein, 11 aa, Influenza virus
CIASSTVLVGL

SEQ ID NO: 433447 - protein, 11 aa, Influenza virus
FSISCFLLIAL

SEQ ID NO: 433448 - protein, 11 aa, Influenza virus
RTISKDLRSGY

SEQ ID NO: 433449 - protein, 11 aa, Influenza virus
LLRHFQKDAKI

SEQ ID NO: 433450 - protein, 11 aa, Influenza virus
NSDWSGYSGSF

SEQ ID NO: 433451 - protein, 11 aa, Influenza virus
DLTDSEMSKLY

SEQ ID NO: 433452 - protein, 11 aa, Influenza virus
LPFHNIHPLTI

SEQ ID NO: 433453 - protein, 11 aa, Influenza virus
ESNGNLVAPWY

SEQ ID NO: 433454 - protein, 11 aa, Influenza virus
KLERSKINEVK

SEQ ID NO: 433455 - protein, 11 aa, Influenza virus
ATNINIREWSY

SEQ ID NO: 433456 - protein, 11 aa, Influenza virus
WTGMVDGWYGY

SEQ ID NO: 433457 - protein, 11 aa, Influenza virus
ATRLYVNKNPY

SEQ ID NO: 433458 - protein, 11 aa, Influenza virus
ITEWSGYSGSF

SEQ ID NO: 433459 - protein, 11 aa, Influenza virus
VSSSLVLAGLI

SEQ ID NO: 433460 - protein, 11 aa, Influenza virus
LWISFSISCFL

SEQ ID NO: 433461 - protein, 11 aa, Influenza virus
KMEAILVVLLY

SEQ ID NO: 433462 - protein, 11 aa, Influenza virus
WMCSNGSLQSK

SEQ ID NO: 433463 - protein, 11 aa, Influenza virus
VYKVLSIYSCI

SEQ ID NO: 433464 - protein, 11 aa, Influenza virus
IYRDEAINNRI

SEQ ID NO: 433465 - protein, 11 aa, Influenza virus
WRGANRPVITI

SEQ ID NO: 433466 - protein, 11 aa, Influenza virus
NEIEQQIGNVI

SEQ ID NO: 433467 - protein, 11 aa, Influenza virus
IEKMNGNYDSI

SEQ ID NO: 433468 - protein, 11 aa, Influenza virus
RTFQNIDRNAL

SEQ ID NO: 433469 - protein, 11 aa, Influenza virus
EGRRRTNLYGF

SEQ ID NO: 433470 - protein, 11 aa, Influenza virus
TTFPYTGDPPY

SEQ ID NO: 433471 - protein, 11 aa, Influenza virus
MMIWHSNLNDT

SEQ ID NO: 433472 - protein, 11 aa, Influenza virus
KNTDLEVLMEW

SEQ ID NO: 433473 - protein, 11 aa, Influenza virus
KLSSGYKDIIL

SEQ ID NO: 433474 - protein, 11 aa, Influenza virus
NPSLRMKWMMA

SEQ ID NO: 433475 - protein, 11 aa, Influenza virus
APEGMCYPGSI

SEQ ID NO: 433476 - protein, 11 aa, Influenza virus
MFDFSKWNVTY

SEQ ID NO: 433477 - protein, 11 aa, Influenza virus
RRAIVSADPLA

SEQ ID NO: 433478 - protein, 11 aa, Influenza virus
RTQESSCVCVK

SEQ ID NO: 433479 - protein, 11 aa, Influenza virus
QSRMQFSSLAV

SEQ ID NO: 433480 - protein, 11 aa, Influenza virus
SSMPFHNIHPL

SEQ ID NO: 433481 - protein, 11 aa, Influenza virus
FRNVLSIAPIM

SEQ ID NO: 433482 - protein, 11 aa, Influenza virus
IVWGVHHSSSL

SEQ ID NO: 433483 - protein, 11 aa, Influenza virus
QIDPVKLSGGY

SEQ ID NO: 433484 - protein, 11 aa, Influenza virus
MIKRGINDRNF

SEQ ID NO: 433485 - protein, 11 aa, Influenza virus
CSIWFSHYNQM

SEQ ID NO: 433486 - protein, 11 aa, Influenza virus
NPALRMKWMMA

SEQ ID NO: 433487 - protein, 11 aa, Influenza virus
KMTITFLILLF

SEQ ID NO: 433488 - protein, 11 aa, Influenza virus
PQCQITGFAPF

SEQ ID NO: 433489 - protein, 11 aa, Influenza virus
SHLECRTFFLA

SEQ ID NO: 433490 - protein, 11 aa, Influenza virus
TISSSLVLVGL

SEQ ID NO: 433491 - protein, 11 aa, Influenza virus
KMNTQILIFTL

SEQ ID NO: 433492 - protein, 11 aa, Influenza virus
NQITGKLNRII

SEQ ID NO: 433493 - protein, 11 aa, Influenza virus
GPANKQASYKI

SEQ ID NO: 433494 - protein, 11 aa, Influenza virus
LRSKYWAIRTR

SEQ ID NO: 433495 - protein, 11 aa, Influenza virus
VYKILSIYSCI

SEQ ID NO: 433496 - protein, 11 aa, Influenza virus
QIDPVKLSSGY

SEQ ID NO: 433497 - protein, 11 aa, Influenza virus
GMMMGMFNMLS

SEQ ID NO: 433498 - protein, 11 aa, Influenza virus
TIHDRSPFRAL

SEQ ID NO: 433499 - protein, 11 aa, Influenza virus
LLAKSVFNNLY

SEQ ID NO: 433500 - protein, 11 aa, Influenza virus
FQHRNEEGTGI

SEQ ID NO: 433501 - protein, 11 aa, Influenza virus
ESNGNFIAPEY

SEQ ID NO: 433502 - protein, 11 aa, Influenza virus
YSKADKICIGY

SEQ ID NO: 433503 - protein, 11 aa, Influenza virus
LLAKSVFNSLY

SEQ ID NO: 433504 - protein, 11 aa, Influenza virus
RSPYRTLMSVK

SEQ ID NO: 433505 - protein, 11 aa, Influenza virus
WSYNAELLVAL

SEQ ID NO: 433506 - protein, 11 aa, Influenza virus
VACSPSECRTF

SEQ ID NO: 433507 - protein, 11 aa, Influenza virus
RSPFRTLMSVK

SEQ ID NO: 433508 - protein, 11 aa, Influenza virus
FQHQNEQGMGM

SEQ ID NO: 433509 - protein, 11 aa, Influenza virus
VLKPGQTVKIK

SEQ ID NO: 433510 - protein, 11 aa, Influenza virus
IASSVVLVGLI

SEQ ID NO: 433511 - protein, 11 aa, Influenza virus
RATEYMMKGVY

SEQ ID NO: 433512 - protein, 11 aa, Influenza virus
ISCSYLECRTF

SEQ ID NO: 433513 - protein, 11 aa, Influenza virus
SECVCHNSTCV

SEQ ID NO: 433514 - protein, 11 aa, Influenza virus
WSWHDGAEITY

SEQ ID NO: 433515 - protein, 11 aa, Influenza virus
STYQNNFVPVV

SEQ ID NO: 433516 - protein, 11 aa, Influenza virus
RRQILRTQESS

SEQ ID NO: 433517 - protein, 11 aa, Influenza virus
TLVSNNDWSGY

SEQ ID NO: 433518 - protein, 11 aa, Influenza virus
IISMCSSTEFL

SEQ ID NO: 433519 - protein, 11 aa, Influenza virus
RLSAGGAIWVT

SEQ ID NO: 433520 - protein, 11 aa, Influenza virus
SVASSLVLLFM

SEQ ID NO: 433521 - protein, 11 aa, Influenza virus
RRAEIIKMESA

SEQ ID NO: 433522 - protein, 11 aa, Influenza virus
YRSWSKPQCQI

SEQ ID NO: 433523 - protein, 11 aa, Influenza virus
ILKDCSIAGWL

SEQ ID NO: 433524 - protein, 11 aa, Influenza virus
GHDFEREGYSL

SEQ ID NO: 433525 - protein, 11 aa, Influenza virus
YLIEDPAAPHG

SEQ ID NO: 433526 - protein, 11 aa, Influenza virus
IVNTTLSTIAL

SEQ ID NO: 433527 - protein, 11 aa, Influenza virus
NRPWVSFDQNL

SEQ ID NO: 433528 - protein, 11 aa, Influenza virus
NQSPRMFLAMI

SEQ ID NO: 433529 - protein, 11 aa, Influenza virus
AINNRFQIQGV

SEQ ID NO: 433530 - protein, 11 aa, Influenza virus
LWISFAISCFL

SEQ ID NO: 433531 - protein, 11 aa, Influenza virus
NQNPRVFLAMI

SEQ ID NO: 433532 - protein, 11 aa, Influenza virus
GRFYIQMCTEL

SEQ ID NO: 433533 - protein, 11 aa, Influenza virus
VSCSHLECRTF

SEQ ID NO: 433534 - protein, 11 aa, Influenza virus
CHSAAFEDLRL

SEQ ID NO: 433535 - protein, 11 aa, Influenza virus
FPFHKDNAIRL

SEQ ID NO: 433536 - protein, 11 aa, Influenza virus
MEEVTNATETV

SEQ ID NO: 433537 - protein, 11 aa, Influenza virus
TIGDCPKYVNV

SEQ ID NO: 433538 - protein, 11 aa, Influenza virus
CRTFFLTHGAL

SEQ ID NO: 433539 - protein, 11 aa, Influenza virus
QEELRSLFSSI

SEQ ID NO: 433540 - protein, 11 aa, Influenza virus
GQFPVQTDEYK

SEQ ID NO: 433541 - protein, 11 aa, Influenza virus
SAKHIEECSCY

SEQ ID NO: 433542 - protein, 11 aa, Influenza virus
GRMSDSIKSWR

SEQ ID NO: 433543 - protein, 11 aa, Influenza virus
YQILAIYATVA

SEQ ID NO: 433544 - protein, 11 aa, Influenza virus
REWSYIVERTK

SEQ ID NO: 433545 - protein, 11 aa, Influenza virus
VQNEFNKACEL

SEQ ID NO: 433546 - protein, 11 aa, Influenza virus
IAASYKRIRLF

SEQ ID NO: 433547 - protein, 11 aa, Influenza virus
IQAGVDRFYRI

SEQ ID NO: 433548 - protein, 11 aa, Influenza virus
IQNIWAYNAEL

SEQ ID NO: 433549 - protein, 11 aa, Influenza virus
LQNTSKHYIGK

SEQ ID NO: 433550 - protein, 11 aa, Influenza virus
FVNITNVQNNY

SEQ ID NO: 433551 - protein, 11 aa, Influenza virus
QLFIKDYRYTY

SEQ ID NO: 433552 - protein, 11 aa, Influenza virus
RTVGQCPKYVK

SEQ ID NO: 433553 - protein, 11 aa, Influenza virus
WSWDDGAILPL

SEQ ID NO: 433554 - protein, 11 aa, Influenza virus
FRTLMSCPIGV

SEQ ID NO: 433555 - protein, 11 aa, Influenza virus
NVKVTHRENLL

SEQ ID NO: 433556 - protein, 11 aa, Influenza virus
YGKGRIFQSHI

SEQ ID NO: 433557 - protein, 11 aa, Influenza virus
AHALKLVVAML

SEQ ID NO: 433558 - protein, 11 aa, Influenza virus
WSGYSGSFIDY

SEQ ID NO: 433559 - protein, 11 aa, Influenza virus
EQMYQKCCTLF

SEQ ID NO: 433560 - protein, 11 aa, Influenza virus
SLAVNVRGSGM

SEQ ID NO: 433561 - protein, 11 aa, Influenza virus
CIVPCFWLEMI

SEQ ID NO: 433562 - protein, 11 aa, Influenza virus
FQHQNAEGIGI

SEQ ID NO: 433563 - protein, 11 aa, Influenza virus
IAMGLIFMCVK

SEQ ID NO: 433564 - protein, 11 aa, Influenza virus
REFEVVDHEFS

SEQ ID NO: 433565 - protein, 11 aa, Influenza virus
LRELWQCYYLL

SEQ ID NO: 433566 - protein, 11 aa, Influenza virus
AIDNGDGCFEI

SEQ ID NO: 433567 - protein, 11 aa, Influenza virus
GRQTYDWTLNR

SEQ ID NO: 433568 - protein, 11 aa, Influenza virus
FYIQMCTELKL

SEQ ID NO: 433569 - protein, 11 aa, Influenza virus
HLRDQGWSYIV

SEQ ID NO: 433570 - protein, 11 aa, Influenza virus
SGRIDFHWLIL

SEQ ID NO: 433571 - protein, 11 aa, Influenza virus
GSYNNTSGKQM

SEQ ID NO: 433572 - protein, 11 aa, Influenza virus
HPSSTKEKNDL

SEQ ID NO: 433573 - protein, 11 aa, Influenza virus
FPFHKGNSARL

SEQ ID NO: 433574 - protein, 11 aa, Influenza virus
LEVGTRWMKII

SEQ ID NO: 433575 - protein, 11 aa, Influenza virus
LHLTGIWDTLI

SEQ ID NO: 433576 - protein, 11 aa, Influenza virus
KMYALHQGTTI

SEQ ID NO: 433577 - protein, 11 aa, Influenza virus
KRLTTTIKTWA

SEQ ID NO: 433578 - protein, 11 aa, Influenza virus
FELIDNEFTEV

SEQ ID NO: 433579 - protein, 11 aa, Influenza virus
REQQGRMDYYW

SEQ ID NO: 433580 - protein, 11 aa, Influenza virus
MLLDPGDTVTF

SEQ ID NO: 433581 - protein, 11 aa, Influenza virus
NLFTLSGVAIA

SEQ ID NO: 433582 - protein, 11 aa, Influenza virus
TIIETGYVCSK

SEQ ID NO: 433583 - protein, 11 aa, Influenza virus
WSWHDGAEIIY

SEQ ID NO: 433584 - protein, 11 aa, Influenza virus
LLQSAILSLQT

SEQ ID NO: 433585 - protein, 11 aa, Influenza virus
IESIIEAESSV

SEQ ID NO: 433586 - protein, 11 aa, Influenza virus
YQILAIYSTAA

SEQ ID NO: 433587 - protein, 11 aa, Influenza virus
TLVANNDWSGY

SEQ ID NO: 433588 - protein, 11 aa, Influenza virus
GQSGRIDFHWM

SEQ ID NO: 433589 - protein, 11 aa, Influenza virus
RQCFNPMTVEL

SEQ ID NO: 433590 - protein, 11 aa, Influenza virus
VPILNTSQRGI

SEQ ID NO: 433591 - protein, 11 aa, Influenza virus
GRYSKADKICI

SEQ ID NO: 433592 - protein, 11 aa, Influenza virus
NRPWISFDQNL

SEQ ID NO: 433593 - protein, 11 aa, Influenza virus
PSSAQEKNDLY

SEQ ID NO: 433594 - protein, 11 aa, Influenza virus
GSWPDGANISF

SEQ ID NO: 433595 - protein, 11 aa, Influenza virus
IHDRSQYRALI

SEQ ID NO: 433596 - protein, 11 aa, Influenza virus
GRFYVQMCTEL

SEQ ID NO: 433597 - protein, 11 aa, Influenza virus
RTISRDSRSGY

SEQ ID NO: 433598 - protein, 11 aa, Influenza virus
EQMYQRCCNLF

SEQ ID NO: 433599 - protein, 11 aa, Influenza virus
VASSLVLLFMI

SEQ ID NO: 433600 - protein, 11 aa, Influenza virus
EEDGTGCFEIL

SEQ ID NO: 433601 - protein, 11 aa, Influenza virus
YRNNRKEPALI

SEQ ID NO: 433602 - protein, 11 aa, Influenza virus
ELRFLFSSIKK

SEQ ID NO: 433603 - protein, 11 aa, Influenza virus
GAFIAPDRATF

SEQ ID NO: 433604 - protein, 11 aa, Influenza virus
RQCFNPMVVEL

SEQ ID NO: 433605 - protein, 11 aa, Influenza virus
ESNGNLIAPEY

SEQ ID NO: 433606 - protein, 11 aa, Influenza virus
QEELKSLFSSI

SEQ ID NO: 433607 - protein, 11 aa, Influenza virus
NQNPRVFLTMI

SEQ ID NO: 433608 - protein, 11 aa, Influenza virus
DTIIFEANGNL

SEQ ID NO: 433609 - protein, 11 aa, Influenza virus
EVCFMYSDFHF

SEQ ID NO: 433610 - protein, 11 aa, Influenza virus
SAASYKRIRLF

SEQ ID NO: 433611 - protein, 11 aa, Influenza virus
LRSILASSGSL

SEQ ID NO: 433612 - protein, 11 aa, Influenza virus
RGNQGVKGWAF

SEQ ID NO: 433613 - protein, 11 aa, Influenza virus
DLYLNGREWSY

SEQ ID NO: 433614 - protein, 11 aa, Influenza virus
FQHQNSEGTGI

SEQ ID NO: 433615 - protein, 11 aa, Influenza virus
MFSNKMARLGK

SEQ ID NO: 433616 - protein, 11 aa, Influenza virus
SSMGVYQILAI

SEQ ID NO: 433617 - protein, 11 aa, Influenza virus
WSYNAELLVAI

SEQ ID NO: 433618 - protein, 11 aa, Influenza virus
CIEGKLSQMSK

SEQ ID NO: 433619 - protein, 11 aa, Influenza virus
WSWPDGALLPL

SEQ ID NO: 433620 - protein, 11 aa, Influenza virus
KMPASRYLTDM

SEQ ID NO: 433621 - protein, 11 aa, Influenza virus
RLYVNKNPYTL

SEQ ID NO: 433622 - protein, 11 aa, Influenza virus
GPANSQASYKI

SEQ ID NO: 433623 - protein, 11 aa, Influenza virus
ILGNPKCDPYL

SEQ ID NO: 433624 - protein, 11 aa, Influenza virus
QRLNPMHQLLR

SEQ ID NO: 433625 - protein, 11 aa, Influenza virus
QEFKMNPNKKI

SEQ ID NO: 433626 - protein, 11 aa, Influenza virus
FRHQNAQGEGI

SEQ ID NO: 433627 - protein, 11 aa, Influenza virus
KITVDHMAIIK

SEQ ID NO: 433628 - protein, 11 aa, Influenza virus
SVPLGSSSNAY

SEQ ID NO: 433629 - protein, 11 aa, Influenza virus
IRTLTLNTMTK

SEQ ID NO: 433630 - protein, 11 aa, Influenza virus
RTISIASRSGY

SEQ ID NO: 433631 - protein, 11 aa, Influenza virus
NRPWVSFNQDL

SEQ ID NO: 433632 - protein, 11 aa, Influenza virus
TSMPFHNIHPL

SEQ ID NO: 433633 - protein, 11 aa, Influenza virus
GMAADKESTQK

SEQ ID NO: 433634 - protein, 11 aa, Influenza virus
PYLNGREWSYI

SEQ ID NO: 433635 - protein, 11 aa, Influenza virus
YPGEVDNNGEL

SEQ ID NO: 433636 - protein, 11 aa, Influenza virus
HPSSTQEKNDL

SEQ ID NO: 433637 - protein, 11 aa, Influenza virus
LMNELGVPFHL

SEQ ID NO: 433638 - protein, 11 aa, Influenza virus
TPYRSLIRFPI

SEQ ID NO: 433639 - protein, 11 aa, Influenza virus
ASNINIREWSY

SEQ ID NO: 433640 - protein, 11 aa, Influenza virus
IGYLSNNSTEK

SEQ ID NO: 433641 - protein, 11 aa, Influenza virus
SILANNGKFEF

SEQ ID NO: 433642 - protein, 11 aa, Influenza virus
ITYIWTYQAEL

SEQ ID NO: 433643 - protein, 11 aa, Influenza virus
ITNKVNNIVDK

SEQ ID NO: 433644 - protein, 11 aa, Influenza virus
YSIADKICIGY

SEQ ID NO: 433645 - protein, 11 aa, Influenza virus
AFIAPNRASFF

SEQ ID NO: 433646 - protein, 11 aa, Influenza virus
SVKMEKIVLLL

SEQ ID NO: 433647 - protein, 11 aa, Influenza virus
FPFHKDNAVRL

SEQ ID NO: 433648 - protein, 11 aa, Influenza virus
RPRVRNQSGRI

SEQ ID NO: 433649 - protein, 11 aa, Influenza virus
VTGKLNRLIEK

SEQ ID NO: 433650 - protein, 11 aa, Influenza virus
MGMRISSSFSF

SEQ ID NO: 433651 - protein, 11 aa, Influenza virus
KQAKGLFGAIA

SEQ ID NO: 433652 - protein, 11 aa, Influenza virus
ARLLVLLENDK

SEQ ID NO: 433653 - protein, 11 aa, Influenza virus
RQCFNPMIVEL

SEQ ID NO: 433654 - protein, 11 aa, Influenza virus
ITFLQALQLLL

SEQ ID NO: 433655 - protein, 11 aa, Influenza virus
ITGKLNRIIEK

SEQ ID NO: 433656 - protein, 11 aa, Influenza virus
SATGPAETRVY

SEQ ID NO: 433657 - protein, 11 aa, Influenza virus
AAVCTHLEVCF

SEQ ID NO: 433658 - protein, 11 aa, Influenza virus
NLHAYISFRNL

SEQ ID NO: 433659 - protein, 11 aa, Influenza virus
LRHLFSGIRSF

SEQ ID NO: 433660 - protein, 11 aa, Influenza virus
IVILVLGLSMV

SEQ ID NO: 433661 - protein, 11 aa, Influenza virus
VLWISFAISCF

SEQ ID NO: 433662 - protein, 11 aa, Influenza virus
ARRIDFHWLLL

SEQ ID NO: 433663 - protein, 11 aa, Influenza virus
IKYNGIITDTL

SEQ ID NO: 433664 - protein, 11 aa, Influenza virus
TLNVESNGNLV

SEQ ID NO: 433665 - protein, 11 aa, Influenza virus
ISCSISECRTF

SEQ ID NO: 433666 - protein, 11 aa, Influenza virus
WSGYSGSFMDY

SEQ ID NO: 433667 - protein, 11 aa, Influenza virus
RTISKDTRSGY

SEQ ID NO: 433668 - protein, 11 aa, Influenza virus
GPANNQASYRI

SEQ ID NO: 433669 - protein, 11 aa, Influenza virus
EQITFMQALQL

SEQ ID NO: 433670 - protein, 11 aa, Influenza virus
SIAGWLLGNPM

SEQ ID NO: 433671 - protein, 11 aa, Influenza virus
RTISTASRSGY

SEQ ID NO: 433672 - protein, 11 aa, Influenza virus
TASRSGYEMLK

SEQ ID NO: 433673 - protein, 11 aa, Influenza virus
SFPDGAQIKYF

SEQ ID NO: 433674 - protein, 11 aa, Influenza virus
QMEKIVLLFAI

SEQ ID NO: 433675 - protein, 11 aa, Influenza virus
LIFMARSALIL

SEQ ID NO: 433676 - protein, 11 aa, Influenza virus
YQILSIYSTAA

SEQ ID NO: 433677 - protein, 11 aa, Influenza virus
SSVSSFERFEM

SEQ ID NO: 433678 - protein, 11 aa, Influenza virus
ITNKINNIVDK

SEQ ID NO: 433679 - protein, 11 aa, Influenza virus
WQGSNRPWIRF

SEQ ID NO: 433680 - protein, 11 aa, Influenza virus
SSVASSLVLLL

SEQ ID NO: 433681 - protein, 11 aa, Influenza virus
ELLTGNLQTLK

SEQ ID NO: 433682 - protein, 11 aa, Influenza virus
RTKEGRRRTNL

SEQ ID NO: 433683 - protein, 11 aa, Influenza virus
IWSYNAQLLVW

SEQ ID NO: 433684 - protein, 11 aa, Influenza virus
FHQIEKEFSEI

SEQ ID NO: 433685 - protein, 11 aa, Influenza virus
REESQLKKQEI

SEQ ID NO: 433686 - protein, 11 aa, Influenza virus
KMNPNKKIITI

SEQ ID NO: 433687 - protein, 11 aa, Influenza virus
FQHQNSEGTGI

SEQ ID NO: 433688 - protein, 11 aa, Influenza virus
GYHANNSTTQI

SEQ ID NO: 433689 - protein, 11 aa, Influenza virus
LSAFDERRNKY

SEQ ID NO: 433690 - protein, 11 aa, Influenza virus
ALMSVPLGSSS

SEQ ID NO: 433691 - protein, 11 aa, Influenza virus
DHAQYREEALL

SEQ ID NO: 433692 - protein, 11 aa, Influenza virus
EIITIGSICMV

SEQ ID NO: 433693 - protein, 11 aa, Influenza virus
WSYNAQLLVLL

SEQ ID NO: 433694 - protein, 11 aa, Influenza virus
ITYIWTYQAEL

SEQ ID NO: 433695 - protein, 11 aa, Influenza virus
SRSGYETFRVI

SEQ ID NO: 433696 - protein, 11 aa, Influenza virus
THTSQYICSPV

SEQ ID NO: 433697 - protein, 11 aa, Influenza virus
SMGIYQILAIY

SEQ ID NO: 433698 - protein, 11 aa, Influenza virus
RTQESECVCHK

SEQ ID NO: 433699 - protein, 11 aa, Influenza virus
RATEYIMKGVY

SEQ ID NO: 433700 - protein, 11 aa, Influenza virus
SSDDFALILNA

SEQ ID NO: 433701 - protein, 11 aa, Influenza virus
RLSAGGDIWVM

SEQ ID NO: 433702 - protein, 11 aa, Influenza virus
LTMGECPKYVK

SEQ ID NO: 433703 - protein, 11 aa, Influenza virus
SIITELPFQNL

SEQ ID NO: 433704 - protein, 11 aa, Influenza virus
VLTDTSRPSDK

SEQ ID NO: 433705 - protein, 11 aa, Influenza virus
SHPGIFENSCL

SEQ ID NO: 433706 - protein, 11 aa, Influenza virus
SHPGIFESSCL

SEQ ID NO: 433707 - protein, 11 aa, Influenza virus
MQNRIQIDPVK

SEQ ID NO: 433708 - protein, 11 aa, Influenza virus
RRIDFNWLLLD

SEQ ID NO: 433709 - protein, 11 aa, Influenza virus
HLEECSCYVDV

SEQ ID NO: 433710 - protein, 11 aa, Influenza virus
NQNPRIFLAMI

SEQ ID NO: 433711 - protein, 11 aa, Influenza virus
KMSLLTEVETY

SEQ ID NO: 433712 - protein, 11 aa, Influenza virus
ISNETILETGY

SEQ ID NO: 433713 - protein, 11 aa, Influenza virus
RPWIRINNETI

SEQ ID NO: 433714 - protein, 11 aa, Influenza virus
LLNASWFNSFL

SEQ ID NO: 433715 - protein, 11 aa, Influenza virus
WSGLVAGWYGF

SEQ ID NO: 433716 - protein, 11 aa, Influenza virus
VQNEFNKACEL

SEQ ID NO: 433717 - protein, 11 aa, Influenza virus
LMNELGIPFHL

SEQ ID NO: 433718 - protein, 11 aa, Influenza virus
CIKNGNMRCTI

SEQ ID NO: 433719 - protein, 11 aa, Influenza virus
TLLAKSVFNNL

SEQ ID NO: 433720 - protein, 11 aa, Influenza virus
LTIYSTAASSL

SEQ ID NO: 433721 - protein, 11 aa, Influenza virus
SVLVNTYQWVI

SEQ ID NO: 433722 - protein, 11 aa, Influenza virus
SMMWEVNGPES

SEQ ID NO: 433723 - protein, 11 aa, Influenza virus
QLNQTYRNNRK

SEQ ID NO: 433724 - protein, 11 aa, Influenza virus
SQLKKQEIEGI

SEQ ID NO: 433725 - protein, 11 aa, Influenza virus
DLWSYNADVLV

SEQ ID NO: 433726 - protein, 11 aa, Influenza virus
GALASCMGLIY

SEQ ID NO: 433727 - protein, 11 aa, Influenza virus
WSFALAQGALV

SEQ ID NO: 433728 - protein, 11 aa, Influenza virus
KRKKRGLFGAI

SEQ ID NO: 433729 - protein, 11 aa, Influenza virus
LYKKLKREMTF

SEQ ID NO: 433730 - protein, 11 aa, Influenza virus
VSSSLVLVGLI

SEQ ID NO: 433731 - protein, 11 aa, Influenza virus
FQHQNEQGVGM

SEQ ID NO: 433732 - protein, 11 aa, Influenza virus
SLEGLVLGNPK

SEQ ID NO: 433733 - protein, 11 aa, Influenza virus
YQILAIYSTVA

SEQ ID NO: 433734 - protein, 11 aa, Influenza virus
WTYNAEVLVLM

SEQ ID NO: 433735 - protein, 11 aa, Influenza virus
LHLEFKADLII

SEQ ID NO: 433736 - protein, 11 aa, Influenza virus
WSWHDGAEIIY

SEQ ID NO: 433737 - protein, 11 aa, Influenza virus
MFSNKVARLGK

SEQ ID NO: 433738 - protein, 11 aa, Influenza virus
VMTDGSASGQA

SEQ ID NO: 433739 - protein, 11 aa, Influenza virus
REFGVVNHEFS

SEQ ID NO: 433740 - protein, 11 aa, Influenza virus
RTISRDSRSGY

SEQ ID NO: 433741 - protein, 11 aa, Influenza virus
WLKTRPILSPL

SEQ ID NO: 433742 - protein, 11 aa, Influenza virus
SGRIDFHWLML

SEQ ID NO: 433743 - protein, 11 aa, Influenza virus
IGYHSNNSTEK

SEQ ID NO: 433744 - protein, 11 aa, Influenza virus
FDSLNITAASL

SEQ ID NO: 433745 - protein, 11 aa, Influenza virus
RTQESSCVCIK

SEQ ID NO: 433746 - protein, 11 aa, Influenza virus
ELIGKTSWSYI

SEQ ID NO: 433747 - protein, 11 aa, Influenza virus
LHLTGKWDTLI

SEQ ID NO: 433748 - protein, 11 aa, Influenza virus
RIAIGNCPKYV

SEQ ID NO: 433749 - protein, 11 aa, Influenza virus
KMEFEPFQSLI

SEQ ID NO: 433750 - protein, 11 aa, Influenza virus
FQHQNEQGTGI

SEQ ID NO: 433751 - protein, 11 aa, Influenza virus
NSNWSGYSGIF

SEQ ID NO: 433752 - protein, 11 aa, Influenza virus
WSKPQCKITGF

SEQ ID NO: 433753 - protein, 11 aa, Influenza virus
VSCSHLECRTF

SEQ ID NO: 433754 - protein, 11 aa, Influenza virus
MINPVKLSGGY

SEQ ID NO: 433755 - protein, 11 aa, Influenza virus
FEKEGYSLVGV

SEQ ID NO: 433756 - protein, 11 aa, Influenza virus
KNTDLEALMEW

SEQ ID NO: 433757 - protein, 11 aa, Influenza virus
FPGEVDNNGEL

SEQ ID NO: 433758 - protein, 11 aa, Influenza virus
WTYNAELLILL

SEQ ID NO: 433759 - protein, 11 aa, Influenza virus
IAASYKRIRLF

SEQ ID NO: 433760 - protein, 11 aa, Influenza virus
FQHQNAEGTGI

SEQ ID NO: 433761 - protein, 11 aa, Influenza virus
RIRMAINWGRI

SEQ ID NO: 433762 - protein, 11 aa, Influenza virus
YQNNFVPVVGA

SEQ ID NO: 433763 - protein, 11 aa, Influenza virus
MIRGQPNERTI

SEQ ID NO: 433764 - protein, 11 aa, Influenza virus
TIISSLPFQNI

SEQ ID NO: 433765 - protein, 11 aa, Influenza virus
LPFHNVHPLTI

SEQ ID NO: 433766 - protein, 11 aa, Influenza virus
RFYALSQGTTI

SEQ ID NO: 433767 - protein, 11 aa, Influenza virus
SLEGLILGNPK

SEQ ID NO: 433768 - protein, 11 aa, Influenza virus
VIREPFISCSI

SEQ ID NO: 433769 - protein, 11 aa, Influenza virus
LRSLIASSGTL

SEQ ID NO: 433770 - protein, 11 aa, Influenza virus
TMHDRSPFRAL

SEQ ID NO: 433771 - protein, 11 aa, Influenza virus
LSFWMCSNGPL

SEQ ID NO: 433772 - protein, 11 aa, Influenza virus
TLLAKSVFNCL

SEQ ID NO: 433773 - protein, 11 aa, Influenza virus
NTRKEPALIVW

SEQ ID NO: 433774 - protein, 11 aa, Influenza virus
IQIDSVKLSSG

SEQ ID NO: 433775 - protein, 11 aa, Influenza virus
PSSTQERNDLY

SEQ ID NO: 433776 - protein, 11 aa, Influenza virus
FQHQNEQGVGI

SEQ ID NO: 433777 - protein, 11 aa, Influenza virus
KTNGNLIAPEY

SEQ ID NO: 433778 - protein, 11 aa, Influenza virus
LWISFATSCFL

SEQ ID NO: 433779 - protein, 11 aa, Influenza virus
IIVILVLGLSM

SEQ ID NO: 433780 - protein, 11 aa, Influenza virus
VPEKIHTRGLF

SEQ ID NO: 433781 - protein, 11 aa, Influenza virus
YRSLIRFPIGV

SEQ ID NO: 433782 - protein, 11 aa, Influenza virus
YLIEDPTAPHG

SEQ ID NO: 433783 - protein, 11 aa, Influenza virus
KGVKLSNMGVY

SEQ ID NO: 433784 - protein, 11 aa, Influenza virus
FRQGTSVWAGR

SEQ ID NO: 433785 - protein, 11 aa, Influenza virus
FVNVTNVQNDY

SEQ ID NO: 433786 - protein, 11 aa, Influenza virus
MMEAMVSRARI

SEQ ID NO: 433787 - protein, 11 aa, Influenza virus
WFSFGASCFVL

SEQ ID NO: 433788 - protein, 11 aa, Influenza virus
TLRGRHANGTM

SEQ ID NO: 433789 - protein, 11 aa, Influenza virus
ATALANTIEIF

SEQ ID NO: 433790 - protein, 11 aa, Influenza virus
ILKDCSVAGWL

SEQ ID NO: 433791 - protein, 11 aa, Influenza virus
GLDRICLGHHA

SEQ ID NO: 433792 - protein, 11 aa, Influenza virus
HQILAIYSTVA

SEQ ID NO: 433793 - protein, 11 aa, Influenza virus
SECVCINGSCI

SEQ ID NO: 433794 - protein, 11 aa, Influenza virus
GAFIAPDRATF

SEQ ID NO: 433795 - protein, 11 aa, Influenza virus
VMLLAIAMGLI

SEQ ID NO: 433796 - protein, 11 aa, Influenza virus
YQFALGQGATL

SEQ ID NO: 433797 - protein, 11 aa, Influenza virus
VLLENDKTLNM

SEQ ID NO: 433798 - protein, 11 aa, Influenza virus
ALLGTNHSNGT

SEQ ID NO: 433799 - protein, 11 aa, Influenza virus
NSNWSGYSGIF

SEQ ID NO: 433800 - protein, 11 aa, Influenza virus
SSMPLHNIHPL

SEQ ID NO: 433801 - protein, 11 aa, Influenza virus
FMYSDFHFIDE

SEQ ID NO: 433802 - protein, 11 aa, Influenza virus
NIMRTQESECV

SEQ ID NO: 433803 - protein, 11 aa, Influenza virus
THTSQYICSPI

SEQ ID NO: 433804 - protein, 11 aa, Influenza virus
SLDEQNKLYGT

SEQ ID NO: 433805 - protein, 11 aa, Influenza virus
MIKRGVNDRNF

SEQ ID NO: 433806 - protein, 11 aa, Influenza virus
ALGQGTTLENK

SEQ ID NO: 433807 - protein, 11 aa, Influenza virus
SRSGYETFKVI

SEQ ID NO: 433808 - protein, 11 aa, Influenza virus
QTDCVLEAMAF

SEQ ID NO: 433809 - protein, 11 aa, Influenza virus
AAMGLKISSSF

SEQ ID NO: 433810 - protein, 11 aa, Influenza virus
SLRGRGSTLGL

SEQ ID NO: 433811 - protein, 11 aa, Influenza virus
LVVFCGTSGTY

SEQ ID NO: 433812 - protein, 11 aa, Influenza virus
FRNVLSVAPIM

SEQ ID NO: 433813 - protein, 11 aa, Influenza virus
VIREPFVSCSI

SEQ ID NO: 433814 - protein, 11 aa, Influenza virus
AIDTGDGCFEI

SEQ ID NO: 433815 - protein, 11 aa, Influenza virus
FVPVVGARPQV

SEQ ID NO: 433816 - protein, 11 aa, Influenza virus
SIESEFNEIEY

SEQ ID NO: 433817 - protein, 11 aa, Influenza virus
TSLCSIWFSHY

SEQ ID NO: 433818 - protein, 11 aa, Influenza virus
SFYRNMRWLTL

SEQ ID NO: 433819 - protein, 11 aa, Influenza virus
KENPAHKSQLV

SEQ ID NO: 433820 - protein, 11 aa, Influenza virus
WSGYSGSFVDY

SEQ ID NO: 433821 - protein, 11 aa, Influenza virus
KRTVSSFYSEM

SEQ ID NO: 433822 - protein, 11 aa, Influenza virus
IHDRSQYRSLI

SEQ ID NO: 433823 - protein, 11 aa, Influenza virus
LMNELGVPFYL

SEQ ID NO: 433824 - protein, 11 aa, Influenza virus
RQIGNVINWTR

SEQ ID NO: 433825 - protein, 11 aa, Influenza virus
SVASSLVLLLM

SEQ ID NO: 433826 - protein, 11 aa, Influenza virus
GQFGRINFHWL

SEQ ID NO: 433827 - protein, 11 aa, Influenza virus
RSGSSFYAELK

SEQ ID NO: 433828 - protein, 11 aa, Influenza virus
YQILSIYSTVA

SEQ ID NO: 433829 - protein, 11 aa, Influenza virus
IMHDRTKIRQL

SEQ ID NO: 433830 - protein, 11 aa, Influenza virus
SQKGILEDEQM

SEQ ID NO: 433831 - protein, 11 aa, Influenza virus
YGKGRIFQSRI

SEQ ID NO: 433832 - protein, 11 aa, Influenza virus
VTDGPSDAQAF

SEQ ID NO: 433833 - protein, 11 aa, Influenza virus
SVLINTYQWII

SEQ ID NO: 433834 - protein, 11 aa, Influenza virus
LRHLFSGIKSF

SEQ ID NO: 433835 - protein, 11 aa, Influenza virus
ITFIQALQLLL

SEQ ID NO: 433836 - protein, 11 aa, Influenza virus
LQNRIMINPVK

SEQ ID NO: 433837 - protein, 11 aa, Influenza virus
WFSFGASCFTL

SEQ ID NO: 433838 - protein, 11 aa, Influenza virus
VGYHSNNSTEK

SEQ ID NO: 433839 - protein, 11 aa, Influenza virus
VTIGKCPKYVK

SEQ ID NO: 433840 - protein, 11 aa, Influenza virus
ILTDTSRPSDK

SEQ ID NO: 433841 - protein, 11 aa, Influenza virus
CRTFFLTQGAL

SEQ ID NO: 433842 - protein, 11 aa, Influenza virus
GIAADKTSTQK

SEQ ID NO: 433843 - protein, 11 aa, Influenza virus
RTISKDSRSGY

SEQ ID NO: 433844 - protein, 11 aa, Influenza virus
TYCSLNGISPI

SEQ ID NO: 433845 - protein, 11 aa, Influenza virus
GMVDGWYGFHH

SEQ ID NO: 433846 - protein, 11 aa, Influenza virus
RVWWTSNSIAV

SEQ ID NO: 433847 - protein, 11 aa, Influenza virus
WRGANRPVITI

SEQ ID NO: 433848 - protein, 11 aa, Influenza virus
SLRLATGLRNI

SEQ ID NO: 433849 - protein, 11 aa, Influenza virus
MMIWHSNLNDA

SEQ ID NO: 433850 - protein, 11 aa, Influenza virus
SFYRSIRWLTL

SEQ ID NO: 433851 - protein, 11 aa, Influenza virus
APGWSWDDGAI

SEQ ID NO: 433852 - protein, 11 aa, Influenza virus
QESECVCINGI

SEQ ID NO: 433853 - protein, 11 aa, Influenza virus
IRMAINWGRIV

SEQ ID NO: 433854 - protein, 11 aa, Influenza virus
YTLVSTKEWSK

SEQ ID NO: 433855 - protein, 11 aa, Influenza virus
SFYRSIRWLTL

SEQ ID NO: 433856 - protein, 11 aa, Influenza virus
SIQSRGLFGAI

SEQ ID NO: 433857 - protein, 11 aa, Influenza virus
LLAKSVFNNLY

SEQ ID NO: 433858 - protein, 11 aa, Influenza virus
PSNSRFESVAW

SEQ ID NO: 433859 - protein, 11 aa, Influenza virus
WSKPQCQIAGF

SEQ ID NO: 433860 - protein, 11 aa, Influenza virus
LWISFAISCLL

SEQ ID NO: 433861 - protein, 11 aa, Influenza virus
DLYLSGREWSY

SEQ ID NO: 433862 - protein, 11 aa, Influenza virus
NPLIRHENRMV

SEQ ID NO: 433863 - protein, 11 aa, Influenza virus
GVQDIIDNNNW

SEQ ID NO: 433864 - protein, 11 aa, Influenza virus
ARSALILRGSV

SEQ ID NO: 433865 - protein, 11 aa, Influenza virus
HEEVTNATETV

SEQ ID NO: 433866 - protein, 11 aa, Influenza virus
FLWCKIVTTVG

SEQ ID NO: 433867 - protein, 11 aa, Influenza virus
WVWLWLVLREK

SEQ ID NO: 433868 - protein, 11 aa, Influenza virus
LILRDCSVAGW

SEQ ID NO: 433869 - protein, 11 aa, Influenza virus
IQSEFNKACEL

SEQ ID NO: 433870 - protein, 11 aa, Influenza virus
VRRAIVSADPL

SEQ ID NO: 433871 - protein, 11 aa, Influenza virus
NEIKGVKLSNM

SEQ ID NO: 433872 - protein, 11 aa, Influenza virus
GRLCNPLNPFV

SEQ ID NO: 433873 - protein, 11 aa, Influenza virus
KLCKLNGIPPL

SEQ ID NO: 433874 - protein, 11 aa, Influenza virus
YPQYPNVRCVC

SEQ ID NO: 433875 - protein, 11 aa, Influenza virus
VGYLSTNSSDK

SEQ ID NO: 433876 - protein, 11 aa, Influenza virus
GINKVCTKGKK

SEQ ID NO: 433877 - protein, 11 aa, Influenza virus
VLVGLILTFIM

SEQ ID NO: 433878 - protein, 11 aa, Influenza virus
WTYNVELLVLM

SEQ ID NO: 433879 - protein, 11 aa, Influenza virus
IENQEELRFLF

SEQ ID NO: 433880 - protein, 11 aa, Influenza virus
YPGSIKNQEEL

SEQ ID NO: 433881 - protein, 11 aa, Influenza virus
LMNELGVSFHL

SEQ ID NO: 433882 - protein, 11 aa, Influenza virus
TLELRSKYWAI

SEQ ID NO: 433883 - protein, 11 aa, Influenza virus
QLLRHFQKDAK

SEQ ID NO: 433884 - protein, 11 aa, Influenza virus
FSFGASCFLLI

SEQ ID NO: 433885 - protein, 11 aa, Influenza virus
ANINFMPYISF

SEQ ID NO: 433886 - protein, 11 aa, Influenza virus
SRYYMGECPKY

SEQ ID NO: 433887 - protein, 11 aa, Influenza virus
ELRSLFSSIKK

SEQ ID NO: 433888 - protein, 11 aa, Influenza virus
STVASSLTLAI

SEQ ID NO: 433889 - protein, 11 aa, Influenza virus
YEELREHLSSV

SEQ ID NO: 433890 - protein, 11 aa, Influenza virus
RRIDFHWLLLD

SEQ ID NO: 433891 - protein, 11 aa, Influenza virus
IQNIWAYNAEL

SEQ ID NO: 433892 - protein, 11 aa, Influenza virus
TESSFEQITFM

SEQ ID NO: 433893 - protein, 11 aa, Influenza virus
KYHWNLALDIV

SEQ ID NO: 433894 - protein, 11 aa, Influenza virus
LSLAIMIAGIF

SEQ ID NO: 433895 - protein, 11 aa, Influenza virus
SRHCSKYHWNL

SEQ ID NO: 433896 - protein, 11 aa, Influenza virus
GSFPNGAQIQY

SEQ ID NO: 433897 - protein, 11 aa, Influenza virus
WISFAISCLLL

SEQ ID NO: 433898 - protein, 11 aa, Influenza virus
TTLIENTYVNK

SEQ ID NO: 433899 - protein, 11 aa, Influenza virus
YPGELDNNGEL

SEQ ID NO: 433900 - protein, 11 aa, Influenza virus
MPASRYLTDMT

SEQ ID NO: 433901 - protein, 11 aa, Influenza virus
WSGYSGAFIDY

SEQ ID NO: 433902 - protein, 11 aa, Influenza virus
FRQSERGEETV

SEQ ID NO: 433903 - protein, 11 aa, Influenza virus
VLLNASWFNSF

SEQ ID NO: 433904 - protein, 11 aa, Influenza virus
FHQIEKEFTEV

SEQ ID NO: 433905 - protein, 11 aa, Influenza virus
LVLMENERTLY

SEQ ID NO: 433906 - protein, 11 aa, Influenza virus
MWACNSGNCRF

SEQ ID NO: 433907 - protein, 11 aa, Influenza virus
CTISLVKTTLF

SEQ ID NO: 433908 - protein, 11 aa, Influenza virus
GTDDDAYAVIH

SEQ ID NO: 433909 - protein, 11 aa, Influenza virus
ATKMKAIIVVL

SEQ ID NO: 433910 - protein, 11 aa, Influenza virus
LIVFNTIGNLV

SEQ ID NO: 433911 - protein, 11 aa, Influenza virus
IASRSGYEILK

SEQ ID NO: 433912 - protein, 11 aa, Influenza virus
GGDIWVTRELY

SEQ ID NO: 433913 - protein, 11 aa, Influenza virus
PSSTQEKNDLY

SEQ ID NO: 433914 - protein, 11 aa, Influenza virus
WLKTRPILSPL

SEQ ID NO: 433915 - protein, 11 aa, Influenza virus
GIAADKASTQK

SEQ ID NO: 433916 - protein, 11 aa, Influenza virus
WSYNAEFLVAM

SEQ ID NO: 433917 - protein, 11 aa, Influenza virus
RTISKDTRSGY

SEQ ID NO: 433918 - protein, 11 aa, Influenza virus
KMEAILVVLLY

SEQ ID NO: 433919 - protein, 11 aa, Influenza virus
WSGYSGSFVDY

SEQ ID NO: 433920 - protein, 11 aa, Influenza virus
SSMPLHNIHPL

SEQ ID NO: 433921 - protein, 11 aa, Influenza virus
MIEAESSVREK

SEQ ID NO: 433922 - protein, 11 aa, Influenza virus
FQHRNEEGTGV

SEQ ID NO: 433923 - protein, 11 aa, Influenza virus
SLFSSIKKYER

SEQ ID NO: 433924 - protein, 11 aa, Influenza virus
YRSLIRFPIGV

SEQ ID NO: 433925 - protein, 11 aa, Influenza virus
GPAANSADHRI

SEQ ID NO: 433926 - protein, 11 aa, Influenza virus
KILRTQESECV

SEQ ID NO: 433927 - protein, 11 aa, Influenza virus
KKMTITFLILL

SEQ ID NO: 433928 - protein, 11 aa, Influenza virus
KLSGGYKDVIL

SEQ ID NO: 433929 - protein, 11 aa, Influenza virus
LLMNELGVPFY

SEQ ID NO: 433930 - protein, 11 aa, Influenza virus
RTFFLTHGSLL

SEQ ID NO: 433931 - protein, 11 aa, Influenza virus
SKNSRSGYETF

SEQ ID NO: 433932 - protein, 11 aa, Influenza virus
FVPVMGARPQV

SEQ ID NO: 433933 - protein, 11 aa, Influenza virus
FVNVTNVQNNY

SEQ ID NO: 433934 - protein, 11 aa, Influenza virus
KGNQGVKGWAF

SEQ ID NO: 433935 - protein, 11 aa, Influenza virus
ITLKFAFNMMF

SEQ ID NO: 433936 - protein, 11 aa, Influenza virus
VSYCRATEYIM

SEQ ID NO: 433937 - protein, 11 aa, Influenza virus
AQSFYRSINWL

SEQ ID NO: 433938 - protein, 11 aa, Influenza virus
YRNWSKPQCQI

SEQ ID NO: 433939 - protein, 11 aa, Influenza virus
RTISTASRYGY

SEQ ID NO: 433940 - protein, 11 aa, Influenza virus
SHPGLFENSCL

SEQ ID NO: 433941 - protein, 11 aa, Influenza virus
SLEGIILGNPK

SEQ ID NO: 433942 - protein, 11 aa, Influenza virus
KSCLPACVYGL

SEQ ID NO: 433943 - protein, 11 aa, Influenza virus
TEVEKQIGNVI

SEQ ID NO: 433944 - protein, 11 aa, Influenza virus
FLNVWTYNAEL

SEQ ID NO: 433945 - protein, 11 aa, Influenza virus
VESMIEAESSV

SEQ ID NO: 433946 - protein, 11 aa, Influenza virus
ETNKFAAICTH

SEQ ID NO: 433947 - protein, 11 aa, Influenza virus
HLKDQSWSYIV

SEQ ID NO: 433948 - protein, 11 aa, Influenza virus
SECVCHNGTCV

SEQ ID NO: 433949 - protein, 11 aa, Influenza virus
RTISKDLRSGY

SEQ ID NO: 433950 - protein, 11 aa, Influenza virus
GVITDTLKSWK

SEQ ID NO: 433951 - protein, 11 aa, Influenza virus
TSWSWPDGALL

SEQ ID NO: 433952 - protein, 11 aa, Influenza virus
MRKKRGLFGAI

SEQ ID NO: 433953 - protein, 11 aa, Influenza virus
LRHLFSGVNSF

SEQ ID NO: 433954 - protein, 11 aa, Influenza virus
GMRNIPGKQAK

SEQ ID NO: 433955 - protein, 11 aa, Influenza virus
ESNGAFIAPRY

SEQ ID NO: 433956 - protein, 11 aa, Influenza virus
WKHVTNTILLV

SEQ ID NO: 433957 - protein, 11 aa, Influenza virus
FHQIEKEFSEV

SEQ ID NO: 433958 - protein, 11 aa, Influenza virus
GQFGRIDFHWL

SEQ ID NO: 433959 - protein, 11 aa, Influenza virus
IQGVRLTQGYK

SEQ ID NO: 433960 - protein, 11 aa, Influenza virus
NLQTYQKRMGV

SEQ ID NO: 433961 - protein, 11 aa, Influenza virus
KLRSGFEMLKI

SEQ ID NO: 433962 - protein, 11 aa, Influenza virus
VVVAKDNAIRF

SEQ ID NO: 433963 - protein, 11 aa, Influenza virus
YQFALGQGATL

SEQ ID NO: 433964 - protein, 11 aa, Influenza virus
MTIASDILKRM

SEQ ID NO: 433965 - protein, 11 aa, Influenza virus
LIRGRPEEVKY

SEQ ID NO: 433966 - protein, 11 aa, Influenza virus
FGASCFILLAI

SEQ ID NO: 433967 - protein, 11 aa, Influenza virus
IVAFCGTSGTY

SEQ ID NO: 433968 - protein, 11 aa, Influenza virus
YYPKYEEESKL

SEQ ID NO: 433969 - protein, 11 aa, Influenza virus
LLGNPECDILL

SEQ ID NO: 433970 - protein, 11 aa, Influenza virus
MGLIYNRMGAV

SEQ ID NO: 433971 - protein, 11 aa, Influenza virus
YRNTRKEPALI

SEQ ID NO: 433972 - protein, 11 aa, Influenza virus
NSNWSGYSGSF

SEQ ID NO: 433973 - protein, 11 aa, Influenza virus
TGRNCTVPCFW

SEQ ID NO: 433974 - protein, 11 aa, Influenza virus
GRLCNPMNPFV

SEQ ID NO: 433975 - protein, 11 aa, Influenza virus
LLVSLGAIGFW

SEQ ID NO: 433976 - protein, 11 aa, Influenza virus
NQNPRMFLAMI

SEQ ID NO: 433977 - protein, 11 aa, Influenza virus
GPASNQASYKI

SEQ ID NO: 433978 - protein, 11 aa, Influenza virus
TREPYVSCDPI

SEQ ID NO: 433979 - protein, 11 aa, Influenza virus
CISATGMALSV

SEQ ID NO: 433980 - protein, 11 aa, Influenza virus
GSVENLEELRF

SEQ ID NO: 433981 - protein, 11 aa, Influenza virus
RLYVNKNPYTL

SEQ ID NO: 433982 - protein, 11 aa, Influenza virus
RGNPGVKGWAF

SEQ ID NO: 433983 - protein, 11 aa, Influenza virus
GSIENQEELRF

SEQ ID NO: 433984 - protein, 11 aa, Influenza virus
LWFSLGASCFL

SEQ ID NO: 433985 - protein, 11 aa, Influenza virus
GPLKAEIAQRL

SEQ ID NO: 433986 - protein, 11 aa, Influenza virus
RRLTVLGKDAG

SEQ ID NO: 433987 - protein, 11 aa, Influenza virus
CIASSIVMVGL

SEQ ID NO: 433988 - protein, 11 aa, Influenza virus
AINSSMPLHNI

SEQ ID NO: 433989 - protein, 11 aa, Influenza virus
AAMGMRISSSF

SEQ ID NO: 433990 - protein, 11 aa, Influenza virus
VTNATETVESK

SEQ ID NO: 433991 - protein, 11 aa, Influenza virus
YVDGFEPNGCI

SEQ ID NO: 433992 - protein, 11 aa, Influenza virus
IHDRTAFRGLI

SEQ ID NO: 433993 - protein, 11 aa, Influenza virus
AKYVWWASNSL

SEQ ID NO: 433994 - protein, 11 aa, Influenza virus
RMCSLMQGSTL

SEQ ID NO: 433995 - protein, 11 aa, Influenza virus
NQTKKMTITFL

SEQ ID NO: 433996 - protein, 11 aa, Influenza virus
RRNRYLEEHPS

SEQ ID NO: 433997 - protein, 11 aa, Influenza virus
NPDPGVKGFAF

SEQ ID NO: 433998 - protein, 11 aa, Influenza virus
HQNAEGTGTAA

SEQ ID NO: 433999 - protein, 11 aa, Influenza virus
LVRGQQGTMDY

SEQ ID NO: 434000 - protein, 11 aa, Influenza virus
CVMLLAIAMGL

SEQ ID NO: 434001 - protein, 11 aa, Influenza virus
SVLVNTYQWII

SEQ ID NO: 434002 - protein, 11 aa, Influenza virus
LIQGYKDIILW

SEQ ID NO: 434003 - protein, 11 aa, Influenza virus
RIQHLEECSCY

SEQ ID NO: 434004 - protein, 11 aa, Influenza virus
YSSVASSLVLL

SEQ ID NO: 434005 - protein, 11 aa, Influenza virus
HQNSEGTGTAA

SEQ ID NO: 434006 - protein, 11 aa, Influenza virus
SLPLALGMKNV

SEQ ID NO: 434007 - protein, 11 aa, Influenza virus
KAPISLGGCSF

SEQ ID NO: 434008 - protein, 11 aa, Influenza virus
LLAKSVFNCLY

SEQ ID NO: 434009 - protein, 11 aa, Influenza virus
YRICKLVGINM

SEQ ID NO: 434010 - protein, 11 aa, Influenza virus
WSYNADLLVAM

SEQ ID NO: 434011 - protein, 11 aa, Influenza virus
NINPVKLSSGY

SEQ ID NO: 434012 - protein, 11 aa, Influenza virus
FRQSERGEETI

SEQ ID NO: 434013 - protein, 11 aa, Influenza virus
RTISTASRYGY

SEQ ID NO: 434014 - protein, 11 aa, Influenza virus
VASSLVLLLMI

SEQ ID NO: 434015 - protein, 11 aa, Influenza virus
SRIAIGNCPKY

SEQ ID NO: 434016 - protein, 11 aa, Influenza virus
KLSSGYKDVIL

SEQ ID NO: 434017 - protein, 11 aa, Influenza virus
RARIKTRLFTI

SEQ ID NO: 434018 - protein, 11 aa, Influenza virus
RTLNTASRSGY

SEQ ID NO: 434019 - protein, 11 aa, Influenza virus
EIWSYNAELLV

SEQ ID NO: 434020 - protein, 11 aa, Influenza virus
FIFLLLTHWAY

SEQ ID NO: 434021 - protein, 11 aa, Influenza virus
IEKIEKIRPLL

SEQ ID NO: 434022 - protein, 11 aa, Influenza virus
HALRELWQCYY

SEQ ID NO: 434023 - protein, 11 aa, Influenza virus
QRFRRPDSSWL

SEQ ID NO: 434024 - protein, 11 aa, Influenza virus
EKLTITYSSPM

SEQ ID NO: 434025 - protein, 11 aa, Influenza virus
HLRDQGWSYIV

SEQ ID NO: 434026 - protein, 11 aa, Influenza virus
FLLMDSLKLSI

SEQ ID NO: 434027 - protein, 11 aa, Influenza virus
FTWAIHHPPTT

SEQ ID NO: 434028 - protein, 11 aa, Influenza virus
QKVPVTQTMEL

SEQ ID NO: 434029 - protein, 11 aa, Influenza virus
IEDPSHEGEGI

SEQ ID NO: 434030 - protein, 11 aa, Influenza virus
DLTDSEMNKLY

SEQ ID NO: 434031 - protein, 11 aa, Influenza virus
PTFSVQRSLPF

SEQ ID NO: 434032 - protein, 11 aa, Influenza virus
SEFLCVGWSST

SEQ ID NO: 434033 - protein, 11 aa, Influenza virus
RPLILKDCSVA

SEQ ID NO: 434034 - protein, 11 aa, Influenza virus
ARRIDFNWLLL

SEQ ID NO: 434035 - protein, 11 aa, Influenza virus
LMTELGVPFHL

SEQ ID NO: 434036 - protein, 11 aa, Influenza virus
KMNTRILILTL

SEQ ID NO: 434037 - protein, 11 aa, Influenza virus
LYFHDSNVKNL

SEQ ID NO: 434038 - protein, 11 aa, Influenza virus
RSGYSGSFIDY

SEQ ID NO: 434039 - protein, 11 aa, Influenza virus
EARVWWTSNSI

SEQ ID NO: 434040 - protein, 11 aa, Influenza virus
WSYNAEFLVAL

SEQ ID NO: 434041 - protein, 11 aa, Influenza virus
SSMPFHNIHPF

SEQ ID NO: 434042 - protein, 11 aa, Influenza virus
SLCNVEGWVVI

SEQ ID NO: 434043 - protein, 11 aa, Influenza virus
WTYNAELLVLL

SEQ ID NO: 434044 - protein, 11 aa, Influenza virus
RLFDYSKWNVS

SEQ ID NO: 434045 - protein, 11 aa, Influenza virus
RRYGPALSINE

SEQ ID NO: 434046 - protein, 11 aa, Influenza virus
ARSALILRGAV

SEQ ID NO: 434047 - protein, 11 aa, Influenza virus
IGYHANNSTTK

SEQ ID NO: 434048 - protein, 11 aa, Influenza virus
LGLRISSSFSF

SEQ ID NO: 434049 - protein, 11 aa, Influenza virus
GEYNNTTGRDV

SEQ ID NO: 434050 - protein, 11 aa, Influenza virus
TAMLNASCAAM

SEQ ID NO: 434051 - protein, 11 aa, Influenza virus
YIIEKYGSGRI

SEQ ID NO: 434052 - protein, 11 aa, Influenza virus
TMGYKDIILWI

SEQ ID NO: 434053 - protein, 11 aa, Influenza virus
MGMFNMLSTVL

SEQ ID NO: 434054 - protein, 11 aa, Influenza virus
ATKLYVNKNPY

SEQ ID NO: 434055 - protein, 11 aa, Influenza virus
NLFEKFFPSSS

SEQ ID NO: 434056 - protein, 11 aa, Influenza virus
LRSIVASSGTL

SEQ ID NO: 434057 - protein, 11 aa, Influenza virus
LIRGRPEEAKY

SEQ ID NO: 434058 - protein, 11 aa, Influenza virus
WSGMIDGWYGF

SEQ ID NO: 434059 - protein, 11 aa, Influenza virus
AVTDVWSYNAK

SEQ ID NO: 434060 - protein, 11 aa, Influenza virus
VLMENERTLGF

SEQ ID NO: 434061 - protein, 11 aa, Influenza virus
NSNNGVKGFSY

SEQ ID NO: 434062 - protein, 11 aa, Influenza virus
AFIAPDRASFF

SEQ ID NO: 434063 - protein, 11 aa, Influenza virus
NQFALGQGTTL

SEQ ID NO: 434064 - protein, 11 aa, Influenza virus
MVLASTTAKAM

SEQ ID NO: 434065 - protein, 11 aa, Influenza virus
IKYNGIITDTF

SEQ ID NO: 434066 - protein, 11 aa, Influenza virus
NKMARLGRGYM

SEQ ID NO: 434067 - protein, 11 aa, Influenza virus
HQIGNVINWTK

SEQ ID NO: 434068 - protein, 11 aa, Influenza virus
ETKCQSPLGAI

SEQ ID NO: 434069 - protein, 11 aa, Influenza virus
VIDGWTTANSK

SEQ ID NO: 434070 - protein, 11 aa, Influenza virus
WSGYSGSFIDY

SEQ ID NO: 434071 - protein, 11 aa, Influenza virus
LFSGYKDIILW

SEQ ID NO: 434072 - protein, 11 aa, Influenza virus
SLKLATGLRNI

SEQ ID NO: 434073 - protein, 11 aa, Influenza virus
FFNNTEPLCEV

SEQ ID NO: 434074 - protein, 11 aa, Influenza virus
ALLNRLNINPV

SEQ ID NO: 434075 - protein, 11 aa, Influenza virus
KYRTESLQNRI

SEQ ID NO: 434076 - protein, 11 aa, Influenza virus
KMNPNQKIIII

SEQ ID NO: 434077 - protein, 11 aa, Influenza virus
APEGMCYPGSV

SEQ ID NO: 434078 - protein, 11 aa, Influenza virus
QQGTMDYYWGI

SEQ ID NO: 434079 - protein, 11 aa, Influenza virus
QRSWMKIYWHL

SEQ ID NO: 434080 - protein, 11 aa, Influenza virus
GPANNQASYKI

SEQ ID NO: 434081 - protein, 11 aa, Influenza virus
VLLENERTLDY

SEQ ID NO: 434082 - protein, 11 aa, Influenza virus
FEREGYSLVGV

SEQ ID NO: 434083 - protein, 11 aa, Influenza virus
KIDPVKLSSGY

SEQ ID NO: 434084 - protein, 11 aa, Influenza virus
YQNSFVPVVGA

SEQ ID NO: 434085 - protein, 11 aa, Influenza virus
GVQDIIDNDNW

SEQ ID NO: 434086 - protein, 11 aa, Influenza virus
LMSQSRTRGIL

SEQ ID NO: 434087 - protein, 11 aa, Influenza virus
AINTTLPFHNI

SEQ ID NO: 434088 - protein, 11 aa, Influenza virus
WLLGNPTCDEF

SEQ ID NO: 434089 - protein, 11 aa, Influenza virus
ELKSLFSSIKK

SEQ ID NO: 434090 - protein, 11 aa, Influenza virus
NQSPRMFLAMI

SEQ ID NO: 434091 - protein, 11 aa, Influenza virus
FQHQNAEGIGI

SEQ ID NO: 434092 - protein, 11 aa, Influenza virus
FRQGNSVWAGR

SEQ ID NO: 434093 - protein, 11 aa, Influenza virus
LSIYSCIASSV

SEQ ID NO: 434094 - protein, 11 aa, Influenza virus
LFQDILMRMSK

SEQ ID NO: 434095 - protein, 11 aa, Influenza virus
WSGYSGAFINY

SEQ ID NO: 434096 - protein, 11 aa, Influenza virus
MWACSNGSCRF

SEQ ID NO: 434097 - protein, 11 aa, Influenza virus
MWACSSGNCRF

SEQ ID NO: 434098 - protein, 11 aa, Influenza virus
SSMPFHNIHPL

SEQ ID NO: 434099 - protein, 11 aa, Influenza virus
RETRGLFGAIA

SEQ ID NO: 434100 - protein, 11 aa, Influenza virus
SATGPADTRVY

SEQ ID NO: 434101 - protein, 11 aa, Influenza virus
SFYRSMRWLTL

SEQ ID NO: 434102 - protein, 11 aa, Influenza virus
FSMSCFVFVAL

SEQ ID NO: 434103 - protein, 11 aa, Influenza virus
KLVLATGPRNV

SEQ ID NO: 434104 - protein, 11 aa, Influenza virus
TPIAFLTSSIV

SEQ ID NO: 434105 - protein, 11 aa, Influenza virus
LIFSARSALIL

SEQ ID NO: 434106 - protein, 11 aa, Influenza virus
MKIIRVGCVIL

SEQ ID NO: 434107 - protein, 11 aa, Influenza virus
STVASSLTLAI

SEQ ID NO: 434108 - protein, 11 aa, Influenza virus
KMEAILVVLLY

SEQ ID NO: 434109 - protein, 11 aa, Influenza virus
AVTDIWSYNAK

SEQ ID NO: 434110 - protein, 11 aa, Influenza virus
AKYVWWTSNSL

SEQ ID NO: 434111 - protein, 11 aa, Influenza virus
MLSTVLGVSVL

SEQ ID NO: 434112 - protein, 11 aa, Influenza virus
KKMEDGFLDVW

SEQ ID NO: 434113 - protein, 11 aa, Influenza virus
ASDILTRMSKM

SEQ ID NO: 434114 - protein, 11 aa, Influenza virus
FRQSERGEDTI

SEQ ID NO: 434115 - protein, 11 aa, Influenza virus
GSFPNGAQIQY

SEQ ID NO: 434116 - protein, 11 aa, Influenza virus
YPGSFNNYEEL

SEQ ID NO: 434117 - protein, 11 aa, Influenza virus
STSCHDGRARM

SEQ ID NO: 434118 - protein, 11 aa, Influenza virus
IASSTVLVGLI

SEQ ID NO: 434119 - protein, 11 aa, Influenza virus
LEKNITVTHSV

SEQ ID NO: 434120 - protein, 11 aa, Influenza virus
FPGELDNNGEL

SEQ ID NO: 434121 - protein, 11 aa, Influenza virus
SRSGYETFRII

SEQ ID NO: 434122 - protein, 11 aa, Influenza virus
NLYVNKNPYTL

SEQ ID NO: 434123 - protein, 11 aa, Influenza virus
ATNINIREWSY

SEQ ID NO: 434124 - protein, 11 aa, Influenza virus
VLVGLILSFIM

SEQ ID NO: 434125 - protein, 11 aa, Influenza virus
IMRTVIALSYI

SEQ ID NO: 434126 - protein, 11 aa, Influenza virus
TVSSSLVLAGL

SEQ ID NO: 434127 - protein, 11 aa, Influenza virus
NTDLEVLMEWL

SEQ ID NO: 434128 - protein, 11 aa, Influenza virus
VKYVWWTSNSL

SEQ ID NO: 434129 - protein, 11 aa, Influenza virus
KILRTQESSCV

SEQ ID NO: 434130 - protein, 11 aa, Influenza virus
LMSQSRTREIL

SEQ ID NO: 434131 - protein, 11 aa, Influenza virus
FQNTSRHYIGK

SEQ ID NO: 434132 - protein, 11 aa, Influenza virus
FPSSSYRRPVG

SEQ ID NO: 434133 - protein, 11 aa, Influenza virus
LILKDCSIAGW

SEQ ID NO: 434134 - protein, 11 aa, Influenza virus
NMARAVKLYKK

SEQ ID NO: 434135 - protein, 11 aa, Influenza virus
RATEYIIKGVY

SEQ ID NO: 434136 - protein, 11 aa, Influenza virus
FSISCFLLAAL

SEQ ID NO: 434137 - protein, 11 aa, Influenza virus
TMHDRSPFRAL

SEQ ID NO: 434138 - protein, 11 aa, Influenza virus
FRISKRGSSGI

SEQ ID NO: 434139 - protein, 11 aa, Influenza virus
WMMAMKYPITA

SEQ ID NO: 434140 - protein, 11 aa, Influenza virus
LWFSFGASCLI

SEQ ID NO: 434141 - protein, 11 aa, Influenza virus
ALLNRLSINPV

SEQ ID NO: 434142 - protein, 11 aa, Influenza virus
WSYNADVLVAL

SEQ ID NO: 434143 - protein, 11 aa, Influenza virus
TIDMTDSEMNK

SEQ ID NO: 434144 - protein, 11 aa, Influenza virus
GIYQILAIYST

SEQ ID NO: 434145 - protein, 11 aa, Influenza virus
VRFNSDLDYQI

SEQ ID NO: 434146 - protein, 11 aa, Influenza virus
KILDEHDSNVK

SEQ ID NO: 434147 - protein, 11 aa, Influenza virus
TPYRSLIRFPV

SEQ ID NO: 434148 - protein, 11 aa, Influenza virus
AAMGLRISSSF

SEQ ID NO: 434149 - protein, 11 aa, Influenza virus
SLESRSGFEMV

SEQ ID NO: 434150 - protein, 11 aa, Influenza virus
CSIWFSHYNQV

SEQ ID NO: 434151 - protein, 11 aa, Influenza virus
FTSFFYRYGFV

SEQ ID NO: 434152 - protein, 11 aa, Influenza virus
GSWPDGANIDF

SEQ ID NO: 434153 - protein, 11 aa, Influenza virus
KSCLPACIYGL

SEQ ID NO: 434154 - protein, 11 aa, Influenza virus
WSSTSCHDGKF

SEQ ID NO: 434155 - protein, 11 aa, Influenza virus
WSWHDGAILPL

SEQ ID NO: 434156 - protein, 11 aa, Influenza virus
RRIDFHWLFLD

SEQ ID NO: 434157 - protein, 11 aa, Influenza virus
LTKKEPDTYDF

SEQ ID NO: 434158 - protein, 11 aa, Influenza virus
QNRMQFSSLTV

SEQ ID NO: 434159 - protein, 11 aa, Influenza virus
GAFIAPDRASF

SEQ ID NO: 434160 - protein, 11 aa, Influenza virus
KMNTQFEAIGR

SEQ ID NO: 434161 - protein, 11 aa, Influenza virus
TPYRSLIQFPI

SEQ ID NO: 434162 - protein, 11 aa, Influenza virus
VSCGPSECRTF

SEQ ID NO: 434163 - protein, 11 aa, Influenza virus
RTISTASRAGY

SEQ ID NO: 434164 - protein, 11 aa, Influenza virus
SQYRALISWPL

SEQ ID NO: 434165 - protein, 11 aa, Influenza virus
MQNRLNNVIDK

SEQ ID NO: 434166 - protein, 11 aa, Influenza virus
SWIPKRNRSIL

SEQ ID NO: 434167 - protein, 11 aa, Influenza virus
ISKRGSSGIMK

SEQ ID NO: 434168 - protein, 11 aa, Influenza virus
GIYQILAIYAT

SEQ ID NO: 434169 - protein, 11 aa, Influenza virus
GAKAGFIEGGW

SEQ ID NO: 434170 - protein, 11 aa, Influenza virus
ITVDHMAIIKK

SEQ ID NO: 434171 - protein, 11 aa, Influenza virus
IENLEELRFVF

SEQ ID NO: 434172 - protein, 11 aa, Influenza virus
LILKDCSVAGW

SEQ ID NO: 434173 - protein, 11 aa, Influenza virus
IIDLADSEMNK

SEQ ID NO: 434174 - protein, 11 aa, Influenza virus
ILRDCSVAGWL

SEQ ID NO: 434175 - protein, 11 aa, Influenza virus
IASSIVLVGLI

SEQ ID NO: 434176 - protein, 11 aa, Influenza virus
NQNPRIFLAMI

SEQ ID NO: 434177 - protein, 11 aa, Influenza virus
LRSLVASSGTL

SEQ ID NO: 434178 - protein, 11 aa, Influenza virus
IHDRSQYRALV

SEQ ID NO: 434179 - protein, 11 aa, Influenza virus
TMHDRSPFRAL

SEQ ID NO: 434180 - protein, 11 aa, Influenza virus
LPFHNVHPLTI

SEQ ID NO: 434181 - protein, 11 aa, Influenza virus
KEVILWFSFGA

SEQ ID NO: 434182 - protein, 11 aa, Influenza virus
LWFSFGASCFI

SEQ ID NO: 434183 - protein, 11 aa, Influenza virus
ATNLYVNKNPY

SEQ ID NO: 434184 - protein, 11 aa, Influenza virus
WSGYSGAFINY

SEQ ID NO: 434185 - protein, 11 aa, Influenza virus
WSYNAEFLVAV

SEQ ID NO: 434186 - protein, 11 aa, Influenza virus
LMSCHIGVAPS

SEQ ID NO: 434187 - protein, 11 aa, Influenza virus
FVNVTHVQNNY

SEQ ID NO: 434188 - protein, 11 aa, Influenza virus
ICIAWSSSSCF

SEQ ID NO: 434189 - protein, 11 aa, Influenza virus
ILGNPKCDLYL

SEQ ID NO: 434190 - protein, 11 aa, Influenza virus
MWACSNGNCRF

SEQ ID NO: 434191 - protein, 11 aa, Influenza virus
LISTPLGSPPI

SEQ ID NO: 434192 - protein, 11 aa, Influenza virus
WQGMVDGWYGF

SEQ ID NO: 434193 - protein, 11 aa, Influenza virus
WSWHDGAEITY

SEQ ID NO: 434194 - protein, 11 aa, Influenza virus
ITDGPSDAQAF

SEQ ID NO: 434195 - protein, 11 aa, Influenza virus
RLNPMHQLLRH

SEQ ID NO: 434196 - protein, 11 aa, Influenza virus
YMNTALLNASC

SEQ ID NO: 434197 - protein, 11 aa, Influenza virus
ETNKFASICTH

SEQ ID NO: 434198 - protein, 11 aa, Influenza virus
NINSVKLSSGY

SEQ ID NO: 434199 - protein, 11 aa, Influenza virus
MWACSNGSCRF

SEQ ID NO: 434200 - protein, 11 aa, Influenza virus
SIKRYERVKMF

SEQ ID NO: 434201 - protein, 11 aa, Influenza virus
STDTVDTLLEK

SEQ ID NO: 434202 - protein, 11 aa, Influenza virus
TIHDRSQYRAL

SEQ ID NO: 434203 - protein, 11 aa, Influenza virus
IASDILKRMSK

SEQ ID NO: 434204 - protein, 11 aa, Influenza virus
WMCSNGSLQCK

SEQ ID NO: 434205 - protein, 11 aa, Influenza virus
AVEECLINDPW

SEQ ID NO: 434206 - protein, 11 aa, Influenza virus
SQKILCTSATA

SEQ ID NO: 434207 - protein, 11 aa, Influenza virus
TTDWSGYSGSF

SEQ ID NO: 434208 - protein, 11 aa, Influenza virus
LYGTQSLSISI

SEQ ID NO: 434209 - protein, 11 aa, Influenza virus
EIFHKCDDHCM

SEQ ID NO: 434210 - protein, 11 aa, Influenza virus
AEIAQKLEDVF

SEQ ID NO: 434211 - protein, 11 aa, Influenza virus
FPNEVGARILA

SEQ ID NO: 434212 - protein, 11 aa, Influenza virus
FNSFLAHALKL

SEQ ID NO: 434213 - protein, 11 aa, Influenza virus
QRSWMKLYWHL

SEQ ID NO: 434214 - protein, 11 aa, Influenza virus
FQHQNEQGTGI

SEQ ID NO: 434215 - protein, 11 aa, Influenza virus
TIISNLPFQNI

SEQ ID NO: 434216 - protein, 11 aa, Influenza virus
FIFILLTHWAY

SEQ ID NO: 434217 - protein, 11 aa, Influenza virus
LLAKSVFNSIY

SEQ ID NO: 434218 - protein, 11 aa, Influenza virus
TQVEELVHGQV

SEQ ID NO: 434219 - protein, 11 aa, Influenza virus
RMYALHQGTTI

SEQ ID NO: 434220 - protein, 11 aa, Influenza virus
FRQGNNVWAGR

SEQ ID NO: 434221 - protein, 11 aa, Influenza virus
SRMSICISGPN

SEQ ID NO: 434222 - protein, 11 aa, Influenza virus
FLLMDALKLSI

SEQ ID NO: 434223 - protein, 11 aa, Influenza virus
WAYNAELLVLI

SEQ ID NO: 434224 - protein, 11 aa, Influenza virus
TSACKRTVSSF

SEQ ID NO: 434225 - protein, 11 aa, Influenza virus
YQILSIYSTVT

SEQ ID NO: 434226 - protein, 11 aa, Influenza virus
WSYNAEFLVAM

SEQ ID NO: 434227 - protein, 11 aa, Influenza virus
SQYRSLISWPL

SEQ ID NO: 434228 - protein, 11 aa, Influenza virus
YENNTWVNQTF

SEQ ID NO: 434229 - protein, 11 aa, Influenza virus
EKNDLYGTQPL

SEQ ID NO: 434230 - protein, 11 aa, Influenza virus
SQLTEVETYVL

SEQ ID NO: 434231 - protein, 11 aa, Influenza virus
PQCQIAGFAPF

SEQ ID NO: 434232 - protein, 11 aa, Influenza virus
TIHDRSQYRSL

SEQ ID NO: 434233 - protein, 11 aa, Influenza virus
NLLIGISNVVL

SEQ ID NO: 434234 - protein, 11 aa, Influenza virus
KRGLFGAIAGF

SEQ ID NO: 434235 - protein, 11 aa, Influenza virus
GLIAPDRVSKL

SEQ ID NO: 434236 - protein, 11 aa, Influenza virus
DTVDTLTENGV

SEQ ID NO: 434237 - protein, 11 aa, Influenza virus
LERSKINGVIL

SEQ ID NO: 434238 - protein, 11 aa, Influenza virus
WSYNARLLVLL

SEQ ID NO: 434239 - protein, 11 aa, Influenza virus
STKEWSKRYEL

SEQ ID NO: 434240 - protein, 11 aa, Influenza virus
IASSVVLVGPI

SEQ ID NO: 434241 - protein, 11 aa, Influenza virus
SSMGIYQILAI

SEQ ID NO: 434242 - protein, 11 aa, Influenza virus
RMFLAMITYIT

SEQ ID NO: 434243 - protein, 11 aa, Influenza virus
TEVEQQIGNVI

SEQ ID NO: 434244 - protein, 11 aa, Influenza virus
SPLTKGMLGFV

SEQ ID NO: 434245 - protein, 11 aa, Influenza virus
YRRPIGISSMV

SEQ ID NO: 434246 - protein, 11 aa, Influenza virus
KMNTKILVLAL

SEQ ID NO: 434247 - protein, 11 aa, Influenza virus
MQNKLNNVIDK

SEQ ID NO: 434248 - protein, 11 aa, Influenza virus
WSYNAELLVAI

SEQ ID NO: 434249 - protein, 11 aa, Influenza virus
QLGSWSWHDGA

SEQ ID NO: 434250 - protein, 11 aa, Influenza virus
SPFRTLMSCPI

SEQ ID NO: 434251 - protein, 11 aa, Influenza virus
ASNINIREWSY

SEQ ID NO: 434252 - protein, 11 aa, Influenza virus
YRSMRWLTLKL

SEQ ID NO: 434253 - protein, 9 aa, Influenza virus
AADKASTQK

SEQ ID NO: 434254 - protein, 9 aa, Influenza virus
AADKDSTQK

SEQ ID NO: 434255 - protein, 9 aa, Influenza virus
AADKESTQE

SEQ ID NO: 434256 - protein, 9 aa, Influenza virus
AADKESTQK

SEQ ID NO: 434257 - protein, 9 aa, Influenza virus
AADKESTQR

SEQ ID NO: 434258 - protein, 9 aa, Influenza virus
AADKESTQT

SEQ ID NO: 434259 - protein, 9 aa, Influenza virus
AADKKSTQK

SEQ ID NO: 434260 - protein, 9 aa, Influenza virus
AADKTSTQK

SEQ ID NO: 434261 - protein, 9 aa, Influenza virus
AADKVSTQK

SEQ ID NO: 434262 - protein, 9 aa, Influenza virus
AADLKSTQA

SEQ ID NO: 434263 - protein, 9 aa, Influenza virus
AADLKSTQT

SEQ ID NO: 434264 - protein, 9 aa, Influenza virus
AADQESTQK

SEQ ID NO: 434265 - protein, 9 aa, Influenza virus
AADQKSTQE

SEQ ID NO: 434266 - protein, 9 aa, Influenza virus
AADRDSTQK

SEQ ID NO: 434267 - protein, 9 aa, Influenza virus
AADRDSTQM

SEQ ID NO: 434268 - protein, 9 aa, Influenza virus
AADRDSTQR

SEQ ID NO: 434269 - protein, 9 aa, Influenza virus
AADRESTQK

SEQ ID NO: 434270 - protein, 9 aa, Influenza virus
AADRESTQR

SEQ ID NO: 434271 - protein, 9 aa, Influenza virus
AADRGSTQK

SEQ ID NO: 434272 - protein, 9 aa, Influenza virus
AADRKSTQK

SEQ ID NO: 434273 - protein, 9 aa, Influenza virus
AADYESTQA

SEQ ID NO: 434274 - protein, 9 aa, Influenza virus
AADYKSTPS

SEQ ID NO: 434275 - protein, 9 aa, Influenza virus
AADYKSTQA

SEQ ID NO: 434276 - protein, 9 aa, Influenza virus
AADYKSTQK

SEQ ID NO: 434277 - protein, 9 aa, Influenza virus
AADYKSTQS

SEQ ID NO: 434278 - protein, 9 aa, Influenza virus
AADYKSTQT

SEQ ID NO: 434279 - protein, 9 aa, Influenza virus
AAEKESTQK

SEQ ID NO: 434280 - protein, 9 aa, Influenza virus
AAFEDLRIS

SEQ ID NO: 434281 - protein, 9 aa, Influenza virus
AAFEDLRLL

SEQ ID NO: 434282 - protein, 9 aa, Influenza virus
AAFEDLRVL

SEQ ID NO: 434283 - protein, 9 aa, Influenza virus
AAFEDLRVS

SEQ ID NO: 434284 - protein, 9 aa, Influenza virus
AAFRGLIST

SEQ ID NO: 434285 - protein, 9 aa, Influenza virus
AAGAAIKGV

SEQ ID NO: 434286 - protein, 9 aa, Influenza virus
AAGAAVKGI

SEQ ID NO: 434287 - protein, 9 aa, Influenza virus
AAGAAVKGV

SEQ ID NO: 434288 - protein, 9 aa, Influenza virus
AAGFHFEEC

SEQ ID NO: 434289 - protein, 9 aa, Influenza virus
AAGGDIWVT

SEQ ID NO: 434290 - protein, 9 aa, Influenza virus
AAICTHLEI

SEQ ID NO: 434291 - protein, 9 aa, Influenza virus
AAICTHLEV

SEQ ID NO: 434292 - protein, 9 aa, Influenza virus
AAICTHMEV

SEQ ID NO: 434293 - protein, 9 aa, Influenza virus
AAIDQINGK

SEQ ID NO: 434294 - protein, 9 aa, Influenza virus
AAIDQISGK

SEQ ID NO: 434295 - protein, 9 aa, Influenza virus
AAIDQITGK

SEQ ID NO: 434296 - protein, 9 aa, Influenza virus
AAIDQMTGK

SEQ ID NO: 434297 - protein, 9 aa, Influenza virus
AAIGLRISS

SEQ ID NO: 434298 - protein, 9 aa, Influenza virus
AAIKGIGTM

SEQ ID NO: 434299 - protein, 9 aa, Influenza virus
AAIKGVGTM

SEQ ID NO: 434300 - protein, 9 aa, Influenza virus
AAINQINGK

SEQ ID NO: 434301 - protein, 9 aa, Influenza virus
AALGLRISS

SEQ ID NO: 434302 - protein, 9 aa, Influenza virus
AALGSPGCD

SEQ ID NO: 434303 - protein, 9 aa, Influenza virus
AAMDDFQLI

SEQ ID NO: 434304 - protein, 9 aa, Influenza virus
AAMDEFQLI

SEQ ID NO: 434305 - protein, 9 aa, Influenza virus
AAMEDFQLI

SEQ ID NO: 434306 - protein, 9 aa, Influenza virus
AAMGLKISS

SEQ ID NO: 434307 - protein, 9 aa, Influenza virus
AAMGLRISS

SEQ ID NO: 434308 - protein, 9 aa, Influenza virus
AAMGMRISS

SEQ ID NO: 434309 - protein, 9 aa, Influenza virus
AANNADHRI

SEQ ID NO: 434310 - protein, 9 aa, Influenza virus
AANNADHRV

SEQ ID NO: 434311 - protein, 9 aa, Influenza virus
AANPIVPSF

SEQ ID NO: 434312 - protein, 9 aa, Influenza virus
AANSADHRI

SEQ ID NO: 434313 - protein, 9 aa, Influenza virus
AANSADHRV

SEQ ID NO: 434314 - protein, 9 aa, Influenza virus
AANSAHHRV

SEQ ID NO: 434315 - protein, 9 aa, Influenza virus
AAPHGLCYP

SEQ ID NO: 434316 - protein, 9 aa, Influenza virus
AAPPEQSRM

SEQ ID NO: 434317 - protein, 9 aa, Influenza virus
AAPPKQSRM

SEQ ID NO: 434318 - protein, 9 aa, Influenza virus
AAPPVQSKM

SEQ ID NO: 434319 - protein, 9 aa, Influenza virus
AAPPVQSRM

SEQ ID NO: 434320 - protein, 9 aa, Influenza virus
AAQELVESQ

SEQ ID NO: 434321 - protein, 9 aa, Influenza virus
AAQKAMMDQ

SEQ ID NO: 434322 - protein, 9 aa, Influenza virus
AAQRAMMDQ

SEQ ID NO: 434323 - protein, 9 aa, Influenza virus
AAQRAMVDQ

SEQ ID NO: 434324 - protein, 9 aa, Influenza virus
AARNIVRRA

SEQ ID NO: 434325 - protein, 9 aa, Influenza virus
AARSIVRRA

SEQ ID NO: 434326 - protein, 9 aa, Influenza virus
AASLCLAIL

SEQ ID NO: 434327 - protein, 9 aa, Influenza virus
AASLCLAVL

SEQ ID NO: 434328 - protein, 9 aa, Influenza virus
AASLSPGMM

SEQ ID NO: 434329 - protein, 9 aa, Influenza virus
AASSLALAI

SEQ ID NO: 434330 - protein, 9 aa, Influenza virus
AASYKRIRL

SEQ ID NO: 434331 - protein, 9 aa, Influenza virus
AASYKRVRL

SEQ ID NO: 434332 - protein, 9 aa, Influenza virus
AATALANTI

SEQ ID NO: 434333 - protein, 9 aa, Influenza virus
AATLCLGHH

SEQ ID NO: 434334 - protein, 9 aa, Influenza virus
AATQTLVSN

SEQ ID NO: 434335 - protein, 9 aa, Influenza virus
AATVTLHFK

SEQ ID NO: 434336 - protein, 9 aa, Influenza virus
AAVDQITGK

SEQ ID NO: 434337 - protein, 9 aa, Influenza virus
AAVKGIGTM

SEQ ID NO: 434338 - protein, 9 aa, Influenza virus
AAVKGVGTI

SEQ ID NO: 434339 - protein, 9 aa, Influenza virus
AAVKGVGTM

SEQ ID NO: 434340 - protein, 9 aa, Influenza virus
AAVSADPLA

SEQ ID NO: 434341 - protein, 9 aa, Influenza virus
AAWSSSSCF

SEQ ID NO: 434342 - protein, 9 aa, Influenza virus
AAWSSSSCH

SEQ ID NO: 434343 - protein, 9 aa, Influenza virus
ACELTDSIW

SEQ ID NO: 434344 - protein, 9 aa, Influenza virus
ACELTDSSW

SEQ ID NO: 434345 - protein, 9 aa, Influenza virus
ACELTDSTW

SEQ ID NO: 434346 - protein, 9 aa, Influenza virus
ACELTDSVW

SEQ ID NO: 434347 - protein, 9 aa, Influenza virus
ACELTGSSW

SEQ ID NO: 434348 - protein, 9 aa, Influenza virus
ACFQPCFYV

SEQ ID NO: 434349 - protein, 9 aa, Influenza virus
ACFYVELIR

SEQ ID NO: 434350 - protein, 9 aa, Influenza virus
ACGNGSCRC

SEQ ID NO: 434351 - protein, 9 aa, Influenza virus
ACGPAECRT

SEQ ID NO: 434352 - protein, 9 aa, Influenza virus
ACGPSECRT

SEQ ID NO: 434353 - protein, 9 aa, Influenza virus
ACGPTECRT

SEQ ID NO: 434354 - protein, 9 aa, Influenza virus
ACHDGASWL

SEQ ID NO: 434355 - protein, 9 aa, Influenza virus
ACHDGISWL

SEQ ID NO: 434356 - protein, 9 aa, Influenza virus
ACHDGKEWL

SEQ ID NO: 434357 - protein, 9 aa, Influenza virus
ACHDGKEWM

SEQ ID NO: 434358 - protein, 9 aa, Influenza virus
ACHDGKGWL

SEQ ID NO: 434359 - protein, 9 aa, Influenza virus
ACHDGKKWL

SEQ ID NO: 434360 - protein, 9 aa, Influenza virus
ACHDGKKWM

SEQ ID NO: 434361 - protein, 9 aa, Influenza virus
ACHDGKKWT

SEQ ID NO: 434362 - protein, 9 aa, Influenza virus
ACHDGRKWM

SEQ ID NO: 434363 - protein, 9 aa, Influenza virus
ACHDGSSWL

SEQ ID NO: 434364 - protein, 9 aa, Influenza virus
ACHDGTNWL

SEQ ID NO: 434365 - protein, 9 aa, Influenza virus
ACHDGTSWL

SEQ ID NO: 434366 - protein, 9 aa, Influenza virus
ACHSAAFED

SEQ ID NO: 434367 - protein, 9 aa, Influenza virus
ACITPNGSI

SEQ ID NO: 434368 - protein, 9 aa, Influenza virus
ACKRTVSSF

SEQ ID NO: 434369 - protein, 9 aa, Influenza virus
ACLRGGRNS

SEQ ID NO: 434370 - protein, 9 aa, Influenza virus
ACNALTGGQ

SEQ ID NO: 434371 - protein, 9 aa, Influenza virus
ACNASTGAQ

SEQ ID NO: 434372 - protein, 9 aa, Influenza virus
ACNASTGGQ

SEQ ID NO: 434373 - protein, 9 aa, Influenza virus
ACNNGSCRC

SEQ ID NO: 434374 - protein, 9 aa, Influenza virus
ACNSAAFED

SEQ ID NO: 434375 - protein, 9 aa, Influenza virus
ACNSGNCRF

SEQ ID NO: 434376 - protein, 9 aa, Influenza virus
ACQKGNIKC

SEQ ID NO: 434377 - protein, 9 aa, Influenza virus
ACQKGNIRC

SEQ ID NO: 434378 - protein, 9 aa, Influenza virus
ACQNGNIRC

SEQ ID NO: 434379 - protein, 9 aa, Influenza virus
ACQNGNLRC

SEQ ID NO: 434380 - protein, 9 aa, Influenza virus
ACQNGNVRC

SEQ ID NO: 434381 - protein, 9 aa, Influenza virus
ACQRGNIRC

SEQ ID NO: 434382 - protein, 9 aa, Influenza virus
ACQTGNIRC

SEQ ID NO: 434383 - protein, 9 aa, Influenza virus
ACSASTGGQ

SEQ ID NO: 434384 - protein, 9 aa, Influenza virus
ACSDGPGWL

SEQ ID NO: 434385 - protein, 9 aa, Influenza virus
ACSDGSGWL

SEQ ID NO: 434386 - protein, 9 aa, Influenza virus
ACSNGNCRF

SEQ ID NO: 434387 - protein, 9 aa, Influenza virus
ACSNGSCRC

SEQ ID NO: 434388 - protein, 9 aa, Influenza virus
ACSNGSCRF

SEQ ID NO: 434389 - protein, 9 aa, Influenza virus
ACSPSECRT

SEQ ID NO: 434390 - protein, 9 aa, Influenza virus
ACSSGNCRF

SEQ ID NO: 434391 - protein, 9 aa, Influenza virus
ACWEQLYTP

SEQ ID NO: 434392 - protein, 9 aa, Influenza virus
ACYNPCFYV

SEQ ID NO: 434393 - protein, 9 aa, Influenza virus
ADAQHRSHR

SEQ ID NO: 434394 - protein, 9 aa, Influenza virus
ADDDAYAVI

SEQ ID NO: 434395 - protein, 9 aa, Influenza virus
ADDEAYAVI

SEQ ID NO: 434396 - protein, 9 aa, Influenza virus
ADEICIGHL

SEQ ID NO: 434397 - protein, 9 aa, Influenza virus
ADEICIGYL

SEQ ID NO: 434398 - protein, 9 aa, Influenza virus
ADEICIGYM

SEQ ID NO: 434399 - protein, 9 aa, Influenza virus
ADGDIWVTR

SEQ ID NO: 434400 - protein, 9 aa, Influenza virus
ADGGPNLYN

SEQ ID NO: 434401 - protein, 9 aa, Influenza virus
ADGVKGFSY

SEQ ID NO: 434402 - protein, 9 aa, Influenza virus
ADHPPKVAW

SEQ ID NO: 434403 - protein, 9 aa, Influenza virus
ADHRIYWIK

SEQ ID NO: 434404 - protein, 9 aa, Influenza virus
ADHRIYWIR

SEQ ID NO: 434405 - protein, 9 aa, Influenza virus
ADHRIYWVR

SEQ ID NO: 434406 - protein, 9 aa, Influenza virus
ADHRVYWIR

SEQ ID NO: 434407 - protein, 9 aa, Influenza virus
ADIKSHAYI

SEQ ID NO: 434408 - protein, 9 aa, Influenza virus
ADINLHAYI

SEQ ID NO: 434409 - protein, 9 aa, Influenza virus
ADINLMPIY

SEQ ID NO: 434410 - protein, 9 aa, Influenza virus
ADKASTQKA

SEQ ID NO: 434411 - protein, 9 aa, Influenza virus
ADKDSNGVQ

SEQ ID NO: 434412 - protein, 9 aa, Influenza virus
ADKDSTQKA

SEQ ID NO: 434413 - protein, 9 aa, Influenza virus
ADKESTQEA

SEQ ID NO: 434414 - protein, 9 aa, Influenza virus
ADKESTQKA

SEQ ID NO: 434415 - protein, 9 aa, Influenza virus
ADKESTQKT

SEQ ID NO: 434416 - protein, 9 aa, Influenza virus
ADKESTQRA

SEQ ID NO: 434417 - protein, 9 aa, Influenza virus
ADKESTQTA

SEQ ID NO: 434418 - protein, 9 aa, Influenza virus
ADKICIGYL

SEQ ID NO: 434419 - protein, 9 aa, Influenza virus
ADKICLGHH

SEQ ID NO: 434420 - protein, 9 aa, Influenza virus
ADKICLGRH

SEQ ID NO: 434421 - protein, 9 aa, Influenza virus
ADKICVGYL

SEQ ID NO: 434422 - protein, 9 aa, Influenza virus
ADKKSTQKA

SEQ ID NO: 434423 - protein, 9 aa, Influenza virus
ADKTSTQKA

SEQ ID NO: 434424 - protein, 9 aa, Influenza virus
ADKVSTQKA

SEQ ID NO: 434425 - protein, 9 aa, Influenza virus
ADLEALMEW

SEQ ID NO: 434426 - protein, 9 aa, Influenza virus
ADLIIERRE

SEQ ID NO: 434427 - protein, 9 aa, Influenza virus
ADLIIERRN

SEQ ID NO: 434428 - protein, 9 aa, Influenza virus
ADLKSTQAA

SEQ ID NO: 434429 - protein, 9 aa, Influenza virus
ADLKSTQTA

SEQ ID NO: 434430 - protein, 9 aa, Influenza virus
ADLLVAMEN

SEQ ID NO: 434431 - protein, 9 aa, Influenza virus
ADMSIGITV

SEQ ID NO: 434432 - protein, 9 aa, Influenza virus
ADMSIGVAV

SEQ ID NO: 434433 - protein, 9 aa, Influenza virus
ADMSIGVTV

SEQ ID NO: 434434 - protein, 9 aa, Influenza virus
ADNDAYAVI

SEQ ID NO: 434435 - protein, 9 aa, Influenza virus
ADPLASLLE

SEQ ID NO: 434436 - protein, 9 aa, Influenza virus
ADPLLSLLE

SEQ ID NO: 434437 - protein, 9 aa, Influenza virus
ADPLVSLLE

SEQ ID NO: 434438 - protein, 9 aa, Influenza virus
ADQELGDAP

SEQ ID NO: 434439 - protein, 9 aa, Influenza virus
ADQESTQKA

SEQ ID NO: 434440 - protein, 9 aa, Influenza virus
ADQKSTQEA

SEQ ID NO: 434441 - protein, 9 aa, Influenza virus
ADQSLPPNF

SEQ ID NO: 434442 - protein, 9 aa, Influenza virus
ADRDSTQKA

SEQ ID NO: 434443 - protein, 9 aa, Influenza virus
ADRDSTQMA

SEQ ID NO: 434444 - protein, 9 aa, Influenza virus
ADRDSTQRA

SEQ ID NO: 434445 - protein, 9 aa, Influenza virus
ADRESTQKA

SEQ ID NO: 434446 - protein, 9 aa, Influenza virus
ADRESTQRA

SEQ ID NO: 434447 - protein, 9 aa, Influenza virus
ADRGSTQKA

SEQ ID NO: 434448 - protein, 9 aa, Influenza virus
ADRICIGYL

SEQ ID NO: 434449 - protein, 9 aa, Influenza virus
ADRICVGYL

SEQ ID NO: 434450 - protein, 9 aa, Influenza virus
ADRIDDAVT

SEQ ID NO: 434451 - protein, 9 aa, Influenza virus
ADRKSTQKA

SEQ ID NO: 434452 - protein, 9 aa, Influenza virus
ADRVDDAVT

SEQ ID NO: 434453 - protein, 9 aa, Influenza virus
ADSEMDKLY

SEQ ID NO: 434454 - protein, 9 aa, Influenza virus
ADSEMKKLY

SEQ ID NO: 434455 - protein, 9 aa, Influenza virus
ADSEMLNLY

SEQ ID NO: 434456 - protein, 9 aa, Influenza virus
ADSEMNKLF

SEQ ID NO: 434457 - protein, 9 aa, Influenza virus
ADSEMNKLH

SEQ ID NO: 434458 - protein, 9 aa, Influenza virus
ADSEMNKLY

SEQ ID NO: 434459 - protein, 9 aa, Influenza virus
ADSEMSKLY

SEQ ID NO: 434460 - protein, 9 aa, Influenza virus
ADSHHRSHR

SEQ ID NO: 434461 - protein, 9 aa, Influenza virus
ADSQHKSHR

SEQ ID NO: 434462 - protein, 9 aa, Influenza virus
ADSQHRSHR

SEQ ID NO: 434463 - protein, 9 aa, Influenza virus
ADTICIGYH

SEQ ID NO: 434464 - protein, 9 aa, Influenza virus
ADTICVGYH

SEQ ID NO: 434465 - protein, 9 aa, Influenza virus
ADTKILFIE

SEQ ID NO: 434466 - protein, 9 aa, Influenza virus
ADTLCIGYH

SEQ ID NO: 434467 - protein, 9 aa, Influenza virus
ADTRILFIE

SEQ ID NO: 434468 - protein, 9 aa, Influenza virus
ADTRILFIK

SEQ ID NO: 434469 - protein, 9 aa, Influenza virus
ADTRILFIR

SEQ ID NO: 434470 - protein, 9 aa, Influenza virus
ADTRILFVK

SEQ ID NO: 434471 - protein, 9 aa, Influenza virus
ADVLVALEN

SEQ ID NO: 434472 - protein, 9 aa, Influenza virus
ADWSWHDGA

SEQ ID NO: 434473 - protein, 9 aa, Influenza virus
ADWSWQDGA

SEQ ID NO: 434474 - protein, 9 aa, Influenza virus
ADWVDDAVT

SEQ ID NO: 434475 - protein, 9 aa, Influenza virus
ADYESTQAA

SEQ ID NO: 434476 - protein, 9 aa, Influenza virus
ADYKSTPSA

SEQ ID NO: 434477 - protein, 9 aa, Influenza virus
ADYKSTQAA

SEQ ID NO: 434478 - protein, 9 aa, Influenza virus
ADYKSTQKT

SEQ ID NO: 434479 - protein, 9 aa, Influenza virus
ADYKSTQSA

SEQ ID NO: 434480 - protein, 9 aa, Influenza virus
ADYKSTQTA

SEQ ID NO: 434481 - protein, 9 aa, Influenza virus
ADYRVYWIR

SEQ ID NO: 434482 - protein, 9 aa, Influenza virus
AECRTFFLT

SEQ ID NO: 434483 - protein, 9 aa, Influenza virus
AEDIGNGCF

SEQ ID NO: 434484 - protein, 9 aa, Influenza virus
AEDKGNGCF

SEQ ID NO: 434485 - protein, 9 aa, Influenza virus
AEDMGDGCF

SEQ ID NO: 434486 - protein, 9 aa, Influenza virus
AEDMGGGCF

SEQ ID NO: 434487 - protein, 9 aa, Influenza virus
AEDMGNGCF

SEQ ID NO: 434488 - protein, 9 aa, Influenza virus
AEDMGNGCL

SEQ ID NO: 434489 - protein, 9 aa, Influenza virus
AEDQGNGCF

SEQ ID NO: 434490 - protein, 9 aa, Influenza virus
AEDRGNGCF

SEQ ID NO: 434491 - protein, 9 aa, Influenza virus
AEEDCTGCF

SEQ ID NO: 434492 - protein, 9 aa, Influenza virus
AEEDGKGCF

SEQ ID NO: 434493 - protein, 9 aa, Influenza virus
AEEDGNGCF

SEQ ID NO: 434494 - protein, 9 aa, Influenza virus
AEEDGRGCF

SEQ ID NO: 434495 - protein, 9 aa, Influenza virus
AEEDGTGCF

SEQ ID NO: 434496 - protein, 9 aa, Influenza virus
AEEMGNGCF

SEQ ID NO: 434497 - protein, 9 aa, Influenza virus
AEESKLKRQ

SEQ ID NO: 434498 - protein, 9 aa, Influenza virus
AEFLVALEN

SEQ ID NO: 434499 - protein, 9 aa, Influenza virus
AEFLVAVEN

SEQ ID NO: 434500 - protein, 9 aa, Influenza virus
AEFLVLMEN

SEQ ID NO: 434501 - protein, 9 aa, Influenza virus
AEGDCYRAC

SEQ ID NO: 434502 - protein, 9 aa, Influenza virus
AEGECYRAC

SEQ ID NO: 434503 - protein, 9 aa, Influenza virus
AEGIGIAAD

SEQ ID NO: 434504 - protein, 9 aa, Influenza virus
AEGRTSDMR

SEQ ID NO: 434505 - protein, 9 aa, Influenza virus
AEGTGIAAD

SEQ ID NO: 434506 - protein, 9 aa, Influenza virus
AEGTGMAAD

SEQ ID NO: 434507 - protein, 9 aa, Influenza virus
AEGTGTAAD

SEQ ID NO: 434508 - protein, 9 aa, Influenza virus
AEIAQKLED

SEQ ID NO: 434509 - protein, 9 aa, Influenza virus
AEIAQRLED

SEQ ID NO: 434510 - protein, 9 aa, Influenza virus
AEIAQRLEG

SEQ ID NO: 434511 - protein, 9 aa, Influenza virus
AEIAQRLEN

SEQ ID NO: 434512 - protein, 9 aa, Influenza virus
AEIAQRLES

SEQ ID NO: 434513 - protein, 9 aa, Influenza virus
AEIEDLIFL

SEQ ID NO: 434514 - protein, 9 aa, Influenza virus
AEIEDLIFM

SEQ ID NO: 434515 - protein, 9 aa, Influenza virus
AEIEDLIFS

SEQ ID NO: 434516 - protein, 9 aa, Influenza virus
AEIEDLTFL

SEQ ID NO: 434517 - protein, 9 aa, Influenza virus
AEILVALEN

SEQ ID NO: 434518 - protein, 9 aa, Influenza virus
AEILVLMEN

SEQ ID NO: 434519 - protein, 9 aa, Influenza virus
AEINTWARN

SEQ ID NO: 434520 - protein, 9 aa, Influenza virus
AEISHCRAT

SEQ ID NO: 434521 - protein, 9 aa, Influenza virus
AEKAMKEHG

SEQ ID NO: 434522 - protein, 9 aa, Influenza virus
AEKAMKEYG

SEQ ID NO: 434523 - protein, 9 aa, Influenza virus
AEKESTQKA

SEQ ID NO: 434524 - protein, 9 aa, Influenza virus
AEKTMKEYG

SEQ ID NO: 434525 - protein, 9 aa, Influenza virus
AELAEKAMK

SEQ ID NO: 434526 - protein, 9 aa, Influenza virus
AELFVLMEN

SEQ ID NO: 434527 - protein, 9 aa, Influenza virus
AELIVLLEN

SEQ ID NO: 434528 - protein, 9 aa, Influenza virus
AELKWLISK

SEQ ID NO: 434529 - protein, 9 aa, Influenza virus
AELKWLVSK

SEQ ID NO: 434530 - protein, 9 aa, Influenza virus
AELLIAMEN

SEQ ID NO: 434531 - protein, 9 aa, Influenza virus
AELLILLEN

SEQ ID NO: 434532 - protein, 9 aa, Influenza virus
AELLVAIEN

SEQ ID NO: 434533 - protein, 9 aa, Influenza virus
AELLVALEN

SEQ ID NO: 434534 - protein, 9 aa, Influenza virus
AELLVAMEN

SEQ ID NO: 434535 - protein, 9 aa, Influenza virus
AELLVLIEN

SEQ ID NO: 434536 - protein, 9 aa, Influenza virus
AELLVLLED

SEQ ID NO: 434537 - protein, 9 aa, Influenza virus
AELLVLLEN

SEQ ID NO: 434538 - protein, 9 aa, Influenza virus
AELLVLLGN

SEQ ID NO: 434539 - protein, 9 aa, Influenza virus
AELLVLMEN

SEQ ID NO: 434540 - protein, 9 aa, Influenza virus
AEMEWLLSN

SEQ ID NO: 434541 - protein, 9 aa, Influenza virus
AEMKWLLSD

SEQ ID NO: 434542 - protein, 9 aa, Influenza virus
AEMKWLLSN

SEQ ID NO: 434543 - protein, 9 aa, Influenza virus
AEMKWLLSS

SEQ ID NO: 434544 - protein, 9 aa, Influenza virus
AEQFTWNGV

SEQ ID NO: 434545 - protein, 9 aa, Influenza virus
AEQTKLYGS

SEQ ID NO: 434546 - protein, 9 aa, Influenza virus
AERGKLKRR

SEQ ID NO: 434547 - protein, 9 aa, Influenza virus
AERQEIVDN

SEQ ID NO: 434548 - protein, 9 aa, Influenza virus
AESEMNKLY

SEQ ID NO: 434549 - protein, 9 aa, Influenza virus
AESRKLLLI

SEQ ID NO: 434550 - protein, 9 aa, Influenza virus
AESRKLLLV

SEQ ID NO: 434551 - protein, 9 aa, Influenza virus
AESRKMLLI

SEQ ID NO: 434552 - protein, 9 aa, Influenza virus
AESSIKEKD

SEQ ID NO: 434553 - protein, 9 aa, Influenza virus
AESSVKEKD

SEQ ID NO: 434554 - protein, 9 aa, Influenza virus
AESSVREKD

SEQ ID NO: 434555 - protein, 9 aa, Influenza virus
AEVLVLMEN

SEQ ID NO: 434556 - protein, 9 aa, Influenza virus
AEVSHCRAT

SEQ ID NO: 434557 - protein, 9 aa, Influenza virus
AEVSYCRAT

SEQ ID NO: 434558 - protein, 9 aa, Influenza virus
AFCGTSGTY

SEQ ID NO: 434559 - protein, 9 aa, Influenza virus
AFCGVDSDT

SEQ ID NO: 434560 - protein, 9 aa, Influenza virus
AFCGVNFDL

SEQ ID NO: 434561 - protein, 9 aa, Influenza virus
AFCGVNSDT

SEQ ID NO: 434562 - protein, 9 aa, Influenza virus
AFDERRNKY

SEQ ID NO: 434563 - protein, 9 aa, Influenza virus
AFDERRNRY

SEQ ID NO: 434564 - protein, 9 aa, Influenza virus
AFFRNMVWL

SEQ ID NO: 434565 - protein, 9 aa, Influenza virus
AFGLICATC

SEQ ID NO: 434566 - protein, 9 aa, Influenza virus
AFGLVCATC

SEQ ID NO: 434567 - protein, 9 aa, Influenza virus
AFGPVHFRN

SEQ ID NO: 434568 - protein, 9 aa, Influenza virus
AFIAPDRAS

SEQ ID NO: 434569 - protein, 9 aa, Influenza virus
AFIAPDRAT

SEQ ID NO: 434570 - protein, 9 aa, Influenza virus
AFIAPDRVS

SEQ ID NO: 434571 - protein, 9 aa, Influenza virus
AFIAPNRAS

SEQ ID NO: 434572 - protein, 9 aa, Influenza virus
AFICIKNGN

SEQ ID NO: 434573 - protein, 9 aa, Influenza virus
AFILWACQN

SEQ ID NO: 434574 - protein, 9 aa, Influenza virus
AFILWACSS

SEQ ID NO: 434575 - protein, 9 aa, Influenza virus
AFIMWACSN

SEQ ID NO: 434576 - protein, 9 aa, Influenza virus
AFIMWACSS

SEQ ID NO: 434577 - protein, 9 aa, Influenza virus
AFKQGNSVW

SEQ ID NO: 434578 - protein, 9 aa, Influenza virus
AFLEDSHPG

SEQ ID NO: 434579 - protein, 9 aa, Influenza virus
AFLEESHPG

SEQ ID NO: 434580 - protein, 9 aa, Influenza virus
AFLEKSHPG

SEQ ID NO: 434581 - protein, 9 aa, Influenza virus
AFLENSHPG

SEQ ID NO: 434582 - protein, 9 aa, Influenza virus
AFLTSSIVC

SEQ ID NO: 434583 - protein, 9 aa, Influenza virus
AFMLWACQN

SEQ ID NO: 434584 - protein, 9 aa, Influenza virus
AFRDNLEPG

SEQ ID NO: 434585 - protein, 9 aa, Influenza virus
AFRGLISTH

SEQ ID NO: 434586 - protein, 9 aa, Influenza virus
AFRGLISTP

SEQ ID NO: 434587 - protein, 9 aa, Influenza virus
AFRGLISTQ

SEQ ID NO: 434588 - protein, 9 aa, Influenza virus
AFRGLMSTP

SEQ ID NO: 434589 - protein, 9 aa, Influenza virus
AFSGMSANG

SEQ ID NO: 434590 - protein, 9 aa, Influenza virus
AFSVQRNLP

SEQ ID NO: 434591 - protein, 9 aa, Influenza virus
AFVAPDRAS

SEQ ID NO: 434592 - protein, 9 aa, Influenza virus
AFVAPDRVS

SEQ ID NO: 434593 - protein, 9 aa, Influenza virus
AFVLWACQN

SEQ ID NO: 434594 - protein, 9 aa, Influenza virus
AFYKILKIK

SEQ ID NO: 434595 - protein, 9 aa, Influenza virus
AFYKILKIR

SEQ ID NO: 434596 - protein, 9 aa, Influenza virus
AFYRSINWL

SEQ ID NO: 434597 - protein, 9 aa, Influenza virus
AGAAIKGVG

SEQ ID NO: 434598 - protein, 9 aa, Influenza virus
AGAAVKGIG

SEQ ID NO: 434599 - protein, 9 aa, Influenza virus
AGAAVKGVG

SEQ ID NO: 434600 - protein, 9 aa, Influenza virus
AGAGALAED

SEQ ID NO: 434601 - protein, 9 aa, Influenza virus
AGAINSSKP

SEQ ID NO: 434602 - protein, 9 aa, Influenza virus
AGAINSSRP

SEQ ID NO: 434603 - protein, 9 aa, Influenza virus
AGALASCMG

SEQ ID NO: 434604 - protein, 9 aa, Influenza virus
AGAVNSSKP

SEQ ID NO: 434605 - protein, 9 aa, Influenza virus
AGDGCFEIL

SEQ ID NO: 434606 - protein, 9 aa, Influenza virus
AGFAPFSKD

SEQ ID NO: 434607 - protein, 9 aa, Influenza virus
AGFHFEECS

SEQ ID NO: 434608 - protein, 9 aa, Influenza virus
AGFIEGGWC

SEQ ID NO: 434609 - protein, 9 aa, Influenza virus
AGFIEGGWP

SEQ ID NO: 434610 - protein, 9 aa, Influenza virus
AGFIEGGWQ

SEQ ID NO: 434611 - protein, 9 aa, Influenza virus
AGFIEGGWS

SEQ ID NO: 434612 - protein, 9 aa, Influenza virus
AGFIEGGWT

SEQ ID NO: 434613 - protein, 9 aa, Influenza virus
AGFIEGRWP

SEQ ID NO: 434614 - protein, 9 aa, Influenza virus
AGFIENGWE

SEQ ID NO: 434615 - protein, 9 aa, Influenza virus
AGFIENGWQ

SEQ ID NO: 434616 - protein, 9 aa, Influenza virus
AGGAIWVTR

SEQ ID NO: 434617 - protein, 9 aa, Influenza virus
AGGDIWATR

SEQ ID NO: 434618 - protein, 9 aa, Influenza virus
AGGDIWITR

SEQ ID NO: 434619 - protein, 9 aa, Influenza virus
AGGDIWVTR

SEQ ID NO: 434620 - protein, 9 aa, Influenza virus
AGGHIWVTR

SEQ ID NO: 434621 - protein, 9 aa, Influenza virus
AGGLILGMQ

SEQ ID NO: 434622 - protein, 9 aa, Influenza virus
AGGNIWITR

SEQ ID NO: 434623 - protein, 9 aa, Influenza virus
AGIFFWMCS

SEQ ID NO: 434624 - protein, 9 aa, Influenza virus
AGIFLWMCS

SEQ ID NO: 434625 - protein, 9 aa, Influenza virus
AGIPSDTPR

SEQ ID NO: 434626 - protein, 9 aa, Influenza virus
AGIPTDTPR

SEQ ID NO: 434627 - protein, 9 aa, Influenza virus
AGISFWMCS

SEQ ID NO: 434628 - protein, 9 aa, Influenza virus
AGISIWMCS

SEQ ID NO: 434629 - protein, 9 aa, Influenza virus
AGISLWMCS

SEQ ID NO: 434630 - protein, 9 aa, Influenza virus
AGKDPKKTG

SEQ ID NO: 434631 - protein, 9 aa, Influenza virus
AGKILRTQE

SEQ ID NO: 434632 - protein, 9 aa, Influenza virus
AGKNADLEA

SEQ ID NO: 434633 - protein, 9 aa, Influenza virus
AGKNSDLEA

SEQ ID NO: 434634 - protein, 9 aa, Influenza virus
AGKNTDLEA

SEQ ID NO: 434635 - protein, 9 aa, Influenza virus
AGKNTDLEV

SEQ ID NO: 434636 - protein, 9 aa, Influenza virus
AGLFFWMCS

SEQ ID NO: 434637 - protein, 9 aa, Influenza virus
AGLFLWMCS

SEQ ID NO: 434638 - protein, 9 aa, Influenza virus
AGLLLWMCS

SEQ ID NO: 434639 - protein, 9 aa, Influenza virus
AGLLVALEN

SEQ ID NO: 434640 - protein, 9 aa, Influenza virus
AGLPSDTPR

SEQ ID NO: 434641 - protein, 9 aa, Influenza virus
AGLSFWMCS

SEQ ID NO: 434642 - protein, 9 aa, Influenza virus
AGLSLWMCF

SEQ ID NO: 434643 - protein, 9 aa, Influenza virus
AGLSLWMCS

SEQ ID NO: 434644 - protein, 9 aa, Influenza virus
AGLTHIMIW

SEQ ID NO: 434645 - protein, 9 aa, Influenza virus
AGLTHLMIW

SEQ ID NO: 434646 - protein, 9 aa, Influenza virus
AGLTHMMIW

SEQ ID NO: 434647 - protein, 9 aa, Influenza virus
AGLVLGNPM

SEQ ID NO: 434648 - protein, 9 aa, Influenza virus
AGNGCFDIL

SEQ ID NO: 434649 - protein, 9 aa, Influenza virus
AGNILRTQE

SEQ ID NO: 434650 - protein, 9 aa, Influenza virus
AGNKLITVG

SEQ ID NO: 434651 - protein, 9 aa, Influenza virus
AGRIDFHWM

SEQ ID NO: 434652 - protein, 9 aa, Influenza virus
AGRMTFYWA

SEQ ID NO: 434653 - protein, 9 aa, Influenza virus
AGRMTFYWI

SEQ ID NO: 434654 - protein, 9 aa, Influenza virus
AGRMTFYWK

SEQ ID NO: 434655 - protein, 9 aa, Influenza virus
AGRMTFYWT

SEQ ID NO: 434656 - protein, 9 aa, Influenza virus
AGSAQHVEE

SEQ ID NO: 434657 - protein, 9 aa, Influenza virus
AGSLSLAIM

SEQ ID NO: 434658 - protein, 9 aa, Influenza virus
AGSSEQAAE

SEQ ID NO: 434659 - protein, 9 aa, Influenza virus
AGSWPDGAN

SEQ ID NO: 434660 - protein, 9 aa, Influenza virus
AGTAKHIEE

SEQ ID NO: 434661 - protein, 9 aa, Influenza virus
AGVDRFYRI

SEQ ID NO: 434662 - protein, 9 aa, Influenza virus
AGVDRFYRT

SEQ ID NO: 434663 - protein, 9 aa, Influenza virus
AGVESAVLR

SEQ ID NO: 434664 - protein, 9 aa, Influenza virus
AGVETMVIL

SEQ ID NO: 434665 - protein, 9 aa, Influenza virus
AGVKMNPNQ

SEQ ID NO: 434666 - protein, 9 aa, Influenza virus
AGVNRFYRT

SEQ ID NO: 434667 - protein, 9 aa, Influenza virus
AGWILGNPE

SEQ ID NO: 434668 - protein, 9 aa, Influenza virus
AGWILGNPK

SEQ ID NO: 434669 - protein, 9 aa, Influenza virus
AGWILGNPM

SEQ ID NO: 434670 - protein, 9 aa, Influenza virus
AGWILGNPR

SEQ ID NO: 434671 - protein, 9 aa, Influenza virus
AGWLIGNPK

SEQ ID NO: 434672 - protein, 9 aa, Influenza virus
AGWLLGNPE

SEQ ID NO: 434673 - protein, 9 aa, Influenza virus
AGWLLGNPK

SEQ ID NO: 434674 - protein, 9 aa, Influenza virus
AGWLLGNPL

SEQ ID NO: 434675 - protein, 9 aa, Influenza virus
AGWLLGNPM

SEQ ID NO: 434676 - protein, 9 aa, Influenza virus
AGWYGFQHQ

SEQ ID NO: 434677 - protein, 9 aa, Influenza virus
AGWYGFQHS

SEQ ID NO: 434678 - protein, 9 aa, Influenza virus
AGWYGFQHT

SEQ ID NO: 434679 - protein, 9 aa, Influenza virus
AGYAADKES

SEQ ID NO: 434680 - protein, 9 aa, Influenza virus
AGYEMLKVP

SEQ ID NO: 434681 - protein, 9 aa, Influenza virus
AHALKLVVA

SEQ ID NO: 434682 - protein, 9 aa, Influenza virus
AHCYPGATI

SEQ ID NO: 434683 - protein, 9 aa, Influenza virus
AHDRICIGY

SEQ ID NO: 434684 - protein, 9 aa, Influenza virus
AHHRVYWIR

SEQ ID NO: 434685 - protein, 9 aa, Influenza virus
AHILVTREP

SEQ ID NO: 434686 - protein, 9 aa, Influenza virus
AHISPLSGS

SEQ ID NO: 434687 - protein, 9 aa, Influenza virus
AHKQLTHHM

SEQ ID NO: 434688 - protein, 9 aa, Influenza virus
AHKSCLPAC

SEQ ID NO: 434689 - protein, 9 aa, Influenza virus
AHKSQLIWM

SEQ ID NO: 434690 - protein, 9 aa, Influenza virus
AHKSQLVWM

SEQ ID NO: 434691 - protein, 9 aa, Influenza virus
AHNGKLCRL

SEQ ID NO: 434692 - protein, 9 aa, Influenza virus
AHTKVLYFH

SEQ ID NO: 434693 - protein, 9 aa, Influenza virus
AHVLVTREP

SEQ ID NO: 434694 - protein, 9 aa, Influenza virus
AIAGFIEGG

SEQ ID NO: 434695 - protein, 9 aa, Influenza virus
AIAGFIEGR

SEQ ID NO: 434696 - protein, 9 aa, Influenza virus
AIAGFIENG

SEQ ID NO: 434697 - protein, 9 aa, Influenza virus
AIALGIINL

SEQ ID NO: 434698 - protein, 9 aa, Influenza virus
AIALSILNL

SEQ ID NO: 434699 - protein, 9 aa, Influenza virus
AIALSVLNL

SEQ ID NO: 434700 - protein, 9 aa, Influenza virus
AIAMGFVFI

SEQ ID NO: 434701 - protein, 9 aa, Influenza virus
AIAMGLIFM

SEQ ID NO: 434702 - protein, 9 aa, Influenza virus
AIAMGLVFI

SEQ ID NO: 434703 - protein, 9 aa, Influenza virus
AIAMGLVFM

SEQ ID NO: 434704 - protein, 9 aa, Influenza virus
AIASKDNGI

SEQ ID NO: 434705 - protein, 9 aa, Influenza virus
AIATPGMQI

SEQ ID NO: 434706 - protein, 9 aa, Influenza virus
AICTHLEIC

SEQ ID NO: 434707 - protein, 9 aa, Influenza virus
AICTHLEVC

SEQ ID NO: 434708 - protein, 9 aa, Influenza virus
AICTHMEVC

SEQ ID NO: 434709 - protein, 9 aa, Influenza virus
AIDAGDGCF

SEQ ID NO: 434710 - protein, 9 aa, Influenza virus
AIDAGNGCF

SEQ ID NO: 434711 - protein, 9 aa, Influenza virus
AIDEGDGCF

SEQ ID NO: 434712 - protein, 9 aa, Influenza virus
AIDEGNGCF

SEQ ID NO: 434713 - protein, 9 aa, Influenza virus
AIDEITTKI

SEQ ID NO: 434714 - protein, 9 aa, Influenza virus
AIDGITNKI

SEQ ID NO: 434715 - protein, 9 aa, Influenza virus
AIDGITNKV

SEQ ID NO: 434716 - protein, 9 aa, Influenza virus
AIDGVTNKV

SEQ ID NO: 434717 - protein, 9 aa, Influenza virus
AIDIMQNKL

SEQ ID NO: 434718 - protein, 9 aa, Influenza virus
AIDKITNKI

SEQ ID NO: 434719 - protein, 9 aa, Influenza virus
AIDKITNKV

SEQ ID NO: 434720 - protein, 9 aa, Influenza virus
AIDNGDGCF

SEQ ID NO: 434721 - protein, 9 aa, Influenza virus
AIDNMQNKL

SEQ ID NO: 434722 - protein, 9 aa, Influenza virus
AIDNMQNRL

SEQ ID NO: 434723 - protein, 9 aa, Influenza virus
AIDQINGKL

SEQ ID NO: 434724 - protein, 9 aa, Influenza virus
AIDQITGKL

SEQ ID NO: 434725 - protein, 9 aa, Influenza virus
AIDQITGTL

SEQ ID NO: 434726 - protein, 9 aa, Influenza virus
AIDQITRKL

SEQ ID NO: 434727 - protein, 9 aa, Influenza virus
AIDQITTKI

SEQ ID NO: 434728 - protein, 9 aa, Influenza virus
AIDQVNGKL

SEQ ID NO: 434729 - protein, 9 aa, Influenza virus
AIDQVTGKL

SEQ ID NO: 434730 - protein, 9 aa, Influenza virus
AIDRITTKI

SEQ ID NO: 434731 - protein, 9 aa, Influenza virus
AIDTGDGCF

SEQ ID NO: 434732 - protein, 9 aa, Influenza virus
AIDTGKGCF

SEQ ID NO: 434733 - protein, 9 aa, Influenza virus
AIDTGNGCF

SEQ ID NO: 434734 - protein, 9 aa, Influenza virus
AIEECLIND

SEQ ID NO: 434735 - protein, 9 aa, Influenza virus
AIEKITNKV

SEQ ID NO: 434736 - protein, 9 aa, Influenza virus
AIENQHTID

SEQ ID NO: 434737 - protein, 9 aa, Influenza virus
AIFSKDNGI

SEQ ID NO: 434738 - protein, 9 aa, Influenza virus
AIGAIDSSM

SEQ ID NO: 434739 - protein, 9 aa, Influenza virus
AIGDCPKYI

SEQ ID NO: 434740 - protein, 9 aa, Influenza virus
AIGDCPKYV

SEQ ID NO: 434741 - protein, 9 aa, Influenza virus
AIGECPKYV

SEQ ID NO: 434742 - protein, 9 aa, Influenza virus
AIGGSGTDN

SEQ ID NO: 434743 - protein, 9 aa, Influenza virus
AIGGSGTNN

SEQ ID NO: 434744 - protein, 9 aa, Influenza virus
AIGKITNKV

SEQ ID NO: 434745 - protein, 9 aa, Influenza virus
AIGLRISSS

SEQ ID NO: 434746 - protein, 9 aa, Influenza virus
AIGLRNTPS

SEQ ID NO: 434747 - protein, 9 aa, Influenza virus
AIGLRNVPQ

SEQ ID NO: 434748 - protein, 9 aa, Influenza virus
AIGNCPKYV

SEQ ID NO: 434749 - protein, 9 aa, Influenza virus
AIGPRNVPQ

SEQ ID NO: 434750 - protein, 9 aa, Influenza virus
AIHHPPTSA

SEQ ID NO: 434751 - protein, 9 aa, Influenza virus
AIHHPPTSD

SEQ ID NO: 434752 - protein, 9 aa, Influenza virus
AIHHPPTSN

SEQ ID NO: 434753 - protein, 9 aa, Influenza virus
AIHHPPTTD

SEQ ID NO: 434754 - protein, 9 aa, Influenza virus
AIIIAGLSF

SEQ ID NO: 434755 - protein, 9 aa, Influenza virus
AIIKKYTSA

SEQ ID NO: 434756 - protein, 9 aa, Influenza virus
AIIKKYTSG

SEQ ID NO: 434757 - protein, 9 aa, Influenza virus
AIISKDNGI

SEQ ID NO: 434758 - protein, 9 aa, Influenza virus
AILAATVTL

SEQ ID NO: 434759 - protein, 9 aa, Influenza virus
AILATTITL

SEQ ID NO: 434760 - protein, 9 aa, Influenza virus
AILATTVTL

SEQ ID NO: 434761 - protein, 9 aa, Influenza virus
AILIAGGLI

SEQ ID NO: 434762 - protein, 9 aa, Influenza virus
AILKPGQTV

SEQ ID NO: 434763 - protein, 9 aa, Influenza virus
AILPFDIDK

SEQ ID NO: 434764 - protein, 9 aa, Influenza virus
AILPLTSIR

SEQ ID NO: 434765 - protein, 9 aa, Influenza virus
AILVAGGLI

SEQ ID NO: 434766 - protein, 9 aa, Influenza virus
AILVTTVTL

SEQ ID NO: 434767 - protein, 9 aa, Influenza virus
AIMIAGLFF

SEQ ID NO: 434768 - protein, 9 aa, Influenza virus
AIMIAGLSF

SEQ ID NO: 434769 - protein, 9 aa, Influenza virus
AIMMAGLSF

SEQ ID NO: 434770 - protein, 9 aa, Influenza virus
AIMVAGLSF

SEQ ID NO: 434771 - protein, 9 aa, Influenza virus
AINEGNGCF

SEQ ID NO: 434772 - protein, 9 aa, Influenza virus
AINEITTKI

SEQ ID NO: 434773 - protein, 9 aa, Influenza virus
AINGVTNKV

SEQ ID NO: 434774 - protein, 9 aa, Influenza virus
AINKITNKV

SEQ ID NO: 434775 - protein, 9 aa, Influenza virus
AINLYASKN

SEQ ID NO: 434776 - protein, 9 aa, Influenza virus
AINNRFQIQ

SEQ ID NO: 434777 - protein, 9 aa, Influenza virus
AINNRIKIN

SEQ ID NO: 434778 - protein, 9 aa, Influenza virus
AINQINGKL

SEQ ID NO: 434779 - protein, 9 aa, Influenza virus
AINQITGKL

SEQ ID NO: 434780 - protein, 9 aa, Influenza virus
AINSRFQIQ

SEQ ID NO: 434781 - protein, 9 aa, Influenza virus
AINSSKPFQ

SEQ ID NO: 434782 - protein, 9 aa, Influenza virus
AINSSKPLQ

SEQ ID NO: 434783 - protein, 9 aa, Influenza virus
AINSSMPFH

SEQ ID NO: 434784 - protein, 9 aa, Influenza virus
AINSSMPLH

SEQ ID NO: 434785 - protein, 9 aa, Influenza virus
AINSSRPFQ

SEQ ID NO: 434786 - protein, 9 aa, Influenza virus
AINTSMPFH

SEQ ID NO: 434787 - protein, 9 aa, Influenza virus
AINTTLPFH

SEQ ID NO: 434788 - protein, 9 aa, Influenza virus
AIRFGEGEQ

SEQ ID NO: 434789 - protein, 9 aa, Influenza virus
AIRFGESEQ

SEQ ID NO: 434790 - protein, 9 aa, Influenza virus
AIRIGEDAH

SEQ ID NO: 434791 - protein, 9 aa, Influenza virus
AIRIGEEAH

SEQ ID NO: 434792 - protein, 9 aa, Influenza virus
AIRIGEGAH

SEQ ID NO: 434793 - protein, 9 aa, Influenza virus
AIRIGENAH

SEQ ID NO: 434794 - protein, 9 aa, Influenza virus
AIRNGTYNH

SEQ ID NO: 434795 - protein, 9 aa, Influenza virus
AIRPKVNGQ

SEQ ID NO: 434796 - protein, 9 aa, Influenza virus
AIRTRSGGN

SEQ ID NO: 434797 - protein, 9 aa, Influenza virus
AISFWMCSG

SEQ ID NO: 434798 - protein, 9 aa, Influenza virus
AISFWMCSN

SEQ ID NO: 434799 - protein, 9 aa, Influenza virus
AISNRFQIQ

SEQ ID NO: 434800 - protein, 9 aa, Influenza virus
AISTTFPYT

SEQ ID NO: 434801 - protein, 9 aa, Influenza virus
AITRSGQNH

SEQ ID NO: 434802 - protein, 9 aa, Influenza virus
AIVFSQEDC

SEQ ID NO: 434803 - protein, 9 aa, Influenza virus
AIVLGIINL

SEQ ID NO: 434804 - protein, 9 aa, Influenza virus
AIVMGLVFI

SEQ ID NO: 434805 - protein, 9 aa, Influenza virus
AIVQITGKL

SEQ ID NO: 434806 - protein, 9 aa, Influenza virus
AIVSADPLA

SEQ ID NO: 434807 - protein, 9 aa, Influenza virus
AIVSKDNGI

SEQ ID NO: 434808 - protein, 9 aa, Influenza virus
AIWTSGSSI

SEQ ID NO: 434809 - protein, 9 aa, Influenza virus
AIWTSSSSI

SEQ ID NO: 434810 - protein, 9 aa, Influenza virus
AIWVTREPY

SEQ ID NO: 434811 - protein, 9 aa, Influenza virus
AIYATVAGS

SEQ ID NO: 434812 - protein, 9 aa, Influenza virus
AIYSCIASS

SEQ ID NO: 434813 - protein, 9 aa, Influenza virus
AIYSTAASS

SEQ ID NO: 434814 - protein, 9 aa, Influenza virus
AIYSTISSS

SEQ ID NO: 434815 - protein, 9 aa, Influenza virus
AIYSTVASS

SEQ ID NO: 434816 - protein, 9 aa, Influenza virus
AIYSTVSSS

SEQ ID NO: 434817 - protein, 9 aa, Influenza virus
AKAGFIEGG

SEQ ID NO: 434818 - protein, 9 aa, Influenza virus
AKAGFIENG

SEQ ID NO: 434819 - protein, 9 aa, Influenza virus
AKAGVKMNP

SEQ ID NO: 434820 - protein, 9 aa, Influenza virus
AKAMEQMAG

SEQ ID NO: 434821 - protein, 9 aa, Influenza virus
AKAMEQVAG

SEQ ID NO: 434822 - protein, 9 aa, Influenza virus
AKCNTKCQT

SEQ ID NO: 434823 - protein, 9 aa, Influenza virus
AKDEGNGCF

SEQ ID NO: 434824 - protein, 9 aa, Influenza virus
AKDILEKTH

SEQ ID NO: 434825 - protein, 9 aa, Influenza virus
AKDLGNGCF

SEQ ID NO: 434826 - protein, 9 aa, Influenza virus
AKDNAIRFG

SEQ ID NO: 434827 - protein, 9 aa, Influenza virus
AKDNAVRFG

SEQ ID NO: 434828 - protein, 9 aa, Influenza virus
AKDNSIRLS

SEQ ID NO: 434829 - protein, 9 aa, Influenza virus
AKEAQDVIM

SEQ ID NO: 434830 - protein, 9 aa, Influenza virus
AKEECYRAC

SEQ ID NO: 434831 - protein, 9 aa, Influenza virus
AKEIALSYS

SEQ ID NO: 434832 - protein, 9 aa, Influenza virus
AKEIGNGCF

SEQ ID NO: 434833 - protein, 9 aa, Influenza virus
AKELGNGCF

SEQ ID NO: 434834 - protein, 9 aa, Influenza virus
AKELVETNH

SEQ ID NO: 434835 - protein, 9 aa, Influenza virus
AKEMGNGCF

SEQ ID NO: 434836 - protein, 9 aa, Influenza virus
AKEQTALYK

SEQ ID NO: 434837 - protein, 9 aa, Influenza virus
AKEQTTLYK

SEQ ID NO: 434838 - protein, 9 aa, Influenza virus
AKETGNGCF

SEQ ID NO: 434839 - protein, 9 aa, Influenza virus
AKEVALGYS

SEQ ID NO: 434840 - protein, 9 aa, Influenza virus
AKEVALSYS

SEQ ID NO: 434841 - protein, 9 aa, Influenza virus
AKEVGNGCF

SEQ ID NO: 434842 - protein, 9 aa, Influenza virus
AKEVSLSYS

SEQ ID NO: 434843 - protein, 9 aa, Influenza virus
AKEWGNGCF

SEQ ID NO: 434844 - protein, 9 aa, Influenza virus
AKFEAVAWS

SEQ ID NO: 434845 - protein, 9 aa, Influenza virus
AKFESVAWS

SEQ ID NO: 434846 - protein, 9 aa, Influenza virus
AKGDCYRAC

SEQ ID NO: 434847 - protein, 9 aa, Influenza virus
AKGDKICLG

SEQ ID NO: 434848 - protein, 9 aa, Influenza virus
AKGECYRAC

SEQ ID NO: 434849 - protein, 9 aa, Influenza virus
AKGEKANVL

SEQ ID NO: 434850 - protein, 9 aa, Influenza virus
AKGLFGAIA

SEQ ID NO: 434851 - protein, 9 aa, Influenza virus
AKGSYNNTN

SEQ ID NO: 434852 - protein, 9 aa, Influenza virus
AKGSYNNTS

SEQ ID NO: 434853 - protein, 9 aa, Influenza virus
AKHIEECSC

SEQ ID NO: 434854 - protein, 9 aa, Influenza virus
AKHIEECSS

SEQ ID NO: 434855 - protein, 9 aa, Influenza virus
AKHVEECSC

SEQ ID NO: 434856 - protein, 9 aa, Influenza virus
AKILTSESQ

SEQ ID NO: 434857 - protein, 9 aa, Influenza virus
AKKASLRLA

SEQ ID NO: 434858 - protein, 9 aa, Influenza virus
AKLANVVRK

SEQ ID NO: 434859 - protein, 9 aa, Influenza virus
AKLEKSRIN

SEQ ID NO: 434860 - protein, 9 aa, Influenza virus
AKLERSKIN

SEQ ID NO: 434861 - protein, 9 aa, Influenza virus
AKLLVLIEN

SEQ ID NO: 434862 - protein, 9 aa, Influenza virus
AKLLVLLEN

SEQ ID NO: 434863 - protein, 9 aa, Influenza virus
AKNGICYPG

SEQ ID NO: 434864 - protein, 9 aa, Influenza virus
AKNILEKTH

SEQ ID NO: 434865 - protein, 9 aa, Influenza virus
AKNILRTQE

SEQ ID NO: 434866 - protein, 9 aa, Influenza virus
AKRSYNNTS

SEQ ID NO: 434867 - protein, 9 aa, Influenza virus
AKSITQTLV

SEQ ID NO: 434868 - protein, 9 aa, Influenza virus
AKSLTQTLV

SEQ ID NO: 434869 - protein, 9 aa, Influenza virus
AKSVFNCLY

SEQ ID NO: 434870 - protein, 9 aa, Influenza virus
AKSVFNNLY

SEQ ID NO: 434871 - protein, 9 aa, Influenza virus
AKSVFNSIY

SEQ ID NO: 434872 - protein, 9 aa, Influenza virus
AKSVFNSLY

SEQ ID NO: 434873 - protein, 9 aa, Influenza virus
AKSVTQTLV

SEQ ID NO: 434874 - protein, 9 aa, Influenza virus
AKVNTLTER

SEQ ID NO: 434875 - protein, 9 aa, Influenza virus
AKYVEWTSN

SEQ ID NO: 434876 - protein, 9 aa, Influenza virus
AKYVWWASN

SEQ ID NO: 434877 - protein, 9 aa, Influenza virus
AKYVWWTSN

SEQ ID NO: 434878 - protein, 9 aa, Influenza virus
ALALSHTAY

SEQ ID NO: 434879 - protein, 9 aa, Influenza virus
ALANTIEIF

SEQ ID NO: 434880 - protein, 9 aa, Influenza virus
ALANTIEVF

SEQ ID NO: 434881 - protein, 9 aa, Influenza virus
ALAQGALLG

SEQ ID NO: 434882 - protein, 9 aa, Influenza virus
ALAQGALVG

SEQ ID NO: 434883 - protein, 9 aa, Influenza virus
ALAQGTLLG

SEQ ID NO: 434884 - protein, 9 aa, Influenza virus
ALAQGVLLG

SEQ ID NO: 434885 - protein, 9 aa, Influenza virus
ALASCMGLI

SEQ ID NO: 434886 - protein, 9 aa, Influenza virus
ALCGSKEQL

SEQ ID NO: 434887 - protein, 9 aa, Influenza virus
ALCGSKERL

SEQ ID NO: 434888 - protein, 9 aa, Influenza virus
ALCGSPFPV

SEQ ID NO: 434889 - protein, 9 aa, Influenza virus
ALCGSPISV

SEQ ID NO: 434890 - protein, 9 aa, Influenza virus
ALCGSPVPV

SEQ ID NO: 434891 - protein, 9 aa, Influenza virus
ALCGSPVSV

SEQ ID NO: 434892 - protein, 9 aa, Influenza virus
ALCGSRERL

SEQ ID NO: 434893 - protein, 9 aa, Influenza virus
ALDTGDGCF

SEQ ID NO: 434894 - protein, 9 aa, Influenza virus
ALENQHTID

SEQ ID NO: 434895 - protein, 9 aa, Influenza virus
ALENQHTIH

SEQ ID NO: 434896 - protein, 9 aa, Influenza virus
ALENQNTID

SEQ ID NO: 434897 - protein, 9 aa, Influenza virus
ALFIGVGNL

SEQ ID NO: 434898 - protein, 9 aa, Influenza virus
ALFLAFILW

SEQ ID NO: 434899 - protein, 9 aa, Influenza virus
ALFVYSLRK

SEQ ID NO: 434900 - protein, 9 aa, Influenza virus
ALGDCPKYI

SEQ ID NO: 434901 - protein, 9 aa, Influenza virus
ALGECPKYI

SEQ ID NO: 434902 - protein, 9 aa, Influenza virus
ALGENMAPE

SEQ ID NO: 434903 - protein, 9 aa, Influenza virus
ALGIINLLI

SEQ ID NO: 434904 - protein, 9 aa, Influenza virus
ALGLRISSS

SEQ ID NO: 434905 - protein, 9 aa, Influenza virus
ALGLRNTPS

SEQ ID NO: 434906 - protein, 9 aa, Influenza virus
ALGLVCATC

SEQ ID NO: 434907 - protein, 9 aa, Influenza virus
ALGMKNVPE

SEQ ID NO: 434908 - protein, 9 aa, Influenza virus
ALGNCPKYI

SEQ ID NO: 434909 - protein, 9 aa, Influenza virus
ALGQGTTLD

SEQ ID NO: 434910 - protein, 9 aa, Influenza virus
ALGQGTTLE

SEQ ID NO: 434911 - protein, 9 aa, Influenza virus
ALGQGTTLK

SEQ ID NO: 434912 - protein, 9 aa, Influenza virus
ALGQGTTLN

SEQ ID NO: 434913 - protein, 9 aa, Influenza virus
ALGQGTTLS

SEQ ID NO: 434914 - protein, 9 aa, Influenza virus
ALGQGTTLY

SEQ ID NO: 434915 - protein, 9 aa, Influenza virus
ALGSPGCDH

SEQ ID NO: 434916 - protein, 9 aa, Influenza virus
ALGSPGCDR

SEQ ID NO: 434917 - protein, 9 aa, Influenza virus
ALGYSTGAL

SEQ ID NO: 434918 - protein, 9 aa, Influenza virus
ALHQGTTIR

SEQ ID NO: 434919 - protein, 9 aa, Influenza virus
ALIDDRSKP

SEQ ID NO: 434920 - protein, 9 aa, Influenza virus
ALIIGVGNL

SEQ ID NO: 434921 - protein, 9 aa, Influenza virus
ALIIWGIHH

SEQ ID NO: 434922 - protein, 9 aa, Influenza virus
ALIIWGVHH

SEQ ID NO: 434923 - protein, 9 aa, Influenza virus
ALILGFVLW

SEQ ID NO: 434924 - protein, 9 aa, Influenza virus
ALILRGAVA

SEQ ID NO: 434925 - protein, 9 aa, Influenza virus
ALILRGSIA

SEQ ID NO: 434926 - protein, 9 aa, Influenza virus
ALILRGSVA

SEQ ID NO: 434927 - protein, 9 aa, Influenza virus
ALILVALAL

SEQ ID NO: 434928 - protein, 9 aa, Influenza virus
ALISWEMGL

SEQ ID NO: 434929 - protein, 9 aa, Influenza virus
ALISWEMGQ

SEQ ID NO: 434930 - protein, 9 aa, Influenza virus
ALISWGMGQ

SEQ ID NO: 434931 - protein, 9 aa, Influenza virus
ALISWPLSS

SEQ ID NO: 434932 - protein, 9 aa, Influenza virus
ALISWPQSS

SEQ ID NO: 434933 - protein, 9 aa, Influenza virus
ALITWGIHH

SEQ ID NO: 434934 - protein, 9 aa, Influenza virus
ALIVWGIHH

SEQ ID NO: 434935 - protein, 9 aa, Influenza virus
ALIVWGVHH

SEQ ID NO: 434936 - protein, 9 aa, Influenza virus
ALKDNLEPG

SEQ ID NO: 434937 - protein, 9 aa, Influenza virus
ALKLSIEDP

SEQ ID NO: 434938 - protein, 9 aa, Influenza virus
ALKLVVAML

SEQ ID NO: 434939 - protein, 9 aa, Influenza virus
ALKMTIASD

SEQ ID NO: 434940 - protein, 9 aa, Influenza virus
ALLEESHPG

SEQ ID NO: 434941 - protein, 9 aa, Influenza virus
ALLGDPHCD

SEQ ID NO: 434942 - protein, 9 aa, Influenza virus
ALLGDPQCD

SEQ ID NO: 434943 - protein, 9 aa, Influenza virus
ALLGTKHSN

SEQ ID NO: 434944 - protein, 9 aa, Influenza virus
ALLGTNHSN

SEQ ID NO: 434945 - protein, 9 aa, Influenza virus
ALLGTRHSN

SEQ ID NO: 434946 - protein, 9 aa, Influenza virus
ALLIAFVLW

SEQ ID NO: 434947 - protein, 9 aa, Influenza virus
ALLIGIGNL

SEQ ID NO: 434948 - protein, 9 aa, Influenza virus
ALLIGVGNL

SEQ ID NO: 434949 - protein, 9 aa, Influenza virus
ALLKHRFEI

SEQ ID NO: 434950 - protein, 9 aa, Influenza virus
ALLLAFILW

SEQ ID NO: 434951 - protein, 9 aa, Influenza virus
ALLLAFMLW

SEQ ID NO: 434952 - protein, 9 aa, Influenza virus
ALLLAFVLW

SEQ ID NO: 434953 - protein, 9 aa, Influenza virus
ALLNASCAA

SEQ ID NO: 434954 - protein, 9 aa, Influenza virus
ALLNDKHSN

SEQ ID NO: 434955 - protein, 9 aa, Influenza virus
ALLNDRHSN

SEQ ID NO: 434956 - protein, 9 aa, Influenza virus
ALLNRLNIN

SEQ ID NO: 434957 - protein, 9 aa, Influenza virus
ALLNRLSIN

SEQ ID NO: 434958 - protein, 9 aa, Influenza virus
ALLPFDIDK

SEQ ID NO: 434959 - protein, 9 aa, Influenza virus
ALLPFDIDR

SEQ ID NO: 434960 - protein, 9 aa, Influenza virus
ALLSRLNIN

SEQ ID NO: 434961 - protein, 9 aa, Influenza virus
ALLVGIGNL

SEQ ID NO: 434962 - protein, 9 aa, Influenza virus
ALMEWIKTR

SEQ ID NO: 434963 - protein, 9 aa, Influenza virus
ALMEWLKTR

SEQ ID NO: 434964 - protein, 9 aa, Influenza virus
ALMSCPIGE

SEQ ID NO: 434965 - protein, 9 aa, Influenza virus
ALMSCPLGE

SEQ ID NO: 434966 - protein, 9 aa, Influenza virus
ALMSVPLGS

SEQ ID NO: 434967 - protein, 9 aa, Influenza virus
ALMSVPMGS

SEQ ID NO: 434968 - protein, 9 aa, Influenza virus
ALNEITTKI

SEQ ID NO: 434969 - protein, 9 aa, Influenza virus
ALNGNGDPN

SEQ ID NO: 434970 - protein, 9 aa, Influenza virus
ALNNRFQIK

SEQ ID NO: 434971 - protein, 9 aa, Influenza virus
ALNNRSQIK

SEQ ID NO: 434972 - protein, 9 aa, Influenza virus
ALNTTLPFH

SEQ ID NO: 434973 - protein, 9 aa, Influenza virus
ALQGTKRSY

SEQ ID NO: 434974 - protein, 9 aa, Influenza virus
ALQLFIKDY

SEQ ID NO: 434975 - protein, 9 aa, Influenza virus
ALQLLFEVE

SEQ ID NO: 434976 - protein, 9 aa, Influenza virus
ALQLLLEVE

SEQ ID NO: 434977 - protein, 9 aa, Influenza virus
ALQLNPIDG

SEQ ID NO: 434978 - protein, 9 aa, Influenza virus
ALQNRIMIN

SEQ ID NO: 434979 - protein, 9 aa, Influenza virus
ALRDNLEPG

SEQ ID NO: 434980 - protein, 9 aa, Influenza virus
ALRDSLEPG

SEQ ID NO: 434981 - protein, 9 aa, Influenza virus
ALRELWQCY

SEQ ID NO: 434982 - protein, 9 aa, Influenza virus
ALRMKWMMA

SEQ ID NO: 434983 - protein, 9 aa, Influenza virus
ALRQIIRES

SEQ ID NO: 434984 - protein, 9 aa, Influenza virus
ALRQKIMES

SEQ ID NO: 434985 - protein, 9 aa, Influenza virus
ALSGMAIAL

SEQ ID NO: 434986 - protein, 9 aa, Influenza virus
ALSGNGDPN

SEQ ID NO: 434987 - protein, 9 aa, Influenza virus
ALSGVAIAL

SEQ ID NO: 434988 - protein, 9 aa, Influenza virus
ALSGVAISL

SEQ ID NO: 434989 - protein, 9 aa, Influenza virus
ALSGVAVAL

SEQ ID NO: 434990 - protein, 9 aa, Influenza virus
ALSHTAYSQ

SEQ ID NO: 434991 - protein, 9 aa, Influenza virus
ALSIAPIMF

SEQ ID NO: 434992 - protein, 9 aa, Influenza virus
ALSILNLLI

SEQ ID NO: 434993 - protein, 9 aa, Influenza virus
ALSINELGN

SEQ ID NO: 434994 - protein, 9 aa, Influenza virus
ALSINELSK

SEQ ID NO: 434995 - protein, 9 aa, Influenza virus
ALSINELSN

SEQ ID NO: 434996 - protein, 9 aa, Influenza virus
ALSINELSS

SEQ ID NO: 434997 - protein, 9 aa, Influenza virus
ALSISELSN

SEQ ID NO: 434998 - protein, 9 aa, Influenza virus
ALSIYSCIA

SEQ ID NO: 434999 - protein, 9 aa, Influenza virus
ALSNRFQIK

SEQ ID NO: 435000 - protein, 9 aa, Influenza virus
ALSQGALLG

SEQ ID NO: 435001 - protein, 9 aa, Influenza virus
ALSQGTTIR

SEQ ID NO: 435002 - protein, 9 aa, Influenza virus
ALSQGTTLR

SEQ ID NO: 435003 - protein, 9 aa, Influenza virus
ALSVLNLLI

SEQ ID NO: 435004 - protein, 9 aa, Influenza virus
ALSYSAGAL

SEQ ID NO: 435005 - protein, 9 aa, Influenza virus
ALSYSTGAL

SEQ ID NO: 435006 - protein, 9 aa, Influenza virus
ALTDDKSKP

SEQ ID NO: 435007 - protein, 9 aa, Influenza virus
ALTDDRSKP

SEQ ID NO: 435008 - protein, 9 aa, Influenza virus
ALTDERSKP

SEQ ID NO: 435009 - protein, 9 aa, Influenza virus
ALTDNRSKP

SEQ ID NO: 435010 - protein, 9 aa, Influenza virus
ALTGGQSFY

SEQ ID NO: 435011 - protein, 9 aa, Influenza virus
ALTLNTMTK

SEQ ID NO: 435012 - protein, 9 aa, Influenza virus
ALVGTKHSN

SEQ ID NO: 435013 - protein, 9 aa, Influenza virus
ALVIWGVHH

SEQ ID NO: 435014 - protein, 9 aa, Influenza virus
ALVRGQQGR

SEQ ID NO: 435015 - protein, 9 aa, Influenza virus
ALVRSGMDP

SEQ ID NO: 435016 - protein, 9 aa, Influenza virus
ALVRTGMDP

SEQ ID NO: 435017 - protein, 9 aa, Influenza virus
ALVSWEMGQ

SEQ ID NO: 435018 - protein, 9 aa, Influenza virus
ALVSWPLSS

SEQ ID NO: 435019 - protein, 9 aa, Influenza virus
ALYGTQSLS

SEQ ID NO: 435020 - protein, 9 aa, Influenza virus
ALYKNANTL

SEQ ID NO: 435021 - protein, 9 aa, Influenza virus
AMAFLEDSH

SEQ ID NO: 435022 - protein, 9 aa, Influenza virus
AMAFLEESH

SEQ ID NO: 435023 - protein, 9 aa, Influenza virus
AMAFLEKSH

SEQ ID NO: 435024 - protein, 9 aa, Influenza virus
AMAFLENSH

SEQ ID NO: 435025 - protein, 9 aa, Influenza virus
AMALLEESH

SEQ ID NO: 435026 - protein, 9 aa, Influenza virus
AMASQGTKR

SEQ ID NO: 435027 - protein, 9 aa, Influenza virus
AMDAGNGCF

SEQ ID NO: 435028 - protein, 9 aa, Influenza virus
AMDDFQLIP

SEQ ID NO: 435029 - protein, 9 aa, Influenza virus
AMDEFQLIP

SEQ ID NO: 435030 - protein, 9 aa, Influenza virus
AMDHTSQYL

SEQ ID NO: 435031 - protein, 9 aa, Influenza virus
AMEDFQLIP

SEQ ID NO: 435032 - protein, 9 aa, Influenza virus
AMEHTSQYL

SEQ ID NO: 435033 - protein, 9 aa, Influenza virus
AMELIRMIK

SEQ ID NO: 435034 - protein, 9 aa, Influenza virus
AMELVEAEK

SEQ ID NO: 435035 - protein, 9 aa, Influenza virus
AMENQHTID

SEQ ID NO: 435036 - protein, 9 aa, Influenza virus
AMEQMAGSS

SEQ ID NO: 435037 - protein, 9 aa, Influenza virus
AMEQVAGSS

SEQ ID NO: 435038 - protein, 9 aa, Influenza virus
AMGLIFMCV

SEQ ID NO: 435039 - protein, 9 aa, Influenza virus
AMGLKISSS

SEQ ID NO: 435040 - protein, 9 aa, Influenza virus
AMGLRISSS

SEQ ID NO: 435041 - protein, 9 aa, Influenza virus
AMGLVFICI

SEQ ID NO: 435042 - protein, 9 aa, Influenza virus
AMGLVFICM

SEQ ID NO: 435043 - protein, 9 aa, Influenza virus
AMGLVFICV

SEQ ID NO: 435044 - protein, 9 aa, Influenza virus
AMGLVFMCV

SEQ ID NO: 435045 - protein, 9 aa, Influenza virus
AMGMRISSS

SEQ ID NO: 435046 - protein, 9 aa, Influenza virus
AMISRARID

SEQ ID NO: 435047 - protein, 9 aa, Influenza virus
AMKHTSQYI

SEQ ID NO: 435048 - protein, 9 aa, Influenza virus
AMKHTSQYL

SEQ ID NO: 435049 - protein, 9 aa, Influenza virus
AMKYPITAD

SEQ ID NO: 435050 - protein, 9 aa, Influenza virus
AMKYPITAE

SEQ ID NO: 435051 - protein, 9 aa, Influenza virus
AMKYPITAN

SEQ ID NO: 435052 - protein, 9 aa, Influenza virus
AMLGDPHCD

SEQ ID NO: 435053 - protein, 9 aa, Influenza virus
AMLNASCAA

SEQ ID NO: 435054 - protein, 9 aa, Influenza virus
AMMDQVREG

SEQ ID NO: 435055 - protein, 9 aa, Influenza virus
AMMDQVRES

SEQ ID NO: 435056 - protein, 9 aa, Influenza virus
AMMSRARID

SEQ ID NO: 435057 - protein, 9 aa, Influenza virus
AMQNRIQID

SEQ ID NO: 435058 - protein, 9 aa, Influenza virus
AMRAIGTHP

SEQ ID NO: 435059 - protein, 9 aa, Influenza virus
AMRAVGTHP

SEQ ID NO: 435060 - protein, 9 aa, Influenza virus
AMRTIGTHP

SEQ ID NO: 435061 - protein, 9 aa, Influenza virus
AMRTIGTQP

SEQ ID NO: 435062 - protein, 9 aa, Influenza virus
AMRTVGTHP

SEQ ID NO: 435063 - protein, 9 aa, Influenza virus
AMRYPITAD

SEQ ID NO: 435064 - protein, 9 aa, Influenza virus
AMTEIWSYN

SEQ ID NO: 435065 - protein, 9 aa, Influenza virus
AMTEVWSYN

SEQ ID NO: 435066 - protein, 9 aa, Influenza virus
AMTHTSQYI

SEQ ID NO: 435067 - protein, 9 aa, Influenza virus
AMVDQVRES

SEQ ID NO: 435068 - protein, 9 aa, Influenza virus
AMVFSQEDC

SEQ ID NO: 435069 - protein, 9 aa, Influenza virus
AMVFSQEEC

SEQ ID NO: 435070 - protein, 9 aa, Influenza virus
AMVSRARID

SEQ ID NO: 435071 - protein, 9 aa, Influenza virus
ANDLGNGCF

SEQ ID NO: 435072 - protein, 9 aa, Influenza virus
ANEESLRQI

SEQ ID NO: 435073 - protein, 9 aa, Influenza virus
ANEIRASVG

SEQ ID NO: 435074 - protein, 9 aa, Influenza virus
ANFSMELPS

SEQ ID NO: 435075 - protein, 9 aa, Influenza virus
ANGTIHDRS

SEQ ID NO: 435076 - protein, 9 aa, Influenza virus
ANGTINDRS

SEQ ID NO: 435077 - protein, 9 aa, Influenza virus
ANGTIVKTL

SEQ ID NO: 435078 - protein, 9 aa, Influenza virus
ANGTKVNTL

SEQ ID NO: 435079 - protein, 9 aa, Influenza virus
ANGTMHDRS

SEQ ID NO: 435080 - protein, 9 aa, Influenza virus
ANGTVVKTL

SEQ ID NO: 435081 - protein, 9 aa, Influenza virus
ANGVKGFSF

SEQ ID NO: 435082 - protein, 9 aa, Influenza virus
ANGVKGFSY

SEQ ID NO: 435083 - protein, 9 aa, Influenza virus
ANGWVSTDK

SEQ ID NO: 435084 - protein, 9 aa, Influenza virus
ANGWVTADK

SEQ ID NO: 435085 - protein, 9 aa, Influenza virus
ANINFMPYI

SEQ ID NO: 435086 - protein, 9 aa, Influenza virus
ANIRNNTYD

SEQ ID NO: 435087 - protein, 9 aa, Influenza virus
ANKLYVNKN

SEQ ID NO: 435088 - protein, 9 aa, Influenza virus
ANKQASYKI

SEQ ID NO: 435089 - protein, 9 aa, Influenza virus
ANLCRFLET

SEQ ID NO: 435090 - protein, 9 aa, Influenza virus
ANLGLNIGI

SEQ ID NO: 435091 - protein, 9 aa, Influenza virus
ANLGLNIGL

SEQ ID NO: 435092 - protein, 9 aa, Influenza virus
ANLGLNVGL

SEQ ID NO: 435093 - protein, 9 aa, Influenza virus
ANNADHRIY

SEQ ID NO: 435094 - protein, 9 aa, Influenza virus
ANNADHRVY

SEQ ID NO: 435095 - protein, 9 aa, Influenza virus
ANNGKFEFI

SEQ ID NO: 435096 - protein, 9 aa, Influenza virus
ANNGRFEFI

SEQ ID NO: 435097 - protein, 9 aa, Influenza virus
ANNQASYKI

SEQ ID NO: 435098 - protein, 9 aa, Influenza virus
ANNQASYRI

SEQ ID NO: 435099 - protein, 9 aa, Influenza virus
ANNSKKQID

SEQ ID NO: 435100 - protein, 9 aa, Influenza virus
ANNSTDTID

SEQ ID NO: 435101 - protein, 9 aa, Influenza virus
ANNSTDTVD

SEQ ID NO: 435102 - protein, 9 aa, Influenza virus
ANNSTEHVD

SEQ ID NO: 435103 - protein, 9 aa, Influenza virus
ANNSTEQVD

SEQ ID NO: 435104 - protein, 9 aa, Influenza virus
ANNSTERVD

SEQ ID NO: 435105 - protein, 9 aa, Influenza virus
ANNSTETVD

SEQ ID NO: 435106 - protein, 9 aa, Influenza virus
ANNSTKQID

SEQ ID NO: 435107 - protein, 9 aa, Influenza virus
ANNSTKQVD

SEQ ID NO: 435108 - protein, 9 aa, Influenza virus
ANNSTTKVD

SEQ ID NO: 435109 - protein, 9 aa, Influenza virus
ANNSTTQID

SEQ ID NO: 435110 - protein, 9 aa, Influenza virus
ANNSTTQVD

SEQ ID NO: 435111 - protein, 9 aa, Influenza virus
ANNSTTQVN

SEQ ID NO: 435112 - protein, 9 aa, Influenza virus
ANNSTVQVD

SEQ ID NO: 435113 - protein, 9 aa, Influenza virus
ANPIVPSFD

SEQ ID NO: 435114 - protein, 9 aa, Influenza virus
ANQRLNPMH

SEQ ID NO: 435115 - protein, 9 aa, Influenza virus
ANQRLNTMH

SEQ ID NO: 435116 - protein, 9 aa, Influenza virus
ANQSLPPNF

SEQ ID NO: 435117 - protein, 9 aa, Influenza virus
ANQVFPQLN

SEQ ID NO: 435118 - protein, 9 aa, Influenza virus
ANRPAIEID

SEQ ID NO: 435119 - protein, 9 aa, Influenza virus
ANRPIIEID

SEQ ID NO: 435120 - protein, 9 aa, Influenza virus
ANRPIITID

SEQ ID NO: 435121 - protein, 9 aa, Influenza virus
ANRPIITIN

SEQ ID NO: 435122 - protein, 9 aa, Influenza virus
ANRPVIEID

SEQ ID NO: 435123 - protein, 9 aa, Influenza virus
ANRPVIEIN

SEQ ID NO: 435124 - protein, 9 aa, Influenza virus
ANRPVIIID

SEQ ID NO: 435125 - protein, 9 aa, Influenza virus
ANRPVIKID

SEQ ID NO: 435126 - protein, 9 aa, Influenza virus
ANRPVITID

SEQ ID NO: 435127 - protein, 9 aa, Influenza virus
ANRPVITIN

SEQ ID NO: 435128 - protein, 9 aa, Influenza virus
ANRPWVSFN

SEQ ID NO: 435129 - protein, 9 aa, Influenza virus
ANSADHRIY

SEQ ID NO: 435130 - protein, 9 aa, Influenza virus
ANSADHRVY

SEQ ID NO: 435131 - protein, 9 aa, Influenza virus
ANSAHHRVY

SEQ ID NO: 435132 - protein, 9 aa, Influenza virus
ANSIIVFCG

SEQ ID NO: 435133 - protein, 9 aa, Influenza virus
ANSQASYKI

SEQ ID NO: 435134 - protein, 9 aa, Influenza virus
ANSQAYTKV

SEQ ID NO: 435135 - protein, 9 aa, Influenza virus
ANTIEIFRS

SEQ ID NO: 435136 - protein, 9 aa, Influenza virus
ANTIEVFKS

SEQ ID NO: 435137 - protein, 9 aa, Influenza virus
ANTIEVFRL

SEQ ID NO: 435138 - protein, 9 aa, Influenza virus
ANTIEVFRS

SEQ ID NO: 435139 - protein, 9 aa, Influenza virus
ANTLSSVNT

SEQ ID NO: 435140 - protein, 9 aa, Influenza virus
ANTLSSVTT

SEQ ID NO: 435141 - protein, 9 aa, Influenza virus
ANTLTSVTT

SEQ ID NO: 435142 - protein, 9 aa, Influenza virus
ANTYRNTDS

SEQ ID NO: 435143 - protein, 9 aa, Influenza virus
ANVKNLHDQ

SEQ ID NO: 435144 - protein, 9 aa, Influenza virus
ANVKNLHEQ

SEQ ID NO: 435145 - protein, 9 aa, Influenza virus
ANVLIGQGD

SEQ ID NO: 435146 - protein, 9 aa, Influenza virus
ANVRNLHDQ

SEQ ID NO: 435147 - protein, 9 aa, Influenza virus
ANVRNLHDR

SEQ ID NO: 435148 - protein, 9 aa, Influenza virus
ANVRNLHEQ

SEQ ID NO: 435149 - protein, 9 aa, Influenza virus
ANVRNLHER

SEQ ID NO: 435150 - protein, 9 aa, Influenza virus
ANVVRKMMT

SEQ ID NO: 435151 - protein, 9 aa, Influenza virus
ANWSWHDGA

SEQ ID NO: 435152 - protein, 9 aa, Influenza virus
ANYSLPPNF

SEQ ID NO: 435153 - protein, 9 aa, Influenza virus
APACDLHLT

SEQ ID NO: 435154 - protein, 9 aa, Influenza virus
APDRASFFK

SEQ ID NO: 435155 - protein, 9 aa, Influenza virus
APDRASFFR

SEQ ID NO: 435156 - protein, 9 aa, Influenza virus
APDRASFLR

SEQ ID NO: 435157 - protein, 9 aa, Influenza virus
APDRATFLR

SEQ ID NO: 435158 - protein, 9 aa, Influenza virus
APDYHYEEC

SEQ ID NO: 435159 - protein, 9 aa, Influenza virus
APEFGYLLK

SEQ ID NO: 435160 - protein, 9 aa, Influenza virus
APEFGYLLR

SEQ ID NO: 435161 - protein, 9 aa, Influenza virus
APEGMCYPG

SEQ ID NO: 435162 - protein, 9 aa, Influenza virus
APEWSYIVE

SEQ ID NO: 435163 - protein, 9 aa, Influenza virus
APEYGFKIS

SEQ ID NO: 435164 - protein, 9 aa, Influenza virus
APEYGFRIS

SEQ ID NO: 435165 - protein, 9 aa, Influenza virus
APEYGHLIT

SEQ ID NO: 435166 - protein, 9 aa, Influenza virus
APEYGHLTT

SEQ ID NO: 435167 - protein, 9 aa, Influenza virus
APEYGHLVT

SEQ ID NO: 435168 - protein, 9 aa, Influenza virus
APEYGYLIT

SEQ ID NO: 435169 - protein, 9 aa, Influenza virus
APFAKDNSI

SEQ ID NO: 435170 - protein, 9 aa, Influenza virus
APFDDRLRR

SEQ ID NO: 435171 - protein, 9 aa, Influenza virus
APFISCSYL

SEQ ID NO: 435172 - protein, 9 aa, Influenza virus
APFLDRIRR

SEQ ID NO: 435173 - protein, 9 aa, Influenza virus
APFLDRLRR

SEQ ID NO: 435174 - protein, 9 aa, Influenza virus
APFSKDNGI

SEQ ID NO: 435175 - protein, 9 aa, Influenza virus
APFSKDNSI

SEQ ID NO: 435176 - protein, 9 aa, Influenza virus
APFSKDNSV

SEQ ID NO: 435177 - protein, 9 aa, Influenza virus
APFTKDNSI

SEQ ID NO: 435178 - protein, 9 aa, Influenza virus
APGFHFEEC

SEQ ID NO: 435179 - protein, 9 aa, Influenza virus
APGIKGFGF

SEQ ID NO: 435180 - protein, 9 aa, Influenza virus
APGTKGFGF

SEQ ID NO: 435181 - protein, 9 aa, Influenza virus
APGVKGFGF

SEQ ID NO: 435182 - protein, 9 aa, Influenza virus
APGWSWDDG

SEQ ID NO: 435183 - protein, 9 aa, Influenza virus
APGYAFEIV

SEQ ID NO: 435184 - protein, 9 aa, Influenza virus
APHGLCYPG

SEQ ID NO: 435185 - protein, 9 aa, Influenza virus
APHKLCFPG

SEQ ID NO: 435186 - protein, 9 aa, Influenza virus
APHKLCYPG

SEQ ID NO: 435187 - protein, 9 aa, Influenza virus
APHRLCYPG

SEQ ID NO: 435188 - protein, 9 aa, Influenza virus
APIEHIASI

SEQ ID NO: 435189 - protein, 9 aa, Influenza virus
APIEHIASM

SEQ ID NO: 435190 - protein, 9 aa, Influenza virus
APIEHVASM

SEQ ID NO: 435191 - protein, 9 aa, Influenza virus
APIEYIASM

SEQ ID NO: 435192 - protein, 9 aa, Influenza virus
APIEYVASM

SEQ ID NO: 435193 - protein, 9 aa, Influenza virus
APILGNYKE

SEQ ID NO: 435194 - protein, 9 aa, Influenza virus
APIMFSNKM

SEQ ID NO: 435195 - protein, 9 aa, Influenza virus
APISLGDCS

SEQ ID NO: 435196 - protein, 9 aa, Influenza virus
APKYGYIIE

SEQ ID NO: 435197 - protein, 9 aa, Influenza virus
APLELRDCK

SEQ ID NO: 435198 - protein, 9 aa, Influenza virus
APLMMAYML

SEQ ID NO: 435199 - protein, 9 aa, Influenza virus
APLMVAYML

SEQ ID NO: 435200 - protein, 9 aa, Influenza virus
APLSKDNGI

SEQ ID NO: 435201 - protein, 9 aa, Influenza virus
APLSKDNSI

SEQ ID NO: 435202 - protein, 9 aa, Influenza virus
APLVLDDCS

SEQ ID NO: 435203 - protein, 9 aa, Influenza virus
APNFHYEEC

SEQ ID NO: 435204 - protein, 9 aa, Influenza virus
APNFYYEEC

SEQ ID NO: 435205 - protein, 9 aa, Influenza virus
APNKFCYPG

SEQ ID NO: 435206 - protein, 9 aa, Influenza virus
APNKLCFPG

SEQ ID NO: 435207 - protein, 9 aa, Influenza virus
APNKLCYPG

SEQ ID NO: 435208 - protein, 9 aa, Influenza virus
APNRASFFR

SEQ ID NO: 435209 - protein, 9 aa, Influenza virus
APNSHYEEC

SEQ ID NO: 435210 - protein, 9 aa, Influenza virus
APNYHYEEC

SEQ ID NO: 435211 - protein, 9 aa, Influenza virus
APNYYYEEC

SEQ ID NO: 435212 - protein, 9 aa, Influenza virus
APPEQSRMQ

SEQ ID NO: 435213 - protein, 9 aa, Influenza virus
APPKQSRMQ

SEQ ID NO: 435214 - protein, 9 aa, Influenza virus
APPVQSKMQ

SEQ ID NO: 435215 - protein, 9 aa, Influenza virus
APPVQSRMQ

SEQ ID NO: 435216 - protein, 9 aa, Influenza virus
APQLNPIDG

SEQ ID NO: 435217 - protein, 9 aa, Influenza virus
APRGHYKIS

SEQ ID NO: 435218 - protein, 9 aa, Influenza virus
APRYAFEIV

SEQ ID NO: 435219 - protein, 9 aa, Influenza virus
APRYAFELV

SEQ ID NO: 435220 - protein, 9 aa, Influenza virus
APRYGYIIE

SEQ ID NO: 435221 - protein, 9 aa, Influenza virus
APRYSFELV

SEQ ID NO: 435222 - protein, 9 aa, Influenza virus
APSCDLHLT

SEQ ID NO: 435223 - protein, 9 aa, Influenza virus
APSGIEYNG

SEQ ID NO: 435224 - protein, 9 aa, Influenza virus
APSGVEYNG

SEQ ID NO: 435225 - protein, 9 aa, Influenza virus
APSPSNSRF

SEQ ID NO: 435226 - protein, 9 aa, Influenza virus
APSPYNSKF

SEQ ID NO: 435227 - protein, 9 aa, Influenza virus
APSPYNSRF

SEQ ID NO: 435228 - protein, 9 aa, Influenza virus
APSRVSKLI

SEQ ID NO: 435229 - protein, 9 aa, Influenza virus
APSRVSKLK

SEQ ID NO: 435230 - protein, 9 aa, Influenza virus
APSRVSKLR

SEQ ID NO: 435231 - protein, 9 aa, Influenza virus
APSRVSKLT

SEQ ID NO: 435232 - protein, 9 aa, Influenza virus
APSRVTKLK

SEQ ID NO: 435233 - protein, 9 aa, Influenza virus
APVLGNCKE

SEQ ID NO: 435234 - protein, 9 aa, Influenza virus
APVLGNYKE

SEQ ID NO: 435235 - protein, 9 aa, Influenza virus
APVLGNYRE

SEQ ID NO: 435236 - protein, 9 aa, Influenza virus
APYRSLIRF

SEQ ID NO: 435237 - protein, 9 aa, Influenza virus
AQAFYKILK

SEQ ID NO: 435238 - protein, 9 aa, Influenza virus
AQDILEKTH

SEQ ID NO: 435239 - protein, 9 aa, Influenza virus
AQDILERTH

SEQ ID NO: 435240 - protein, 9 aa, Influenza virus
AQDNAIRFG

SEQ ID NO: 435241 - protein, 9 aa, Influenza virus
AQDRGLFGA

SEQ ID NO: 435242 - protein, 9 aa, Influenza virus
AQDVIMEVV

SEQ ID NO: 435243 - protein, 9 aa, Influenza virus
AQEKNDLYG

SEQ ID NO: 435244 - protein, 9 aa, Influenza virus
AQGALLGTK

SEQ ID NO: 435245 - protein, 9 aa, Influenza virus
AQGALLGTN

SEQ ID NO: 435246 - protein, 9 aa, Influenza virus
AQGALLGTR

SEQ ID NO: 435247 - protein, 9 aa, Influenza virus
AQGALVGTK

SEQ ID NO: 435248 - protein, 9 aa, Influenza virus
AQGEGIAAD

SEQ ID NO: 435249 - protein, 9 aa, Influenza virus
AQGEGTAAD

SEQ ID NO: 435250 - protein, 9 aa, Influenza virus
AQGIGQAAD

SEQ ID NO: 435251 - protein, 9 aa, Influenza virus
AQGQGTAAD

SEQ ID NO: 435252 - protein, 9 aa, Influenza virus
AQGSGYAAD

SEQ ID NO: 435253 - protein, 9 aa, Influenza virus
AQGSYNNTS

SEQ ID NO: 435254 - protein, 9 aa, Influenza virus
AQGTGQAAD

SEQ ID NO: 435255 - protein, 9 aa, Influenza virus
AQGVLLGTK

SEQ ID NO: 435256 - protein, 9 aa, Influenza virus
AQGYKDIIL

SEQ ID NO: 435257 - protein, 9 aa, Influenza virus
AQHGICYPG

SEQ ID NO: 435258 - protein, 9 aa, Influenza virus
AQHIEECSC

SEQ ID NO: 435259 - protein, 9 aa, Influenza virus
AQHRSHRQM

SEQ ID NO: 435260 - protein, 9 aa, Influenza virus
AQHVEECSC

SEQ ID NO: 435261 - protein, 9 aa, Influenza virus
AQIDESCEG

SEQ ID NO: 435262 - protein, 9 aa, Influenza virus
AQIIKLLPF

SEQ ID NO: 435263 - protein, 9 aa, Influenza virus
AQKAMMDQV

SEQ ID NO: 435264 - protein, 9 aa, Influenza virus
AQKLEDVFA

SEQ ID NO: 435265 - protein, 9 aa, Influenza virus
AQLLVLLEN

SEQ ID NO: 435266 - protein, 9 aa, Influenza virus
AQLLVWLEN

SEQ ID NO: 435267 - protein, 9 aa, Influenza virus
AQMALQLFI

SEQ ID NO: 435268 - protein, 9 aa, Influenza virus
AQNAISITF

SEQ ID NO: 435269 - protein, 9 aa, Influenza virus
AQNAISTTF

SEQ ID NO: 435270 - protein, 9 aa, Influenza virus
AQNGICYPG

SEQ ID NO: 435271 - protein, 9 aa, Influenza virus
AQNILEKTH

SEQ ID NO: 435272 - protein, 9 aa, Influenza virus
AQNRGLFGA

SEQ ID NO: 435273 - protein, 9 aa, Influenza virus
AQRAMMDQV

SEQ ID NO: 435274 - protein, 9 aa, Influenza virus
AQRAMVDQV

SEQ ID NO: 435275 - protein, 9 aa, Influenza virus
AQRLEDVFA

SEQ ID NO: 435276 - protein, 9 aa, Influenza virus
AQRLEGVFA

SEQ ID NO: 435277 - protein, 9 aa, Influenza virus
AQRLENVFA

SEQ ID NO: 435278 - protein, 9 aa, Influenza virus
AQRLESVFA

SEQ ID NO: 435279 - protein, 9 aa, Influenza virus
AQSFYRSIN

SEQ ID NO: 435280 - protein, 9 aa, Influenza virus
AQSLSISVG

SEQ ID NO: 435281 - protein, 9 aa, Influenza virus
AQTDCVLEA

SEQ ID NO: 435282 - protein, 9 aa, Influenza virus
AQYGICYPG

SEQ ID NO: 435283 - protein, 9 aa, Influenza virus
AQYREEALL

SEQ ID NO: 435284 - protein, 9 aa, Influenza virus
ARCICEKLE

SEQ ID NO: 435285 - protein, 9 aa, Influenza virus
ARCNTKCQT

SEQ ID NO: 435286 - protein, 9 aa, Influenza virus
ARELGNGCF

SEQ ID NO: 435287 - protein, 9 aa, Influenza virus
ARFEAVAWS

SEQ ID NO: 435288 - protein, 9 aa, Influenza virus
ARFESVAWS

SEQ ID NO: 435289 - protein, 9 aa, Influenza virus
ARGDKICLG

SEQ ID NO: 435290 - protein, 9 aa, Influenza virus
ARGEKANVL

SEQ ID NO: 435291 - protein, 9 aa, Influenza virus
ARGLFGAIA

SEQ ID NO: 435292 - protein, 9 aa, Influenza virus
ARGSYNNTS

SEQ ID NO: 435293 - protein, 9 aa, Influenza virus
ARHIEECPC

SEQ ID NO: 435294 - protein, 9 aa, Influenza virus
ARHIEECSC

SEQ ID NO: 435295 - protein, 9 aa, Influenza virus
ARHIEEWSC

SEQ ID NO: 435296 - protein, 9 aa, Influenza virus
ARIDARIDF

SEQ ID NO: 435297 - protein, 9 aa, Influenza virus
ARIDARVDF

SEQ ID NO: 435298 - protein, 9 aa, Influenza virus
ARIDARVDS

SEQ ID NO: 435299 - protein, 9 aa, Influenza virus
ARIDFESGR

SEQ ID NO: 435300 - protein, 9 aa, Influenza virus
ARIGEGQRS

SEQ ID NO: 435301 - protein, 9 aa, Influenza virus
ARIITSESQ

SEQ ID NO: 435302 - protein, 9 aa, Influenza virus
ARIKTRLFT

SEQ ID NO: 435303 - protein, 9 aa, Influenza virus
ARILASESQ

SEQ ID NO: 435304 - protein, 9 aa, Influenza virus
ARILTSESQ

SEQ ID NO: 435305 - protein, 9 aa, Influenza virus
ARLGKGYMF

SEQ ID NO: 435306 - protein, 9 aa, Influenza virus
ARLGRGYMF

SEQ ID NO: 435307 - protein, 9 aa, Influenza virus
ARLLVLLEN

SEQ ID NO: 435308 - protein, 9 aa, Influenza virus
ARLYIWGVH

SEQ ID NO: 435309 - protein, 9 aa, Influenza virus
ARMTICIQG

SEQ ID NO: 435310 - protein, 9 aa, Influenza virus
ARNGICYPG

SEQ ID NO: 435311 - protein, 9 aa, Influenza virus
ARNICEKLE

SEQ ID NO: 435312 - protein, 9 aa, Influenza virus
ARNILRTQD

SEQ ID NO: 435313 - protein, 9 aa, Influenza virus
ARNILRTQE

SEQ ID NO: 435314 - protein, 9 aa, Influenza virus
ARNIVRRAA

SEQ ID NO: 435315 - protein, 9 aa, Influenza virus
ARNIVRRAI

SEQ ID NO: 435316 - protein, 9 aa, Influenza virus
ARNIVRRAT

SEQ ID NO: 435317 - protein, 9 aa, Influenza virus
ARPKVNGQA

SEQ ID NO: 435318 - protein, 9 aa, Influenza virus
ARPLVNGQS

SEQ ID NO: 435319 - protein, 9 aa, Influenza virus
ARPQVNGQS

SEQ ID NO: 435320 - protein, 9 aa, Influenza virus
ARQEKNPAL

SEQ ID NO: 435321 - protein, 9 aa, Influenza virus
ARQMVHAMR

SEQ ID NO: 435322 - protein, 9 aa, Influenza virus
ARQMVQAMR

SEQ ID NO: 435323 - protein, 9 aa, Influenza virus
ARRICEKLE

SEQ ID NO: 435324 - protein, 9 aa, Influenza virus
ARRIDFHWL

SEQ ID NO: 435325 - protein, 9 aa, Influenza virus
ARRIDFNWL

SEQ ID NO: 435326 - protein, 9 aa, Influenza virus
ARRMVQAMR

SEQ ID NO: 435327 - protein, 9 aa, Influenza virus
ARSALILRG

SEQ ID NO: 435328 - protein, 9 aa, Influenza virus
ARSICEKLE

SEQ ID NO: 435329 - protein, 9 aa, Influenza virus
ARSIVRRAT

SEQ ID NO: 435330 - protein, 9 aa, Influenza virus
ARVDFESGR

SEQ ID NO: 435331 - protein, 9 aa, Influenza virus
ARVWWTSNS

SEQ ID NO: 435332 - protein, 9 aa, Influenza virus
ASACHDGAS

SEQ ID NO: 435333 - protein, 9 aa, Influenza virus
ASACHDGIS

SEQ ID NO: 435334 - protein, 9 aa, Influenza virus
ASACHDGSS

SEQ ID NO: 435335 - protein, 9 aa, Influenza virus
ASACHDGTN

SEQ ID NO: 435336 - protein, 9 aa, Influenza virus
ASACHDGTS

SEQ ID NO: 435337 - protein, 9 aa, Influenza virus
ASAGQISIQ

SEQ ID NO: 435338 - protein, 9 aa, Influenza virus
ASAGQISTQ

SEQ ID NO: 435339 - protein, 9 aa, Influenza virus
ASAGQISVQ

SEQ ID NO: 435340 - protein, 9 aa, Influenza virus
ASAGQTSVQ

SEQ ID NO: 435341 - protein, 9 aa, Influenza virus
ASAGQVSVQ

SEQ ID NO: 435342 - protein, 9 aa, Influenza virus
ASALILRGS

SEQ ID NO: 435343 - protein, 9 aa, Influenza virus
ASCAAMDDF

SEQ ID NO: 435344 - protein, 9 aa, Influenza virus
ASCAAMDEF

SEQ ID NO: 435345 - protein, 9 aa, Influenza virus
ASCAAMEDF

SEQ ID NO: 435346 - protein, 9 aa, Influenza virus
ASCFIFLAI

SEQ ID NO: 435347 - protein, 9 aa, Influenza virus
ASCFILLAI

SEQ ID NO: 435348 - protein, 9 aa, Influenza virus
ASCFILLAV

SEQ ID NO: 435349 - protein, 9 aa, Influenza virus
ASCFLFLAI

SEQ ID NO: 435350 - protein, 9 aa, Influenza virus
ASCFLLIAI

SEQ ID NO: 435351 - protein, 9 aa, Influenza virus
ASCFLLLAI

SEQ ID NO: 435352 - protein, 9 aa, Influenza virus
ASCFLLLAV

SEQ ID NO: 435353 - protein, 9 aa, Influenza virus
ASCFTLLAI

SEQ ID NO: 435354 - protein, 9 aa, Influenza virus
ASCFVLLAA

SEQ ID NO: 435355 - protein, 9 aa, Influenza virus
ASCFVLLAD

SEQ ID NO: 435356 - protein, 9 aa, Influenza virus
ASCFVLLAI

SEQ ID NO: 435357 - protein, 9 aa, Influenza virus
ASCFVLLAV

SEQ ID NO: 435358 - protein, 9 aa, Influenza virus
ASCHDGRAW

SEQ ID NO: 435359 - protein, 9 aa, Influenza virus
ASCMGLIYN

SEQ ID NO: 435360 - protein, 9 aa, Influenza virus
ASCVMLLAI

SEQ ID NO: 435361 - protein, 9 aa, Influenza virus
ASDILKRMS

SEQ ID NO: 435362 - protein, 9 aa, Influenza virus
ASDILTRMS

SEQ ID NO: 435363 - protein, 9 aa, Influenza virus
ASGDIWITR

SEQ ID NO: 435364 - protein, 9 aa, Influenza virus
ASGDIWVTR

SEQ ID NO: 435365 - protein, 9 aa, Influenza virus
ASGKADTRI

SEQ ID NO: 435366 - protein, 9 aa, Influenza virus
ASGKAETRI

SEQ ID NO: 435367 - protein, 9 aa, Influenza virus
ASGLRNVPA

SEQ ID NO: 435368 - protein, 9 aa, Influenza virus
ASGRADTKI

SEQ ID NO: 435369 - protein, 9 aa, Influenza virus
ASGRADTRI

SEQ ID NO: 435370 - protein, 9 aa, Influenza virus
ASGSSISFC

SEQ ID NO: 435371 - protein, 9 aa, Influenza virus
ASICTHLEV

SEQ ID NO: 435372 - protein, 9 aa, Influenza virus
ASIRNNSYD

SEQ ID NO: 435373 - protein, 9 aa, Influenza virus
ASIRNNTYD

SEQ ID NO: 435374 - protein, 9 aa, Influenza virus
ASIRNNTYN

SEQ ID NO: 435375 - protein, 9 aa, Influenza virus
ASIRNSTYD

SEQ ID NO: 435376 - protein, 9 aa, Influenza virus
ASIRRNYFT

SEQ ID NO: 435377 - protein, 9 aa, Influenza virus
ASKEPEVHE

SEQ ID NO: 435378 - protein, 9 aa, Influenza virus
ASKNPYTLV

SEQ ID NO: 435379 - protein, 9 aa, Influenza virus
ASLCLAILI

SEQ ID NO: 435380 - protein, 9 aa, Influenza virus
ASLCLAILV

SEQ ID NO: 435381 - protein, 9 aa, Influenza virus
ASLCLAVLI

SEQ ID NO: 435382 - protein, 9 aa, Influenza virus
ASLLEMCHG

SEQ ID NO: 435383 - protein, 9 aa, Influenza virus
ASLLEMCHS

SEQ ID NO: 435384 - protein, 9 aa, Influenza virus
ASLRLAVGL

SEQ ID NO: 435385 - protein, 9 aa, Influenza virus
ASLSPGMMM

SEQ ID NO: 435386 - protein, 9 aa, Influenza virus
ASMRRDYFT

SEQ ID NO: 435387 - protein, 9 aa, Influenza virus
ASMRRNYFT

SEQ ID NO: 435388 - protein, 9 aa, Influenza virus
ASMRRSYFT

SEQ ID NO: 435389 - protein, 9 aa, Influenza virus
ASNINIREW

SEQ ID NO: 435390 - protein, 9 aa, Influenza virus
ASNQASYKI

SEQ ID NO: 435391 - protein, 9 aa, Influenza virus
ASNRPWISF

SEQ ID NO: 435392 - protein, 9 aa, Influenza virus
ASNRPWVSF

SEQ ID NO: 435393 - protein, 9 aa, Influenza virus
ASNSIVTFC

SEQ ID NO: 435394 - protein, 9 aa, Influenza virus
ASNSLIALC

SEQ ID NO: 435395 - protein, 9 aa, Influenza virus
ASPQLEGFS

SEQ ID NO: 435396 - protein, 9 aa, Influenza virus
ASPSCLVVR

SEQ ID NO: 435397 - protein, 9 aa, Influenza virus
ASQGTKRPY

SEQ ID NO: 435398 - protein, 9 aa, Influenza virus
ASQGTKRSH

SEQ ID NO: 435399 - protein, 9 aa, Influenza virus
ASQGTKRSY

SEQ ID NO: 435400 - protein, 9 aa, Influenza virus
ASQYGPSHS

SEQ ID NO: 435401 - protein, 9 aa, Influenza virus
ASRHHMGEC

SEQ ID NO: 435402 - protein, 9 aa, Influenza virus
ASRHYMGEC

SEQ ID NO: 435403 - protein, 9 aa, Influenza virus
ASRKADTRI

SEQ ID NO: 435404 - protein, 9 aa, Influenza virus
ASRSGYEML

SEQ ID NO: 435405 - protein, 9 aa, Influenza virus
ASRSGYEVL

SEQ ID NO: 435406 - protein, 9 aa, Influenza virus
ASRYGYEML

SEQ ID NO: 435407 - protein, 9 aa, Influenza virus
ASRYYMGEC

SEQ ID NO: 435408 - protein, 9 aa, Influenza virus
ASSGIAIAL

SEQ ID NO: 435409 - protein, 9 aa, Influenza virus
ASSGIAIVL

SEQ ID NO: 435410 - protein, 9 aa, Influenza virus
ASSGSLEFI

SEQ ID NO: 435411 - protein, 9 aa, Influenza virus
ASSISFCGV

SEQ ID NO: 435412 - protein, 9 aa, Influenza virus
ASSIVLVGL

SEQ ID NO: 435413 - protein, 9 aa, Influenza virus
ASSIVMVGL

SEQ ID NO: 435414 - protein, 9 aa, Influenza virus
ASSKSRARI

SEQ ID NO: 435415 - protein, 9 aa, Influenza virus
ASSLALAII

SEQ ID NO: 435416 - protein, 9 aa, Influenza virus
ASSLALAIM

SEQ ID NO: 435417 - protein, 9 aa, Influenza virus
ASSLILAAI

SEQ ID NO: 435418 - protein, 9 aa, Influenza virus
ASSLPFQNI

SEQ ID NO: 435419 - protein, 9 aa, Influenza virus
ASSLTLAIM

SEQ ID NO: 435420 - protein, 9 aa, Influenza virus
ASSLVLAAI

SEQ ID NO: 435421 - protein, 9 aa, Influenza virus
ASSLVLAAL

SEQ ID NO: 435422 - protein, 9 aa, Influenza virus
ASSLVLAAS

SEQ ID NO: 435423 - protein, 9 aa, Influenza virus
ASSLVLAIM

SEQ ID NO: 435424 - protein, 9 aa, Influenza virus
ASSLVLIVS

SEQ ID NO: 435425 - protein, 9 aa, Influenza virus
ASSLVLLFM

SEQ ID NO: 435426 - protein, 9 aa, Influenza virus
ASSLVLLLM

SEQ ID NO: 435427 - protein, 9 aa, Influenza virus
ASSLVLLVS

SEQ ID NO: 435428 - protein, 9 aa, Influenza virus
ASSLVLVVS

SEQ ID NO: 435429 - protein, 9 aa, Influenza virus
ASSQAHTKI

SEQ ID NO: 435430 - protein, 9 aa, Influenza virus
ASSQAHTKV

SEQ ID NO: 435431 - protein, 9 aa, Influenza virus
ASSQAYTKI

SEQ ID NO: 435432 - protein, 9 aa, Influenza virus
ASSQAYTKV

SEQ ID NO: 435433 - protein, 9 aa, Influenza virus
ASSQLEGFS

SEQ ID NO: 435434 - protein, 9 aa, Influenza virus
ASSSVLLVS

SEQ ID NO: 435435 - protein, 9 aa, Influenza virus
ASSTVLVGL

SEQ ID NO: 435436 - protein, 9 aa, Influenza virus
ASSTVMVGL

SEQ ID NO: 435437 - protein, 9 aa, Influenza virus
ASSVVLVGL

SEQ ID NO: 435438 - protein, 9 aa, Influenza virus
ASSVVLVGP

SEQ ID NO: 435439 - protein, 9 aa, Influenza virus
ASTGAQSFY

SEQ ID NO: 435440 - protein, 9 aa, Influenza virus
ASTGGQAFY

SEQ ID NO: 435441 - protein, 9 aa, Influenza virus
ASTGGQSFY

SEQ ID NO: 435442 - protein, 9 aa, Influenza virus
ASTLVLLVS

SEQ ID NO: 435443 - protein, 9 aa, Influenza virus
ASTNAHDRI

SEQ ID NO: 435444 - protein, 9 aa, Influenza virus
ASTNAYDRI

SEQ ID NO: 435445 - protein, 9 aa, Influenza virus
ASTQKAIDE

SEQ ID NO: 435446 - protein, 9 aa, Influenza virus
ASTQKAINE

SEQ ID NO: 435447 - protein, 9 aa, Influenza virus
ASTTAKAME

SEQ ID NO: 435448 - protein, 9 aa, Influenza virus
ASVPASRYL

SEQ ID NO: 435449 - protein, 9 aa, Influenza virus
ASWAGNILR

SEQ ID NO: 435450 - protein, 9 aa, Influenza virus
ASWFNSFLA

SEQ ID NO: 435451 - protein, 9 aa, Influenza virus
ASWFNSFLI

SEQ ID NO: 435452 - protein, 9 aa, Influenza virus
ASWFNSFLK

SEQ ID NO: 435453 - protein, 9 aa, Influenza virus
ASWFNSFLT

SEQ ID NO: 435454 - protein, 9 aa, Influenza virus
ASWFNSFLV

SEQ ID NO: 435455 - protein, 9 aa, Influenza virus
ASWSWHDGA

SEQ ID NO: 435456 - protein, 9 aa, Influenza virus
ASYKIFKSH

SEQ ID NO: 435457 - protein, 9 aa, Influenza virus
ASYKIFKSQ

SEQ ID NO: 435458 - protein, 9 aa, Influenza virus
ASYKIFKSR

SEQ ID NO: 435459 - protein, 9 aa, Influenza virus
ASYKIFKSY

SEQ ID NO: 435460 - protein, 9 aa, Influenza virus
ASYKRIRLF

SEQ ID NO: 435461 - protein, 9 aa, Influenza virus
ASYKRVRLF

SEQ ID NO: 435462 - protein, 9 aa, Influenza virus
ASYRIFKSH

SEQ ID NO: 435463 - protein, 9 aa, Influenza virus
ATACHDGKE

SEQ ID NO: 435464 - protein, 9 aa, Influenza virus
ATACHDGKG

SEQ ID NO: 435465 - protein, 9 aa, Influenza virus
ATACHDGKK

SEQ ID NO: 435466 - protein, 9 aa, Influenza virus
ATACHDGRK

SEQ ID NO: 435467 - protein, 9 aa, Influenza virus
ATACSDGPG

SEQ ID NO: 435468 - protein, 9 aa, Influenza virus
ATACSDGSG

SEQ ID NO: 435469 - protein, 9 aa, Influenza virus
ATAIFRKAT

SEQ ID NO: 435470 - protein, 9 aa, Influenza virus
ATAIIRKAT

SEQ ID NO: 435471 - protein, 9 aa, Influenza virus
ATAILKKAT

SEQ ID NO: 435472 - protein, 9 aa, Influenza virus
ATAILRKAT

SEQ ID NO: 435473 - protein, 9 aa, Influenza virus
ATALANTIE

SEQ ID NO: 435474 - protein, 9 aa, Influenza virus
ATAQMALQL

SEQ ID NO: 435475 - protein, 9 aa, Influenza virus
ATASFIYDG

SEQ ID NO: 435476 - protein, 9 aa, Influenza virus
ATASFIYEG

SEQ ID NO: 435477 - protein, 9 aa, Influenza virus
ATASFIYGG

SEQ ID NO: 435478 - protein, 9 aa, Influenza virus
ATASFIYNG

SEQ ID NO: 435479 - protein, 9 aa, Influenza virus
ATASFVYDG

SEQ ID NO: 435480 - protein, 9 aa, Influenza virus
ATASLIYDG

SEQ ID NO: 435481 - protein, 9 aa, Influenza virus
ATASLIYNG

SEQ ID NO: 435482 - protein, 9 aa, Influenza virus
ATATVYYDR

SEQ ID NO: 435483 - protein, 9 aa, Influenza virus
ATATVYYER

SEQ ID NO: 435484 - protein, 9 aa, Influenza virus
ATATVYYNG

SEQ ID NO: 435485 - protein, 9 aa, Influenza virus
ATATVYYNK

SEQ ID NO: 435486 - protein, 9 aa, Influenza virus
ATATVYYNR

SEQ ID NO: 435487 - protein, 9 aa, Influenza virus
ATAVAVIKY

SEQ ID NO: 435488 - protein, 9 aa, Influenza virus
ATAVAVLKY

SEQ ID NO: 435489 - protein, 9 aa, Influenza virus
ATCEQIADA

SEQ ID NO: 435490 - protein, 9 aa, Influenza virus
ATCEQIADS

SEQ ID NO: 435491 - protein, 9 aa, Influenza virus
ATCVCRDNW

SEQ ID NO: 435492 - protein, 9 aa, Influenza virus
ATDTVDTLT

SEQ ID NO: 435493 - protein, 9 aa, Influenza virus
ATEIRASVG

SEQ ID NO: 435494 - protein, 9 aa, Influenza virus
ATEIRSSVG

SEQ ID NO: 435495 - protein, 9 aa, Influenza virus
ATEIRTSVG

SEQ ID NO: 435496 - protein, 9 aa, Influenza virus
ATETVEITG

SEQ ID NO: 435497 - protein, 9 aa, Influenza virus
ATEYIMKGV

SEQ ID NO: 435498 - protein, 9 aa, Influenza virus
ATEYMMKGV

SEQ ID NO: 435499 - protein, 9 aa, Influenza virus
ATFLRSNAP

SEQ ID NO: 435500 - protein, 9 aa, Influenza virus
ATGFHFEEC

SEQ ID NO: 435501 - protein, 9 aa, Influenza virus
ATGFHLEEC

SEQ ID NO: 435502 - protein, 9 aa, Influenza virus
ATGLKNVPA

SEQ ID NO: 435503 - protein, 9 aa, Influenza virus
ATGLRNAHK

SEQ ID NO: 435504 - protein, 9 aa, Influenza virus
ATGLRNIPA

SEQ ID NO: 435505 - protein, 9 aa, Influenza virus
ATGLRNIPQ

SEQ ID NO: 435506 - protein, 9 aa, Influenza virus
ATGLRNIPS

SEQ ID NO: 435507 - protein, 9 aa, Influenza virus
ATGLRNVPA

SEQ ID NO: 435508 - protein, 9 aa, Influenza virus
ATGLRNVPI

SEQ ID NO: 435509 - protein, 9 aa, Influenza virus
ATGLRNVPK

SEQ ID NO: 435510 - protein, 9 aa, Influenza virus
ATGLRNVPQ

SEQ ID NO: 435511 - protein, 9 aa, Influenza virus
ATGLRNVPS

SEQ ID NO: 435512 - protein, 9 aa, Influenza virus
ATGLRNVPT

SEQ ID NO: 435513 - protein, 9 aa, Influenza virus
ATGMALSVV

SEQ ID NO: 435514 - protein, 9 aa, Influenza virus
ATGMILSVV

SEQ ID NO: 435515 - protein, 9 aa, Influenza virus
ATGMKNVPE

SEQ ID NO: 435516 - protein, 9 aa, Influenza virus
ATGMRNIPE

SEQ ID NO: 435517 - protein, 9 aa, Influenza virus
ATGMRNIPG

SEQ ID NO: 435518 - protein, 9 aa, Influenza virus
ATGMRNVPE

SEQ ID NO: 435519 - protein, 9 aa, Influenza virus
ATGMTLSVV

SEQ ID NO: 435520 - protein, 9 aa, Influenza virus
ATGPADTRI

SEQ ID NO: 435521 - protein, 9 aa, Influenza virus
ATGPADTRV

SEQ ID NO: 435522 - protein, 9 aa, Influenza virus
ATGPAETRI

SEQ ID NO: 435523 - protein, 9 aa, Influenza virus
ATGPAETRV

SEQ ID NO: 435524 - protein, 9 aa, Influenza virus
ATGPRNVPA

SEQ ID NO: 435525 - protein, 9 aa, Influenza virus
ATGPRNVPQ

SEQ ID NO: 435526 - protein, 9 aa, Influenza virus
ATGRVTVST

SEQ ID NO: 435527 - protein, 9 aa, Influenza virus
ATGVTLSVV

SEQ ID NO: 435528 - protein, 9 aa, Influenza virus
ATGYHFEEC

SEQ ID NO: 435529 - protein, 9 aa, Influenza virus
ATIGECPKY

SEQ ID NO: 435530 - protein, 9 aa, Influenza virus
ATINEEALR

SEQ ID NO: 435531 - protein, 9 aa, Influenza virus
ATIWTSGSS

SEQ ID NO: 435532 - protein, 9 aa, Influenza virus
ATKLYVNKN

SEQ ID NO: 435533 - protein, 9 aa, Influenza virus
ATKMEAILV

SEQ ID NO: 435534 - protein, 9 aa, Influenza virus
ATKMKAIIV

SEQ ID NO: 435535 - protein, 9 aa, Influenza virus
ATKMKAILV

SEQ ID NO: 435536 - protein, 9 aa, Influenza virus
ATKRIRLAI

SEQ ID NO: 435537 - protein, 9 aa, Influenza virus
ATKRIRMAI

SEQ ID NO: 435538 - protein, 9 aa, Influenza virus
ATKRIRMAT

SEQ ID NO: 435539 - protein, 9 aa, Influenza virus
ATKRLRMAI

SEQ ID NO: 435540 - protein, 9 aa, Influenza virus
ATLCLGHHA

SEQ ID NO: 435541 - protein, 9 aa, Influenza virus
ATNGNYGPI

SEQ ID NO: 435542 - protein, 9 aa, Influenza virus
ATNINIREW

SEQ ID NO: 435543 - protein, 9 aa, Influenza virus
ATNLYVNKN

SEQ ID NO: 435544 - protein, 9 aa, Influenza virus
ATNPIVPSF

SEQ ID NO: 435545 - protein, 9 aa, Influenza virus
ATNPVVPSF

SEQ ID NO: 435546 - protein, 9 aa, Influenza virus
ATPGMQIRG

SEQ ID NO: 435547 - protein, 9 aa, Influenza virus
ATQTLVSNN

SEQ ID NO: 435548 - protein, 9 aa, Influenza virus
ATREGKHIV

SEQ ID NO: 435549 - protein, 9 aa, Influenza virus
ATRGVQIAS

SEQ ID NO: 435550 - protein, 9 aa, Influenza virus
ATRLYVNKN

SEQ ID NO: 435551 - protein, 9 aa, Influenza virus
ATRPKVNGQ

SEQ ID NO: 435552 - protein, 9 aa, Influenza virus
ATRPQVNGQ

SEQ ID NO: 435553 - protein, 9 aa, Influenza virus
ATRPRVNGQ

SEQ ID NO: 435554 - protein, 9 aa, Influenza virus
ATRSKVNGQ

SEQ ID NO: 435555 - protein, 9 aa, Influenza virus
ATSACKRTV

SEQ ID NO: 435556 - protein, 9 aa, Influenza virus
ATSPIVPSF

SEQ ID NO: 435557 - protein, 9 aa, Influenza virus
ATTHSWIPK

SEQ ID NO: 435558 - protein, 9 aa, Influenza virus
ATTHSWTPK

SEQ ID NO: 435559 - protein, 9 aa, Influenza virus
ATTHSWVPI

SEQ ID NO: 435560 - protein, 9 aa, Influenza virus
ATTHSWVPK

SEQ ID NO: 435561 - protein, 9 aa, Influenza virus
ATTITLHFK

SEQ ID NO: 435562 - protein, 9 aa, Influenza virus
ATTNPLIKH

SEQ ID NO: 435563 - protein, 9 aa, Influenza virus
ATTNPLIRH

SEQ ID NO: 435564 - protein, 9 aa, Influenza virus
ATTVTLHFK

SEQ ID NO: 435565 - protein, 9 aa, Influenza virus
ATVAGSLSL

SEQ ID NO: 435566 - protein, 9 aa, Influenza virus
ATVNEEALR

SEQ ID NO: 435567 - protein, 9 aa, Influenza virus
ATVNEGALR

SEQ ID NO: 435568 - protein, 9 aa, Influenza virus
ATVSADPLA

SEQ ID NO: 435569 - protein, 9 aa, Influenza virus
ATVSADPLL

SEQ ID NO: 435570 - protein, 9 aa, Influenza virus
ATVSADPLV

SEQ ID NO: 435571 - protein, 9 aa, Influenza virus
ATVTLHFKQ

SEQ ID NO: 435572 - protein, 9 aa, Influenza virus
ATVYYDRRL

SEQ ID NO: 435573 - protein, 9 aa, Influenza virus
ATVYYERRL

SEQ ID NO: 435574 - protein, 9 aa, Influenza virus
ATVYYNGRL

SEQ ID NO: 435575 - protein, 9 aa, Influenza virus
ATVYYNKRL

SEQ ID NO: 435576 - protein, 9 aa, Influenza virus
ATVYYNRRL

SEQ ID NO: 435577 - protein, 9 aa, Influenza virus
ATVYYNRRP

SEQ ID NO: 435578 - protein, 9 aa, Influenza virus
ATYQRTRAL

SEQ ID NO: 435579 - protein, 9 aa, Influenza virus
AVAKDNAIR

SEQ ID NO: 435580 - protein, 9 aa, Influenza virus
AVANGTKVN

SEQ ID NO: 435581 - protein, 9 aa, Influenza virus
AVATTHSWI

SEQ ID NO: 435582 - protein, 9 aa, Influenza virus
AVATTHSWT

SEQ ID NO: 435583 - protein, 9 aa, Influenza virus
AVATTHSWV

SEQ ID NO: 435584 - protein, 9 aa, Influenza virus
AVAVIKYNG

SEQ ID NO: 435585 - protein, 9 aa, Influenza virus
AVAVLKYDG

SEQ ID NO: 435586 - protein, 9 aa, Influenza virus
AVAVLKYKG

SEQ ID NO: 435587 - protein, 9 aa, Influenza virus
AVAVLKYNG

SEQ ID NO: 435588 - protein, 9 aa, Influenza virus
AVAVVKYNG

SEQ ID NO: 435589 - protein, 9 aa, Influenza virus
AVAWSATAC

SEQ ID NO: 435590 - protein, 9 aa, Influenza virus
AVDEGNGCF

SEQ ID NO: 435591 - protein, 9 aa, Influenza virus
AVDGTIAGF

SEQ ID NO: 435592 - protein, 9 aa, Influenza virus
AVDICKAAI

SEQ ID NO: 435593 - protein, 9 aa, Influenza virus
AVDICKAAL

SEQ ID NO: 435594 - protein, 9 aa, Influenza virus
AVDICKAAM

SEQ ID NO: 435595 - protein, 9 aa, Influenza virus
AVDLGSCGI

SEQ ID NO: 435596 - protein, 9 aa, Influenza virus
AVDQITGKL

SEQ ID NO: 435597 - protein, 9 aa, Influenza virus
AVDTCYPFD

SEQ ID NO: 435598 - protein, 9 aa, Influenza virus
AVDTGDGCF

SEQ ID NO: 435599 - protein, 9 aa, Influenza virus
AVDTGNGCF

SEQ ID NO: 435600 - protein, 9 aa, Influenza virus
AVEKEFSNL

SEQ ID NO: 435601 - protein, 9 aa, Influenza virus
AVENGTSVK

SEQ ID NO: 435602 - protein, 9 aa, Influenza virus
AVENQHTID

SEQ ID NO: 435603 - protein, 9 aa, Influenza virus
AVFCGTSGT

SEQ ID NO: 435604 - protein, 9 aa, Influenza virus
AVGGSGTDN

SEQ ID NO: 435605 - protein, 9 aa, Influenza virus
AVGGSGTNN

SEQ ID NO: 435606 - protein, 9 aa, Influenza virus
AVGICKAAM

SEQ ID NO: 435607 - protein, 9 aa, Influenza virus
AVGKCPKYV

SEQ ID NO: 435608 - protein, 9 aa, Influenza virus
AVGKCPRYV

SEQ ID NO: 435609 - protein, 9 aa, Influenza virus
AVGKEFGNL

SEQ ID NO: 435610 - protein, 9 aa, Influenza virus
AVGKEFNNL

SEQ ID NO: 435611 - protein, 9 aa, Influenza virus
AVGKEFSNL

SEQ ID NO: 435612 - protein, 9 aa, Influenza virus
AVGLRNTPS

SEQ ID NO: 435613 - protein, 9 aa, Influenza virus
AVGRCPRYV

SEQ ID NO: 435614 - protein, 9 aa, Influenza virus
AVIHYGGIP

SEQ ID NO: 435615 - protein, 9 aa, Influenza virus
AVIHYGGMP

SEQ ID NO: 435616 - protein, 9 aa, Influenza virus
AVIHYGGVP

SEQ ID NO: 435617 - protein, 9 aa, Influenza virus
AVIKYNGII

SEQ ID NO: 435618 - protein, 9 aa, Influenza virus
AVIYGNPKC

SEQ ID NO: 435619 - protein, 9 aa, Influenza virus
AVKLSSGYK

SEQ ID NO: 435620 - protein, 9 aa, Influenza virus
AVKLYKKLK

SEQ ID NO: 435621 - protein, 9 aa, Influenza virus
AVKLYRKLK

SEQ ID NO: 435622 - protein, 9 aa, Influenza virus
AVKQNGKSG

SEQ ID NO: 435623 - protein, 9 aa, Influenza virus
AVLIAGGLI

SEQ ID NO: 435624 - protein, 9 aa, Influenza virus
AVLKPGQTL

SEQ ID NO: 435625 - protein, 9 aa, Influenza virus
AVLKPGQTV

SEQ ID NO: 435626 - protein, 9 aa, Influenza virus
AVLKYKGII

SEQ ID NO: 435627 - protein, 9 aa, Influenza virus
AVLKYNGII

SEQ ID NO: 435628 - protein, 9 aa, Influenza virus
AVLKYNGMI

SEQ ID NO: 435629 - protein, 9 aa, Influenza virus
AVLKYNGVI

SEQ ID NO: 435630 - protein, 9 aa, Influenza virus
AVLRGFLII

SEQ ID NO: 435631 - protein, 9 aa, Influenza virus
AVLRGFLIL

SEQ ID NO: 435632 - protein, 9 aa, Influenza virus
AVNICKAAM

SEQ ID NO: 435633 - protein, 9 aa, Influenza virus
AVNNRFQIK

SEQ ID NO: 435634 - protein, 9 aa, Influenza virus
AVNSSKPFQ

SEQ ID NO: 435635 - protein, 9 aa, Influenza virus
AVNSSMPFH

SEQ ID NO: 435636 - protein, 9 aa, Influenza virus
AVNSWHILS

SEQ ID NO: 435637 - protein, 9 aa, Influenza virus
AVNTTLSTI

SEQ ID NO: 435638 - protein, 9 aa, Influenza virus
AVPNGTIVK

SEQ ID NO: 435639 - protein, 9 aa, Influenza virus
AVPNGTIVR

SEQ ID NO: 435640 - protein, 9 aa, Influenza virus
AVPNGTKVN

SEQ ID NO: 435641 - protein, 9 aa, Influenza virus
AVPNGTLVK

SEQ ID NO: 435642 - protein, 9 aa, Influenza virus
AVPNGTMVK

SEQ ID NO: 435643 - protein, 9 aa, Influenza virus
AVPNGTVVK

SEQ ID NO: 435644 - protein, 9 aa, Influenza virus
AVRFGESEQ

SEQ ID NO: 435645 - protein, 9 aa, Influenza virus
AVRGDLNFV

SEQ ID NO: 435646 - protein, 9 aa, Influenza virus
AVRIGEDAH

SEQ ID NO: 435647 - protein, 9 aa, Influenza virus
AVSADPLAS

SEQ ID NO: 435648 - protein, 9 aa, Influenza virus
AVSFWMCSN

SEQ ID NO: 435649 - protein, 9 aa, Influenza virus
AVSIDRFLR

SEQ ID NO: 435650 - protein, 9 aa, Influenza virus
AVSNGTKIN

SEQ ID NO: 435651 - protein, 9 aa, Influenza virus
AVSNGTKVN

SEQ ID NO: 435652 - protein, 9 aa, Influenza virus
AVTDGPAAN

SEQ ID NO: 435653 - protein, 9 aa, Influenza virus
AVTDGPADN

SEQ ID NO: 435654 - protein, 9 aa, Influenza virus
AVTDIWSYN

SEQ ID NO: 435655 - protein, 9 aa, Influenza virus
AVTDVWSYN

SEQ ID NO: 435656 - protein, 9 aa, Influenza virus
AVTWWNRKG

SEQ ID NO: 435657 - protein, 9 aa, Influenza virus
AVTWWNRNG

SEQ ID NO: 435658 - protein, 9 aa, Influenza virus
AVTWWNRSG

SEQ ID NO: 435659 - protein, 9 aa, Influenza virus
AVVKYNGII

SEQ ID NO: 435660 - protein, 9 aa, Influenza virus
AVVMGLVFI

SEQ ID NO: 435661 - protein, 9 aa, Influenza virus
AVVMTDGNA

SEQ ID NO: 435662 - protein, 9 aa, Influenza virus
AVVMTDGPA

SEQ ID NO: 435663 - protein, 9 aa, Influenza virus
AVVMTDGSA

SEQ ID NO: 435664 - protein, 9 aa, Influenza virus
AVVSKDNGI

SEQ ID NO: 435665 - protein, 9 aa, Influenza virus
AWIGRTKST

SEQ ID NO: 435666 - protein, 9 aa, Influenza virus
AWLHICVTG

SEQ ID NO: 435667 - protein, 9 aa, Influenza virus
AWLHVCITG

SEQ ID NO: 435668 - protein, 9 aa, Influenza virus
AWLHVCVTG

SEQ ID NO: 435669 - protein, 9 aa, Influenza virus
AWSASACHD

SEQ ID NO: 435670 - protein, 9 aa, Influenza virus
AWSATACHD

SEQ ID NO: 435671 - protein, 9 aa, Influenza virus
AWSATACSD

SEQ ID NO: 435672 - protein, 9 aa, Influenza virus
AWSRSSCHD

SEQ ID NO: 435673 - protein, 9 aa, Influenza virus
AWSSASCHD

SEQ ID NO: 435674 - protein, 9 aa, Influenza virus
AWSSSSCFD

SEQ ID NO: 435675 - protein, 9 aa, Influenza virus
AWSSSSCHD

SEQ ID NO: 435676 - protein, 9 aa, Influenza virus
AWSSSSCYD

SEQ ID NO: 435677 - protein, 9 aa, Influenza virus
AWSSTSCFD

SEQ ID NO: 435678 - protein, 9 aa, Influenza virus
AWSYIVERP

SEQ ID NO: 435679 - protein, 9 aa, Influenza virus
AWTAVNSIC

SEQ ID NO: 435680 - protein, 9 aa, Influenza virus
AWTMVNSIC

SEQ ID NO: 435681 - protein, 9 aa, Influenza virus
AWTVINSIC

SEQ ID NO: 435682 - protein, 9 aa, Influenza virus
AWTVVNSIC

SEQ ID NO: 435683 - protein, 9 aa, Influenza virus
AWTVVNSLC

SEQ ID NO: 435684 - protein, 9 aa, Influenza virus
AYAVIHYGG

SEQ ID NO: 435685 - protein, 9 aa, Influenza virus
AYCNTDLGA

SEQ ID NO: 435686 - protein, 9 aa, Influenza virus
AYCNTDLGS

SEQ ID NO: 435687 - protein, 9 aa, Influenza virus
AYCNTDLGT

SEQ ID NO: 435688 - protein, 9 aa, Influenza virus
AYCYPGATM

SEQ ID NO: 435689 - protein, 9 aa, Influenza virus
AYCYPGATV

SEQ ID NO: 435690 - protein, 9 aa, Influenza virus
AYCYPGSTV

SEQ ID NO: 435691 - protein, 9 aa, Influenza virus
AYCYPGTTV

SEQ ID NO: 435692 - protein, 9 aa, Influenza virus
AYDKICIGY

SEQ ID NO: 435693 - protein, 9 aa, Influenza virus
AYDRICIGY

SEQ ID NO: 435694 - protein, 9 aa, Influenza virus
AYERMCNIL

SEQ ID NO: 435695 - protein, 9 aa, Influenza virus
AYGVKGFSF

SEQ ID NO: 435696 - protein, 9 aa, Influenza virus
AYIVKKGDS

SEQ ID NO: 435697 - protein, 9 aa, Influenza virus
AYKIIKKGD

SEQ ID NO: 435698 - protein, 9 aa, Influenza virus
AYKILTIYS

SEQ ID NO: 435699 - protein, 9 aa, Influenza virus
AYKIVKEGD

SEQ ID NO: 435700 - protein, 9 aa, Influenza virus
AYKIVKKGD

SEQ ID NO: 435701 - protein, 9 aa, Influenza virus
AYKIVKTGD

SEQ ID NO: 435702 - protein, 9 aa, Influenza virus
AYMLERELV

SEQ ID NO: 435703 - protein, 9 aa, Influenza virus
AYNAELIVL

SEQ ID NO: 435704 - protein, 9 aa, Influenza virus
AYNAELLVL

SEQ ID NO: 435705 - protein, 9 aa, Influenza virus
AYNFNEGSY

SEQ ID NO: 435706 - protein, 9 aa, Influenza virus
AYNNTTGRD

SEQ ID NO: 435707 - protein, 9 aa, Influenza virus
AYPFQNLTK

SEQ ID NO: 435708 - protein, 9 aa, Influenza virus
AYPLQNLTK

SEQ ID NO: 435709 - protein, 9 aa, Influenza virus
AYQAKFESV

SEQ ID NO: 435710 - protein, 9 aa, Influenza virus
AYQAQFESV

SEQ ID NO: 435711 - protein, 9 aa, Influenza virus
AYQARFESV

SEQ ID NO: 435712 - protein, 9 aa, Influenza virus
AYQKQMTRG

SEQ ID NO: 435713 - protein, 9 aa, Influenza virus
AYQKRMGLQ

SEQ ID NO: 435714 - protein, 9 aa, Influenza virus
AYQKRMGVQ

SEQ ID NO: 435715 - protein, 9 aa, Influenza virus
AYQKRMTRG

SEQ ID NO: 435716 - protein, 9 aa, Influenza virus
AYRKRMTRG

SEQ ID NO: 435717 - protein, 9 aa, Influenza virus
AYSQITNGT

SEQ ID NO: 435718 - protein, 9 aa, Influenza virus
AYTKILYFH

SEQ ID NO: 435719 - protein, 9 aa, Influenza virus
AYTKIMYFH

SEQ ID NO: 435720 - protein, 9 aa, Influenza virus
AYTKVLYFH

SEQ ID NO: 435721 - protein, 9 aa, Influenza virus
AYTKVMYFH

SEQ ID NO: 435722 - protein, 9 aa, Influenza virus
AYVDGFEPN

SEQ ID NO: 435723 - protein, 9 aa, Influenza virus
AYVDGFKPN

SEQ ID NO: 435724 - protein, 9 aa, Influenza virus
AYWWDGLQS

SEQ ID NO: 435725 - protein, 9 aa, Influenza virus
CAAMDDFQL

SEQ ID NO: 435726 - protein, 9 aa, Influenza virus
CAAMDEFQL

SEQ ID NO: 435727 - protein, 9 aa, Influenza virus
CAAMEDFQL

SEQ ID NO: 435728 - protein, 9 aa, Influenza virus
CAAWSSSSC

SEQ ID NO: 435729 - protein, 9 aa, Influenza virus
CAGIPSDTP

SEQ ID NO: 435730 - protein, 9 aa, Influenza virus
CAGIPTDTP

SEQ ID NO: 435731 - protein, 9 aa, Influenza virus
CAGLPSDTP

SEQ ID NO: 435732 - protein, 9 aa, Influenza virus
CASNINIRE

SEQ ID NO: 435733 - protein, 9 aa, Influenza virus
CATCEQIAD

SEQ ID NO: 435734 - protein, 9 aa, Influenza virus
CATNINIRE

SEQ ID NO: 435735 - protein, 9 aa, Influenza virus
CAVATTHSW

SEQ ID NO: 435736 - protein, 9 aa, Influenza virus
CAVNSWHIL

SEQ ID NO: 435737 - protein, 9 aa, Influenza virus
CAVVMTDGN

SEQ ID NO: 435738 - protein, 9 aa, Influenza virus
CAVVMTDGS

SEQ ID NO: 435739 - protein, 9 aa, Influenza virus
CCNLFEKFF

SEQ ID NO: 435740 - protein, 9 aa, Influenza virus
CCSLFEKFF

SEQ ID NO: 435741 - protein, 9 aa, Influenza virus
CCTLFEKFF

SEQ ID NO: 435742 - protein, 9 aa, Influenza virus
CDAPFDDRL

SEQ ID NO: 435743 - protein, 9 aa, Influenza virus
CDDDCMASI

SEQ ID NO: 435744 - protein, 9 aa, Influenza virus
CDDHCMESI

SEQ ID NO: 435745 - protein, 9 aa, Influenza virus
CDDLIGKNS

SEQ ID NO: 435746 - protein, 9 aa, Influenza virus
CDDLIGKTS

SEQ ID NO: 435747 - protein, 9 aa, Influenza virus
CDDNCMESI

SEQ ID NO: 435748 - protein, 9 aa, Influenza virus
CDDPCMESI

SEQ ID NO: 435749 - protein, 9 aa, Influenza virus
CDDQCMESI

SEQ ID NO: 435750 - protein, 9 aa, Influenza virus
CDDSCMESI

SEQ ID NO: 435751 - protein, 9 aa, Influenza virus
CDELIGKTS

SEQ ID NO: 435752 - protein, 9 aa, Influenza virus
CDHSDNADK

SEQ ID NO: 435753 - protein, 9 aa, Influenza virus
CDIINGALG

SEQ ID NO: 435754 - protein, 9 aa, Influenza virus
CDIVNAALG

SEQ ID NO: 435755 - protein, 9 aa, Influenza virus
CDIVNGALG

SEQ ID NO: 435756 - protein, 9 aa, Influenza virus
CDIVNSALG

SEQ ID NO: 435757 - protein, 9 aa, Influenza virus
CDLHLEFKA

SEQ ID NO: 435758 - protein, 9 aa, Influenza virus
CDLHLTGIW

SEQ ID NO: 435759 - protein, 9 aa, Influenza virus
CDLHLTGKW

SEQ ID NO: 435760 - protein, 9 aa, Influenza virus
CDLHLTGTW

SEQ ID NO: 435761 - protein, 9 aa, Influenza virus
CDLINGALG

SEQ ID NO: 435762 - protein, 9 aa, Influenza virus
CDLYLNGRE

SEQ ID NO: 435763 - protein, 9 aa, Influenza virus
CDLYLSGRE

SEQ ID NO: 435764 - protein, 9 aa, Influenza virus
CDLYLTGTW

SEQ ID NO: 435765 - protein, 9 aa, Influenza virus
CDNECMETI

SEQ ID NO: 435766 - protein, 9 aa, Influenza virus
CDNKCIESI

SEQ ID NO: 435767 - protein, 9 aa, Influenza virus
CDNKCMETI

SEQ ID NO: 435768 - protein, 9 aa, Influenza virus
CDNLIGKTS

SEQ ID NO: 435769 - protein, 9 aa, Influenza virus
CDNNCIESI

SEQ ID NO: 435770 - protein, 9 aa, Influenza virus
CDNNCMESI

SEQ ID NO: 435771 - protein, 9 aa, Influenza virus
CDNQCMESI

SEQ ID NO: 435772 - protein, 9 aa, Influenza virus
CDNSCIESI

SEQ ID NO: 435773 - protein, 9 aa, Influenza virus
CDNTCIESI

SEQ ID NO: 435774 - protein, 9 aa, Influenza virus
CDPDECRFY

SEQ ID NO: 435775 - protein, 9 aa, Influenza virus
CDPDGCRFY

SEQ ID NO: 435776 - protein, 9 aa, Influenza virus
CDPHLTGTW

SEQ ID NO: 435777 - protein, 9 aa, Influenza virus
CDPIGCKMY

SEQ ID NO: 435778 - protein, 9 aa, Influenza virus
CDPLGCKMY

SEQ ID NO: 435779 - protein, 9 aa, Influenza virus
CDPLGCRMY

SEQ ID NO: 435780 - protein, 9 aa, Influenza virus
CDPNECRFY

SEQ ID NO: 435781 - protein, 9 aa, Influenza virus
CDPSGCKMY

SEQ ID NO: 435782 - protein, 9 aa, Influenza virus
CDPTGCKMY

SEQ ID NO: 435783 - protein, 9 aa, Influenza virus
CDPYLNGRE

SEQ ID NO: 435784 - protein, 9 aa, Influenza virus
CDRLQDTTW

SEQ ID NO: 435785 - protein, 9 aa, Influenza virus
CDSHLKFKA

SEQ ID NO: 435786 - protein, 9 aa, Influenza virus
CDSPSNING

SEQ ID NO: 435787 - protein, 9 aa, Influenza virus
CDSPSNVKG

SEQ ID NO: 435788 - protein, 9 aa, Influenza virus
CDSPSNVNG

SEQ ID NO: 435789 - protein, 9 aa, Influenza virus
CDTKCQTPL

SEQ ID NO: 435790 - protein, 9 aa, Influenza virus
CDYLIGKTS

SEQ ID NO: 435791 - protein, 9 aa, Influenza virus
CEGECFYSG

SEQ ID NO: 435792 - protein, 9 aa, Influenza virus
CEITGFAPF

SEQ ID NO: 435793 - protein, 9 aa, Influenza virus
CEKLEQSGL

SEQ ID NO: 435794 - protein, 9 aa, Influenza virus
CEPDECRFY

SEQ ID NO: 435795 - protein, 9 aa, Influenza virus
CEPIIIEKN

SEQ ID NO: 435796 - protein, 9 aa, Influenza virus
CEPIIIERN

SEQ ID NO: 435797 - protein, 9 aa, Influenza virus
CEPIIVERN

SEQ ID NO: 435798 - protein, 9 aa, Influenza virus
CEPTIIERN

SEQ ID NO: 435799 - protein, 9 aa, Influenza virus
CEQIADAQH

SEQ ID NO: 435800 - protein, 9 aa, Influenza virus
CEQIADSHH

SEQ ID NO: 435801 - protein, 9 aa, Influenza virus
CEQIADSQH

SEQ ID NO: 435802 - protein, 9 aa, Influenza virus
CESKCFWKG

SEQ ID NO: 435803 - protein, 9 aa, Influenza virus
CESKCFWRG

SEQ ID NO: 435804 - protein, 9 aa, Influenza virus
CETKCQSPL

SEQ ID NO: 435805 - protein, 9 aa, Influenza virus
CETKCQTPL

SEQ ID NO: 435806 - protein, 9 aa, Influenza virus
CETQCQTPL

SEQ ID NO: 435807 - protein, 9 aa, Influenza virus
CETRCQTPL

SEQ ID NO: 435808 - protein, 9 aa, Influenza virus
CEVNSWHIF

SEQ ID NO: 435809 - protein, 9 aa, Influenza virus
CEVNSWHIL

SEQ ID NO: 435810 - protein, 9 aa, Influenza virus
CEVSSWHIL

SEQ ID NO: 435811 - protein, 9 aa, Influenza virus
CFDGKEWLH

SEQ ID NO: 435812 - protein, 9 aa, Influenza virus
CFDGKEWMH

SEQ ID NO: 435813 - protein, 9 aa, Influenza virus
CFDGREWMH

SEQ ID NO: 435814 - protein, 9 aa, Influenza virus
CFDILHKCD

SEQ ID NO: 435815 - protein, 9 aa, Influenza virus
CFDILHKCN

SEQ ID NO: 435816 - protein, 9 aa, Influenza virus
CFDLYHKCD

SEQ ID NO: 435817 - protein, 9 aa, Influenza virus
CFEFWHKCD

SEQ ID NO: 435818 - protein, 9 aa, Influenza virus
CFEFWHKCN

SEQ ID NO: 435819 - protein, 9 aa, Influenza virus
CFEFYHKCD

SEQ ID NO: 435820 - protein, 9 aa, Influenza virus
CFEFYHKCN

SEQ ID NO: 435821 - protein, 9 aa, Influenza virus
CFEFYHRCD

SEQ ID NO: 435822 - protein, 9 aa, Influenza virus
CFEIFHKCD

SEQ ID NO: 435823 - protein, 9 aa, Influenza virus
CFEIFHQCD

SEQ ID NO: 435824 - protein, 9 aa, Influenza virus
CFEIFHRCD

SEQ ID NO: 435825 - protein, 9 aa, Influenza virus
CFEILHKCD

SEQ ID NO: 435826 - protein, 9 aa, Influenza virus
CFEILHKCN

SEQ ID NO: 435827 - protein, 9 aa, Influenza virus
CFEILHRCD

SEQ ID NO: 435828 - protein, 9 aa, Influenza virus
CFEILHRCN

SEQ ID NO: 435829 - protein, 9 aa, Influenza virus
CFEIYHACD

SEQ ID NO: 435830 - protein, 9 aa, Influenza virus
CFEIYHKCD

SEQ ID NO: 435831 - protein, 9 aa, Influenza virus
CFEIYHNCD

SEQ ID NO: 435832 - protein, 9 aa, Influenza virus
CFEIYHRCD

SEQ ID NO: 435833 - protein, 9 aa, Influenza virus
CFEIYHTCD

SEQ ID NO: 435834 - protein, 9 aa, Influenza virus
CFELLHKCN

SEQ ID NO: 435835 - protein, 9 aa, Influenza virus
CFELYHKCD

SEQ ID NO: 435836 - protein, 9 aa, Influenza virus
CFELYHKCN

SEQ ID NO: 435837 - protein, 9 aa, Influenza virus
CFELYHRCD

SEQ ID NO: 435838 - protein, 9 aa, Influenza virus
CFFMQIAIL

SEQ ID NO: 435839 - protein, 9 aa, Influenza virus
CFKIYHKCD

SEQ ID NO: 435840 - protein, 9 aa, Influenza virus
CFKIYHKCN

SEQ ID NO: 435841 - protein, 9 aa, Influenza virus
CFKIYHRCD

SEQ ID NO: 435842 - protein, 9 aa, Influenza virus
CFLLAALLL

SEQ ID NO: 435843 - protein, 9 aa, Influenza virus
CFLLIALLL

SEQ ID NO: 435844 - protein, 9 aa, Influenza virus
CFLLVALFL

SEQ ID NO: 435845 - protein, 9 aa, Influenza virus
CFLLVALLI

SEQ ID NO: 435846 - protein, 9 aa, Influenza virus
CFLLVALLL

SEQ ID NO: 435847 - protein, 9 aa, Influenza virus
CFLMQIAIL

SEQ ID NO: 435848 - protein, 9 aa, Influenza virus
CFLMQIATL

SEQ ID NO: 435849 - protein, 9 aa, Influenza virus
CFLMQIAVL

SEQ ID NO: 435850 - protein, 9 aa, Influenza virus
CFLMQITIL

SEQ ID NO: 435851 - protein, 9 aa, Influenza virus
CFLWHVRKR

SEQ ID NO: 435852 - protein, 9 aa, Influenza virus
CFMYSDFHF

SEQ ID NO: 435853 - protein, 9 aa, Influenza virus
CFNFFHKCN

SEQ ID NO: 435854 - protein, 9 aa, Influenza virus
CFNLLHKCN

SEQ ID NO: 435855 - protein, 9 aa, Influenza virus
CFNPCFYVE

SEQ ID NO: 435856 - protein, 9 aa, Influenza virus
CFNPITGSP

SEQ ID NO: 435857 - protein, 9 aa, Influenza virus
CFNPMIAEL

SEQ ID NO: 435858 - protein, 9 aa, Influenza virus
CFNPMIIEL

SEQ ID NO: 435859 - protein, 9 aa, Influenza virus
CFNPMIVEL

SEQ ID NO: 435860 - protein, 9 aa, Influenza virus
CFNPMTVEL

SEQ ID NO: 435861 - protein, 9 aa, Influenza virus
CFNPMVVEL

SEQ ID NO: 435862 - protein, 9 aa, Influenza virus
CFPFYHKCD

SEQ ID NO: 435863 - protein, 9 aa, Influenza virus
CFPGELDNN

SEQ ID NO: 435864 - protein, 9 aa, Influenza virus
CFPGEVDNN

SEQ ID NO: 435865 - protein, 9 aa, Influenza virus
CFQPCFYIE

SEQ ID NO: 435866 - protein, 9 aa, Influenza virus
CFQPCFYVE

SEQ ID NO: 435867 - protein, 9 aa, Influenza virus
CFQRSKFLL

SEQ ID NO: 435868 - protein, 9 aa, Influenza virus
CFRIYHKCD

SEQ ID NO: 435869 - protein, 9 aa, Influenza virus
CFSILHKCN

SEQ ID NO: 435870 - protein, 9 aa, Influenza virus
CFSLLHKCN

SEQ ID NO: 435871 - protein, 9 aa, Influenza virus
CFTFYHKCD

SEQ ID NO: 435872 - protein, 9 aa, Influenza virus
CFTFYHKCN

SEQ ID NO: 435873 - protein, 9 aa, Influenza virus
CFTIMTDGP

SEQ ID NO: 435874 - protein, 9 aa, Influenza virus
CFTIYHKCD

SEQ ID NO: 435875 - protein, 9 aa, Influenza virus
CFTVLTDGP

SEQ ID NO: 435876 - protein, 9 aa, Influenza virus
CFTVMTDGP

SEQ ID NO: 435877 - protein, 9 aa, Influenza virus
CFVFVALIL

SEQ ID NO: 435878 - protein, 9 aa, Influenza virus
CFWKGGSIK

SEQ ID NO: 435879 - protein, 9 aa, Influenza virus
CFWKGGSIN

SEQ ID NO: 435880 - protein, 9 aa, Influenza virus
CFWKGGTIN

SEQ ID NO: 435881 - protein, 9 aa, Influenza virus
CFWLEMIRG

SEQ ID NO: 435882 - protein, 9 aa, Influenza virus
CFWMCSNGS

SEQ ID NO: 435883 - protein, 9 aa, Influenza virus
CFWRGGSII

SEQ ID NO: 435884 - protein, 9 aa, Influenza virus
CFWRGGSIN

SEQ ID NO: 435885 - protein, 9 aa, Influenza virus
CFWVELIRG

SEQ ID NO: 435886 - protein, 9 aa, Influenza virus
CFWVELVRG

SEQ ID NO: 435887 - protein, 9 aa, Influenza virus
CFWVEMIRG

SEQ ID NO: 435888 - protein, 9 aa, Influenza virus
CFWVMTDGP

SEQ ID NO: 435889 - protein, 9 aa, Influenza virus
CFYIELIRG

SEQ ID NO: 435890 - protein, 9 aa, Influenza virus
CFYSGGTIN

SEQ ID NO: 435891 - protein, 9 aa, Influenza virus
CFYVELIRG

SEQ ID NO: 435892 - protein, 9 aa, Influenza virus
CFYVELTRG

SEQ ID NO: 435893 - protein, 9 aa, Influenza virus
CFYVELVRG

SEQ ID NO: 435894 - protein, 9 aa, Influenza virus
CGCRDNWQG

SEQ ID NO: 435895 - protein, 9 aa, Influenza virus
CGILGILTG

SEQ ID NO: 435896 - protein, 9 aa, Influenza virus
CGILGTIIG

SEQ ID NO: 435897 - protein, 9 aa, Influenza virus
CGLDNEPGS

SEQ ID NO: 435898 - protein, 9 aa, Influenza virus
CGLLGIITG

SEQ ID NO: 435899 - protein, 9 aa, Influenza virus
CGLLGILIG

SEQ ID NO: 435900 - protein, 9 aa, Influenza virus
CGLLGTITG

SEQ ID NO: 435901 - protein, 9 aa, Influenza virus
CGLLGTLIG

SEQ ID NO: 435902 - protein, 9 aa, Influenza virus
CGLLGTLTG

SEQ ID NO: 435903 - protein, 9 aa, Influenza virus
CGLLGTVTG

SEQ ID NO: 435904 - protein, 9 aa, Influenza virus
CGLNNEPGS

SEQ ID NO: 435905 - protein, 9 aa, Influenza virus
CGMIDGWYG

SEQ ID NO: 435906 - protein, 9 aa, Influenza virus
CGNGSCRCT

SEQ ID NO: 435907 - protein, 9 aa, Influenza virus
CGNNCIESI

SEQ ID NO: 435908 - protein, 9 aa, Influenza virus
CGPAECRTF

SEQ ID NO: 435909 - protein, 9 aa, Influenza virus
CGPSECRTF

SEQ ID NO: 435910 - protein, 9 aa, Influenza virus
CGPTECRTF

SEQ ID NO: 435911 - protein, 9 aa, Influenza virus
CGSKEQLGS

SEQ ID NO: 435912 - protein, 9 aa, Influenza virus
CGSKERLGS

SEQ ID NO: 435913 - protein, 9 aa, Influenza virus
CGSKKRLGS

SEQ ID NO: 435914 - protein, 9 aa, Influenza virus
CGSPFPVGS

SEQ ID NO: 435915 - protein, 9 aa, Influenza virus
CGSPISVGS

SEQ ID NO: 435916 - protein, 9 aa, Influenza virus
CGSPVPVGS

SEQ ID NO: 435917 - protein, 9 aa, Influenza virus
CGSPVSVGS

SEQ ID NO: 435918 - protein, 9 aa, Influenza virus
CGSRERLGS

SEQ ID NO: 435919 - protein, 9 aa, Influenza virus
CGTGSWPDG

SEQ ID NO: 435920 - protein, 9 aa, Influenza virus
CGTSGTYGA

SEQ ID NO: 435921 - protein, 9 aa, Influenza virus
CGTSGTYGS

SEQ ID NO: 435922 - protein, 9 aa, Influenza virus
CGTSGTYGT

SEQ ID NO: 435923 - protein, 9 aa, Influenza virus
CGVDSDTTG

SEQ ID NO: 435924 - protein, 9 aa, Influenza virus
CGVDSDTTS

SEQ ID NO: 435925 - protein, 9 aa, Influenza virus
CGVNSDTTG

SEQ ID NO: 435926 - protein, 9 aa, Influenza virus
CGVNSDTTS

SEQ ID NO: 435927 - protein, 9 aa, Influenza virus
CGVNSNTTG

SEQ ID NO: 435928 - protein, 9 aa, Influenza virus
CGVSGEVPG

SEQ ID NO: 435929 - protein, 9 aa, Influenza virus
CGVSSEVPE

SEQ ID NO: 435930 - protein, 9 aa, Influenza virus
CGVSSEVPG

SEQ ID NO: 435931 - protein, 9 aa, Influenza virus
CHDGASWLT

SEQ ID NO: 435932 - protein, 9 aa, Influenza virus
CHDGIARMT

SEQ ID NO: 435933 - protein, 9 aa, Influenza virus
CHDGIGRMT

SEQ ID NO: 435934 - protein, 9 aa, Influenza virus
CHDGISRMS

SEQ ID NO: 435935 - protein, 9 aa, Influenza virus
CHDGISWLT

SEQ ID NO: 435936 - protein, 9 aa, Influenza virus
CHDGKARMS

SEQ ID NO: 435937 - protein, 9 aa, Influenza virus
CHDGKAWLH

SEQ ID NO: 435938 - protein, 9 aa, Influenza virus
CHDGKEWLH

SEQ ID NO: 435939 - protein, 9 aa, Influenza virus
CHDGKFRMS

SEQ ID NO: 435940 - protein, 9 aa, Influenza virus
CHDGKKWMA

SEQ ID NO: 435941 - protein, 9 aa, Influenza virus
CHDGKKWMT

SEQ ID NO: 435942 - protein, 9 aa, Influenza virus
CHDGKSRMS

SEQ ID NO: 435943 - protein, 9 aa, Influenza virus
CHDGKSWLH

SEQ ID NO: 435944 - protein, 9 aa, Influenza virus
CHDGMSRMS

SEQ ID NO: 435945 - protein, 9 aa, Influenza virus
CHDGNAWLH

SEQ ID NO: 435946 - protein, 9 aa, Influenza virus
CHDGNKWMT

SEQ ID NO: 435947 - protein, 9 aa, Influenza virus
CHDGRARMS

SEQ ID NO: 435948 - protein, 9 aa, Influenza virus
CHDGRAWLH

SEQ ID NO: 435949 - protein, 9 aa, Influenza virus
CHDGRKWMT

SEQ ID NO: 435950 - protein, 9 aa, Influenza virus
CHDGRSRMS

SEQ ID NO: 435951 - protein, 9 aa, Influenza virus
CHDGSSWLT

SEQ ID NO: 435952 - protein, 9 aa, Influenza virus
CHDGTNWLT

SEQ ID NO: 435953 - protein, 9 aa, Influenza virus
CHDGTSWLT

SEQ ID NO: 435954 - protein, 9 aa, Influenza virus
CHDGVGRMT

SEQ ID NO: 435955 - protein, 9 aa, Influenza virus
CHDGVNRMT

SEQ ID NO: 435956 - protein, 9 aa, Influenza virus
CHDGVSRMS

SEQ ID NO: 435957 - protein, 9 aa, Influenza virus
CHDGVSRMT

SEQ ID NO: 435958 - protein, 9 aa, Influenza virus
CHIGVAPSP

SEQ ID NO: 435959 - protein, 9 aa, Influenza virus
CHITGFAPF

SEQ ID NO: 435960 - protein, 9 aa, Influenza virus
CHKGICPVV

SEQ ID NO: 435961 - protein, 9 aa, Influenza virus
CHKGVCPVV

SEQ ID NO: 435962 - protein, 9 aa, Influenza virus
CHNGICPVA

SEQ ID NO: 435963 - protein, 9 aa, Influenza virus
CHNGICPVV

SEQ ID NO: 435964 - protein, 9 aa, Influenza virus
CHNGTCAVV

SEQ ID NO: 435965 - protein, 9 aa, Influenza virus
CHNGTCPVV

SEQ ID NO: 435966 - protein, 9 aa, Influenza virus
CHNGTCVVI

SEQ ID NO: 435967 - protein, 9 aa, Influenza virus
CHNGTCVVV

SEQ ID NO: 435968 - protein, 9 aa, Influenza virus
CHNGVCPVV

SEQ ID NO: 435969 - protein, 9 aa, Influenza virus
CHPIGMIIG

SEQ ID NO: 435970 - protein, 9 aa, Influenza virus
CHPIGMLIG

SEQ ID NO: 435971 - protein, 9 aa, Influenza virus
CHPIGMVIG

SEQ ID NO: 435972 - protein, 9 aa, Influenza virus
CHPIGMVVG

SEQ ID NO: 435973 - protein, 9 aa, Influenza virus
CHPVGMLIG

SEQ ID NO: 435974 - protein, 9 aa, Influenza virus
CHQRSKFLL

SEQ ID NO: 435975 - protein, 9 aa, Influenza virus
CHSAAFEDL

SEQ ID NO: 435976 - protein, 9 aa, Influenza virus
CHSGICPVV

SEQ ID NO: 435977 - protein, 9 aa, Influenza virus
CHSGVCPVV

SEQ ID NO: 435978 - protein, 9 aa, Influenza virus
CHTKCQTYA

SEQ ID NO: 435979 - protein, 9 aa, Influenza virus
CHTKCQTYT

SEQ ID NO: 435980 - protein, 9 aa, Influenza virus
CIASSIVLV

SEQ ID NO: 435981 - protein, 9 aa, Influenza virus
CIASSIVMV

SEQ ID NO: 435982 - protein, 9 aa, Influenza virus
CIASSLILA

SEQ ID NO: 435983 - protein, 9 aa, Influenza virus
CIASSLVLA

SEQ ID NO: 435984 - protein, 9 aa, Influenza virus
CIASSTVLV

SEQ ID NO: 435985 - protein, 9 aa, Influenza virus
CIASSTVMV

SEQ ID NO: 435986 - protein, 9 aa, Influenza virus
CIASSVVLV

SEQ ID NO: 435987 - protein, 9 aa, Influenza virus
CIAWSSASC

SEQ ID NO: 435988 - protein, 9 aa, Influenza virus
CIAWSSSSC

SEQ ID NO: 435989 - protein, 9 aa, Influenza virus
CICEKLEQS

SEQ ID NO: 435990 - protein, 9 aa, Influenza virus
CICINGTCT

SEQ ID NO: 435991 - protein, 9 aa, Influenza virus
CICRDNWKG

SEQ ID NO: 435992 - protein, 9 aa, Influenza virus
CICRDNWQG

SEQ ID NO: 435993 - protein, 9 aa, Influenza virus
CICRDNWRG

SEQ ID NO: 435994 - protein, 9 aa, Influenza virus
CICRDNWTG

SEQ ID NO: 435995 - protein, 9 aa, Influenza virus
CIDFRDMRK

SEQ ID NO: 435996 - protein, 9 aa, Influenza virus
CIEGKLSQM

SEQ ID NO: 435997 - protein, 9 aa, Influenza virus
CIEKIRNGT

SEQ ID NO: 435998 - protein, 9 aa, Influenza virus
CIEKVRNGT

SEQ ID NO: 435999 - protein, 9 aa, Influenza virus
CIERVRNGT

SEQ ID NO: 436000 - protein, 9 aa, Influenza virus
CIESIRNGT

SEQ ID NO: 436001 - protein, 9 aa, Influenza virus
CIESKLSQM

SEQ ID NO: 436002 - protein, 9 aa, Influenza virus
CIESVRNGT

SEQ ID NO: 436003 - protein, 9 aa, Influenza virus
CIGHHANNS

SEQ ID NO: 436004 - protein, 9 aa, Influenza virus
CIGSIRNET

SEQ ID NO: 436005 - protein, 9 aa, Influenza virus
CIGSIRNGT

SEQ ID NO: 436006 - protein, 9 aa, Influenza virus
CIGWSSTSC

SEQ ID NO: 436007 - protein, 9 aa, Influenza virus
CIGYHANNS

SEQ ID NO: 436008 - protein, 9 aa, Influenza virus
CIGYHSNNS

SEQ ID NO: 436009 - protein, 9 aa, Influenza virus
CIGYLSNNA

SEQ ID NO: 436010 - protein, 9 aa, Influenza virus
CIGYLSNNS

SEQ ID NO: 436011 - protein, 9 aa, Influenza virus
CIGYLSTNS

SEQ ID NO: 436012 - protein, 9 aa, Influenza virus
CIGYMSNNS

SEQ ID NO: 436013 - protein, 9 aa, Influenza virus
CIGYQSNNS

SEQ ID NO: 436014 - protein, 9 aa, Influenza virus
CIGYQTNNS

SEQ ID NO: 436015 - protein, 9 aa, Influenza virus
CIINSWHIY

SEQ ID NO: 436016 - protein, 9 aa, Influenza virus
CIKNGNMQC

SEQ ID NO: 436017 - protein, 9 aa, Influenza virus
CIKNGNMRC

SEQ ID NO: 436018 - protein, 9 aa, Influenza virus
CIKPCFWVE

SEQ ID NO: 436019 - protein, 9 aa, Influenza virus
CIKTFFGWK

SEQ ID NO: 436020 - protein, 9 aa, Influenza virus
CILDQNFRN

SEQ ID NO: 436021 - protein, 9 aa, Influenza virus
CINGICTVV

SEQ ID NO: 436022 - protein, 9 aa, Influenza virus
CINGSCAVV

SEQ ID NO: 436023 - protein, 9 aa, Influenza virus
CINGSCIVV

SEQ ID NO: 436024 - protein, 9 aa, Influenza virus
CINGSCTVV

SEQ ID NO: 436025 - protein, 9 aa, Influenza virus
CINGTCAVV

SEQ ID NO: 436026 - protein, 9 aa, Influenza virus
CINGTCTVI

SEQ ID NO: 436027 - protein, 9 aa, Influenza virus
CINGTCTVV

SEQ ID NO: 436028 - protein, 9 aa, Influenza virus
CINRCFYVE

SEQ ID NO: 436029 - protein, 9 aa, Influenza virus
CIQGNNDNA

SEQ ID NO: 436030 - protein, 9 aa, Influenza virus
CIRPCFWVE

SEQ ID NO: 436031 - protein, 9 aa, Influenza virus
CIRTFFGWK

SEQ ID NO: 436032 - protein, 9 aa, Influenza virus
CISATGMAL

SEQ ID NO: 436033 - protein, 9 aa, Influenza virus
CISATGMIL

SEQ ID NO: 436034 - protein, 9 aa, Influenza virus
CISATGMTL

SEQ ID NO: 436035 - protein, 9 aa, Influenza virus
CISATGVTL

SEQ ID NO: 436036 - protein, 9 aa, Influenza virus
CISGPNNNA

SEQ ID NO: 436037 - protein, 9 aa, Influenza virus
CISGTCAVV

SEQ ID NO: 436038 - protein, 9 aa, Influenza virus
CISTTGMTL

SEQ ID NO: 436039 - protein, 9 aa, Influenza virus
CITGDDKNA

SEQ ID NO: 436040 - protein, 9 aa, Influenza virus
CITGDDRNA

SEQ ID NO: 436041 - protein, 9 aa, Influenza virus
CITPNGSIP

SEQ ID NO: 436042 - protein, 9 aa, Influenza virus
CITPNGSIS

SEQ ID NO: 436043 - protein, 9 aa, Influenza virus
CIVAVTDGP

SEQ ID NO: 436044 - protein, 9 aa, Influenza virus
CIVPCFWLE

SEQ ID NO: 436045 - protein, 9 aa, Influenza virus
CKAAIGLRI

SEQ ID NO: 436046 - protein, 9 aa, Influenza virus
CKAALGLRI

SEQ ID NO: 436047 - protein, 9 aa, Influenza virus
CKAAMGLKI

SEQ ID NO: 436048 - protein, 9 aa, Influenza virus
CKAAMGLRI

SEQ ID NO: 436049 - protein, 9 aa, Influenza virus
CKAAMGMRI

SEQ ID NO: 436050 - protein, 9 aa, Influenza virus
CKDPNNERG

SEQ ID NO: 436051 - protein, 9 aa, Influenza virus
CKIEAVIYG

SEQ ID NO: 436052 - protein, 9 aa, Influenza virus
CKIEGWVVV

SEQ ID NO: 436053 - protein, 9 aa, Influenza virus
CKITGFAPF

SEQ ID NO: 436054 - protein, 9 aa, Influenza virus
CKIVTTVGW

SEQ ID NO: 436055 - protein, 9 aa, Influenza virus
CKLLGINMS

SEQ ID NO: 436056 - protein, 9 aa, Influenza virus
CKLNGIPPL

SEQ ID NO: 436057 - protein, 9 aa, Influenza virus
CKLVGINMS

SEQ ID NO: 436058 - protein, 9 aa, Influenza virus
CKMYALHQG

SEQ ID NO: 436059 - protein, 9 aa, Influenza virus
CKPYIGKCP

SEQ ID NO: 436060 - protein, 9 aa, Influenza virus
CKRTVSSFY

SEQ ID NO: 436061 - protein, 9 aa, Influenza virus
CKSKCFWRG

SEQ ID NO: 436062 - protein, 9 aa, Influenza virus
CKTFFLTQG

SEQ ID NO: 436063 - protein, 9 aa, Influenza virus
CKTKCQTYA

SEQ ID NO: 436064 - protein, 9 aa, Influenza virus
CKVEAVIYG

SEQ ID NO: 436065 - protein, 9 aa, Influenza virus
CKVEGWVVV

SEQ ID NO: 436066 - protein, 9 aa, Influenza virus
CLAILIAGG

SEQ ID NO: 436067 - protein, 9 aa, Influenza virus
CLAILVAGG

SEQ ID NO: 436068 - protein, 9 aa, Influenza virus
CLAVLIAGG

SEQ ID NO: 436069 - protein, 9 aa, Influenza virus
CLGHHAIPN

SEQ ID NO: 436070 - protein, 9 aa, Influenza virus
CLGHHAVAN

SEQ ID NO: 436071 - protein, 9 aa, Influenza virus
CLGHHAVEN

SEQ ID NO: 436072 - protein, 9 aa, Influenza virus
CLGHHAVPN

SEQ ID NO: 436073 - protein, 9 aa, Influenza virus
CLGHHAVQN

SEQ ID NO: 436074 - protein, 9 aa, Influenza virus
CLGHHAVSN

SEQ ID NO: 436075 - protein, 9 aa, Influenza virus
CLGHHAVTN

SEQ ID NO: 436076 - protein, 9 aa, Influenza virus
CLINDPWVL

SEQ ID NO: 436077 - protein, 9 aa, Influenza virus
CLKIYHKCD

SEQ ID NO: 436078 - protein, 9 aa, Influenza virus
CLKNGNMRC

SEQ ID NO: 436079 - protein, 9 aa, Influenza virus
CLLQSLQQI

SEQ ID NO: 436080 - protein, 9 aa, Influenza virus
CLNGSMQCR

SEQ ID NO: 436081 - protein, 9 aa, Influenza virus
CLPACAYGP

SEQ ID NO: 436082 - protein, 9 aa, Influenza virus
CLPACIYGL

SEQ ID NO: 436083 - protein, 9 aa, Influenza virus
CLPACVYGL

SEQ ID NO: 436084 - protein, 9 aa, Influenza virus
CLPACVYGP

SEQ ID NO: 436085 - protein, 9 aa, Influenza virus
CLRGGRNSF

SEQ ID NO: 436086 - protein, 9 aa, Influenza virus
CLRNGNMRC

SEQ ID NO: 436087 - protein, 9 aa, Influenza virus
CLTDKGSIQ

SEQ ID NO: 436088 - protein, 9 aa, Influenza virus
CLVPCFWLE

SEQ ID NO: 436089 - protein, 9 aa, Influenza virus
CLVPCFWVE

SEQ ID NO: 436090 - protein, 9 aa, Influenza virus
CLYASPQLE

SEQ ID NO: 436091 - protein, 9 aa, Influenza virus
CMASIRNNS

SEQ ID NO: 436092 - protein, 9 aa, Influenza virus
CMASIRNNT

SEQ ID NO: 436093 - protein, 9 aa, Influenza virus
CMASIRNST

SEQ ID NO: 436094 - protein, 9 aa, Influenza virus
CMATIRNGT

SEQ ID NO: 436095 - protein, 9 aa, Influenza virus
CMAWSSSSC

SEQ ID NO: 436096 - protein, 9 aa, Influenza virus
CMDSVKNGT

SEQ ID NO: 436097 - protein, 9 aa, Influenza virus
CMDSVRNGT

SEQ ID NO: 436098 - protein, 9 aa, Influenza virus
CMDTIRNGT

SEQ ID NO: 436099 - protein, 9 aa, Influenza virus
CMEAIRNGT

SEQ ID NO: 436100 - protein, 9 aa, Influenza virus
CMERIRNNT

SEQ ID NO: 436101 - protein, 9 aa, Influenza virus
CMESIKNGT

SEQ ID NO: 436102 - protein, 9 aa, Influenza virus
CMESIRDNT

SEQ ID NO: 436103 - protein, 9 aa, Influenza virus
CMESIRNGT

SEQ ID NO: 436104 - protein, 9 aa, Influenza virus
CMESIRNNT

SEQ ID NO: 436105 - protein, 9 aa, Influenza virus
CMESVKNGT

SEQ ID NO: 436106 - protein, 9 aa, Influenza virus
CMESVRNGT

SEQ ID NO: 436107 - protein, 9 aa, Influenza virus
CMETIKNGT

SEQ ID NO: 436108 - protein, 9 aa, Influenza virus
CMETIRNGT

SEQ ID NO: 436109 - protein, 9 aa, Influenza virus
CMETTRNGT

SEQ ID NO: 436110 - protein, 9 aa, Influenza virus
CMGLIYNRM

SEQ ID NO: 436111 - protein, 9 aa, Influenza virus
CMGSIRNNT

SEQ ID NO: 436112 - protein, 9 aa, Influenza virus
CMGTIRNGT

SEQ ID NO: 436113 - protein, 9 aa, Influenza virus
CMIKAVRGD

SEQ ID NO: 436114 - protein, 9 aa, Influenza virus
CMKNGNMQC

SEQ ID NO: 436115 - protein, 9 aa, Influenza virus
CMKTFFGWK

SEQ ID NO: 436116 - protein, 9 aa, Influenza virus
CMKTFFGWR

SEQ ID NO: 436117 - protein, 9 aa, Influenza virus
CMMKAVRGD

SEQ ID NO: 436118 - protein, 9 aa, Influenza virus
CMNSVKNGT

SEQ ID NO: 436119 - protein, 9 aa, Influenza virus
CMNSVKTGT

SEQ ID NO: 436120 - protein, 9 aa, Influenza virus
CMNSVRNGT

SEQ ID NO: 436121 - protein, 9 aa, Influenza virus
CMRPCFWVE

SEQ ID NO: 436122 - protein, 9 aa, Influenza virus
CMRTFFGWK

SEQ ID NO: 436123 - protein, 9 aa, Influenza virus
CMSGPNDNA

SEQ ID NO: 436124 - protein, 9 aa, Influenza virus
CMSGPNNNA

SEQ ID NO: 436125 - protein, 9 aa, Influenza virus
CMSSVKNGT

SEQ ID NO: 436126 - protein, 9 aa, Influenza virus
CMTSIRNNT

SEQ ID NO: 436127 - protein, 9 aa, Influenza virus
CMVKAVRGD

SEQ ID NO: 436128 - protein, 9 aa, Influenza virus
CNALTGGQS

SEQ ID NO: 436129 - protein, 9 aa, Influenza virus
CNASTGAQS

SEQ ID NO: 436130 - protein, 9 aa, Influenza virus
CNASTGGQA

SEQ ID NO: 436131 - protein, 9 aa, Influenza virus
CNASTGGQS

SEQ ID NO: 436132 - protein, 9 aa, Influenza virus
CNDNCMESI

SEQ ID NO: 436133 - protein, 9 aa, Influenza virus
CNDPYPGNN

SEQ ID NO: 436134 - protein, 9 aa, Influenza virus
CNDSCMDTI

SEQ ID NO: 436135 - protein, 9 aa, Influenza virus
CNDSCMEAI

SEQ ID NO: 436136 - protein, 9 aa, Influenza virus
CNDSCMETI

SEQ ID NO: 436137 - protein, 9 aa, Influenza virus
CNEPYPGNN

SEQ ID NO: 436138 - protein, 9 aa, Influenza virus
CNFEGWIVG

SEQ ID NO: 436139 - protein, 9 aa, Influenza virus
CNILKGKFQ

SEQ ID NO: 436140 - protein, 9 aa, Influenza virus
CNLFEKFFP

SEQ ID NO: 436141 - protein, 9 aa, Influenza virus
CNNECMETI

SEQ ID NO: 436142 - protein, 9 aa, Influenza virus
CNNGSCRCT

SEQ ID NO: 436143 - protein, 9 aa, Influenza virus
CNNPITGSP

SEQ ID NO: 436144 - protein, 9 aa, Influenza virus
CNNSCMETI

SEQ ID NO: 436145 - protein, 9 aa, Influenza virus
CNNTCMETI

SEQ ID NO: 436146 - protein, 9 aa, Influenza virus
CNPLNPFVN

SEQ ID NO: 436147 - protein, 9 aa, Influenza virus
CNPLNPFVS

SEQ ID NO: 436148 - protein, 9 aa, Influenza virus
CNPLNPFVT

SEQ ID NO: 436149 - protein, 9 aa, Influenza virus
CNPMNPFVS

SEQ ID NO: 436150 - protein, 9 aa, Influenza virus
CNSAAFEDL

SEQ ID NO: 436151 - protein, 9 aa, Influenza virus
CNSGNCRFN

SEQ ID NO: 436152 - protein, 9 aa, Influenza virus
CNSNAITRS

SEQ ID NO: 436153 - protein, 9 aa, Influenza virus
CNTDLGAPL

SEQ ID NO: 436154 - protein, 9 aa, Influenza virus
CNTDLGSPL

SEQ ID NO: 436155 - protein, 9 aa, Influenza virus
CNTDLGTPL

SEQ ID NO: 436156 - protein, 9 aa, Influenza virus
CNTKCQTSL

SEQ ID NO: 436157 - protein, 9 aa, Influenza virus
CNTKCQTSM

SEQ ID NO: 436158 - protein, 9 aa, Influenza virus
CNTKCQTSV

SEQ ID NO: 436159 - protein, 9 aa, Influenza virus
CNTKCQTYA

SEQ ID NO: 436160 - protein, 9 aa, Influenza virus
CNTRCQTSV

SEQ ID NO: 436161 - protein, 9 aa, Influenza virus
CNVEGWVVI

SEQ ID NO: 436162 - protein, 9 aa, Influenza virus
CNVEGWVVV

SEQ ID NO: 436163 - protein, 9 aa, Influenza virus
CPFKGFFPF

SEQ ID NO: 436164 - protein, 9 aa, Influenza virus
CPFQGFFPF

SEQ ID NO: 436165 - protein, 9 aa, Influenza virus
CPFRGFFPF

SEQ ID NO: 436166 - protein, 9 aa, Influenza virus
CPIGEAPSP

SEQ ID NO: 436167 - protein, 9 aa, Influenza virus
CPIGEVPSP

SEQ ID NO: 436168 - protein, 9 aa, Influenza virus
CPIGVAPSP

SEQ ID NO: 436169 - protein, 9 aa, Influenza virus
CPIKGWAPL

SEQ ID NO: 436170 - protein, 9 aa, Influenza virus
CPIRGWAPL

SEQ ID NO: 436171 - protein, 9 aa, Influenza virus
CPKYIKQGS

SEQ ID NO: 436172 - protein, 9 aa, Influenza virus
CPKYIKSDQ

SEQ ID NO: 436173 - protein, 9 aa, Influenza virus
CPKYIKSGQ

SEQ ID NO: 436174 - protein, 9 aa, Influenza virus
CPKYIPSGS

SEQ ID NO: 436175 - protein, 9 aa, Influenza virus
CPKYIPSNS

SEQ ID NO: 436176 - protein, 9 aa, Influenza virus
CPKYIPSRS

SEQ ID NO: 436177 - protein, 9 aa, Influenza virus
CPKYISSGS

SEQ ID NO: 436178 - protein, 9 aa, Influenza virus
CPKYMNVKS

SEQ ID NO: 436179 - protein, 9 aa, Influenza virus
CPKYVKQES

SEQ ID NO: 436180 - protein, 9 aa, Influenza virus
CPKYVKQGS

SEQ ID NO: 436181 - protein, 9 aa, Influenza virus
CPKYVKSDR

SEQ ID NO: 436182 - protein, 9 aa, Influenza virus
CPKYVKSEK

SEQ ID NO: 436183 - protein, 9 aa, Influenza virus
CPKYVKSER

SEQ ID NO: 436184 - protein, 9 aa, Influenza virus
CPKYVKSKR

SEQ ID NO: 436185 - protein, 9 aa, Influenza virus
CPKYVNIKS

SEQ ID NO: 436186 - protein, 9 aa, Influenza virus
CPKYVNVKS

SEQ ID NO: 436187 - protein, 9 aa, Influenza virus
CPKYVNVRS

SEQ ID NO: 436188 - protein, 9 aa, Influenza virus
CPKYVRSEK

SEQ ID NO: 436189 - protein, 9 aa, Influenza virus
CPLGEAPSP

SEQ ID NO: 436190 - protein, 9 aa, Influenza virus
CPMGVAPSP

SEQ ID NO: 436191 - protein, 9 aa, Influenza virus
CPNGSLQCT

SEQ ID NO: 436192 - protein, 9 aa, Influenza virus
CPRYIKQKS

SEQ ID NO: 436193 - protein, 9 aa, Influenza virus
CPRYIPSGS

SEQ ID NO: 436194 - protein, 9 aa, Influenza virus
CPRYVKQES

SEQ ID NO: 436195 - protein, 9 aa, Influenza virus
CPRYVKQGS

SEQ ID NO: 436196 - protein, 9 aa, Influenza virus
CPRYVKQKS

SEQ ID NO: 436197 - protein, 9 aa, Influenza virus
CPRYVKQSS

SEQ ID NO: 436198 - protein, 9 aa, Influenza virus
CPRYVKQTS

SEQ ID NO: 436199 - protein, 9 aa, Influenza virus
CPSPLKLID

SEQ ID NO: 436200 - protein, 9 aa, Influenza virus
CPSPLKLVD

SEQ ID NO: 436201 - protein, 9 aa, Influenza virus
CPSPLRLID

SEQ ID NO: 436202 - protein, 9 aa, Influenza virus
CPSPLRLVD

SEQ ID NO: 436203 - protein, 9 aa, Influenza virus
CPVGEAPSP

SEQ ID NO: 436204 - protein, 9 aa, Influenza virus
CPVGVAPSP

SEQ ID NO: 436205 - protein, 9 aa, Influenza virus
CPVKGWAPL

SEQ ID NO: 436206 - protein, 9 aa, Influenza virus
CPVVFTDGS

SEQ ID NO: 436207 - protein, 9 aa, Influenza virus
CPVVMTDGP

SEQ ID NO: 436208 - protein, 9 aa, Influenza virus
CQDEFCYTL

SEQ ID NO: 436209 - protein, 9 aa, Influenza virus
CQIAGFAPF

SEQ ID NO: 436210 - protein, 9 aa, Influenza virus
CQITGFAPF

SEQ ID NO: 436211 - protein, 9 aa, Influenza virus
CQKGNIKCN

SEQ ID NO: 436212 - protein, 9 aa, Influenza virus
CQKGNIRCD

SEQ ID NO: 436213 - protein, 9 aa, Influenza virus
CQKGNIRCN

SEQ ID NO: 436214 - protein, 9 aa, Influenza virus
CQLNEGIMN

SEQ ID NO: 436215 - protein, 9 aa, Influenza virus
CQLNEGVIN

SEQ ID NO: 436216 - protein, 9 aa, Influenza virus
CQLNEGVMN

SEQ ID NO: 436217 - protein, 9 aa, Influenza virus
CQMEKIVLL

SEQ ID NO: 436218 - protein, 9 aa, Influenza virus
CQNGNIRCQ

SEQ ID NO: 436219 - protein, 9 aa, Influenza virus
CQNGNIRCT

SEQ ID NO: 436220 - protein, 9 aa, Influenza virus
CQNGNLRCQ

SEQ ID NO: 436221 - protein, 9 aa, Influenza virus
CQNGNVRCQ

SEQ ID NO: 436222 - protein, 9 aa, Influenza virus
CQNGNVRCT

SEQ ID NO: 436223 - protein, 9 aa, Influenza virus
CQRGNIRCN

SEQ ID NO: 436224 - protein, 9 aa, Influenza virus
CQSEIGGIN

SEQ ID NO: 436225 - protein, 9 aa, Influenza virus
CQSEIGGIS

SEQ ID NO: 436226 - protein, 9 aa, Influenza virus
CQSEIGWIN

SEQ ID NO: 436227 - protein, 9 aa, Influenza virus
CQSPLGAIN

SEQ ID NO: 436228 - protein, 9 aa, Influenza virus
CQTEIGGIN

SEQ ID NO: 436229 - protein, 9 aa, Influenza virus
CQTEVGGIN

SEQ ID NO: 436230 - protein, 9 aa, Influenza virus
CQTGNIRCQ

SEQ ID NO: 436231 - protein, 9 aa, Influenza virus
CQTPIGAIN

SEQ ID NO: 436232 - protein, 9 aa, Influenza virus
CQTPLGAIN

SEQ ID NO: 436233 - protein, 9 aa, Influenza virus
CQTPLGALN

SEQ ID NO: 436234 - protein, 9 aa, Influenza virus
CQTPMGAIN

SEQ ID NO: 436235 - protein, 9 aa, Influenza virus
CQTPMGAVN

SEQ ID NO: 436236 - protein, 9 aa, Influenza virus
CQTPVGAIN

SEQ ID NO: 436237 - protein, 9 aa, Influenza virus
CQTSVGGID

SEQ ID NO: 436238 - protein, 9 aa, Influenza virus
CQTSVGGIN

SEQ ID NO: 436239 - protein, 9 aa, Influenza virus
CQTYAGAIN

SEQ ID NO: 436240 - protein, 9 aa, Influenza virus
CQTYAGAVN

SEQ ID NO: 436241 - protein, 9 aa, Influenza virus
CQTYTGAIN

SEQ ID NO: 436242 - protein, 9 aa, Influenza virus
CQVTGFAPF

SEQ ID NO: 436243 - protein, 9 aa, Influenza virus
CRATEYIMK

SEQ ID NO: 436244 - protein, 9 aa, Influenza virus
CRATEYMMK

SEQ ID NO: 436245 - protein, 9 aa, Influenza virus
CRDNWHASN

SEQ ID NO: 436246 - protein, 9 aa, Influenza virus
CRDNWHGSN

SEQ ID NO: 436247 - protein, 9 aa, Influenza virus
CRDNWKGAN

SEQ ID NO: 436248 - protein, 9 aa, Influenza virus
CRDNWKGSN

SEQ ID NO: 436249 - protein, 9 aa, Influenza virus
CRDNWMGSN

SEQ ID NO: 436250 - protein, 9 aa, Influenza virus
CRDNWNGMN

SEQ ID NO: 436251 - protein, 9 aa, Influenza virus
CRDNWQGAN

SEQ ID NO: 436252 - protein, 9 aa, Influenza virus
CRDNWQGSN

SEQ ID NO: 436253 - protein, 9 aa, Influenza virus
CRDNWRGAN

SEQ ID NO: 436254 - protein, 9 aa, Influenza virus
CRDNWRGSN

SEQ ID NO: 436255 - protein, 9 aa, Influenza virus
CRDNWTGTN

SEQ ID NO: 436256 - protein, 9 aa, Influenza virus
CRDPNNERG

SEQ ID NO: 436257 - protein, 9 aa, Influenza virus
CRETRGLFG

SEQ ID NO: 436258 - protein, 9 aa, Influenza virus
CRFEGWIVG

SEQ ID NO: 436259 - protein, 9 aa, Influenza virus
CRFYALSQG

SEQ ID NO: 436260 - protein, 9 aa, Influenza virus
CRICIDFRD

SEQ ID NO: 436261 - protein, 9 aa, Influenza virus
CRICILDQN

SEQ ID NO: 436262 - protein, 9 aa, Influenza virus
CRICIRADG

SEQ ID NO: 436263 - protein, 9 aa, Influenza virus
CRIIQNEDI

SEQ ID NO: 436264 - protein, 9 aa, Influenza virus
CRKTRGLFG

SEQ ID NO: 436265 - protein, 9 aa, Influenza virus
CRLRGIPPL

SEQ ID NO: 436266 - protein, 9 aa, Influenza virus
CRLSGIPPL

SEQ ID NO: 436267 - protein, 9 aa, Influenza virus
CRMFALSQG

SEQ ID NO: 436268 - protein, 9 aa, Influenza virus
CRMYALHQG

SEQ ID NO: 436269 - protein, 9 aa, Influenza virus
CRNPNNEKG

SEQ ID NO: 436270 - protein, 9 aa, Influenza virus
CRNPNNERG

SEQ ID NO: 436271 - protein, 9 aa, Influenza virus
CRTFFLTHG

SEQ ID NO: 436272 - protein, 9 aa, Influenza virus
CRTFFLTQG

SEQ ID NO: 436273 - protein, 9 aa, Influenza virus
CRTKEGRRK

SEQ ID NO: 436274 - protein, 9 aa, Influenza virus
CRTKEGRRR

SEQ ID NO: 436275 - protein, 9 aa, Influenza virus
CRTLLAKSV

SEQ ID NO: 436276 - protein, 9 aa, Influenza virus
CRTREGRRK

SEQ ID NO: 436277 - protein, 9 aa, Influenza virus
CSALFVYSL

SEQ ID NO: 436278 - protein, 9 aa, Influenza virus
CSASTGGQS

SEQ ID NO: 436279 - protein, 9 aa, Influenza virus
CSCYGHDSK

SEQ ID NO: 436280 - protein, 9 aa, Influenza virus
CSCYGHNQK

SEQ ID NO: 436281 - protein, 9 aa, Influenza virus
CSCYGHNSK

SEQ ID NO: 436282 - protein, 9 aa, Influenza virus
CSCYGHSQK

SEQ ID NO: 436283 - protein, 9 aa, Influenza virus
CSCYMDIDV

SEQ ID NO: 436284 - protein, 9 aa, Influenza virus
CSCYPDAGE

SEQ ID NO: 436285 - protein, 9 aa, Influenza virus
CSCYPDAGK

SEQ ID NO: 436286 - protein, 9 aa, Influenza virus
CSCYPDASE

SEQ ID NO: 436287 - protein, 9 aa, Influenza virus
CSCYPDSGE

SEQ ID NO: 436288 - protein, 9 aa, Influenza virus
CSCYPNAGE

SEQ ID NO: 436289 - protein, 9 aa, Influenza virus
CSCYPNDGK

SEQ ID NO: 436290 - protein, 9 aa, Influenza virus
CSCYPNEGK

SEQ ID NO: 436291 - protein, 9 aa, Influenza virus
CSCYPNLCQ

SEQ ID NO: 436292 - protein, 9 aa, Influenza virus
CSCYPNLGK

SEQ ID NO: 436293 - protein, 9 aa, Influenza virus
CSCYPNLGQ

SEQ ID NO: 436294 - protein, 9 aa, Influenza virus
CSCYPNMGK

SEQ ID NO: 436295 - protein, 9 aa, Influenza virus
CSCYPNSGK

SEQ ID NO: 436296 - protein, 9 aa, Influenza virus
CSCYPQYPN

SEQ ID NO: 436297 - protein, 9 aa, Influenza virus
CSCYPRFPG

SEQ ID NO: 436298 - protein, 9 aa, Influenza virus
CSCYPRYPD

SEQ ID NO: 436299 - protein, 9 aa, Influenza virus
CSCYPRYPG

SEQ ID NO: 436300 - protein, 9 aa, Influenza virus
CSCYPRYPN

SEQ ID NO: 436301 - protein, 9 aa, Influenza virus
CSCYPRYSG

SEQ ID NO: 436302 - protein, 9 aa, Influenza virus
CSCYPSGED

SEQ ID NO: 436303 - protein, 9 aa, Influenza virus
CSCYPSGEN

SEQ ID NO: 436304 - protein, 9 aa, Influenza virus
CSCYPSGES

SEQ ID NO: 436305 - protein, 9 aa, Influenza virus
CSCYPSGTD

SEQ ID NO: 436306 - protein, 9 aa, Influenza virus
CSCYSRYPN

SEQ ID NO: 436307 - protein, 9 aa, Influenza virus
CSCYVDIDI

SEQ ID NO: 436308 - protein, 9 aa, Influenza virus
CSCYVDIDV

SEQ ID NO: 436309 - protein, 9 aa, Influenza virus
CSCYVDTDV

SEQ ID NO: 436310 - protein, 9 aa, Influenza virus
CSCYVDVDV

SEQ ID NO: 436311 - protein, 9 aa, Influenza virus
CSDGPGWLT

SEQ ID NO: 436312 - protein, 9 aa, Influenza virus
CSDGSGWLT

SEQ ID NO: 436313 - protein, 9 aa, Influenza virus
CSFAGWILG

SEQ ID NO: 436314 - protein, 9 aa, Influenza virus
CSFAGWLLG

SEQ ID NO: 436315 - protein, 9 aa, Influenza virus
CSFEGWIGG

SEQ ID NO: 436316 - protein, 9 aa, Influenza virus
CSFEGWIVG

SEQ ID NO: 436317 - protein, 9 aa, Influenza virus
CSGFFGDNP

SEQ ID NO: 436318 - protein, 9 aa, Influenza virus
CSGHSCRIC

SEQ ID NO: 436319 - protein, 9 aa, Influenza virus
CSGIFGDNP

SEQ ID NO: 436320 - protein, 9 aa, Influenza virus
CSGLVGDTP

SEQ ID NO: 436321 - protein, 9 aa, Influenza virus
CSGVFGDNP

SEQ ID NO: 436322 - protein, 9 aa, Influenza virus
CSGVFGDSP

SEQ ID NO: 436323 - protein, 9 aa, Influenza virus
CSGVFGDTP

SEQ ID NO: 436324 - protein, 9 aa, Influenza virus
CSGVLGDNP

SEQ ID NO: 436325 - protein, 9 aa, Influenza virus
CSHLECRTF

SEQ ID NO: 436326 - protein, 9 aa, Influenza virus
CSHMECRTF

SEQ ID NO: 436327 - protein, 9 aa, Influenza virus
CSHSECRTF

SEQ ID NO: 436328 - protein, 9 aa, Influenza virus
CSIAGWLLG

SEQ ID NO: 436329 - protein, 9 aa, Influenza virus
CSIDECRTF

SEQ ID NO: 436330 - protein, 9 aa, Influenza virus
CSIDGKAPI

SEQ ID NO: 436331 - protein, 9 aa, Influenza virus
CSIHECRTF

SEQ ID NO: 436332 - protein, 9 aa, Influenza virus
CSINECRTF

SEQ ID NO: 436333 - protein, 9 aa, Influenza virus
CSINGKAPI

SEQ ID NO: 436334 - protein, 9 aa, Influenza virus
CSINGKEPI

SEQ ID NO: 436335 - protein, 9 aa, Influenza virus
CSINGKQPI

SEQ ID NO: 436336 - protein, 9 aa, Influenza virus
CSINGRAPI

SEQ ID NO: 436337 - protein, 9 aa, Influenza virus
CSISECRTF

SEQ ID NO: 436338 - protein, 9 aa, Influenza virus
CSIWFSHYN

SEQ ID NO: 436339 - protein, 9 aa, Influenza virus
CSKFHSDTP

SEQ ID NO: 436340 - protein, 9 aa, Influenza virus
CSKILTDTS

SEQ ID NO: 436341 - protein, 9 aa, Influenza virus
CSKTLTDTS

SEQ ID NO: 436342 - protein, 9 aa, Influenza virus
CSKVLTDTS

SEQ ID NO: 436343 - protein, 9 aa, Influenza virus
CSKYHWNLA

SEQ ID NO: 436344 - protein, 9 aa, Influenza virus
CSLEGIILG

SEQ ID NO: 436345 - protein, 9 aa, Influenza virus
CSLEGLILG

SEQ ID NO: 436346 - protein, 9 aa, Influenza virus
CSLEGLILS

SEQ ID NO: 436347 - protein, 9 aa, Influenza virus
CSLEGLVLG

SEQ ID NO: 436348 - protein, 9 aa, Influenza virus
CSLFEKFFP

SEQ ID NO: 436349 - protein, 9 aa, Influenza virus
CSLKGLILG

SEQ ID NO: 436350 - protein, 9 aa, Influenza virus
CSLMQGSTL

SEQ ID NO: 436351 - protein, 9 aa, Influenza virus
CSLNGISPI

SEQ ID NO: 436352 - protein, 9 aa, Influenza virus
CSLNGISPV

SEQ ID NO: 436353 - protein, 9 aa, Influenza virus
CSLNGVSPI

SEQ ID NO: 436354 - protein, 9 aa, Influenza virus
CSLNGVSPV

SEQ ID NO: 436355 - protein, 9 aa, Influenza virus
CSNDTINYY

SEQ ID NO: 436356 - protein, 9 aa, Influenza virus
CSNGNCRFH

SEQ ID NO: 436357 - protein, 9 aa, Influenza virus
CSNGNCRFN

SEQ ID NO: 436358 - protein, 9 aa, Influenza virus
CSNGSCRCT

SEQ ID NO: 436359 - protein, 9 aa, Influenza virus
CSNGSCRFN

SEQ ID NO: 436360 - protein, 9 aa, Influenza virus
CSNGSLHGR

SEQ ID NO: 436361 - protein, 9 aa, Influenza virus
CSNGSLQCK

SEQ ID NO: 436362 - protein, 9 aa, Influenza virus
CSNGSLQCR

SEQ ID NO: 436363 - protein, 9 aa, Influenza virus
CSNGSLQFR

SEQ ID NO: 436364 - protein, 9 aa, Influenza virus
CSNGSLRCR

SEQ ID NO: 436365 - protein, 9 aa, Influenza virus
CSNGSMQCK

SEQ ID NO: 436366 - protein, 9 aa, Influenza virus
CSNGSMQCN

SEQ ID NO: 436367 - protein, 9 aa, Influenza virus
CSNGSMQCR

SEQ ID NO: 436368 - protein, 9 aa, Influenza virus
CSNNTTNYY

SEQ ID NO: 436369 - protein, 9 aa, Influenza virus
CSNPITGSP

SEQ ID NO: 436370 - protein, 9 aa, Influenza virus
CSNSSMQCR

SEQ ID NO: 436371 - protein, 9 aa, Influenza virus
CSPLSRCRE

SEQ ID NO: 436372 - protein, 9 aa, Influenza virus
CSPLSRCRK

SEQ ID NO: 436373 - protein, 9 aa, Influenza virus
CSPSECRTF

SEQ ID NO: 436374 - protein, 9 aa, Influenza virus
CSPVLTDNP

SEQ ID NO: 436375 - protein, 9 aa, Influenza virus
CSQNILRTQ

SEQ ID NO: 436376 - protein, 9 aa, Influenza virus
CSQRSKFLL

SEQ ID NO: 436377 - protein, 9 aa, Influenza virus
CSRILTDTS

SEQ ID NO: 436378 - protein, 9 aa, Influenza virus
CSRVLTDTS

SEQ ID NO: 436379 - protein, 9 aa, Influenza virus
CSSGNCRFN

SEQ ID NO: 436380 - protein, 9 aa, Influenza virus
CSSGNCRFS

SEQ ID NO: 436381 - protein, 9 aa, Influenza virus
CSSPLRLVD

SEQ ID NO: 436382 - protein, 9 aa, Influenza virus
CSSPSGIEG

SEQ ID NO: 436383 - protein, 9 aa, Influenza virus
CSSTEFLGQ

SEQ ID NO: 436384 - protein, 9 aa, Influenza virus
CSVAGWLLG

SEQ ID NO: 436385 - protein, 9 aa, Influenza virus
CSVEGWVVI

SEQ ID NO: 436386 - protein, 9 aa, Influenza virus
CSVEYASKT

SEQ ID NO: 436387 - protein, 9 aa, Influenza virus
CSVSECRTF

SEQ ID NO: 436388 - protein, 9 aa, Influenza virus
CSYLECRTF

SEQ ID NO: 436389 - protein, 9 aa, Influenza virus
CTCRDNWKG

SEQ ID NO: 436390 - protein, 9 aa, Influenza virus
CTCRDNWQG

SEQ ID NO: 436391 - protein, 9 aa, Influenza virus
CTGCFEIFH

SEQ ID NO: 436392 - protein, 9 aa, Influenza virus
CTGILTDTS

SEQ ID NO: 436393 - protein, 9 aa, Influenza virus
CTGNLIAPR

SEQ ID NO: 436394 - protein, 9 aa, Influenza virus
CTGVLTDTS

SEQ ID NO: 436395 - protein, 9 aa, Influenza virus
CTHLEICFM

SEQ ID NO: 436396 - protein, 9 aa, Influenza virus
CTHLEVCFM

SEQ ID NO: 436397 - protein, 9 aa, Influenza virus
CTHMEVCFM

SEQ ID NO: 436398 - protein, 9 aa, Influenza virus
CTINSWHIF

SEQ ID NO: 436399 - protein, 9 aa, Influenza virus
CTINSWHIY

SEQ ID NO: 436400 - protein, 9 aa, Influenza virus
CTIPCFWVE

SEQ ID NO: 436401 - protein, 9 aa, Influenza virus
CTISLVKTT

SEQ ID NO: 436402 - protein, 9 aa, Influenza virus
CTKGKKAVD

SEQ ID NO: 436403 - protein, 9 aa, Influenza virus
CTLFEKFFP

SEQ ID NO: 436404 - protein, 9 aa, Influenza virus
CTLIDALLG

SEQ ID NO: 436405 - protein, 9 aa, Influenza virus
CTLIDAMLG

SEQ ID NO: 436406 - protein, 9 aa, Influenza virus
CTLMDALLG

SEQ ID NO: 436407 - protein, 9 aa, Influenza virus
CTLVDALLG

SEQ ID NO: 436408 - protein, 9 aa, Influenza virus
CTSPCLTDK

SEQ ID NO: 436409 - protein, 9 aa, Influenza virus
CTVIMTDGS

SEQ ID NO: 436410 - protein, 9 aa, Influenza virus
CTVPCFWVE

SEQ ID NO: 436411 - protein, 9 aa, Influenza virus
CTVVMTDGN

SEQ ID NO: 436412 - protein, 9 aa, Influenza virus
CTVVMTDGS

SEQ ID NO: 436413 - protein, 9 aa, Influenza virus
CVAWSSSSC

SEQ ID NO: 436414 - protein, 9 aa, Influenza virus
CVAWSSTSC

SEQ ID NO: 436415 - protein, 9 aa, Influenza virus
CVCHKGICP

SEQ ID NO: 436416 - protein, 9 aa, Influenza virus
CVCHKGVCP

SEQ ID NO: 436417 - protein, 9 aa, Influenza virus
CVCHNGICP

SEQ ID NO: 436418 - protein, 9 aa, Influenza virus
CVCHNGTCA

SEQ ID NO: 436419 - protein, 9 aa, Influenza virus
CVCHNGTCV

SEQ ID NO: 436420 - protein, 9 aa, Influenza virus
CVCHNGVCP

SEQ ID NO: 436421 - protein, 9 aa, Influenza virus
CVCHNSTCV

SEQ ID NO: 436422 - protein, 9 aa, Influenza virus
CVCHSGICP

SEQ ID NO: 436423 - protein, 9 aa, Influenza virus
CVCHSGVCP

SEQ ID NO: 436424 - protein, 9 aa, Influenza virus
CVCINGICT

SEQ ID NO: 436425 - protein, 9 aa, Influenza virus
CVCINGSCA

SEQ ID NO: 436426 - protein, 9 aa, Influenza virus
CVCINGSCI

SEQ ID NO: 436427 - protein, 9 aa, Influenza virus
CVCINGSCT

SEQ ID NO: 436428 - protein, 9 aa, Influenza virus
CVCINGTCA

SEQ ID NO: 436429 - protein, 9 aa, Influenza virus
CVCINGTCT

SEQ ID NO: 436430 - protein, 9 aa, Influenza virus
CVCISGTCA

SEQ ID NO: 436431 - protein, 9 aa, Influenza virus
CVCQDEFCY

SEQ ID NO: 436432 - protein, 9 aa, Influenza virus
CVCRDNWHA

SEQ ID NO: 436433 - protein, 9 aa, Influenza virus
CVCRDNWHG

SEQ ID NO: 436434 - protein, 9 aa, Influenza virus
CVCRDNWKG

SEQ ID NO: 436435 - protein, 9 aa, Influenza virus
CVCRDNWMG

SEQ ID NO: 436436 - protein, 9 aa, Influenza virus
CVCRDNWNG

SEQ ID NO: 436437 - protein, 9 aa, Influenza virus
CVCRDNWQG

SEQ ID NO: 436438 - protein, 9 aa, Influenza virus
CVCRDNWRG

SEQ ID NO: 436439 - protein, 9 aa, Influenza virus
CVCRDNWTG

SEQ ID NO: 436440 - protein, 9 aa, Influenza virus
CVCWDNWRG

SEQ ID NO: 436441 - protein, 9 aa, Influenza virus
CVGWSSTSC

SEQ ID NO: 436442 - protein, 9 aa, Influenza virus
CVGWSSTTC

SEQ ID NO: 436443 - protein, 9 aa, Influenza virus
CVGYHANNS

SEQ ID NO: 436444 - protein, 9 aa, Influenza virus
CVGYHSNNS

SEQ ID NO: 436445 - protein, 9 aa, Influenza virus
CVGYLSTNS

SEQ ID NO: 436446 - protein, 9 aa, Influenza virus
CVILLNPFV

SEQ ID NO: 436447 - protein, 9 aa, Influenza virus
CVKNGNLRC

SEQ ID NO: 436448 - protein, 9 aa, Influenza virus
CVKNGNMQC

SEQ ID NO: 436449 - protein, 9 aa, Influenza virus
CVKNGNMRC

SEQ ID NO: 436450 - protein, 9 aa, Influenza virus
CVKNGNMRG

SEQ ID NO: 436451 - protein, 9 aa, Influenza virus
CVLEAMAFL

SEQ ID NO: 436452 - protein, 9 aa, Influenza virus
CVMLLAIAM

SEQ ID NO: 436453 - protein, 9 aa, Influenza virus
CVNRCFYVE

SEQ ID NO: 436454 - protein, 9 aa, Influenza virus
CVQGNNDNA

SEQ ID NO: 436455 - protein, 9 aa, Influenza virus
CVQGNNKNA

SEQ ID NO: 436456 - protein, 9 aa, Influenza virus
CVQGNNNNA

SEQ ID NO: 436457 - protein, 9 aa, Influenza virus
CVRHNGTCA

SEQ ID NO: 436458 - protein, 9 aa, Influenza virus
CVSGPNNNA

SEQ ID NO: 436459 - protein, 9 aa, Influenza virus
CVSHNGTWA

SEQ ID NO: 436460 - protein, 9 aa, Influenza virus
CVSLLQSAI

SEQ ID NO: 436461 - protein, 9 aa, Influenza virus
CVTGDDKNA

SEQ ID NO: 436462 - protein, 9 aa, Influenza virus
CVTGDDRNA

SEQ ID NO: 436463 - protein, 9 aa, Influenza virus
CVTGYEKNA

SEQ ID NO: 436464 - protein, 9 aa, Influenza virus
CVVAVTDGP

SEQ ID NO: 436465 - protein, 9 aa, Influenza virus
CVVIMTDGP

SEQ ID NO: 436466 - protein, 9 aa, Influenza virus
CVVIMTDGS

SEQ ID NO: 436467 - protein, 9 aa, Influenza virus
CVVTVTDGP

SEQ ID NO: 436468 - protein, 9 aa, Influenza virus
CVVVMTDGS

SEQ ID NO: 436469 - protein, 9 aa, Influenza virus
CVYRDNWKG

SEQ ID NO: 436470 - protein, 9 aa, Influenza virus
CWEQLYTPG

SEQ ID NO: 436471 - protein, 9 aa, Influenza virus
CWEQMYTPG

SEQ ID NO: 436472 - protein, 9 aa, Influenza virus
CWSFALAQG

SEQ ID NO: 436473 - protein, 9 aa, Influenza virus
CYDGKAWLH

SEQ ID NO: 436474 - protein, 9 aa, Influenza virus
CYGHDSKVT

SEQ ID NO: 436475 - protein, 9 aa, Influenza virus
CYGHNQKIT

SEQ ID NO: 436476 - protein, 9 aa, Influenza virus
CYGHNQKVT

SEQ ID NO: 436477 - protein, 9 aa, Influenza virus
CYGHNSKVT

SEQ ID NO: 436478 - protein, 9 aa, Influenza virus
CYGHSQKVT

SEQ ID NO: 436479 - protein, 9 aa, Influenza virus
CYMDIDVYC

SEQ ID NO: 436480 - protein, 9 aa, Influenza virus
CYNPCFYVE

SEQ ID NO: 436481 - protein, 9 aa, Influenza virus
CYPFDVPDY

SEQ ID NO: 436482 - protein, 9 aa, Influenza virus
CYPFDVPEY

SEQ ID NO: 436483 - protein, 9 aa, Influenza virus
CYPFDVPGY

SEQ ID NO: 436484 - protein, 9 aa, Influenza virus
CYPFDVPNY

SEQ ID NO: 436485 - protein, 9 aa, Influenza virus
CYPGATINE

SEQ ID NO: 436486 - protein, 9 aa, Influenza virus
CYPGATVNE

SEQ ID NO: 436487 - protein, 9 aa, Influenza virus
CYPGELDNN

SEQ ID NO: 436488 - protein, 9 aa, Influenza virus
CYPGELNNN

SEQ ID NO: 436489 - protein, 9 aa, Influenza virus
CYPGEVDNN

SEQ ID NO: 436490 - protein, 9 aa, Influenza virus
CYPGFVENL

SEQ ID NO: 436491 - protein, 9 aa, Influenza virus
CYPGGFTNE

SEQ ID NO: 436492 - protein, 9 aa, Influenza virus
CYPGKFTNE

SEQ ID NO: 436493 - protein, 9 aa, Influenza virus
CYPGKFVNE

SEQ ID NO: 436494 - protein, 9 aa, Influenza virus
CYPGKFVNG

SEQ ID NO: 436495 - protein, 9 aa, Influenza virus
CYPGNFNDY

SEQ ID NO: 436496 - protein, 9 aa, Influenza virus
CYPGRFTNE

SEQ ID NO: 436497 - protein, 9 aa, Influenza virus
CYPGSFNDY

SEQ ID NO: 436498 - protein, 9 aa, Influenza virus
CYPGSFNNY

SEQ ID NO: 436499 - protein, 9 aa, Influenza virus
CYPGSIENL

SEQ ID NO: 436500 - protein, 9 aa, Influenza virus
CYPGSIENQ

SEQ ID NO: 436501 - protein, 9 aa, Influenza virus
CYPGSIKNQ

SEQ ID NO: 436502 - protein, 9 aa, Influenza virus
CYPGSLNDY

SEQ ID NO: 436503 - protein, 9 aa, Influenza virus
CYPGSTVNE

SEQ ID NO: 436504 - protein, 9 aa, Influenza virus
CYPGSVENL

SEQ ID NO: 436505 - protein, 9 aa, Influenza virus
CYPGSVENQ

SEQ ID NO: 436506 - protein, 9 aa, Influenza virus
CYPGTTVNE

SEQ ID NO: 436507 - protein, 9 aa, Influenza virus
CYPNDGKVE

SEQ ID NO: 436508 - protein, 9 aa, Influenza virus
CYPNEGKVE

SEQ ID NO: 436509 - protein, 9 aa, Influenza virus
CYPNLCQVE

SEQ ID NO: 436510 - protein, 9 aa, Influenza virus
CYPNLGKVE

SEQ ID NO: 436511 - protein, 9 aa, Influenza virus
CYPNLGQVE

SEQ ID NO: 436512 - protein, 9 aa, Influenza virus
CYPNMGKVE

SEQ ID NO: 436513 - protein, 9 aa, Influenza virus
CYPNNGKVE

SEQ ID NO: 436514 - protein, 9 aa, Influenza virus
CYPNSGKVE

SEQ ID NO: 436515 - protein, 9 aa, Influenza virus
CYPQYPNVR

SEQ ID NO: 436516 - protein, 9 aa, Influenza virus
CYPRYPDVR

SEQ ID NO: 436517 - protein, 9 aa, Influenza virus
CYPRYPGVR

SEQ ID NO: 436518 - protein, 9 aa, Influenza virus
CYPRYPNVR

SEQ ID NO: 436519 - protein, 9 aa, Influenza virus
CYPYDVPDH

SEQ ID NO: 436520 - protein, 9 aa, Influenza virus
CYPYDVPDY

SEQ ID NO: 436521 - protein, 9 aa, Influenza virus
CYPYDVPEY

SEQ ID NO: 436522 - protein, 9 aa, Influenza virus
CYPYDVQDY

SEQ ID NO: 436523 - protein, 9 aa, Influenza virus
CYPYYVPDY

SEQ ID NO: 436524 - protein, 9 aa, Influenza virus
CYQFALGHG

SEQ ID NO: 436525 - protein, 9 aa, Influenza virus
CYQFALGQG

SEQ ID NO: 436526 - protein, 9 aa, Influenza virus
CYQRSKFLL

SEQ ID NO: 436527 - protein, 9 aa, Influenza virus
CYRACFYVE

SEQ ID NO: 436528 - protein, 9 aa, Influenza virus
CYSRYPNVR

SEQ ID NO: 436529 - protein, 9 aa, Influenza virus
CYTKCQTYA

SEQ ID NO: 436530 - protein, 9 aa, Influenza virus
CYTLITDGP

SEQ ID NO: 436531 - protein, 9 aa, Influenza virus
CYTLMTDGP

SEQ ID NO: 436532 - protein, 9 aa, Influenza virus
CYTLVTDGP

SEQ ID NO: 436533 - protein, 9 aa, Influenza virus
CYVDIDIYC

SEQ ID NO: 436534 - protein, 9 aa, Influenza virus
CYVDIDVYC

SEQ ID NO: 436535 - protein, 9 aa, Influenza virus
CYVDTDVYC

SEQ ID NO: 436536 - protein, 9 aa, Influenza virus
CYVDVDVYC

SEQ ID NO: 436537 - protein, 9 aa, Influenza virus
CYWVMTDGP

SEQ ID NO: 436538 - protein, 9 aa, Influenza virus
DAEMNKLFE

SEQ ID NO: 436539 - protein, 9 aa, Influenza virus
DAERGKLKR

SEQ ID NO: 436540 - protein, 9 aa, Influenza virus
DAGDGCFEI

SEQ ID NO: 436541 - protein, 9 aa, Influenza virus
DAGNGCFDI

SEQ ID NO: 436542 - protein, 9 aa, Influenza virus
DAHILVTRE

SEQ ID NO: 436543 - protein, 9 aa, Influenza virus
DAHVLVTRE

SEQ ID NO: 436544 - protein, 9 aa, Influenza virus
DAIEECLIN

SEQ ID NO: 436545 - protein, 9 aa, Influenza virus
DAINNRFQI

SEQ ID NO: 436546 - protein, 9 aa, Influenza virus
DALKLSIED

SEQ ID NO: 436547 - protein, 9 aa, Influenza virus
DALLGDPHC

SEQ ID NO: 436548 - protein, 9 aa, Influenza virus
DALLGDPQC

SEQ ID NO: 436549 - protein, 9 aa, Influenza virus
DAMLGDPHC

SEQ ID NO: 436550 - protein, 9 aa, Influenza virus
DAMTEIWSY

SEQ ID NO: 436551 - protein, 9 aa, Influenza virus
DAMTEVWSY

SEQ ID NO: 436552 - protein, 9 aa, Influenza virus
DANGWVSTD

SEQ ID NO: 436553 - protein, 9 aa, Influenza virus
DANGWVTAD

SEQ ID NO: 436554 - protein, 9 aa, Influenza virus
DANVKNLHD

SEQ ID NO: 436555 - protein, 9 aa, Influenza virus
DANVKNLHE

SEQ ID NO: 436556 - protein, 9 aa, Influenza virus
DANVRNLHD

SEQ ID NO: 436557 - protein, 9 aa, Influenza virus
DANVRNLHE

SEQ ID NO: 436558 - protein, 9 aa, Influenza virus
DAPFDDRLR

SEQ ID NO: 436559 - protein, 9 aa, Influenza virus
DAPFLDRIR

SEQ ID NO: 436560 - protein, 9 aa, Influenza virus
DAPFLDRLR

SEQ ID NO: 436561 - protein, 9 aa, Influenza virus
DAQAFYKIL

SEQ ID NO: 436562 - protein, 9 aa, Influenza virus
DAQAFYKLL

SEQ ID NO: 436563 - protein, 9 aa, Influenza virus
DAQHRSHRQ

SEQ ID NO: 436564 - protein, 9 aa, Influenza virus
DAQIDESCE

SEQ ID NO: 436565 - protein, 9 aa, Influenza virus
DARIDFESG

SEQ ID NO: 436566 - protein, 9 aa, Influenza virus
DARVDFESG

SEQ ID NO: 436567 - protein, 9 aa, Influenza virus
DATAVAVIK

SEQ ID NO: 436568 - protein, 9 aa, Influenza virus
DATAVAVLK

SEQ ID NO: 436569 - protein, 9 aa, Influenza virus
DATYQRTRA

SEQ ID NO: 436570 - protein, 9 aa, Influenza virus
DAVATTHSW

SEQ ID NO: 436571 - protein, 9 aa, Influenza virus
DAVKLSSGY

SEQ ID NO: 436572 - protein, 9 aa, Influenza virus
DAVTDIWSY

SEQ ID NO: 436573 - protein, 9 aa, Influenza virus
DAVTDVWSY

SEQ ID NO: 436574 - protein, 9 aa, Influenza virus
DAYAVIHYG

SEQ ID NO: 436575 - protein, 9 aa, Influenza virus
DCDLINGAL

SEQ ID NO: 436576 - protein, 9 aa, Influenza virus
DCETKCQTP

SEQ ID NO: 436577 - protein, 9 aa, Influenza virus
DCFLWHVRK

SEQ ID NO: 436578 - protein, 9 aa, Influenza virus
DCFQPCFYV

SEQ ID NO: 436579 - protein, 9 aa, Influenza virus
DCIKPCFWV

SEQ ID NO: 436580 - protein, 9 aa, Influenza virus
DCIRPCFWV

SEQ ID NO: 436581 - protein, 9 aa, Influenza virus
DCKIEAVIY

SEQ ID NO: 436582 - protein, 9 aa, Influenza virus
DCKVEAVIY

SEQ ID NO: 436583 - protein, 9 aa, Influenza virus
DCLVPCFWV

SEQ ID NO: 436584 - protein, 9 aa, Influenza virus
DCMASIRNN

SEQ ID NO: 436585 - protein, 9 aa, Influenza virus
DCMESIRNN

SEQ ID NO: 436586 - protein, 9 aa, Influenza virus
DCMIKAVRG

SEQ ID NO: 436587 - protein, 9 aa, Influenza virus
DCMMKAVRG

SEQ ID NO: 436588 - protein, 9 aa, Influenza virus
DCMRPCFWV

SEQ ID NO: 436589 - protein, 9 aa, Influenza virus
DCMVKAVRG

SEQ ID NO: 436590 - protein, 9 aa, Influenza virus
DCNFEGWIV

SEQ ID NO: 436591 - protein, 9 aa, Influenza virus
DCNNPITGS

SEQ ID NO: 436592 - protein, 9 aa, Influenza virus
DCPKYIKQG

SEQ ID NO: 436593 - protein, 9 aa, Influenza virus
DCPKYIKSG

SEQ ID NO: 436594 - protein, 9 aa, Influenza virus
DCPKYMNVK

SEQ ID NO: 436595 - protein, 9 aa, Influenza virus
DCPKYVKQG

SEQ ID NO: 436596 - protein, 9 aa, Influenza virus
DCPKYVNIK

SEQ ID NO: 436597 - protein, 9 aa, Influenza virus
DCPKYVNVK

SEQ ID NO: 436598 - protein, 9 aa, Influenza virus
DCPKYVNVR

SEQ ID NO: 436599 - protein, 9 aa, Influenza virus
DCPRYVKQG

SEQ ID NO: 436600 - protein, 9 aa, Influenza virus
DCRDNWKGS

SEQ ID NO: 436601 - protein, 9 aa, Influenza virus
DCRFEGWIV

SEQ ID NO: 436602 - protein, 9 aa, Influenza virus
DCRTFFLTQ

SEQ ID NO: 436603 - protein, 9 aa, Influenza virus
DCSFAGWIL

SEQ ID NO: 436604 - protein, 9 aa, Influenza virus
DCSFAGWLL

SEQ ID NO: 436605 - protein, 9 aa, Influenza virus
DCSFEGWIG

SEQ ID NO: 436606 - protein, 9 aa, Influenza virus
DCSFEGWIV

SEQ ID NO: 436607 - protein, 9 aa, Influenza virus
DCSIAGWLL

SEQ ID NO: 436608 - protein, 9 aa, Influenza virus
DCSITGWLL

SEQ ID NO: 436609 - protein, 9 aa, Influenza virus
DCSLEGIIL

SEQ ID NO: 436610 - protein, 9 aa, Influenza virus
DCSLEGLIL

SEQ ID NO: 436611 - protein, 9 aa, Influenza virus
DCSLEGLVL

SEQ ID NO: 436612 - protein, 9 aa, Influenza virus
DCSLKGLIL

SEQ ID NO: 436613 - protein, 9 aa, Influenza virus
DCSNPITGS

SEQ ID NO: 436614 - protein, 9 aa, Influenza virus
DCSVAGWLL

SEQ ID NO: 436615 - protein, 9 aa, Influenza virus
DCSVSGWLL

SEQ ID NO: 436616 - protein, 9 aa, Influenza virus
DCTGCFEIF

SEQ ID NO: 436617 - protein, 9 aa, Influenza virus
DCVLEAMAF

SEQ ID NO: 436618 - protein, 9 aa, Influenza virus
DCVLEAMAL

SEQ ID NO: 436619 - protein, 9 aa, Influenza virus
DCWSFALAQ

SEQ ID NO: 436620 - protein, 9 aa, Influenza virus
DCYRACFYV

SEQ ID NO: 436621 - protein, 9 aa, Influenza virus
DCYWVMTDG

SEQ ID NO: 436622 - protein, 9 aa, Influenza virus
DDAINNRFQ

SEQ ID NO: 436623 - protein, 9 aa, Influenza virus
DDAVTDIWS

SEQ ID NO: 436624 - protein, 9 aa, Influenza virus
DDAVTDVWS

SEQ ID NO: 436625 - protein, 9 aa, Influenza virus
DDAYAVIHY

SEQ ID NO: 436626 - protein, 9 aa, Influenza virus
DDCMASIRN

SEQ ID NO: 436627 - protein, 9 aa, Influenza virus
DDCSLEGII

SEQ ID NO: 436628 - protein, 9 aa, Influenza virus
DDCSLEGLI

SEQ ID NO: 436629 - protein, 9 aa, Influenza virus
DDCSLEGLV

SEQ ID NO: 436630 - protein, 9 aa, Influenza virus
DDCSLKGLI

SEQ ID NO: 436631 - protein, 9 aa, Influenza virus
DDDAYAVIH

SEQ ID NO: 436632 - protein, 9 aa, Influenza virus
DDDCMASIR

SEQ ID NO: 436633 - protein, 9 aa, Influenza virus
DDDVSWTSN

SEQ ID NO: 436634 - protein, 9 aa, Influenza virus
DDENATASF

SEQ ID NO: 436635 - protein, 9 aa, Influenza virus
DDFALILNA

SEQ ID NO: 436636 - protein, 9 aa, Influenza virus
DDFALIVNA

SEQ ID NO: 436637 - protein, 9 aa, Influenza virus
DDFFNRLNW

SEQ ID NO: 436638 - protein, 9 aa, Influenza virus
DDFQLIPMI

SEQ ID NO: 436639 - protein, 9 aa, Influenza virus
DDGAILPFD

SEQ ID NO: 436640 - protein, 9 aa, Influenza virus
DDGAILPFG

SEQ ID NO: 436641 - protein, 9 aa, Influenza virus
DDGAILPLT

SEQ ID NO: 436642 - protein, 9 aa, Influenza virus
DDGAVAVLK

SEQ ID NO: 436643 - protein, 9 aa, Influenza virus
DDGFIDIWT

SEQ ID NO: 436644 - protein, 9 aa, Influenza virus
DDGFIDVWT

SEQ ID NO: 436645 - protein, 9 aa, Influenza virus
DDGFLDIWT

SEQ ID NO: 436646 - protein, 9 aa, Influenza virus
DDGFLDVWT

SEQ ID NO: 436647 - protein, 9 aa, Influenza virus
DDGLLDVWT

SEQ ID NO: 436648 - protein, 9 aa, Influenza virus
DDHCMESIR

SEQ ID NO: 436649 - protein, 9 aa, Influenza virus
DDIDQSLII

SEQ ID NO: 436650 - protein, 9 aa, Influenza virus
DDKNATASF

SEQ ID NO: 436651 - protein, 9 aa, Influenza virus
DDLIEKTSW

SEQ ID NO: 436652 - protein, 9 aa, Influenza virus
DDLIGKTSW

SEQ ID NO: 436653 - protein, 9 aa, Influenza virus
DDNCMERIR

SEQ ID NO: 436654 - protein, 9 aa, Influenza virus
DDNCMESIR

SEQ ID NO: 436655 - protein, 9 aa, Influenza virus
DDNVYKALS

SEQ ID NO: 436656 - protein, 9 aa, Influenza virus
DDPNWSGYS

SEQ ID NO: 436657 - protein, 9 aa, Influenza virus
DDQCMESIR

SEQ ID NO: 436658 - protein, 9 aa, Influenza virus
DDQIEDLWA

SEQ ID NO: 436659 - protein, 9 aa, Influenza virus
DDQIEELWA

SEQ ID NO: 436660 - protein, 9 aa, Influenza virus
DDQIEGLWA

SEQ ID NO: 436661 - protein, 9 aa, Influenza virus
DDQIENLWA

SEQ ID NO: 436662 - protein, 9 aa, Influenza virus
DDQIIDIWA

SEQ ID NO: 436663 - protein, 9 aa, Influenza virus
DDQIQDIWA

SEQ ID NO: 436664 - protein, 9 aa, Influenza virus
DDQIQDLWA

SEQ ID NO: 436665 - protein, 9 aa, Influenza virus
DDQIQDVWA

SEQ ID NO: 436666 - protein, 9 aa, Influenza virus
DDQIQNIWA

SEQ ID NO: 436667 - protein, 9 aa, Influenza virus
DDQITDIWA

SEQ ID NO: 436668 - protein, 9 aa, Influenza virus
DDQVTDIWA

SEQ ID NO: 436669 - protein, 9 aa, Influenza virus
DDRNATASF

SEQ ID NO: 436670 - protein, 9 aa, Influenza virus
DDRNATASL

SEQ ID NO: 436671 - protein, 9 aa, Influenza virus
DDSCMESIR

SEQ ID NO: 436672 - protein, 9 aa, Influenza virus
DDSSSNSNC

SEQ ID NO: 436673 - protein, 9 aa, Influenza virus
DDSSSSSNC

SEQ ID NO: 436674 - protein, 9 aa, Influenza virus
DDSVYKALS

SEQ ID NO: 436675 - protein, 9 aa, Influenza virus
DDVDQSLII

SEQ ID NO: 436676 - protein, 9 aa, Influenza virus
DDVDQSLVI

SEQ ID NO: 436677 - protein, 9 aa, Influenza virus
DDVLMGRTI

SEQ ID NO: 436678 - protein, 9 aa, Influenza virus
DDVSWASNS

SEQ ID NO: 436679 - protein, 9 aa, Influenza virus
DDVSWTSNS

SEQ ID NO: 436680 - protein, 9 aa, Influenza virus
DDVWLGRTV

SEQ ID NO: 436681 - protein, 9 aa, Influenza virus
DDVWMGRTI

SEQ ID NO: 436682 - protein, 9 aa, Influenza virus
DEAINNRFQ

SEQ ID NO: 436683 - protein, 9 aa, Influenza virus
DEAINNRIK

SEQ ID NO: 436684 - protein, 9 aa, Influenza virus
DEAINSRFQ

SEQ ID NO: 436685 - protein, 9 aa, Influenza virus
DEAISNRFQ

SEQ ID NO: 436686 - protein, 9 aa, Influenza virus
DEALKMTIA

SEQ ID NO: 436687 - protein, 9 aa, Influenza virus
DEALNNRFQ

SEQ ID NO: 436688 - protein, 9 aa, Influenza virus
DEALNNRSQ

SEQ ID NO: 436689 - protein, 9 aa, Influenza virus
DEALSNRFQ

SEQ ID NO: 436690 - protein, 9 aa, Influenza virus
DEAVNNRFQ

SEQ ID NO: 436691 - protein, 9 aa, Influenza virus
DECIEKVRN

SEQ ID NO: 436692 - protein, 9 aa, Influenza virus
DECRFYALS

SEQ ID NO: 436693 - protein, 9 aa, Influenza virus
DECRTFFLT

SEQ ID NO: 436694 - protein, 9 aa, Influenza virus
DEEGTGIAA

SEQ ID NO: 436695 - protein, 9 aa, Influenza virus
DEESRARIK

SEQ ID NO: 436696 - protein, 9 aa, Influenza virus
DEFCYTLIT

SEQ ID NO: 436697 - protein, 9 aa, Influenza virus
DEFCYTLMT

SEQ ID NO: 436698 - protein, 9 aa, Influenza virus
DEFCYTLVT

SEQ ID NO: 436699 - protein, 9 aa, Influenza virus
DEFQLIPMI

SEQ ID NO: 436700 - protein, 9 aa, Influenza virus
DEGDGCFNF

SEQ ID NO: 436701 - protein, 9 aa, Influenza virus
DEGDGCFNL

SEQ ID NO: 436702 - protein, 9 aa, Influenza virus
DEGDGCFSI

SEQ ID NO: 436703 - protein, 9 aa, Influenza virus
DEGDGCFSL

SEQ ID NO: 436704 - protein, 9 aa, Influenza virus
DEGLPQSGR

SEQ ID NO: 436705 - protein, 9 aa, Influenza virus
DEGNGCFEL

SEQ ID NO: 436706 - protein, 9 aa, Influenza virus
DEGNGCFTF

SEQ ID NO: 436707 - protein, 9 aa, Influenza virus
DEHDANVRN

SEQ ID NO: 436708 - protein, 9 aa, Influenza virus
DEHDSNVEN

SEQ ID NO: 436709 - protein, 9 aa, Influenza virus
DEHDSNVKN

SEQ ID NO: 436710 - protein, 9 aa, Influenza virus
DEICIGHLS

SEQ ID NO: 436711 - protein, 9 aa, Influenza virus
DEICIGYLS

SEQ ID NO: 436712 - protein, 9 aa, Influenza virus
DEICIGYMS

SEQ ID NO: 436713 - protein, 9 aa, Influenza virus
DEIGEDIAP

SEQ ID NO: 436714 - protein, 9 aa, Influenza virus
DEIGEDLAP

SEQ ID NO: 436715 - protein, 9 aa, Influenza virus
DEIGEDVAP

SEQ ID NO: 436716 - protein, 9 aa, Influenza virus
DEITTKINN

SEQ ID NO: 436717 - protein, 9 aa, Influenza virus
DELCPSPLK

SEQ ID NO: 436718 - protein, 9 aa, Influenza virus
DELIGKTSW

SEQ ID NO: 436719 - protein, 9 aa, Influenza virus
DENATASFI

SEQ ID NO: 436720 - protein, 9 aa, Influenza virus
DEQMYQKCC

SEQ ID NO: 436721 - protein, 9 aa, Influenza virus
DEQMYQRCC

SEQ ID NO: 436722 - protein, 9 aa, Influenza virus
DEQNKLYGA

SEQ ID NO: 436723 - protein, 9 aa, Influenza virus
DEQNKLYGT

SEQ ID NO: 436724 - protein, 9 aa, Influenza virus
DEQTKLYGS

SEQ ID NO: 436725 - protein, 9 aa, Influenza virus
DERGLFGAI

SEQ ID NO: 436726 - protein, 9 aa, Influenza virus
DERGNPGVK

SEQ ID NO: 436727 - protein, 9 aa, Influenza virus
DERRNKYLE

SEQ ID NO: 436728 - protein, 9 aa, Influenza virus
DERRNRYLE

SEQ ID NO: 436729 - protein, 9 aa, Influenza virus
DESCEGECF

SEQ ID NO: 436730 - protein, 9 aa, Influenza virus
DESRIERQK

SEQ ID NO: 436731 - protein, 9 aa, Influenza virus
DEVDQSLII

SEQ ID NO: 436732 - protein, 9 aa, Influenza virus
DEVKRRLSA

SEQ ID NO: 436733 - protein, 9 aa, Influenza virus
DEVKRRLST

SEQ ID NO: 436734 - protein, 9 aa, Influenza virus
DEVRRRLSA

SEQ ID NO: 436735 - protein, 9 aa, Influenza virus
DEVRRRLST

SEQ ID NO: 436736 - protein, 9 aa, Influenza virus
DEVRRRLSV

SEQ ID NO: 436737 - protein, 9 aa, Influenza virus
DEVSWTSNS

SEQ ID NO: 436738 - protein, 9 aa, Influenza virus
DEVWWTSNS

SEQ ID NO: 436739 - protein, 9 aa, Influenza virus
DEYKNTGDS

SEQ ID NO: 436740 - protein, 9 aa, Influenza virus
DEYKNTRDS

SEQ ID NO: 436741 - protein, 9 aa, Influenza virus
DFALILNAP

SEQ ID NO: 436742 - protein, 9 aa, Influenza virus
DFALIVNAL

SEQ ID NO: 436743 - protein, 9 aa, Influenza virus
DFALIVNAP

SEQ ID NO: 436744 - protein, 9 aa, Influenza virus
DFALIVNAS

SEQ ID NO: 436745 - protein, 9 aa, Influenza virus
DFEKEGYSL

SEQ ID NO: 436746 - protein, 9 aa, Influenza virus
DFEREGYSL

SEQ ID NO: 436747 - protein, 9 aa, Influenza virus
DFFKRLNWL

SEQ ID NO: 436748 - protein, 9 aa, Influenza virus
DFFNRLNWL

SEQ ID NO: 436749 - protein, 9 aa, Influenza virus
DFFRRLNWL

SEQ ID NO: 436750 - protein, 9 aa, Influenza virus
DFHDSNVKN

SEQ ID NO: 436751 - protein, 9 aa, Influenza virus
DFHDSNVKS

SEQ ID NO: 436752 - protein, 9 aa, Influenza virus
DFHDSNVRN

SEQ ID NO: 436753 - protein, 9 aa, Influenza virus
DFHDSSVKN

SEQ ID NO: 436754 - protein, 9 aa, Influenza virus
DFHWMLLDP

SEQ ID NO: 436755 - protein, 9 aa, Influenza virus
DFICVGWSS

SEQ ID NO: 436756 - protein, 9 aa, Influenza virus
DFIKWNVTY

SEQ ID NO: 436757 - protein, 9 aa, Influenza virus
DFKSTQAAI

SEQ ID NO: 436758 - protein, 9 aa, Influenza virus
DFLCVGWSS

SEQ ID NO: 436759 - protein, 9 aa, Influenza virus
DFLDVWTYN

SEQ ID NO: 436760 - protein, 9 aa, Influenza virus
DFLNNTEPL

SEQ ID NO: 436761 - protein, 9 aa, Influenza virus
DFMCVGWSS

SEQ ID NO: 436762 - protein, 9 aa, Influenza virus
DFQLIPMIS

SEQ ID NO: 436763 - protein, 9 aa, Influenza virus
DFRDMRKNT

SEQ ID NO: 436764 - protein, 9 aa, Influenza virus
DFSKWNVTY

SEQ ID NO: 436765 - protein, 9 aa, Influenza virus
DFTKWNVTH

SEQ ID NO: 436766 - protein, 9 aa, Influenza virus
DFTKWNVTY

SEQ ID NO: 436767 - protein, 9 aa, Influenza virus
DFVRQCFNP

SEQ ID NO: 436768 - protein, 9 aa, Influenza virus
DGADINFMP

SEQ ID NO: 436769 - protein, 9 aa, Influenza virus
DGADLPFTI

SEQ ID NO: 436770 - protein, 9 aa, Influenza virus
DGAEIEYFL

SEQ ID NO: 436771 - protein, 9 aa, Influenza virus
DGAEIIYFE

SEQ ID NO: 436772 - protein, 9 aa, Influenza virus
DGAEIIYFK

SEQ ID NO: 436773 - protein, 9 aa, Influenza virus
DGAEITYFK

SEQ ID NO: 436774 - protein, 9 aa, Influenza virus
DGAELPFAI

SEQ ID NO: 436775 - protein, 9 aa, Influenza virus
DGAELPFII

SEQ ID NO: 436776 - protein, 9 aa, Influenza virus
DGAELPFTI

SEQ ID NO: 436777 - protein, 9 aa, Influenza virus
DGAFLAPRY

SEQ ID NO: 436778 - protein, 9 aa, Influenza virus
DGAILPFDF

SEQ ID NO: 436779 - protein, 9 aa, Influenza virus
DGAILPFDI

SEQ ID NO: 436780 - protein, 9 aa, Influenza virus
DGAILPFGI

SEQ ID NO: 436781 - protein, 9 aa, Influenza virus
DGAILPLTS

SEQ ID NO: 436782 - protein, 9 aa, Influenza virus
DGAKIEYFL

SEQ ID NO: 436783 - protein, 9 aa, Influenza virus
DGAKIKYFL

SEQ ID NO: 436784 - protein, 9 aa, Influenza virus
DGAKIQYFS

SEQ ID NO: 436785 - protein, 9 aa, Influenza virus
DGAKLPFTI

SEQ ID NO: 436786 - protein, 9 aa, Influenza virus
DGALLPFDI

SEQ ID NO: 436787 - protein, 9 aa, Influenza virus
DGANIDFMP

SEQ ID NO: 436788 - protein, 9 aa, Influenza virus
DGANIDFVP

SEQ ID NO: 436789 - protein, 9 aa, Influenza virus
DGANIGFMP

SEQ ID NO: 436790 - protein, 9 aa, Influenza virus
DGANINFMA

SEQ ID NO: 436791 - protein, 9 aa, Influenza virus
DGANINFMH

SEQ ID NO: 436792 - protein, 9 aa, Influenza virus
DGANINFMP

SEQ ID NO: 436793 - protein, 9 aa, Influenza virus
DGANINFMS

SEQ ID NO: 436794 - protein, 9 aa, Influenza virus
DGANINLMP

SEQ ID NO: 436795 - protein, 9 aa, Influenza virus
DGANISFMP

SEQ ID NO: 436796 - protein, 9 aa, Influenza virus
DGAQIKYFS

SEQ ID NO: 436797 - protein, 9 aa, Influenza virus
DGAQIQYFS

SEQ ID NO: 436798 - protein, 9 aa, Influenza virus
DGARIQYFS

SEQ ID NO: 436799 - protein, 9 aa, Influenza virus
DGATSACKR

SEQ ID NO: 436800 - protein, 9 aa, Influenza virus
DGAVAVLKY

SEQ ID NO: 436801 - protein, 9 aa, Influenza virus
DGAVLPFDI

SEQ ID NO: 436802 - protein, 9 aa, Influenza virus
DGCFEILHK

SEQ ID NO: 436803 - protein, 9 aa, Influenza virus
DGCFEILHR

SEQ ID NO: 436804 - protein, 9 aa, Influenza virus
DGCFNFFHK

SEQ ID NO: 436805 - protein, 9 aa, Influenza virus
DGCFNLLHK

SEQ ID NO: 436806 - protein, 9 aa, Influenza virus
DGCFSILHK

SEQ ID NO: 436807 - protein, 9 aa, Influenza virus
DGCFSLLHK

SEQ ID NO: 436808 - protein, 9 aa, Influenza virus
DGCRFYALS

SEQ ID NO: 436809 - protein, 9 aa, Influenza virus
DGDIIFLWG

SEQ ID NO: 436810 - protein, 9 aa, Influenza virus
DGFEPNGCI

SEQ ID NO: 436811 - protein, 9 aa, Influenza virus
DGFEPNGYI

SEQ ID NO: 436812 - protein, 9 aa, Influenza virus
DGFIDIWTY

SEQ ID NO: 436813 - protein, 9 aa, Influenza virus
DGFIDVWTY

SEQ ID NO: 436814 - protein, 9 aa, Influenza virus
DGFKPNGCI

SEQ ID NO: 436815 - protein, 9 aa, Influenza virus
DGFLDIWTY

SEQ ID NO: 436816 - protein, 9 aa, Influenza virus
DGFLDVWTY

SEQ ID NO: 436817 - protein, 9 aa, Influenza virus
DGFLGVWTY

SEQ ID NO: 436818 - protein, 9 aa, Influenza virus
DGFLNVWTY

SEQ ID NO: 436819 - protein, 9 aa, Influenza virus
DGFMDVWTY

SEQ ID NO: 436820 - protein, 9 aa, Influenza virus
DGGHIEECS

SEQ ID NO: 436821 - protein, 9 aa, Influenza virus
DGGPNLYNI

SEQ ID NO: 436822 - protein, 9 aa, Influenza virus
DGIARMTIC

SEQ ID NO: 436823 - protein, 9 aa, Influenza virus
DGIGRFYIQ

SEQ ID NO: 436824 - protein, 9 aa, Influenza virus
DGIGRMTIC

SEQ ID NO: 436825 - protein, 9 aa, Influenza virus
DGITNKINS

SEQ ID NO: 436826 - protein, 9 aa, Influenza virus
DGITNKVNS

SEQ ID NO: 436827 - protein, 9 aa, Influenza virus
DGKAPISLG

SEQ ID NO: 436828 - protein, 9 aa, Influenza virus
DGKAWLHIC

SEQ ID NO: 436829 - protein, 9 aa, Influenza virus
DGKAWLHVC

SEQ ID NO: 436830 - protein, 9 aa, Influenza virus
DGKEWLHVC

SEQ ID NO: 436831 - protein, 9 aa, Influenza virus
DGKEWMHIC

SEQ ID NO: 436832 - protein, 9 aa, Influenza virus
DGKEWMHVC

SEQ ID NO: 436833 - protein, 9 aa, Influenza virus
DGKEWMHVS

SEQ ID NO: 436834 - protein, 9 aa, Influenza virus
DGKGCFDLY

SEQ ID NO: 436835 - protein, 9 aa, Influenza virus
DGKGCFEIY

SEQ ID NO: 436836 - protein, 9 aa, Influenza virus
DGKGCFELY

SEQ ID NO: 436837 - protein, 9 aa, Influenza virus
DGKGCFETY

SEQ ID NO: 436838 - protein, 9 aa, Influenza virus
DGKGCSELY

SEQ ID NO: 436839 - protein, 9 aa, Influenza virus
DGKSSACKR

SEQ ID NO: 436840 - protein, 9 aa, Influenza virus
DGKSWLHVC

SEQ ID NO: 436841 - protein, 9 aa, Influenza virus
DGKVECVCR

SEQ ID NO: 436842 - protein, 9 aa, Influenza virus
DGLLDVWTY

SEQ ID NO: 436843 - protein, 9 aa, Influenza virus
DGLQSSDDF

SEQ ID NO: 436844 - protein, 9 aa, Influenza virus
DGNASGKAD

SEQ ID NO: 436845 - protein, 9 aa, Influenza virus
DGNAWLHVC

SEQ ID NO: 436846 - protein, 9 aa, Influenza virus
DGNGCFEIF

SEQ ID NO: 436847 - protein, 9 aa, Influenza virus
DGNGCFELY

SEQ ID NO: 436848 - protein, 9 aa, Influenza virus
DGNIIFLWG

SEQ ID NO: 436849 - protein, 9 aa, Influenza virus
DGNLIAPWY

SEQ ID NO: 436850 - protein, 9 aa, Influenza virus
DGPAANNAD

SEQ ID NO: 436851 - protein, 9 aa, Influenza virus
DGPAANSAD

SEQ ID NO: 436852 - protein, 9 aa, Influenza virus
DGPAANSAH

SEQ ID NO: 436853 - protein, 9 aa, Influenza virus
DGPANKQAS

SEQ ID NO: 436854 - protein, 9 aa, Influenza virus
DGPANNQAS

SEQ ID NO: 436855 - protein, 9 aa, Influenza virus
DGPANSQAS

SEQ ID NO: 436856 - protein, 9 aa, Influenza virus
DGPANSQAY

SEQ ID NO: 436857 - protein, 9 aa, Influenza virus
DGPASNQAS

SEQ ID NO: 436858 - protein, 9 aa, Influenza virus
DGPGWLTIG

SEQ ID NO: 436859 - protein, 9 aa, Influenza virus
DGPGWLTLG

SEQ ID NO: 436860 - protein, 9 aa, Influenza virus
DGPQIQYFS

SEQ ID NO: 436861 - protein, 9 aa, Influenza virus
DGPSDAQAF

SEQ ID NO: 436862 - protein, 9 aa, Influenza virus
DGPSNAQAF

SEQ ID NO: 436863 - protein, 9 aa, Influenza virus
DGQDCDLIN

SEQ ID NO: 436864 - protein, 9 aa, Influenza virus
DGQRSWMKI

SEQ ID NO: 436865 - protein, 9 aa, Influenza virus
DGQRSWMKL

SEQ ID NO: 436866 - protein, 9 aa, Influenza virus
DGQSGRIDF

SEQ ID NO: 436867 - protein, 9 aa, Influenza virus
DGRAWLHIC

SEQ ID NO: 436868 - protein, 9 aa, Influenza virus
DGRAWLHVC

SEQ ID NO: 436869 - protein, 9 aa, Influenza virus
DGREWMHVC

SEQ ID NO: 436870 - protein, 9 aa, Influenza virus
DGRGCFEIY

SEQ ID NO: 436871 - protein, 9 aa, Influenza virus
DGRLIQNSI

SEQ ID NO: 436872 - protein, 9 aa, Influenza virus
DGSANSQAY

SEQ ID NO: 436873 - protein, 9 aa, Influenza virus
DGSASGKAD

SEQ ID NO: 436874 - protein, 9 aa, Influenza virus
DGSASGKAE

SEQ ID NO: 436875 - protein, 9 aa, Influenza virus
DGSASGQAY

SEQ ID NO: 436876 - protein, 9 aa, Influenza virus
DGSASGRAD

SEQ ID NO: 436877 - protein, 9 aa, Influenza virus
DGSASRKAD

SEQ ID NO: 436878 - protein, 9 aa, Influenza virus
DGSASSQAH

SEQ ID NO: 436879 - protein, 9 aa, Influenza virus
DGSASSQAY

SEQ ID NO: 436880 - protein, 9 aa, Influenza virus
DGSATGPAD

SEQ ID NO: 436881 - protein, 9 aa, Influenza virus
DGSATGPAE

SEQ ID NO: 436882 - protein, 9 aa, Influenza virus
DGSDIGFMP

SEQ ID NO: 436883 - protein, 9 aa, Influenza virus
DGSGWLTLG

SEQ ID NO: 436884 - protein, 9 aa, Influenza virus
DGSIGKVCR

SEQ ID NO: 436885 - protein, 9 aa, Influenza virus
DGSKIGFMP

SEQ ID NO: 436886 - protein, 9 aa, Influenza virus
DGSNIGFMP

SEQ ID NO: 436887 - protein, 9 aa, Influenza virus
DGSNIKFMP

SEQ ID NO: 436888 - protein, 9 aa, Influenza virus
DGSSSACLR

SEQ ID NO: 436889 - protein, 9 aa, Influenza virus
DGTAFRGLI

SEQ ID NO: 436890 - protein, 9 aa, Influenza virus
DGTGCFEIF

SEQ ID NO: 436891 - protein, 9 aa, Influenza virus
DGTGCFELF

SEQ ID NO: 436892 - protein, 9 aa, Influenza virus
DGTIAGFIE

SEQ ID NO: 436893 - protein, 9 aa, Influenza virus
DGTYKILTI

SEQ ID NO: 436894 - protein, 9 aa, Influenza virus
DGVGRMTIC

SEQ ID NO: 436895 - protein, 9 aa, Influenza virus
DGVNRMTIC

SEQ ID NO: 436896 - protein, 9 aa, Influenza virus
DGVSRMTIC

SEQ ID NO: 436897 - protein, 9 aa, Influenza virus
DGVTASCLD

SEQ ID NO: 436898 - protein, 9 aa, Influenza virus
DGVTASCRD

SEQ ID NO: 436899 - protein, 9 aa, Influenza virus
DGVTNKVNS

SEQ ID NO: 436900 - protein, 9 aa, Influenza virus
DGVWIGRTK

SEQ ID NO: 436901 - protein, 9 aa, Influenza virus
DGVYKALSI

SEQ ID NO: 436902 - protein, 9 aa, Influenza virus
DGWILGNPQ

SEQ ID NO: 436903 - protein, 9 aa, Influenza virus
DGWINSPNH

SEQ ID NO: 436904 - protein, 9 aa, Influenza virus
DGWTTANSK

SEQ ID NO: 436905 - protein, 9 aa, Influenza virus
DGWYGFHHS

SEQ ID NO: 436906 - protein, 9 aa, Influenza virus
DGWYGFKHQ

SEQ ID NO: 436907 - protein, 9 aa, Influenza virus
DGWYGFRHH

SEQ ID NO: 436908 - protein, 9 aa, Influenza virus
DGWYGFRHQ

SEQ ID NO: 436909 - protein, 9 aa, Influenza virus
DGWYGFRYQ

SEQ ID NO: 436910 - protein, 9 aa, Influenza virus
DGWYGYHHE

SEQ ID NO: 436911 - protein, 9 aa, Influenza virus
DGWYGYHHI

SEQ ID NO: 436912 - protein, 9 aa, Influenza virus
DGWYGYHHN

SEQ ID NO: 436913 - protein, 9 aa, Influenza virus
DGWYGYHHQ

SEQ ID NO: 436914 - protein, 9 aa, Influenza virus
DGWYGYHHS

SEQ ID NO: 436915 - protein, 9 aa, Influenza virus
DGWYGYHHT

SEQ ID NO: 436916 - protein, 9 aa, Influenza virus
DGWYGYKHQ

SEQ ID NO: 436917 - protein, 9 aa, Influenza virus
DGWYGYRHQ

SEQ ID NO: 436918 - protein, 9 aa, Influenza virus
DHAQYREEA

SEQ ID NO: 436919 - protein, 9 aa, Influenza virus
DHCMESIRN

SEQ ID NO: 436920 - protein, 9 aa, Influenza virus
DHEGEGIPL

SEQ ID NO: 436921 - protein, 9 aa, Influenza virus
DHGVKGWAF

SEQ ID NO: 436922 - protein, 9 aa, Influenza virus
DHICIGYHA

SEQ ID NO: 436923 - protein, 9 aa, Influenza virus
DHIEVTNAT

SEQ ID NO: 436924 - protein, 9 aa, Influenza virus
DHITFSHNG

SEQ ID NO: 436925 - protein, 9 aa, Influenza virus
DHKDFEEES

SEQ ID NO: 436926 - protein, 9 aa, Influenza virus
DHKDYEEEA

SEQ ID NO: 436927 - protein, 9 aa, Influenza virus
DHKEFEEES

SEQ ID NO: 436928 - protein, 9 aa, Influenza virus
DHKEFEKES

SEQ ID NO: 436929 - protein, 9 aa, Influenza virus
DHKEYEEEA

SEQ ID NO: 436930 - protein, 9 aa, Influenza virus
DHMAIIKKY

SEQ ID NO: 436931 - protein, 9 aa, Influenza virus
DHNIYRDEA

SEQ ID NO: 436932 - protein, 9 aa, Influenza virus
DHRIYWIKE

SEQ ID NO: 436933 - protein, 9 aa, Influenza virus
DHRIYWIRE

SEQ ID NO: 436934 - protein, 9 aa, Influenza virus
DHRIYWIRK

SEQ ID NO: 436935 - protein, 9 aa, Influenza virus
DHRVYWIRE

SEQ ID NO: 436936 - protein, 9 aa, Influenza virus
DHSDNADKI

SEQ ID NO: 436937 - protein, 9 aa, Influenza virus
DHSQYREEA

SEQ ID NO: 436938 - protein, 9 aa, Influenza virus
DHTQYREEA

SEQ ID NO: 436939 - protein, 9 aa, Influenza virus
DHTSQYLCT

SEQ ID NO: 436940 - protein, 9 aa, Influenza virus
DICYPGKFT

SEQ ID NO: 436941 - protein, 9 aa, Influenza virus
DICYPGRFT

SEQ ID NO: 436942 - protein, 9 aa, Influenza virus
DIDIYCICR

SEQ ID NO: 436943 - protein, 9 aa, Influenza virus
DIDQSLIIA

SEQ ID NO: 436944 - protein, 9 aa, Influenza virus
DIDVYCICR

SEQ ID NO: 436945 - protein, 9 aa, Influenza virus
DIDVYCVCR

SEQ ID NO: 436946 - protein, 9 aa, Influenza virus
DIEAMASQG

SEQ ID NO: 436947 - protein, 9 aa, Influenza virus
DIEAMATQG

SEQ ID NO: 436948 - protein, 9 aa, Influenza virus
DIECVCRDN

SEQ ID NO: 436949 - protein, 9 aa, Influenza virus
DIEIMASQG

SEQ ID NO: 436950 - protein, 9 aa, Influenza virus
DIFVIREPF

SEQ ID NO: 436951 - protein, 9 aa, Influenza virus
DIFVMREPF

SEQ ID NO: 436952 - protein, 9 aa, Influenza virus
DIIDNDNWS

SEQ ID NO: 436953 - protein, 9 aa, Influenza virus
DIIDNNNWS

SEQ ID NO: 436954 - protein, 9 aa, Influenza virus
DIIFLWGIH

SEQ ID NO: 436955 - protein, 9 aa, Influenza virus
DIILWFSFG

SEQ ID NO: 436956 - protein, 9 aa, Influenza virus
DIILWISFS

SEQ ID NO: 436957 - protein, 9 aa, Influenza virus
DIILWVSFS

SEQ ID NO: 436958 - protein, 9 aa, Influenza virus
DIINGALGS

SEQ ID NO: 436959 - protein, 9 aa, Influenza virus
DIITDTIKS

SEQ ID NO: 436960 - protein, 9 aa, Influenza virus
DIIVFNTIG

SEQ ID NO: 436961 - protein, 9 aa, Influenza virus
DIKSHAYIS

SEQ ID NO: 436962 - protein, 9 aa, Influenza virus
DILDGVTAS

SEQ ID NO: 436963 - protein, 9 aa, Influenza virus
DILEGTTAS

SEQ ID NO: 436964 - protein, 9 aa, Influenza virus
DILEKAHNG

SEQ ID NO: 436965 - protein, 9 aa, Influenza virus
DILEKEHNG

SEQ ID NO: 436966 - protein, 9 aa, Influenza virus
DILEKKHNG

SEQ ID NO: 436967 - protein, 9 aa, Influenza virus
DILEKTHNG

SEQ ID NO: 436968 - protein, 9 aa, Influenza virus
DILEKVHNG

SEQ ID NO: 436969 - protein, 9 aa, Influenza virus
DILERTHNG

SEQ ID NO: 436970 - protein, 9 aa, Influenza virus
DILHKCDNE

SEQ ID NO: 436971 - protein, 9 aa, Influenza virus
DILHKCDNK

SEQ ID NO: 436972 - protein, 9 aa, Influenza virus
DILHKCNNE

SEQ ID NO: 436973 - protein, 9 aa, Influenza virus
DILKHNPTE

SEQ ID NO: 436974 - protein, 9 aa, Influenza virus
DILKQNPTE

SEQ ID NO: 436975 - protein, 9 aa, Influenza virus
DILRQNPSE

SEQ ID NO: 436976 - protein, 9 aa, Influenza virus
DILRQNPTE

SEQ ID NO: 436977 - protein, 9 aa, Influenza virus
DILRTQESE

SEQ ID NO: 436978 - protein, 9 aa, Influenza virus
DILRTQESS

SEQ ID NO: 436979 - protein, 9 aa, Influenza virus
DILVTREPY

SEQ ID NO: 436980 - protein, 9 aa, Influenza virus
DIMQNKLNN

SEQ ID NO: 436981 - protein, 9 aa, Influenza virus
DIMRTQESS

SEQ ID NO: 436982 - protein, 9 aa, Influenza virus
DINIAEYSI

SEQ ID NO: 436983 - protein, 9 aa, Influenza virus
DINIMASQG

SEQ ID NO: 436984 - protein, 9 aa, Influenza virus
DINLHAYIS

SEQ ID NO: 436985 - protein, 9 aa, Influenza virus
DINLMPIYS

SEQ ID NO: 436986 - protein, 9 aa, Influenza virus
DINMADYSI

SEQ ID NO: 436987 - protein, 9 aa, Influenza virus
DINMEDYSI

SEQ ID NO: 436988 - protein, 9 aa, Influenza virus
DIRTATREG

SEQ ID NO: 436989 - protein, 9 aa, Influenza virus
DISMEDYSI

SEQ ID NO: 436990 - protein, 9 aa, Influenza virus
DITIGSICM

SEQ ID NO: 436991 - protein, 9 aa, Influenza virus
DIVLVMKRK

SEQ ID NO: 436992 - protein, 9 aa, Influenza virus
DIVNAALGS

SEQ ID NO: 436993 - protein, 9 aa, Influenza virus
DIVNGALGS

SEQ ID NO: 436994 - protein, 9 aa, Influenza virus
DIVNSALGS

SEQ ID NO: 436995 - protein, 9 aa, Influenza virus
DIWAYNAEL

SEQ ID NO: 436996 - protein, 9 aa, Influenza virus
DIWITREPY

SEQ ID NO: 436997 - protein, 9 aa, Influenza virus
DIWMGRTIS

SEQ ID NO: 436998 - protein, 9 aa, Influenza virus
DIWSYNAKL

SEQ ID NO: 436999 - protein, 9 aa, Influenza virus
DIWSYNAQL

SEQ ID NO: 437000 - protein, 9 aa, Influenza virus
DIWSYNARL

SEQ ID NO: 437001 - protein, 9 aa, Influenza virus
DIWTYNAEL

SEQ ID NO: 437002 - protein, 9 aa, Influenza virus
DIWTYQAEL

SEQ ID NO: 437003 - protein, 9 aa, Influenza virus
DIWVTRELY

SEQ ID NO: 437004 - protein, 9 aa, Influenza virus
DIWVTREPY

SEQ ID NO: 437005 - protein, 9 aa, Influenza virus
DIWVTRKPY

SEQ ID NO: 437006 - protein, 9 aa, Influenza virus
DIWVTRVPY

SEQ ID NO: 437007 - protein, 9 aa, Influenza virus
DIYCICRDN

SEQ ID NO: 437008 - protein, 9 aa, Influenza virus
DIYCVCRDN

SEQ ID NO: 437009 - protein, 9 aa, Influenza virus
DIYDFNEGS

SEQ ID NO: 437010 - protein, 9 aa, Influenza virus
DKASTQKAI

SEQ ID NO: 437011 - protein, 9 aa, Influenza virus
DKAVKLYKK

SEQ ID NO: 437012 - protein, 9 aa, Influenza virus
DKAVKLYRK

SEQ ID NO: 437013 - protein, 9 aa, Influenza virus
DKCYQFALG

SEQ ID NO: 437014 - protein, 9 aa, Influenza virus
DKDSNGVQD

SEQ ID NO: 437015 - protein, 9 aa, Influenza virus
DKEPMGFRY

SEQ ID NO: 437016 - protein, 9 aa, Influenza virus
DKESMGFRY

SEQ ID NO: 437017 - protein, 9 aa, Influenza virus
DKESTQKAF

SEQ ID NO: 437018 - protein, 9 aa, Influenza virus
DKESTQKAI

SEQ ID NO: 437019 - protein, 9 aa, Influenza virus
DKESTQKAV

SEQ ID NO: 437020 - protein, 9 aa, Influenza virus
DKESTQRAF

SEQ ID NO: 437021 - protein, 9 aa, Influenza virus
DKGNGCFEI

SEQ ID NO: 437022 - protein, 9 aa, Influenza virus
DKGSIQSDK

SEQ ID NO: 437023 - protein, 9 aa, Influenza virus
DKHDSNVKN

SEQ ID NO: 437024 - protein, 9 aa, Influenza virus
DKHSNGTAK

SEQ ID NO: 437025 - protein, 9 aa, Influenza virus
DKHSNGTIK

SEQ ID NO: 437026 - protein, 9 aa, Influenza virus
DKHSNGTMK

SEQ ID NO: 437027 - protein, 9 aa, Influenza virus
DKHSNGTVK

SEQ ID NO: 437028 - protein, 9 aa, Influenza virus
DKHSNNTVK

SEQ ID NO: 437029 - protein, 9 aa, Influenza virus
DKHSNNTVR

SEQ ID NO: 437030 - protein, 9 aa, Influenza virus
DKICIGYHA

SEQ ID NO: 437031 - protein, 9 aa, Influenza virus
DKICIGYLS

SEQ ID NO: 437032 - protein, 9 aa, Influenza virus
DKICIGYQT

SEQ ID NO: 437033 - protein, 9 aa, Influenza virus
DKICLGHHA

SEQ ID NO: 437034 - protein, 9 aa, Influenza virus
DKICLGRHA

SEQ ID NO: 437035 - protein, 9 aa, Influenza virus
DKICVGYLS

SEQ ID NO: 437036 - protein, 9 aa, Influenza virus
DKIDDQIED

SEQ ID NO: 437037 - protein, 9 aa, Influenza virus
DKIDDQIEE

SEQ ID NO: 437038 - protein, 9 aa, Influenza virus
DKIDDQIEG

SEQ ID NO: 437039 - protein, 9 aa, Influenza virus
DKIDDQIEN

SEQ ID NO: 437040 - protein, 9 aa, Influenza virus
DKIDTLTET

SEQ ID NO: 437041 - protein, 9 aa, Influenza virus
DKINDQIED

SEQ ID NO: 437042 - protein, 9 aa, Influenza virus
DKITFEATG

SEQ ID NO: 437043 - protein, 9 aa, Influenza virus
DKITNKINN

SEQ ID NO: 437044 - protein, 9 aa, Influenza virus
DKITNKVNN

SEQ ID NO: 437045 - protein, 9 aa, Influenza virus
DKLTQGRQT

SEQ ID NO: 437046 - protein, 9 aa, Influenza virus
DKLYIWGIH

SEQ ID NO: 437047 - protein, 9 aa, Influenza virus
DKLYIWGVH

SEQ ID NO: 437048 - protein, 9 aa, Influenza virus
DKLYVWGIH

SEQ ID NO: 437049 - protein, 9 aa, Influenza virus
DKLYVWGVH

SEQ ID NO: 437050 - protein, 9 aa, Influenza virus
DKMNGNYDS

SEQ ID NO: 437051 - protein, 9 aa, Influenza virus
DKMNREFEV

SEQ ID NO: 437052 - protein, 9 aa, Influenza virus
DKMNREFGV

SEQ ID NO: 437053 - protein, 9 aa, Influenza virus
DKMNTQFEA

SEQ ID NO: 437054 - protein, 9 aa, Influenza virus
DKMNTQFET

SEQ ID NO: 437055 - protein, 9 aa, Influenza virus
DKMNTRFEA

SEQ ID NO: 437056 - protein, 9 aa, Influenza virus
DKNALGDCP

SEQ ID NO: 437057 - protein, 9 aa, Influenza virus
DKNALGECP

SEQ ID NO: 437058 - protein, 9 aa, Influenza virus
DKNATASFI

SEQ ID NO: 437059 - protein, 9 aa, Influenza virus
DKNSNGVQD

SEQ ID NO: 437060 - protein, 9 aa, Influenza virus
DKPFQNVNK

SEQ ID NO: 437061 - protein, 9 aa, Influenza virus
DKPFQNVNR

SEQ ID NO: 437062 - protein, 9 aa, Influenza virus
DKPFQNVSR

SEQ ID NO: 437063 - protein, 9 aa, Influenza virus
DKQTKTMTI

SEQ ID NO: 437064 - protein, 9 aa, Influenza virus
DKRIGSCTS

SEQ ID NO: 437065 - protein, 9 aa, Influenza virus
DKRYGPALS

SEQ ID NO: 437066 - protein, 9 aa, Influenza virus
DKTLDLHDA

SEQ ID NO: 437067 - protein, 9 aa, Influenza virus
DKTLDMHDA

SEQ ID NO: 437068 - protein, 9 aa, Influenza virus
DKTLNMHDA

SEQ ID NO: 437069 - protein, 9 aa, Influenza virus
DKTNQQFEL

SEQ ID NO: 437070 - protein, 9 aa, Influenza virus
DKTNQQFEM

SEQ ID NO: 437071 - protein, 9 aa, Influenza virus
DKTPYRSLI

SEQ ID NO: 437072 - protein, 9 aa, Influenza virus
DKTSTQKAI

SEQ ID NO: 437073 - protein, 9 aa, Influenza virus
DKVCTKGKK

SEQ ID NO: 437074 - protein, 9 aa, Influenza virus
DKVDTIIEN

SEQ ID NO: 437075 - protein, 9 aa, Influenza virus
DKVDTLLEN

SEQ ID NO: 437076 - protein, 9 aa, Influenza virus
DKVDTLTEN

SEQ ID NO: 437077 - protein, 9 aa, Influenza virus
DKVDTLTET

SEQ ID NO: 437078 - protein, 9 aa, Influenza virus
DKVNTIIEN

SEQ ID NO: 437079 - protein, 9 aa, Influenza virus
DKVRLQLKD

SEQ ID NO: 437080 - protein, 9 aa, Influenza virus
DKVRLQLRD

SEQ ID NO: 437081 - protein, 9 aa, Influenza virus
DKVRMQLKD

SEQ ID NO: 437082 - protein, 9 aa, Influenza virus
DKVRMQLRD

SEQ ID NO: 437083 - protein, 9 aa, Influenza virus
DKVSTQKAI

SEQ ID NO: 437084 - protein, 9 aa, Influenza virus
DKVSTQKAL

SEQ ID NO: 437085 - protein, 9 aa, Influenza virus
DKVWWTSNS

SEQ ID NO: 437086 - protein, 9 aa, Influenza virus
DKYHQIEKE

SEQ ID NO: 437087 - protein, 9 aa, Influenza virus
DLADSEMDK

SEQ ID NO: 437088 - protein, 9 aa, Influenza virus
DLADSEMKK

SEQ ID NO: 437089 - protein, 9 aa, Influenza virus
DLADSEMNK

SEQ ID NO: 437090 - protein, 9 aa, Influenza virus
DLADSEMSK

SEQ ID NO: 437091 - protein, 9 aa, Influenza virus
DLDNCHPIG

SEQ ID NO: 437092 - protein, 9 aa, Influenza virus
DLDYQIGYI

SEQ ID NO: 437093 - protein, 9 aa, Influenza virus
DLDYQIGYV

SEQ ID NO: 437094 - protein, 9 aa, Influenza virus
DLEALMEWI

SEQ ID NO: 437095 - protein, 9 aa, Influenza virus
DLEALMEWL

SEQ ID NO: 437096 - protein, 9 aa, Influenza virus
DLEKYVEDT

SEQ ID NO: 437097 - protein, 9 aa, Influenza virus
DLENYVEDT

SEQ ID NO: 437098 - protein, 9 aa, Influenza virus
DLERYVEDT

SEQ ID NO: 437099 - protein, 9 aa, Influenza virus
DLGAPLELR

SEQ ID NO: 437100 - protein, 9 aa, Influenza virus
DLGKCGLLG

SEQ ID NO: 437101 - protein, 9 aa, Influenza virus
DLGNCHPIG

SEQ ID NO: 437102 - protein, 9 aa, Influenza virus
DLGNCHPVG

SEQ ID NO: 437103 - protein, 9 aa, Influenza virus
DLGNGCFEF

SEQ ID NO: 437104 - protein, 9 aa, Influenza virus
DLGPATAQM

SEQ ID NO: 437105 - protein, 9 aa, Influenza virus
DLGQCGILG

SEQ ID NO: 437106 - protein, 9 aa, Influenza virus
DLGQCGLLG

SEQ ID NO: 437107 - protein, 9 aa, Influenza virus
DLGRCGLLG

SEQ ID NO: 437108 - protein, 9 aa, Influenza virus
DLGSCGILG

SEQ ID NO: 437109 - protein, 9 aa, Influenza virus
DLGSCHPIG

SEQ ID NO: 437110 - protein, 9 aa, Influenza virus
DLGSPLELR

SEQ ID NO: 437111 - protein, 9 aa, Influenza virus
DLGTPLELR

SEQ ID NO: 437112 - protein, 9 aa, Influenza virus
DLHDANVKN

SEQ ID NO: 437113 - protein, 9 aa, Influenza virus
DLHDANVRN

SEQ ID NO: 437114 - protein, 9 aa, Influenza virus
DLHDSNVKN

SEQ ID NO: 437115 - protein, 9 aa, Influenza virus
DLHDSNVRN

SEQ ID NO: 437116 - protein, 9 aa, Influenza virus
DLHDSNVRS

SEQ ID NO: 437117 - protein, 9 aa, Influenza virus
DLHLEFKAD

SEQ ID NO: 437118 - protein, 9 aa, Influenza virus
DLHLTGIWD

SEQ ID NO: 437119 - protein, 9 aa, Influenza virus
DLHLTGMWD

SEQ ID NO: 437120 - protein, 9 aa, Influenza virus
DLHLTGTWD

SEQ ID NO: 437121 - protein, 9 aa, Influenza virus
DLIENLQAY

SEQ ID NO: 437122 - protein, 9 aa, Influenza virus
DLIETNHTG

SEQ ID NO: 437123 - protein, 9 aa, Influenza virus
DLIETTHTG

SEQ ID NO: 437124 - protein, 9 aa, Influenza virus
DLIFLARSA

SEQ ID NO: 437125 - protein, 9 aa, Influenza virus
DLIFMARSA

SEQ ID NO: 437126 - protein, 9 aa, Influenza virus
DLIFSARSA

SEQ ID NO: 437127 - protein, 9 aa, Influenza virus
DLIGKNSWS

SEQ ID NO: 437128 - protein, 9 aa, Influenza virus
DLIGKTSWS

SEQ ID NO: 437129 - protein, 9 aa, Influenza virus
DLIIERKEG

SEQ ID NO: 437130 - protein, 9 aa, Influenza virus
DLIIERRDG

SEQ ID NO: 437131 - protein, 9 aa, Influenza virus
DLIIERREG

SEQ ID NO: 437132 - protein, 9 aa, Influenza virus
DLIIERRNS

SEQ ID NO: 437133 - protein, 9 aa, Influenza virus
DLILFNTIG

SEQ ID NO: 437134 - protein, 9 aa, Influenza virus
DLINGALGS

SEQ ID NO: 437135 - protein, 9 aa, Influenza virus
DLIVERQDG

SEQ ID NO: 437136 - protein, 9 aa, Influenza virus
DLIVERQEG

SEQ ID NO: 437137 - protein, 9 aa, Influenza virus
DLIVFNTIG

SEQ ID NO: 437138 - protein, 9 aa, Influenza virus
DLKSTQAAI

SEQ ID NO: 437139 - protein, 9 aa, Influenza virus
DLKSTQAAV

SEQ ID NO: 437140 - protein, 9 aa, Influenza virus
DLKSTQTAI

SEQ ID NO: 437141 - protein, 9 aa, Influenza virus
DLLDNLQAY

SEQ ID NO: 437142 - protein, 9 aa, Influenza virus
DLLENLQAY

SEQ ID NO: 437143 - protein, 9 aa, Influenza virus
DLLENLQTY

SEQ ID NO: 437144 - protein, 9 aa, Influenza virus
DLLVAMENQ

SEQ ID NO: 437145 - protein, 9 aa, Influenza virus
DLNFVNRAN

SEQ ID NO: 437146 - protein, 9 aa, Influenza virus
DLNMGQPFY

SEQ ID NO: 437147 - protein, 9 aa, Influenza virus
DLPFTQEQK

SEQ ID NO: 437148 - protein, 9 aa, Influenza virus
DLRSGYEML

SEQ ID NO: 437149 - protein, 9 aa, Influenza virus
DLRSGYETF

SEQ ID NO: 437150 - protein, 9 aa, Influenza virus
DLSFQGRGV

SEQ ID NO: 437151 - protein, 9 aa, Influenza virus
DLSQCGLLG

SEQ ID NO: 437152 - protein, 9 aa, Influenza virus
DLTDAEMNK

SEQ ID NO: 437153 - protein, 9 aa, Influenza virus
DLTDSEMNK

SEQ ID NO: 437154 - protein, 9 aa, Influenza virus
DLTDSEMSK

SEQ ID NO: 437155 - protein, 9 aa, Influenza virus
DLTFLARSA

SEQ ID NO: 437156 - protein, 9 aa, Influenza virus
DLTNSEMNK

SEQ ID NO: 437157 - protein, 9 aa, Influenza virus
DLVETNHTG

SEQ ID NO: 437158 - protein, 9 aa, Influenza virus
DLVETSHTG

SEQ ID NO: 437159 - protein, 9 aa, Influenza virus
DLWAYNAEL

SEQ ID NO: 437160 - protein, 9 aa, Influenza virus
DLWMGRTIS

SEQ ID NO: 437161 - protein, 9 aa, Influenza virus
DLWMGTTIS

SEQ ID NO: 437162 - protein, 9 aa, Influenza virus
DLWSYNAEL

SEQ ID NO: 437163 - protein, 9 aa, Influenza virus
DLWSYNAGL

SEQ ID NO: 437164 - protein, 9 aa, Influenza virus
DLWTYNAEL

SEQ ID NO: 437165 - protein, 9 aa, Influenza virus
DLYDYKEDR

SEQ ID NO: 437166 - protein, 9 aa, Influenza virus
DLYDYKENR

SEQ ID NO: 437167 - protein, 9 aa, Influenza virus
DLYDYKESR

SEQ ID NO: 437168 - protein, 9 aa, Influenza virus
DLYDYKKNR

SEQ ID NO: 437169 - protein, 9 aa, Influenza virus
DLYGTQPLS

SEQ ID NO: 437170 - protein, 9 aa, Influenza virus
DLYGTQSLS

SEQ ID NO: 437171 - protein, 9 aa, Influenza virus
DLYKVATGR

SEQ ID NO: 437172 - protein, 9 aa, Influenza virus
DLYLNGREW

SEQ ID NO: 437173 - protein, 9 aa, Influenza virus
DLYLSGREW

SEQ ID NO: 437174 - protein, 9 aa, Influenza virus
DLYLTGTWD

SEQ ID NO: 437175 - protein, 9 aa, Influenza virus
DMADSEMLN

SEQ ID NO: 437176 - protein, 9 aa, Influenza virus
DMADSTMLN

SEQ ID NO: 437177 - protein, 9 aa, Influenza virus
DMGDSEMLN

SEQ ID NO: 437178 - protein, 9 aa, Influenza virus
DMGNGCFKI

SEQ ID NO: 437179 - protein, 9 aa, Influenza virus
DMGNGCFRI

SEQ ID NO: 437180 - protein, 9 aa, Influenza virus
DMGNGCFTI

SEQ ID NO: 437181 - protein, 9 aa, Influenza virus
DMGNGCLKI

SEQ ID NO: 437182 - protein, 9 aa, Influenza virus
DMGQCGLLG

SEQ ID NO: 437183 - protein, 9 aa, Influenza virus
DMHDANVKN

SEQ ID NO: 437184 - protein, 9 aa, Influenza virus
DMHDANVRN

SEQ ID NO: 437185 - protein, 9 aa, Influenza virus
DMSIGITVI

SEQ ID NO: 437186 - protein, 9 aa, Influenza virus
DMSIGVAVI

SEQ ID NO: 437187 - protein, 9 aa, Influenza virus
DMSIGVTVI

SEQ ID NO: 437188 - protein, 9 aa, Influenza virus
DMTDSEMNK

SEQ ID NO: 437189 - protein, 9 aa, Influenza virus
DNADKICLG

SEQ ID NO: 437190 - protein, 9 aa, Influenza virus
DNAIDEGDG

SEQ ID NO: 437191 - protein, 9 aa, Influenza virus
DNAIRFGEG

SEQ ID NO: 437192 - protein, 9 aa, Influenza virus
DNAIRFGES

SEQ ID NO: 437193 - protein, 9 aa, Influenza virus
DNAIRIGED

SEQ ID NO: 437194 - protein, 9 aa, Influenza virus
DNAIRIGEE

SEQ ID NO: 437195 - protein, 9 aa, Influenza virus
DNAIRIGEN

SEQ ID NO: 437196 - protein, 9 aa, Influenza virus
DNAIRLGEN

SEQ ID NO: 437197 - protein, 9 aa, Influenza virus
DNAIRLGET

SEQ ID NO: 437198 - protein, 9 aa, Influenza virus
DNAIRPGEN

SEQ ID NO: 437199 - protein, 9 aa, Influenza virus
DNAKDEGNG

SEQ ID NO: 437200 - protein, 9 aa, Influenza virus
DNAKDLGNG

SEQ ID NO: 437201 - protein, 9 aa, Influenza virus
DNAKEIGNG

SEQ ID NO: 437202 - protein, 9 aa, Influenza virus
DNAKELGNG

SEQ ID NO: 437203 - protein, 9 aa, Influenza virus
DNAKEMGNG

SEQ ID NO: 437204 - protein, 9 aa, Influenza virus
DNAKETGNG

SEQ ID NO: 437205 - protein, 9 aa, Influenza virus
DNAKEVGNG

SEQ ID NO: 437206 - protein, 9 aa, Influenza virus
DNALRLAEN

SEQ ID NO: 437207 - protein, 9 aa, Influenza virus
DNANDLGNG

SEQ ID NO: 437208 - protein, 9 aa, Influenza virus
DNARELGNG

SEQ ID NO: 437209 - protein, 9 aa, Influenza virus
DNASAVVWY

SEQ ID NO: 437210 - protein, 9 aa, Influenza virus
DNATATVYY

SEQ ID NO: 437211 - protein, 9 aa, Influenza virus
DNAVRFGES

SEQ ID NO: 437212 - protein, 9 aa, Influenza virus
DNAVRIGED

SEQ ID NO: 437213 - protein, 9 aa, Influenza virus
DNAVRIGEN

SEQ ID NO: 437214 - protein, 9 aa, Influenza virus
DNAVRIGES

SEQ ID NO: 437215 - protein, 9 aa, Influenza virus
DNAVRLGEN

SEQ ID NO: 437216 - protein, 9 aa, Influenza virus
DNCMERIRN

SEQ ID NO: 437217 - protein, 9 aa, Influenza virus
DNCMESIRD

SEQ ID NO: 437218 - protein, 9 aa, Influenza virus
DNCMESIRN

SEQ ID NO: 437219 - protein, 9 aa, Influenza virus
DNDAYAVIH

SEQ ID NO: 437220 - protein, 9 aa, Influenza virus
DNDCESKCF

SEQ ID NO: 437221 - protein, 9 aa, Influenza virus
DNDNWSGYS

SEQ ID NO: 437222 - protein, 9 aa, Influenza virus
DNDPSGYAQ

SEQ ID NO: 437223 - protein, 9 aa, Influenza virus
DNEAVAVLK

SEQ ID NO: 437224 - protein, 9 aa, Influenza virus
DNECMETIK

SEQ ID NO: 437225 - protein, 9 aa, Influenza virus
DNEFTEVEQ

SEQ ID NO: 437226 - protein, 9 aa, Influenza virus
DNENATATV

SEQ ID NO: 437227 - protein, 9 aa, Influenza virus
DNEPGSGKL

SEQ ID NO: 437228 - protein, 9 aa, Influenza virus
DNEPGSGNW

SEQ ID NO: 437229 - protein, 9 aa, Influenza virus
DNEPNGYAQ

SEQ ID NO: 437230 - protein, 9 aa, Influenza virus
DNEPSGYAQ

SEQ ID NO: 437231 - protein, 9 aa, Influenza virus
DNEPTGYAQ

SEQ ID NO: 437232 - protein, 9 aa, Influenza virus
DNEQTDLYK

SEQ ID NO: 437233 - protein, 9 aa, Influenza virus
DNGAVAVLK

SEQ ID NO: 437234 - protein, 9 aa, Influenza virus
DNGAVAVVK

SEQ ID NO: 437235 - protein, 9 aa, Influenza virus
DNGDGCFEI

SEQ ID NO: 437236 - protein, 9 aa, Influenza virus
DNGGLIAPS

SEQ ID NO: 437237 - protein, 9 aa, Influenza virus
DNGIRIGSK

SEQ ID NO: 437238 - protein, 9 aa, Influenza virus
DNGIRIGSR

SEQ ID NO: 437239 - protein, 9 aa, Influenza virus
DNGIRVGSR

SEQ ID NO: 437240 - protein, 9 aa, Influenza virus
DNGVRIGSK

SEQ ID NO: 437241 - protein, 9 aa, Influenza virus
DNGVWIGRT

SEQ ID NO: 437242 - protein, 9 aa, Influenza virus
DNHSMSDIE

SEQ ID NO: 437243 - protein, 9 aa, Influenza virus
DNHVEVVSA

SEQ ID NO: 437244 - protein, 9 aa, Influenza virus
DNIEVTNAT

SEQ ID NO: 437245 - protein, 9 aa, Influenza virus
DNIIFSHNG

SEQ ID NO: 437246 - protein, 9 aa, Influenza virus
DNITFLHNG

SEQ ID NO: 437247 - protein, 9 aa, Influenza virus
DNITFSDNG

SEQ ID NO: 437248 - protein, 9 aa, Influenza virus
DNITFSHNG

SEQ ID NO: 437249 - protein, 9 aa, Influenza virus
DNIYKILSI

SEQ ID NO: 437250 - protein, 9 aa, Influenza virus
DNKCIESIR

SEQ ID NO: 437251 - protein, 9 aa, Influenza virus
DNKCMETIK

SEQ ID NO: 437252 - protein, 9 aa, Influenza virus
DNKHSNDTI

SEQ ID NO: 437253 - protein, 9 aa, Influenza virus
DNKHSNDTV

SEQ ID NO: 437254 - protein, 9 aa, Influenza virus
DNKHSNGTI

SEQ ID NO: 437255 - protein, 9 aa, Influenza virus
DNKNWSGYS

SEQ ID NO: 437256 - protein, 9 aa, Influenza virus
DNKTKKMTI

SEQ ID NO: 437257 - protein, 9 aa, Influenza virus
DNLEPGTFD

SEQ ID NO: 437258 - protein, 9 aa, Influenza virus
DNLIGKTSW

SEQ ID NO: 437259 - protein, 9 aa, Influenza virus
DNLNWSGYS

SEQ ID NO: 437260 - protein, 9 aa, Influenza virus
DNLQAYQKR

SEQ ID NO: 437261 - protein, 9 aa, Influenza virus
DNMQNKLNN

SEQ ID NO: 437262 - protein, 9 aa, Influenza virus
DNMQNRLNN

SEQ ID NO: 437263 - protein, 9 aa, Influenza virus
DNNCESKCF

SEQ ID NO: 437264 - protein, 9 aa, Influenza virus
DNNCIESIR

SEQ ID NO: 437265 - protein, 9 aa, Influenza virus
DNNCMESIR

SEQ ID NO: 437266 - protein, 9 aa, Influenza virus
DNNGELRHL

SEQ ID NO: 437267 - protein, 9 aa, Influenza virus
DNNIRIGSK

SEQ ID NO: 437268 - protein, 9 aa, Influenza virus
DNNKNATNP

SEQ ID NO: 437269 - protein, 9 aa, Influenza virus
DNNNRSGYS

SEQ ID NO: 437270 - protein, 9 aa, Influenza virus
DNNNWFGYF

SEQ ID NO: 437271 - protein, 9 aa, Influenza virus
DNNNWSGYS

SEQ ID NO: 437272 - protein, 9 aa, Influenza virus
DNNSWSGYS

SEQ ID NO: 437273 - protein, 9 aa, Influenza virus
DNPITGSPG

SEQ ID NO: 437274 - protein, 9 aa, Influenza virus
DNPNWSGYS

SEQ ID NO: 437275 - protein, 9 aa, Influenza virus
DNPRPNDPA

SEQ ID NO: 437276 - protein, 9 aa, Influenza virus
DNPRPNDPN

SEQ ID NO: 437277 - protein, 9 aa, Influenza virus
DNPRPNDPS

SEQ ID NO: 437278 - protein, 9 aa, Influenza virus
DNPRPNDPT

SEQ ID NO: 437279 - protein, 9 aa, Influenza virus
DNPRPNDPV

SEQ ID NO: 437280 - protein, 9 aa, Influenza virus
DNQCMESIR

SEQ ID NO: 437281 - protein, 9 aa, Influenza virus
DNQNWSGYS

SEQ ID NO: 437282 - protein, 9 aa, Influenza virus
DNQTKKMTI

SEQ ID NO: 437283 - protein, 9 aa, Influenza virus
DNQTKTMTI

SEQ ID NO: 437284 - protein, 9 aa, Influenza virus
DNQVFPQLN

SEQ ID NO: 437285 - protein, 9 aa, Influenza virus
DNRSGYSGI

SEQ ID NO: 437286 - protein, 9 aa, Influenza virus
DNSCESKCF

SEQ ID NO: 437287 - protein, 9 aa, Influenza virus
DNSCIESIR

SEQ ID NO: 437288 - protein, 9 aa, Influenza virus
DNSIQLSAG

SEQ ID NO: 437289 - protein, 9 aa, Influenza virus
DNSIRIGSK

SEQ ID NO: 437290 - protein, 9 aa, Influenza virus
DNSIRIGSR

SEQ ID NO: 437291 - protein, 9 aa, Influenza virus
DNSIRLAAG

SEQ ID NO: 437292 - protein, 9 aa, Influenza virus
DNSIRLSAD

SEQ ID NO: 437293 - protein, 9 aa, Influenza virus
DNSIRLSAG

SEQ ID NO: 437294 - protein, 9 aa, Influenza virus
DNSIRLSAS

SEQ ID NO: 437295 - protein, 9 aa, Influenza virus
DNSNWSGYS

SEQ ID NO: 437296 - protein, 9 aa, Influenza virus
DNSVRIGSK

SEQ ID NO: 437297 - protein, 9 aa, Influenza virus
DNSVRLSAG

SEQ ID NO: 437298 - protein, 9 aa, Influenza virus
DNSVRLSAS

SEQ ID NO: 437299 - protein, 9 aa, Influenza virus
DNTCIESIR

SEQ ID NO: 437300 - protein, 9 aa, Influenza virus
DNTKWNENQ

SEQ ID NO: 437301 - protein, 9 aa, Influenza virus
DNTWLGGTI

SEQ ID NO: 437302 - protein, 9 aa, Influenza virus
DNTWLGRTI

SEQ ID NO: 437303 - protein, 9 aa, Influenza virus
DNVKELGNG

SEQ ID NO: 437304 - protein, 9 aa, Influenza virus
DNVSWTSNS

SEQ ID NO: 437305 - protein, 9 aa, Influenza virus
DNVYKALSI

SEQ ID NO: 437306 - protein, 9 aa, Influenza virus
DNVYKILSI

SEQ ID NO: 437307 - protein, 9 aa, Influenza virus
DNVYKVLAI

SEQ ID NO: 437308 - protein, 9 aa, Influenza virus
DNVYKVLSI

SEQ ID NO: 437309 - protein, 9 aa, Influenza virus
DNVYRALSI

SEQ ID NO: 437310 - protein, 9 aa, Influenza virus
DNWHASNRP

SEQ ID NO: 437311 - protein, 9 aa, Influenza virus
DNWHGSNRP

SEQ ID NO: 437312 - protein, 9 aa, Influenza virus
DNWKGANRP

SEQ ID NO: 437313 - protein, 9 aa, Influenza virus
DNWKGSNRP

SEQ ID NO: 437314 - protein, 9 aa, Influenza virus
DNWMGSNRP

SEQ ID NO: 437315 - protein, 9 aa, Influenza virus
DNWNGMNRP

SEQ ID NO: 437316 - protein, 9 aa, Influenza virus
DNWQGANRP

SEQ ID NO: 437317 - protein, 9 aa, Influenza virus
DNWQGSNRP

SEQ ID NO: 437318 - protein, 9 aa, Influenza virus
DNWRGANRP

SEQ ID NO: 437319 - protein, 9 aa, Influenza virus
DNWRGSNRP

SEQ ID NO: 437320 - protein, 9 aa, Influenza virus
DNWSGYSGS

SEQ ID NO: 437321 - protein, 9 aa, Influenza virus
DNWTGTNRP

SEQ ID NO: 437322 - protein, 9 aa, Influenza virus
DNYGVKGFG

SEQ ID NO: 437323 - protein, 9 aa, Influenza virus
DPAAPHGLC

SEQ ID NO: 437324 - protein, 9 aa, Influenza virus
DPDECRFYA

SEQ ID NO: 437325 - protein, 9 aa, Influenza virus
DPDGCRFYA

SEQ ID NO: 437326 - protein, 9 aa, Influenza virus
DPDHEGEGI

SEQ ID NO: 437327 - protein, 9 aa, Influenza virus
DPDPFRLLQ

SEQ ID NO: 437328 - protein, 9 aa, Influenza virus
DPDYQIGYV

SEQ ID NO: 437329 - protein, 9 aa, Influenza virus
DPFKLLQNS

SEQ ID NO: 437330 - protein, 9 aa, Influenza virus
DPFKLLQTS

SEQ ID NO: 437331 - protein, 9 aa, Influenza virus
DPFRLLQNS

SEQ ID NO: 437332 - protein, 9 aa, Influenza virus
DPFRLLQSS

SEQ ID NO: 437333 - protein, 9 aa, Influenza virus
DPGAPHGLC

SEQ ID NO: 437334 - protein, 9 aa, Influenza virus
DPGDTVTFT

SEQ ID NO: 437335 - protein, 9 aa, Influenza virus
DPGVKGFAF

SEQ ID NO: 437336 - protein, 9 aa, Influenza virus
DPHLTGTWD

SEQ ID NO: 437337 - protein, 9 aa, Influenza virus
DPICIGYHA

SEQ ID NO: 437338 - protein, 9 aa, Influenza virus
DPIGCKMYA

SEQ ID NO: 437339 - protein, 9 aa, Influenza virus
DPKGLFGAI

SEQ ID NO: 437340 - protein, 9 aa, Influenza virus
DPKKTGGPI

SEQ ID NO: 437341 - protein, 9 aa, Influenza virus
DPLASLLEM

SEQ ID NO: 437342 - protein, 9 aa, Influenza virus
DPLGCKMYA

SEQ ID NO: 437343 - protein, 9 aa, Influenza virus
DPLGCRMYA

SEQ ID NO: 437344 - protein, 9 aa, Influenza virus
DPLLSLLEM

SEQ ID NO: 437345 - protein, 9 aa, Influenza virus
DPNALLKHR

SEQ ID NO: 437346 - protein, 9 aa, Influenza virus
DPNAPHKLC

SEQ ID NO: 437347 - protein, 9 aa, Influenza virus
DPNAPNKFC

SEQ ID NO: 437348 - protein, 9 aa, Influenza virus
DPNAPNKLC

SEQ ID NO: 437349 - protein, 9 aa, Influenza virus
DPNDERGNP

SEQ ID NO: 437350 - protein, 9 aa, Influenza virus
DPNECRFYA

SEQ ID NO: 437351 - protein, 9 aa, Influenza virus
DPNEERGNP

SEQ ID NO: 437352 - protein, 9 aa, Influenza virus
DPNEERGSP

SEQ ID NO: 437353 - protein, 9 aa, Influenza virus
DPNHEGEGI

SEQ ID NO: 437354 - protein, 9 aa, Influenza virus
DPNNEKGNP

SEQ ID NO: 437355 - protein, 9 aa, Influenza virus
DPNNERGNP

SEQ ID NO: 437356 - protein, 9 aa, Influenza virus
DPNNMDKAV

SEQ ID NO: 437357 - protein, 9 aa, Influenza virus
DPNNMDRAV

SEQ ID NO: 437358 - protein, 9 aa, Influenza virus
DPNTLLKHR

SEQ ID NO: 437359 - protein, 9 aa, Influenza virus
DPNVLLKHR

SEQ ID NO: 437360 - protein, 9 aa, Influenza virus
DPNWSGYSG

SEQ ID NO: 437361 - protein, 9 aa, Influenza virus
DPPYSHGTG

SEQ ID NO: 437362 - protein, 9 aa, Influenza virus
DPRMCSLMQ

SEQ ID NO: 437363 - protein, 9 aa, Influenza virus
DPSAPHGLC

SEQ ID NO: 437364 - protein, 9 aa, Influenza virus
DPSAPHRLC

SEQ ID NO: 437365 - protein, 9 aa, Influenza virus
DPSGCKMYA

SEQ ID NO: 437366 - protein, 9 aa, Influenza virus
DPSGYAQTD

SEQ ID NO: 437367 - protein, 9 aa, Influenza virus
DPSHEGEGI

SEQ ID NO: 437368 - protein, 9 aa, Influenza virus
DPSIMSCDS

SEQ ID NO: 437369 - protein, 9 aa, Influenza virus
DPSNMDRAV

SEQ ID NO: 437370 - protein, 9 aa, Influenza virus
DPSTISCDS

SEQ ID NO: 437371 - protein, 9 aa, Influenza virus
DPSTMSCDS

SEQ ID NO: 437372 - protein, 9 aa, Influenza virus
DPSTVSCDS

SEQ ID NO: 437373 - protein, 9 aa, Influenza virus
DPSVVSCDS

SEQ ID NO: 437374 - protein, 9 aa, Influenza virus
DPTAPHGLC

SEQ ID NO: 437375 - protein, 9 aa, Influenza virus
DPTGCKMYA

SEQ ID NO: 437376 - protein, 9 aa, Influenza virus
DPVELSSGY

SEQ ID NO: 437377 - protein, 9 aa, Influenza virus
DPVKLSGGY

SEQ ID NO: 437378 - protein, 9 aa, Influenza virus
DPVKLSNGY

SEQ ID NO: 437379 - protein, 9 aa, Influenza virus
DPVKLSSGY

SEQ ID NO: 437380 - protein, 9 aa, Influenza virus
DPWVLLNAS

SEQ ID NO: 437381 - protein, 9 aa, Influenza virus
DPYLNGREW

SEQ ID NO: 437382 - protein, 9 aa, Influenza virus
DPYPGNNBN

SEQ ID NO: 437383 - protein, 9 aa, Influenza virus
DPYPGNNNG

SEQ ID NO: 437384 - protein, 9 aa, Influenza virus
DPYPGNNNN

SEQ ID NO: 437385 - protein, 9 aa, Influenza virus
DPYPGSNNN

SEQ ID NO: 437386 - protein, 9 aa, Influenza virus
DQADSEMNK

SEQ ID NO: 437387 - protein, 9 aa, Influenza virus
DQAWSYIVE

SEQ ID NO: 437388 - protein, 9 aa, Influenza virus
DQCMESIRN

SEQ ID NO: 437389 - protein, 9 aa, Influenza virus
DQDWSYIVE

SEQ ID NO: 437390 - protein, 9 aa, Influenza virus
DQELGDAPF

SEQ ID NO: 437391 - protein, 9 aa, Influenza virus
DQGAGYAAD

SEQ ID NO: 437392 - protein, 9 aa, Influenza virus
DQGNGCFEI

SEQ ID NO: 437393 - protein, 9 aa, Influenza virus
DQGSGYAAD

SEQ ID NO: 437394 - protein, 9 aa, Influenza virus
DQGTGQAAD

SEQ ID NO: 437395 - protein, 9 aa, Influenza virus
DQGWSYIVE

SEQ ID NO: 437396 - protein, 9 aa, Influenza virus
DQICIGHHA

SEQ ID NO: 437397 - protein, 9 aa, Influenza virus
DQICIGYHA

SEQ ID NO: 437398 - protein, 9 aa, Influenza virus
DQICIGYHS

SEQ ID NO: 437399 - protein, 9 aa, Influenza virus
DQICVGYHA

SEQ ID NO: 437400 - protein, 9 aa, Influenza virus
DQICVGYHS

SEQ ID NO: 437401 - protein, 9 aa, Influenza virus
DQIEDLWAY

SEQ ID NO: 437402 - protein, 9 aa, Influenza virus
DQIEELWAY

SEQ ID NO: 437403 - protein, 9 aa, Influenza virus
DQIEGLWAY

SEQ ID NO: 437404 - protein, 9 aa, Influenza virus
DQIENLWAY

SEQ ID NO: 437405 - protein, 9 aa, Influenza virus
DQIEVTNAT

SEQ ID NO: 437406 - protein, 9 aa, Influenza virus
DQIIDIWAY

SEQ ID NO: 437407 - protein, 9 aa, Influenza virus
DQINGKLNR

SEQ ID NO: 437408 - protein, 9 aa, Influenza virus
DQIQDIWAY

SEQ ID NO: 437409 - protein, 9 aa, Influenza virus
DQIQDLWAY

SEQ ID NO: 437410 - protein, 9 aa, Influenza virus
DQIQDVWAY

SEQ ID NO: 437411 - protein, 9 aa, Influenza virus
DQIQNIWAY

SEQ ID NO: 437412 - protein, 9 aa, Influenza virus
DQISGKLNR

SEQ ID NO: 437413 - protein, 9 aa, Influenza virus
DQISIVPNI

SEQ ID NO: 437414 - protein, 9 aa, Influenza virus
DQITDIWAY

SEQ ID NO: 437415 - protein, 9 aa, Influenza virus
DQITGKLNH

SEQ ID NO: 437416 - protein, 9 aa, Influenza virus
DQITGKLNR

SEQ ID NO: 437417 - protein, 9 aa, Influenza virus
DQITGTLNR

SEQ ID NO: 437418 - protein, 9 aa, Influenza virus
DQITTKINN

SEQ ID NO: 437419 - protein, 9 aa, Influenza virus
DQKSLRGRG

SEQ ID NO: 437420 - protein, 9 aa, Influenza virus
DQKSTQEAI

SEQ ID NO: 437421 - protein, 9 aa, Influenza virus
DQLKLATGL

SEQ ID NO: 437422 - protein, 9 aa, Influenza virus
DQNFRNIRK

SEQ ID NO: 437423 - protein, 9 aa, Influenza virus
DQSLIIAAR

SEQ ID NO: 437424 - protein, 9 aa, Influenza virus
DQSLPPNFP

SEQ ID NO: 437425 - protein, 9 aa, Influenza virus
DQSLPPNFS

SEQ ID NO: 437426 - protein, 9 aa, Influenza virus
DQSLVIAAR

SEQ ID NO: 437427 - protein, 9 aa, Influenza virus
DQSWSYIVE

SEQ ID NO: 437428 - protein, 9 aa, Influenza virus
DQVEVTNAT

SEQ ID NO: 437429 - protein, 9 aa, Influenza virus
DQVKLSSGY

SEQ ID NO: 437430 - protein, 9 aa, Influenza virus
DQVREGRNP

SEQ ID NO: 437431 - protein, 9 aa, Influenza virus
DQVRESRNP

SEQ ID NO: 437432 - protein, 9 aa, Influenza virus
DQVTDIWAY

SEQ ID NO: 437433 - protein, 9 aa, Influenza virus
DQVTGKLNR

SEQ ID NO: 437434 - protein, 9 aa, Influenza virus
DRAAFRGLI

SEQ ID NO: 437435 - protein, 9 aa, Influenza virus
DRAPYRSLI

SEQ ID NO: 437436 - protein, 9 aa, Influenza virus
DRATFLRSN

SEQ ID NO: 437437 - protein, 9 aa, Influenza virus
DRAVKLYKK

SEQ ID NO: 437438 - protein, 9 aa, Influenza virus
DRAVKLYRK

SEQ ID NO: 437439 - protein, 9 aa, Influenza virus
DRDSTQKAI

SEQ ID NO: 437440 - protein, 9 aa, Influenza virus
DRDSTQMAI

SEQ ID NO: 437441 - protein, 9 aa, Influenza virus
DRDSTQRAI

SEQ ID NO: 437442 - protein, 9 aa, Influenza virus
DRFLRVKDQ

SEQ ID NO: 437443 - protein, 9 aa, Influenza virus
DRFLRVRDQ

SEQ ID NO: 437444 - protein, 9 aa, Influenza virus
DRFYRICKL

SEQ ID NO: 437445 - protein, 9 aa, Influenza virus
DRFYRTCKL

SEQ ID NO: 437446 - protein, 9 aa, Influenza virus
DRGLFGAIA

SEQ ID NO: 437447 - protein, 9 aa, Influenza virus
DRGLFGAKA

SEQ ID NO: 437448 - protein, 9 aa, Influenza virus
DRGNGCFEI

SEQ ID NO: 437449 - protein, 9 aa, Influenza virus
DRGSTQKAI

SEQ ID NO: 437450 - protein, 9 aa, Influenza virus
DRHSNGTIK

SEQ ID NO: 437451 - protein, 9 aa, Influenza virus
DRHSNGTVK

SEQ ID NO: 437452 - protein, 9 aa, Influenza virus
DRICIGYHA

SEQ ID NO: 437453 - protein, 9 aa, Influenza virus
DRICIGYLS

SEQ ID NO: 437454 - protein, 9 aa, Influenza virus
DRICIGYQS

SEQ ID NO: 437455 - protein, 9 aa, Influenza virus
DRICLGHHA

SEQ ID NO: 437456 - protein, 9 aa, Influenza virus
DRICVGYHA

SEQ ID NO: 437457 - protein, 9 aa, Influenza virus
DRICVGYLS

SEQ ID NO: 437458 - protein, 9 aa, Influenza virus
DRIDDAVTD

SEQ ID NO: 437459 - protein, 9 aa, Influenza virus
DRIEVTNAT

SEQ ID NO: 437460 - protein, 9 aa, Influenza virus
DRIPHRTLL

SEQ ID NO: 437461 - protein, 9 aa, Influenza virus
DRIQDIWAY

SEQ ID NO: 437462 - protein, 9 aa, Influenza virus
DRIRRDQKS

SEQ ID NO: 437463 - protein, 9 aa, Influenza virus
DRISHRTLL

SEQ ID NO: 437464 - protein, 9 aa, Influenza virus
DRITTKINN

SEQ ID NO: 437465 - protein, 9 aa, Influenza virus
DRLQDTTWD

SEQ ID NO: 437466 - protein, 9 aa, Influenza virus
DRLRRDQKA

SEQ ID NO: 437467 - protein, 9 aa, Influenza virus
DRLRRDQKS

SEQ ID NO: 437468 - protein, 9 aa, Influenza virus
DRLRRDQRA

SEQ ID NO: 437469 - protein, 9 aa, Influenza virus
DRLRRDQRS

SEQ ID NO: 437470 - protein, 9 aa, Influenza virus
DRLTQGRQT

SEQ ID NO: 437471 - protein, 9 aa, Influenza virus
DRLVLATGL

SEQ ID NO: 437472 - protein, 9 aa, Influenza virus
DRMIKAVRG

SEQ ID NO: 437473 - protein, 9 aa, Influenza virus
DRNAIGDCP

SEQ ID NO: 437474 - protein, 9 aa, Influenza virus
DRNALGDCP

SEQ ID NO: 437475 - protein, 9 aa, Influenza virus
DRNATASFI

SEQ ID NO: 437476 - protein, 9 aa, Influenza virus
DRNATASLI

SEQ ID NO: 437477 - protein, 9 aa, Influenza virus
DRNFWRGDN

SEQ ID NO: 437478 - protein, 9 aa, Influenza virus
DRNFWRGEN

SEQ ID NO: 437479 - protein, 9 aa, Influenza virus
DRPKVNGQA

SEQ ID NO: 437480 - protein, 9 aa, Influenza virus
DRPLVNGQR

SEQ ID NO: 437481 - protein, 9 aa, Influenza virus
DRRLTTTIK

SEQ ID NO: 437482 - protein, 9 aa, Influenza virus
DRRYGPALS

SEQ ID NO: 437483 - protein, 9 aa, Influenza virus
DRSFRPNIG

SEQ ID NO: 437484 - protein, 9 aa, Influenza virus
DRSPFRALI

SEQ ID NO: 437485 - protein, 9 aa, Influenza virus
DRSPFRALM

SEQ ID NO: 437486 - protein, 9 aa, Influenza virus
DRSPFRALV

SEQ ID NO: 437487 - protein, 9 aa, Influenza virus
DRSPFRTLM

SEQ ID NO: 437488 - protein, 9 aa, Influenza virus
DRSPHRALM

SEQ ID NO: 437489 - protein, 9 aa, Influenza virus
DRSPHRTLL

SEQ ID NO: 437490 - protein, 9 aa, Influenza virus
DRSPHRTLM

SEQ ID NO: 437491 - protein, 9 aa, Influenza virus
DRSPQRTLM

SEQ ID NO: 437492 - protein, 9 aa, Influenza virus
DRSPYRALI

SEQ ID NO: 437493 - protein, 9 aa, Influenza virus
DRSPYRALM

SEQ ID NO: 437494 - protein, 9 aa, Influenza virus
DRSPYRTLL

SEQ ID NO: 437495 - protein, 9 aa, Influenza virus
DRSPYRTLM

SEQ ID NO: 437496 - protein, 9 aa, Influenza virus
DRSQFRALI

SEQ ID NO: 437497 - protein, 9 aa, Influenza virus
DRSQYRALI

SEQ ID NO: 437498 - protein, 9 aa, Influenza virus
DRSQYRALV

SEQ ID NO: 437499 - protein, 9 aa, Influenza virus
DRSQYRSLI

SEQ ID NO: 437500 - protein, 9 aa, Influenza virus
DRTAFRGLI

SEQ ID NO: 437501 - protein, 9 aa, Influenza virus
DRTAFRGLM

SEQ ID NO: 437502 - protein, 9 aa, Influenza virus
DRTLDLHDA

SEQ ID NO: 437503 - protein, 9 aa, Influenza virus
DRTNHQFEL

SEQ ID NO: 437504 - protein, 9 aa, Influenza virus
DRTPHRTLL

SEQ ID NO: 437505 - protein, 9 aa, Influenza virus
DRTPYRSLI

SEQ ID NO: 437506 - protein, 9 aa, Influenza virus
DRTPYRTLL

SEQ ID NO: 437507 - protein, 9 aa, Influenza virus
DRTSHRTLL

SEQ ID NO: 437508 - protein, 9 aa, Influenza virus
DRTSYRSLI

SEQ ID NO: 437509 - protein, 9 aa, Influenza virus
DRTSYRTLL

SEQ ID NO: 437510 - protein, 9 aa, Influenza virus
DRTTFRGLI

SEQ ID NO: 437511 - protein, 9 aa, Influenza virus
DRTTFRGLL

SEQ ID NO: 437512 - protein, 9 aa, Influenza virus
DRVDDAVTD

SEQ ID NO: 437513 - protein, 9 aa, Influenza virus
DRVRKQLRQ

SEQ ID NO: 437514 - protein, 9 aa, Influenza virus
DRVRLQLRD

SEQ ID NO: 437515 - protein, 9 aa, Influenza virus
DRVRMQLRD

SEQ ID NO: 437516 - protein, 9 aa, Influenza virus
DRVWWTSNS

SEQ ID NO: 437517 - protein, 9 aa, Influenza virus
DSCMDTIRN

SEQ ID NO: 437518 - protein, 9 aa, Influenza virus
DSCMEAIRN

SEQ ID NO: 437519 - protein, 9 aa, Influenza virus
DSCMESIRN

SEQ ID NO: 437520 - protein, 9 aa, Influenza virus
DSCMETIRN

SEQ ID NO: 437521 - protein, 9 aa, Influenza virus
DSDILVTRE

SEQ ID NO: 437522 - protein, 9 aa, Influenza virus
DSDVLVTRE

SEQ ID NO: 437523 - protein, 9 aa, Influenza virus
DSECVSHNG

SEQ ID NO: 437524 - protein, 9 aa, Influenza virus
DSEIKKLYE

SEQ ID NO: 437525 - protein, 9 aa, Influenza virus
DSEMDKLFE

SEQ ID NO: 437526 - protein, 9 aa, Influenza virus
DSEMDKLYE

SEQ ID NO: 437527 - protein, 9 aa, Influenza virus
DSEMKKLYE

SEQ ID NO: 437528 - protein, 9 aa, Influenza virus
DSEMLNLYD

SEQ ID NO: 437529 - protein, 9 aa, Influenza virus
DSEMLNLYE

SEQ ID NO: 437530 - protein, 9 aa, Influenza virus
DSEMNKLFE

SEQ ID NO: 437531 - protein, 9 aa, Influenza virus
DSEMNKLYE

SEQ ID NO: 437532 - protein, 9 aa, Influenza virus
DSEMNNLYE

SEQ ID NO: 437533 - protein, 9 aa, Influenza virus
DSEMNRLFE

SEQ ID NO: 437534 - protein, 9 aa, Influenza virus
DSEMSKLFE

SEQ ID NO: 437535 - protein, 9 aa, Influenza virus
DSEMSKLYE

SEQ ID NO: 437536 - protein, 9 aa, Influenza virus
DSFRQSERG

SEQ ID NO: 437537 - protein, 9 aa, Influenza virus
DSFYAELKW

SEQ ID NO: 437538 - protein, 9 aa, Influenza virus
DSFYRNLIW

SEQ ID NO: 437539 - protein, 9 aa, Influenza virus
DSFYRSMKW

SEQ ID NO: 437540 - protein, 9 aa, Influenza virus
DSGAVAVLK

SEQ ID NO: 437541 - protein, 9 aa, Influenza virus
DSGYVCSGL

SEQ ID NO: 437542 - protein, 9 aa, Influenza virus
DSHHRSHRQ

SEQ ID NO: 437543 - protein, 9 aa, Influenza virus
DSHLKFKAD

SEQ ID NO: 437544 - protein, 9 aa, Influenza virus
DSIGSWSHN

SEQ ID NO: 437545 - protein, 9 aa, Influenza virus
DSIGSWSQN

SEQ ID NO: 437546 - protein, 9 aa, Influenza virus
DSIIFNSIG

SEQ ID NO: 437547 - protein, 9 aa, Influenza virus
DSIKSWRKD

SEQ ID NO: 437548 - protein, 9 aa, Influenza virus
DSIKSWRRD

SEQ ID NO: 437549 - protein, 9 aa, Influenza virus
DSIRGEFNQ

SEQ ID NO: 437550 - protein, 9 aa, Influenza virus
DSIRGEFSQ

SEQ ID NO: 437551 - protein, 9 aa, Influenza virus
DSITDIWTY

SEQ ID NO: 437552 - protein, 9 aa, Influenza virus
DSITEVWSY

SEQ ID NO: 437553 - protein, 9 aa, Influenza virus
DSITFSHNG

SEQ ID NO: 437554 - protein, 9 aa, Influenza virus
DSIVSWSQN

SEQ ID NO: 437555 - protein, 9 aa, Influenza virus
DSLEPGTFD

SEQ ID NO: 437556 - protein, 9 aa, Influenza virus
DSLKLSIED

SEQ ID NO: 437557 - protein, 9 aa, Influenza virus
DSLNITAAS

SEQ ID NO: 437558 - protein, 9 aa, Influenza virus
DSLTEIWSY

SEQ ID NO: 437559 - protein, 9 aa, Influenza virus
DSMTEIWSY

SEQ ID NO: 437560 - protein, 9 aa, Influenza virus
DSMTEVMVV

SEQ ID NO: 437561 - protein, 9 aa, Influenza virus
DSMTEVWSY

SEQ ID NO: 437562 - protein, 9 aa, Influenza virus
DSNALLKHR

SEQ ID NO: 437563 - protein, 9 aa, Influenza virus
DSNGNFIAP

SEQ ID NO: 437564 - protein, 9 aa, Influenza virus
DSNGVQDII

SEQ ID NO: 437565 - protein, 9 aa, Influenza virus
DSNVENLFD

SEQ ID NO: 437566 - protein, 9 aa, Influenza virus
DSNVKNLFD

SEQ ID NO: 437567 - protein, 9 aa, Influenza virus
DSNVKNLYD

SEQ ID NO: 437568 - protein, 9 aa, Influenza virus
DSNVKNLYE

SEQ ID NO: 437569 - protein, 9 aa, Influenza virus
DSNVKNLYN

SEQ ID NO: 437570 - protein, 9 aa, Influenza virus
DSNVKSLYD

SEQ ID NO: 437571 - protein, 9 aa, Influenza virus
DSNVRNLHE

SEQ ID NO: 437572 - protein, 9 aa, Influenza virus
DSNVRNLYD

SEQ ID NO: 437573 - protein, 9 aa, Influenza virus
DSNVRSLHE

SEQ ID NO: 437574 - protein, 9 aa, Influenza virus
DSNVTNLHE

SEQ ID NO: 437575 - protein, 9 aa, Influenza virus
DSNYVCSGL

SEQ ID NO: 437576 - protein, 9 aa, Influenza virus
DSPSNANGG

SEQ ID NO: 437577 - protein, 9 aa, Influenza virus
DSPSNINGE

SEQ ID NO: 437578 - protein, 9 aa, Influenza virus
DSPSNINGG

SEQ ID NO: 437579 - protein, 9 aa, Influenza virus
DSPSNVKGG

SEQ ID NO: 437580 - protein, 9 aa, Influenza virus
DSPSNVNGG

SEQ ID NO: 437581 - protein, 9 aa, Influenza virus
DSQHKSHRQ

SEQ ID NO: 437582 - protein, 9 aa, Influenza virus
DSQHRSHRQ

SEQ ID NO: 437583 - protein, 9 aa, Influenza virus
DSQTATKRI

SEQ ID NO: 437584 - protein, 9 aa, Influenza virus
DSQTATKRL

SEQ ID NO: 437585 - protein, 9 aa, Influenza virus
DSRAVGKCP

SEQ ID NO: 437586 - protein, 9 aa, Influenza virus
DSRSGYEIL

SEQ ID NO: 437587 - protein, 9 aa, Influenza virus
DSRSGYEML

SEQ ID NO: 437588 - protein, 9 aa, Influenza virus
DSRSGYETF

SEQ ID NO: 437589 - protein, 9 aa, Influenza virus
DSRSGYEVL

SEQ ID NO: 437590 - protein, 9 aa, Influenza virus
DSSFYAEMK

SEQ ID NO: 437591 - protein, 9 aa, Influenza virus
DSSILTDSQ

SEQ ID NO: 437592 - protein, 9 aa, Influenza virus
DSSYICSGL

SEQ ID NO: 437593 - protein, 9 aa, Influenza virus
DSSYLCSGL

SEQ ID NO: 437594 - protein, 9 aa, Influenza virus
DSSYVCSGL

SEQ ID NO: 437595 - protein, 9 aa, Influenza virus
DSTAVAVIK

SEQ ID NO: 437596 - protein, 9 aa, Influenza virus
DSTDSEMNK

SEQ ID NO: 437597 - protein, 9 aa, Influenza virus
DSTQKAIDI

SEQ ID NO: 437598 - protein, 9 aa, Influenza virus
DSTQKAIDN

SEQ ID NO: 437599 - protein, 9 aa, Influenza virus
DSTQMAIDN

SEQ ID NO: 437600 - protein, 9 aa, Influenza virus
DSTQRAIDN

SEQ ID NO: 437601 - protein, 9 aa, Influenza virus
DSTWLGRTI

SEQ ID NO: 437602 - protein, 9 aa, Influenza virus
DSVGSWSQN

SEQ ID NO: 437603 - protein, 9 aa, Influenza virus
DSVKLSSGY

SEQ ID NO: 437604 - protein, 9 aa, Influenza virus
DSVTELWSY

SEQ ID NO: 437605 - protein, 9 aa, Influenza virus
DSVYKALSI

SEQ ID NO: 437606 - protein, 9 aa, Influenza virus
DSWAVGRCP

SEQ ID NO: 437607 - protein, 9 aa, Influenza virus
DTCYPFDVP

SEQ ID NO: 437608 - protein, 9 aa, Influenza virus
DTDVVNFLS

SEQ ID NO: 437609 - protein, 9 aa, Influenza virus
DTDVVNFVS

SEQ ID NO: 437610 - protein, 9 aa, Influenza virus
DTDVVNYVS

SEQ ID NO: 437611 - protein, 9 aa, Influenza virus
DTDVYCICR

SEQ ID NO: 437612 - protein, 9 aa, Influenza virus
DTEISFTIT

SEQ ID NO: 437613 - protein, 9 aa, Influenza virus
DTELSFTIT

SEQ ID NO: 437614 - protein, 9 aa, Influenza virus
DTELSFTVT

SEQ ID NO: 437615 - protein, 9 aa, Influenza virus
DTFKSWKGN

SEQ ID NO: 437616 - protein, 9 aa, Influenza virus
DTGDGCFEI

SEQ ID NO: 437617 - protein, 9 aa, Influenza virus
DTGKGCFDI

SEQ ID NO: 437618 - protein, 9 aa, Influenza virus
DTGNGCFDI

SEQ ID NO: 437619 - protein, 9 aa, Influenza virus
DTHIHIFSF

SEQ ID NO: 437620 - protein, 9 aa, Influenza virus
DTICIGYHA

SEQ ID NO: 437621 - protein, 9 aa, Influenza virus
DTICVGYHA

SEQ ID NO: 437622 - protein, 9 aa, Influenza virus
DTIEERFEI

SEQ ID NO: 437623 - protein, 9 aa, Influenza virus
DTIIENNVT

SEQ ID NO: 437624 - protein, 9 aa, Influenza virus
DTIIESNVT

SEQ ID NO: 437625 - protein, 9 aa, Influenza virus
DTIIFEANG

SEQ ID NO: 437626 - protein, 9 aa, Influenza virus
DTIIFEASG

SEQ ID NO: 437627 - protein, 9 aa, Influenza virus
DTIIFEATG

SEQ ID NO: 437628 - protein, 9 aa, Influenza virus
DTILEKNIT

SEQ ID NO: 437629 - protein, 9 aa, Influenza virus
DTILEKNVT

SEQ ID NO: 437630 - protein, 9 aa, Influenza virus
DTILEQNVT

SEQ ID NO: 437631 - protein, 9 aa, Influenza virus
DTILERNVT

SEQ ID NO: 437632 - protein, 9 aa, Influenza virus
DTIMEKNVI

SEQ ID NO: 437633 - protein, 9 aa, Influenza virus
DTIMEKNVT

SEQ ID NO: 437634 - protein, 9 aa, Influenza virus
DTIMEKSVT

SEQ ID NO: 437635 - protein, 9 aa, Influenza virus
DTIMERNVT

SEQ ID NO: 437636 - protein, 9 aa, Influenza virus
DTINFESTG

SEQ ID NO: 437637 - protein, 9 aa, Influenza virus
DTINYYNET

SEQ ID NO: 437638 - protein, 9 aa, Influenza virus
DTIRNGTYN

SEQ ID NO: 437639 - protein, 9 aa, Influenza virus
DTISFESTG

SEQ ID NO: 437640 - protein, 9 aa, Influenza virus
DTITFEATG

SEQ ID NO: 437641 - protein, 9 aa, Influenza virus
DTITFSFNG

SEQ ID NO: 437642 - protein, 9 aa, Influenza virus
DTKCQTPLG

SEQ ID NO: 437643 - protein, 9 aa, Influenza virus
DTKIDLWSY

SEQ ID NO: 437644 - protein, 9 aa, Influenza virus
DTKILFIEE

SEQ ID NO: 437645 - protein, 9 aa, Influenza virus
DTKVDLWSY

SEQ ID NO: 437646 - protein, 9 aa, Influenza virus
DTLCIGYHA

SEQ ID NO: 437647 - protein, 9 aa, Influenza virus
DTLIERDNA

SEQ ID NO: 437648 - protein, 9 aa, Influenza virus
DTLIERDNS

SEQ ID NO: 437649 - protein, 9 aa, Influenza virus
DTLIERENA

SEQ ID NO: 437650 - protein, 9 aa, Influenza virus
DTLIERENS

SEQ ID NO: 437651 - protein, 9 aa, Influenza virus
DTLIERGSS

SEQ ID NO: 437652 - protein, 9 aa, Influenza virus
DTLKSWKGN

SEQ ID NO: 437653 - protein, 9 aa, Influenza virus
DTLLEKNVT

SEQ ID NO: 437654 - protein, 9 aa, Influenza virus
DTLLENDVP

SEQ ID NO: 437655 - protein, 9 aa, Influenza virus
DTLLENGVP

SEQ ID NO: 437656 - protein, 9 aa, Influenza virus
DTLLENNVP

SEQ ID NO: 437657 - protein, 9 aa, Influenza virus
DTLLESDVP

SEQ ID NO: 437658 - protein, 9 aa, Influenza virus
DTLTEKGIE

SEQ ID NO: 437659 - protein, 9 aa, Influenza virus
DTLTENGVP

SEQ ID NO: 437660 - protein, 9 aa, Influenza virus
DTLTETGVP

SEQ ID NO: 437661 - protein, 9 aa, Influenza virus
DTNKTFQNI

SEQ ID NO: 437662 - protein, 9 aa, Influenza virus
DTPRGEDAQ

SEQ ID NO: 437663 - protein, 9 aa, Influenza virus
DTPRGEDGQ

SEQ ID NO: 437664 - protein, 9 aa, Influenza virus
DTPRGEDNQ

SEQ ID NO: 437665 - protein, 9 aa, Influenza virus
DTPRGEDSQ

SEQ ID NO: 437666 - protein, 9 aa, Influenza virus
DTPRNDDRF

SEQ ID NO: 437667 - protein, 9 aa, Influenza virus
DTPRNDDRS

SEQ ID NO: 437668 - protein, 9 aa, Influenza virus
DTPRNDDSS

SEQ ID NO: 437669 - protein, 9 aa, Influenza virus
DTPRNEDGS

SEQ ID NO: 437670 - protein, 9 aa, Influenza virus
DTPRNEDSS

SEQ ID NO: 437671 - protein, 9 aa, Influenza virus
DTPRNGDSS

SEQ ID NO: 437672 - protein, 9 aa, Influenza virus
DTPRPADPS

SEQ ID NO: 437673 - protein, 9 aa, Influenza virus
DTPRPDDPS

SEQ ID NO: 437674 - protein, 9 aa, Influenza virus
DTPRPSDPS

SEQ ID NO: 437675 - protein, 9 aa, Influenza virus
DTPRPTDPS

SEQ ID NO: 437676 - protein, 9 aa, Influenza virus
DTPRPVDPS

SEQ ID NO: 437677 - protein, 9 aa, Influenza virus
DTPRSDDSS

SEQ ID NO: 437678 - protein, 9 aa, Influenza virus
DTRILFIEE

SEQ ID NO: 437679 - protein, 9 aa, Influenza virus
DTRILFIKE

SEQ ID NO: 437680 - protein, 9 aa, Influenza virus
DTRILFIRE

SEQ ID NO: 437681 - protein, 9 aa, Influenza virus
DTRILFVKE

SEQ ID NO: 437682 - protein, 9 aa, Influenza virus
DTRSGYEML

SEQ ID NO: 437683 - protein, 9 aa, Influenza virus
DTTAVAVLK

SEQ ID NO: 437684 - protein, 9 aa, Influenza virus
DTTCWSWPD

SEQ ID NO: 437685 - protein, 9 aa, Influenza virus
DTTGWSWPD

SEQ ID NO: 437686 - protein, 9 aa, Influenza virus
DTTMEKNVT

SEQ ID NO: 437687 - protein, 9 aa, Influenza virus
DTTSWSWPD

SEQ ID NO: 437688 - protein, 9 aa, Influenza virus
DTTWDVFIE

SEQ ID NO: 437689 - protein, 9 aa, Influenza virus
DTTYQRTRA

SEQ ID NO: 437690 - protein, 9 aa, Influenza virus
DTVDTILEK

SEQ ID NO: 437691 - protein, 9 aa, Influenza virus
DTVDTLIEQ

SEQ ID NO: 437692 - protein, 9 aa, Influenza virus
DTVDTLLEK

SEQ ID NO: 437693 - protein, 9 aa, Influenza virus
DTVDTLTEN

SEQ ID NO: 437694 - protein, 9 aa, Influenza virus
DTVDTVLEK

SEQ ID NO: 437695 - protein, 9 aa, Influenza virus
DTVDTVLER

SEQ ID NO: 437696 - protein, 9 aa, Influenza virus
DTVDTVREK

SEQ ID NO: 437697 - protein, 9 aa, Influenza virus
DTVIFSFNG

SEQ ID NO: 437698 - protein, 9 aa, Influenza virus
DTVLEKNVT

SEQ ID NO: 437699 - protein, 9 aa, Influenza virus
DTVLERNVT

SEQ ID NO: 437700 - protein, 9 aa, Influenza virus
DTVNFSFNG

SEQ ID NO: 437701 - protein, 9 aa, Influenza virus
DTVNRTHQY

SEQ ID NO: 437702 - protein, 9 aa, Influenza virus
DTVNTLIEQ

SEQ ID NO: 437703 - protein, 9 aa, Influenza virus
DTVNTLMEQ

SEQ ID NO: 437704 - protein, 9 aa, Influenza virus
DTVNTLTEQ

SEQ ID NO: 437705 - protein, 9 aa, Influenza virus
DTVREKNVT

SEQ ID NO: 437706 - protein, 9 aa, Influenza virus
DTVTFIFNG

SEQ ID NO: 437707 - protein, 9 aa, Influenza virus
DTVTFNFNG

SEQ ID NO: 437708 - protein, 9 aa, Influenza virus
DTVTFSFNG

SEQ ID NO: 437709 - protein, 9 aa, Influenza virus
DTVTFTFNG

SEQ ID NO: 437710 - protein, 9 aa, Influenza virus
DTYDFNEGA

SEQ ID NO: 437711 - protein, 9 aa, Influenza virus
DTYDFNEGS

SEQ ID NO: 437712 - protein, 9 aa, Influenza virus
DTYDFNEGT

SEQ ID NO: 437713 - protein, 9 aa, Influenza virus
DVADSEMNK

SEQ ID NO: 437714 - protein, 9 aa, Influenza virus
DVCYPGKFA

SEQ ID NO: 437715 - protein, 9 aa, Influenza virus
DVCYPGKFS

SEQ ID NO: 437716 - protein, 9 aa, Influenza virus
DVCYPGKFT

SEQ ID NO: 437717 - protein, 9 aa, Influenza virus
DVCYPGKFV

SEQ ID NO: 437718 - protein, 9 aa, Influenza virus
DVDQSLIIA

SEQ ID NO: 437719 - protein, 9 aa, Influenza virus
DVDQSLVIA

SEQ ID NO: 437720 - protein, 9 aa, Influenza virus
DVDVYCICR

SEQ ID NO: 437721 - protein, 9 aa, Influenza virus
DVECVCRDN

SEQ ID NO: 437722 - protein, 9 aa, Influenza virus
DVFAIREPF

SEQ ID NO: 437723 - protein, 9 aa, Influenza virus
DVFIERPTA

SEQ ID NO: 437724 - protein, 9 aa, Influenza virus
DVFIIREPF

SEQ ID NO: 437725 - protein, 9 aa, Influenza virus
DVFVIREPF

SEQ ID NO: 437726 - protein, 9 aa, Influenza virus
DVFVMREPF

SEQ ID NO: 437727 - protein, 9 aa, Influenza virus
DVFVTREPF

SEQ ID NO: 437728 - protein, 9 aa, Influenza virus
DVFVVREPF

SEQ ID NO: 437729 - protein, 9 aa, Influenza virus
DVGYLCAGI

SEQ ID NO: 437730 - protein, 9 aa, Influenza virus
DVIITREPY

SEQ ID NO: 437731 - protein, 9 aa, Influenza virus
DVILWFSFG

SEQ ID NO: 437732 - protein, 9 aa, Influenza virus
DVILWFSLG

SEQ ID NO: 437733 - protein, 9 aa, Influenza virus
DVILWISFS

SEQ ID NO: 437734 - protein, 9 aa, Influenza virus
DVIMEVVFP

SEQ ID NO: 437735 - protein, 9 aa, Influenza virus
DVINFESTG

SEQ ID NO: 437736 - protein, 9 aa, Influenza virus
DVIRSWRKQ

SEQ ID NO: 437737 - protein, 9 aa, Influenza virus
DVISFESTG

SEQ ID NO: 437738 - protein, 9 aa, Influenza virus
DVIVTREPY

SEQ ID NO: 437739 - protein, 9 aa, Influenza virus
DVLDGVTAS

SEQ ID NO: 437740 - protein, 9 aa, Influenza virus
DVLVALENQ

SEQ ID NO: 437741 - protein, 9 aa, Influenza virus
DVLVIWGIH

SEQ ID NO: 437742 - protein, 9 aa, Influenza virus
DVLVLWGIH

SEQ ID NO: 437743 - protein, 9 aa, Influenza virus
DVLVMWGIH

SEQ ID NO: 437744 - protein, 9 aa, Influenza virus
DVLVMWGLH

SEQ ID NO: 437745 - protein, 9 aa, Influenza virus
DVLVTREPY

SEQ ID NO: 437746 - protein, 9 aa, Influenza virus
DVLWTSNSI

SEQ ID NO: 437747 - protein, 9 aa, Influenza virus
DVNPTLLFL

SEQ ID NO: 437748 - protein, 9 aa, Influenza virus
DVPDYQSIR

SEQ ID NO: 437749 - protein, 9 aa, Influenza virus
DVPDYQSLR

SEQ ID NO: 437750 - protein, 9 aa, Influenza virus
DVPEWSYIV

SEQ ID NO: 437751 - protein, 9 aa, Influenza virus
DVPEYQSLR

SEQ ID NO: 437752 - protein, 9 aa, Influenza virus
DVPGYQSLR

SEQ ID NO: 437753 - protein, 9 aa, Influenza virus
DVPNYQSLR

SEQ ID NO: 437754 - protein, 9 aa, Influenza virus
DVRCICKDN

SEQ ID NO: 437755 - protein, 9 aa, Influenza virus
DVRCICRDN

SEQ ID NO: 437756 - protein, 9 aa, Influenza virus
DVRCVCRDN

SEQ ID NO: 437757 - protein, 9 aa, Influenza virus
DVSFQGRGV

SEQ ID NO: 437758 - protein, 9 aa, Influenza virus
DVSWASNSI

SEQ ID NO: 437759 - protein, 9 aa, Influenza virus
DVSWTSNSI

SEQ ID NO: 437760 - protein, 9 aa, Influenza virus
DVTDSEMDK

SEQ ID NO: 437761 - protein, 9 aa, Influenza virus
DVTDSEMNK

SEQ ID NO: 437762 - protein, 9 aa, Influenza virus
DVTDSEMNR

SEQ ID NO: 437763 - protein, 9 aa, Influenza virus
DVVLVMKRK

SEQ ID NO: 437764 - protein, 9 aa, Influenza virus
DVVNFLSME

SEQ ID NO: 437765 - protein, 9 aa, Influenza virus
DVVNFVSME

SEQ ID NO: 437766 - protein, 9 aa, Influenza virus
DVVNYVSME

SEQ ID NO: 437767 - protein, 9 aa, Influenza virus
DVVRSWKKQ

SEQ ID NO: 437768 - protein, 9 aa, Influenza virus
DVVRSWRKK

SEQ ID NO: 437769 - protein, 9 aa, Influenza virus
DVVRSWRKQ

SEQ ID NO: 437770 - protein, 9 aa, Influenza virus
DVVRSWRRQ

SEQ ID NO: 437771 - protein, 9 aa, Influenza virus
DVWAYNAEL

SEQ ID NO: 437772 - protein, 9 aa, Influenza virus
DVWLGRTIS

SEQ ID NO: 437773 - protein, 9 aa, Influenza virus
DVWLGRTMS

SEQ ID NO: 437774 - protein, 9 aa, Influenza virus
DVWLGRTVS

SEQ ID NO: 437775 - protein, 9 aa, Influenza virus
DVWMGRTIG

SEQ ID NO: 437776 - protein, 9 aa, Influenza virus
DVWMGRTIN

SEQ ID NO: 437777 - protein, 9 aa, Influenza virus
DVWMGRTIS

SEQ ID NO: 437778 - protein, 9 aa, Influenza virus
DVWMGRTVS

SEQ ID NO: 437779 - protein, 9 aa, Influenza virus
DVWSYNAKL

SEQ ID NO: 437780 - protein, 9 aa, Influenza virus
DVWTYNAEL

SEQ ID NO: 437781 - protein, 9 aa, Influenza virus
DVWTYNTEL

SEQ ID NO: 437782 - protein, 9 aa, Influenza virus
DVWTYNVEL

SEQ ID NO: 437783 - protein, 9 aa, Influenza virus
DVYCICRDN

SEQ ID NO: 437784 - protein, 9 aa, Influenza virus
DVYCVCRDN

SEQ ID NO: 437785 - protein, 9 aa, Influenza virus
DVYQILAIY

SEQ ID NO: 437786 - protein, 9 aa, Influenza virus
DWILWISFA

SEQ ID NO: 437787 - protein, 9 aa, Influenza virus
DWPDGAKIE

SEQ ID NO: 437788 - protein, 9 aa, Influenza virus
DWSGYSGAF

SEQ ID NO: 437789 - protein, 9 aa, Influenza virus
DWSGYSGSF

SEQ ID NO: 437790 - protein, 9 aa, Influenza virus
DWSKPQCQI

SEQ ID NO: 437791 - protein, 9 aa, Influenza virus
DWSWHDGAI

SEQ ID NO: 437792 - protein, 9 aa, Influenza virus
DWSWHDGAV

SEQ ID NO: 437793 - protein, 9 aa, Influenza virus
DWSWPDGAE

SEQ ID NO: 437794 - protein, 9 aa, Influenza virus
DWSYIVERP

SEQ ID NO: 437795 - protein, 9 aa, Influenza virus
DWTLNRNQP

SEQ ID NO: 437796 - protein, 9 aa, Influenza virus
DWVDDAVTD

SEQ ID NO: 437797 - protein, 9 aa, Influenza virus
DWVLWISFA

SEQ ID NO: 437798 - protein, 9 aa, Influenza virus
DYARLYIWG

SEQ ID NO: 437799 - protein, 9 aa, Influenza virus
DYEEEAKLE

SEQ ID NO: 437800 - protein, 9 aa, Influenza virus
DYEELKEQL

SEQ ID NO: 437801 - protein, 9 aa, Influenza virus
DYEELKHLL

SEQ ID NO: 437802 - protein, 9 aa, Influenza virus
DYEELKHLM

SEQ ID NO: 437803 - protein, 9 aa, Influenza virus
DYEELREQL

SEQ ID NO: 437804 - protein, 9 aa, Influenza virus
DYESTQAAI

SEQ ID NO: 437805 - protein, 9 aa, Influenza virus
DYHDSNVKN

SEQ ID NO: 437806 - protein, 9 aa, Influenza virus
DYHYEECSC

SEQ ID NO: 437807 - protein, 9 aa, Influenza virus
DYILDEESR

SEQ ID NO: 437808 - protein, 9 aa, Influenza virus
DYKEESQLK

SEQ ID NO: 437809 - protein, 9 aa, Influenza virus
DYKSTPSAI

SEQ ID NO: 437810 - protein, 9 aa, Influenza virus
DYKSTQAAI

SEQ ID NO: 437811 - protein, 9 aa, Influenza virus
DYKSTQAAV

SEQ ID NO: 437812 - protein, 9 aa, Influenza virus
DYKSTQKTI

SEQ ID NO: 437813 - protein, 9 aa, Influenza virus
DYKSTQSAI

SEQ ID NO: 437814 - protein, 9 aa, Influenza virus
DYKSTQSAV

SEQ ID NO: 437815 - protein, 9 aa, Influenza virus
DYKSTQTAI

SEQ ID NO: 437816 - protein, 9 aa, Influenza virus
DYLIGKTSW

SEQ ID NO: 437817 - protein, 9 aa, Influenza virus
DYNNTTGRD

SEQ ID NO: 437818 - protein, 9 aa, Influenza virus
DYPKYEEES

SEQ ID NO: 437819 - protein, 9 aa, Influenza virus
DYPKYEKES

SEQ ID NO: 437820 - protein, 9 aa, Influenza virus
DYPKYSEEA

SEQ ID NO: 437821 - protein, 9 aa, Influenza virus
DYPKYSEES

SEQ ID NO: 437822 - protein, 9 aa, Influenza virus
DYPKYSKES

SEQ ID NO: 437823 - protein, 9 aa, Influenza virus
DYQIGYICS

SEQ ID NO: 437824 - protein, 9 aa, Influenza virus
DYQIGYVCS

SEQ ID NO: 437825 - protein, 9 aa, Influenza virus
DYQSIRSIL

SEQ ID NO: 437826 - protein, 9 aa, Influenza virus
DYQSLRSIL

SEQ ID NO: 437827 - protein, 9 aa, Influenza virus
DYREESQLK

SEQ ID NO: 437828 - protein, 9 aa, Influenza virus
DYRYTYRCH

SEQ ID NO: 437829 - protein, 9 aa, Influenza virus
DYSIDSGYV

SEQ ID NO: 437830 - protein, 9 aa, Influenza virus
DYSIDSNYV

SEQ ID NO: 437831 - protein, 9 aa, Influenza virus
DYSIDSSYI

SEQ ID NO: 437832 - protein, 9 aa, Influenza virus
DYSIDSSYV

SEQ ID NO: 437833 - protein, 9 aa, Influenza virus
DYSKYEEES

SEQ ID NO: 437834 - protein, 9 aa, Influenza virus
DYTIDEESR

SEQ ID NO: 437835 - protein, 9 aa, Influenza virus
DYTLDEESR

SEQ ID NO: 437836 - protein, 9 aa, Influenza virus
DYTRLYIWG

SEQ ID NO: 437837 - protein, 9 aa, Influenza virus
DYWAEGDCY

SEQ ID NO: 437838 - protein, 9 aa, Influenza virus
DYWAEGECY

SEQ ID NO: 437839 - protein, 9 aa, Influenza virus
DYWAKEECY

SEQ ID NO: 437840 - protein, 9 aa, Influenza virus
DYWAKGDCY

SEQ ID NO: 437841 - protein, 9 aa, Influenza virus
DYWAKGECY

SEQ ID NO: 437842 - protein, 9 aa, Influenza virus
DYYWAILKP

SEQ ID NO: 437843 - protein, 9 aa, Influenza virus
DYYWAVLKP

SEQ ID NO: 437844 - protein, 9 aa, Influenza virus
DYYWGILKR

SEQ ID NO: 437845 - protein, 9 aa, Influenza virus
EAESSIKEK

SEQ ID NO: 437846 - protein, 9 aa, Influenza virus
EAESSVKEK

SEQ ID NO: 437847 - protein, 9 aa, Influenza virus
EAESSVREK

SEQ ID NO: 437848 - protein, 9 aa, Influenza virus
EAGLKWELM

SEQ ID NO: 437849 - protein, 9 aa, Influenza virus
EAHILVTRE

SEQ ID NO: 437850 - protein, 9 aa, Influenza virus
EAIDKITNK

SEQ ID NO: 437851 - protein, 9 aa, Influenza virus
EAIEECLIN

SEQ ID NO: 437852 - protein, 9 aa, Influenza virus
EAIEKITNK

SEQ ID NO: 437853 - protein, 9 aa, Influenza virus
EAIGKITNK

SEQ ID NO: 437854 - protein, 9 aa, Influenza virus
EAINKITNK

SEQ ID NO: 437855 - protein, 9 aa, Influenza virus
EAINNRFQI

SEQ ID NO: 437856 - protein, 9 aa, Influenza virus
EAINNRIKI

SEQ ID NO: 437857 - protein, 9 aa, Influenza virus
EAINSRFQI

SEQ ID NO: 437858 - protein, 9 aa, Influenza virus
EAIRNGTYN

SEQ ID NO: 437859 - protein, 9 aa, Influenza virus
EAISNRFQI

SEQ ID NO: 437860 - protein, 9 aa, Influenza virus
EAKLEKSRI

SEQ ID NO: 437861 - protein, 9 aa, Influenza virus
EAKLERSKI

SEQ ID NO: 437862 - protein, 9 aa, Influenza virus
EAKYVEWTS

SEQ ID NO: 437863 - protein, 9 aa, Influenza virus
EAKYVWWAS

SEQ ID NO: 437864 - protein, 9 aa, Influenza virus
EAKYVWWTS

SEQ ID NO: 437865 - protein, 9 aa, Influenza virus
EALKGSARH

SEQ ID NO: 437866 - protein, 9 aa, Influenza virus
EALKMTIAS

SEQ ID NO: 437867 - protein, 9 aa, Influenza virus
EALLNRLNI

SEQ ID NO: 437868 - protein, 9 aa, Influenza virus
EALLNRLSI

SEQ ID NO: 437869 - protein, 9 aa, Influenza virus
EALMEWIKT

SEQ ID NO: 437870 - protein, 9 aa, Influenza virus
EALMEWLKT

SEQ ID NO: 437871 - protein, 9 aa, Influenza virus
EALNNRFQI

SEQ ID NO: 437872 - protein, 9 aa, Influenza virus
EALNNRSQI

SEQ ID NO: 437873 - protein, 9 aa, Influenza virus
EALQGSARH

SEQ ID NO: 437874 - protein, 9 aa, Influenza virus
EALQNRIMI

SEQ ID NO: 437875 - protein, 9 aa, Influenza virus
EALRQIIRE

SEQ ID NO: 437876 - protein, 9 aa, Influenza virus
EALRQKIME

SEQ ID NO: 437877 - protein, 9 aa, Influenza virus
EALSNRFQI

SEQ ID NO: 437878 - protein, 9 aa, Influenza virus
EAMAFLEDS

SEQ ID NO: 437879 - protein, 9 aa, Influenza virus
EAMAFLEES

SEQ ID NO: 437880 - protein, 9 aa, Influenza virus
EAMAFLEKS

SEQ ID NO: 437881 - protein, 9 aa, Influenza virus
EAMAFLENS

SEQ ID NO: 437882 - protein, 9 aa, Influenza virus
EAMALLEES

SEQ ID NO: 437883 - protein, 9 aa, Influenza virus
EAMASQGTK

SEQ ID NO: 437884 - protein, 9 aa, Influenza virus
EAMATQGTK

SEQ ID NO: 437885 - protein, 9 aa, Influenza virus
EAMISRARI

SEQ ID NO: 437886 - protein, 9 aa, Influenza virus
EAMMSRARI

SEQ ID NO: 437887 - protein, 9 aa, Influenza virus
EAMQNRIQI

SEQ ID NO: 437888 - protein, 9 aa, Influenza virus
EAMQNRMQI

SEQ ID NO: 437889 - protein, 9 aa, Influenza virus
EAMQNRVKI

SEQ ID NO: 437890 - protein, 9 aa, Influenza virus
EAMVSRARI

SEQ ID NO: 437891 - protein, 9 aa, Influenza virus
EANGNLIAP

SEQ ID NO: 437892 - protein, 9 aa, Influenza virus
EAPGWSWDD

SEQ ID NO: 437893 - protein, 9 aa, Influenza virus
EAPLNRLNI

SEQ ID NO: 437894 - protein, 9 aa, Influenza virus
EAPSPYNSK

SEQ ID NO: 437895 - protein, 9 aa, Influenza virus
EAPSPYNSR

SEQ ID NO: 437896 - protein, 9 aa, Influenza virus
EAQDVIMEV

SEQ ID NO: 437897 - protein, 9 aa, Influenza virus
EARGLFGAI

SEQ ID NO: 437898 - protein, 9 aa, Influenza virus
EARVWWTSN

SEQ ID NO: 437899 - protein, 9 aa, Influenza virus
EATGNLIAP

SEQ ID NO: 437900 - protein, 9 aa, Influenza virus
EATGNLLVP

SEQ ID NO: 437901 - protein, 9 aa, Influenza virus
EATGNLVAP

SEQ ID NO: 437902 - protein, 9 aa, Influenza virus
EATGNLVVP

SEQ ID NO: 437903 - protein, 9 aa, Influenza virus
EAVAVLKYN

SEQ ID NO: 437904 - protein, 9 aa, Influenza virus
EAVAWSATA

SEQ ID NO: 437905 - protein, 9 aa, Influenza virus
EAVEECLIN

SEQ ID NO: 437906 - protein, 9 aa, Influenza virus
EAVIYGNPK

SEQ ID NO: 437907 - protein, 9 aa, Influenza virus
EAVNNRFQI

SEQ ID NO: 437908 - protein, 9 aa, Influenza virus
EAWPIGESP

SEQ ID NO: 437909 - protein, 9 aa, Influenza virus
EAYNFNEGS

SEQ ID NO: 437910 - protein, 9 aa, Influenza virus
ECACINGSC

SEQ ID NO: 437911 - protein, 9 aa, Influenza virus
ECACVNGSC

SEQ ID NO: 437912 - protein, 9 aa, Influenza virus
ECFNPCFYV

SEQ ID NO: 437913 - protein, 9 aa, Influenza virus
ECFNPITGS

SEQ ID NO: 437914 - protein, 9 aa, Influenza virus
ECFWVMTDG

SEQ ID NO: 437915 - protein, 9 aa, Influenza virus
ECFYSGGTI

SEQ ID NO: 437916 - protein, 9 aa, Influenza virus
ECICINGTC

SEQ ID NO: 437917 - protein, 9 aa, Influenza virus
ECICRDNWT

SEQ ID NO: 437918 - protein, 9 aa, Influenza virus
ECIEKIRNG

SEQ ID NO: 437919 - protein, 9 aa, Influenza virus
ECIEKVRNG

SEQ ID NO: 437920 - protein, 9 aa, Influenza virus
ECIERVRNG

SEQ ID NO: 437921 - protein, 9 aa, Influenza virus
ECIESVRNG

SEQ ID NO: 437922 - protein, 9 aa, Influenza virus
ECIGWSSTS

SEQ ID NO: 437923 - protein, 9 aa, Influenza virus
ECITPNGSI

SEQ ID NO: 437924 - protein, 9 aa, Influenza virus
ECKMFALSQ

SEQ ID NO: 437925 - protein, 9 aa, Influenza virus
ECKTFFLTQ

SEQ ID NO: 437926 - protein, 9 aa, Influenza virus
ECLINDPWV

SEQ ID NO: 437927 - protein, 9 aa, Influenza virus
ECLVPCFWV

SEQ ID NO: 437928 - protein, 9 aa, Influenza virus
ECMESVKNG

SEQ ID NO: 437929 - protein, 9 aa, Influenza virus
ECMESVRNG

SEQ ID NO: 437930 - protein, 9 aa, Influenza virus
ECMETIKNG

SEQ ID NO: 437931 - protein, 9 aa, Influenza virus
ECMIKAVRG

SEQ ID NO: 437932 - protein, 9 aa, Influenza virus
ECPKYIKSD

SEQ ID NO: 437933 - protein, 9 aa, Influenza virus
ECPKYVKQG

SEQ ID NO: 437934 - protein, 9 aa, Influenza virus
ECPKYVKSD

SEQ ID NO: 437935 - protein, 9 aa, Influenza virus
ECPKYVKSE

SEQ ID NO: 437936 - protein, 9 aa, Influenza virus
ECPKYVKSN

SEQ ID NO: 437937 - protein, 9 aa, Influenza virus
ECPKYVKSS

SEQ ID NO: 437938 - protein, 9 aa, Influenza virus
ECPKYVKST

SEQ ID NO: 437939 - protein, 9 aa, Influenza virus
ECPKYVRSA

SEQ ID NO: 437940 - protein, 9 aa, Influenza virus
ECPKYVRSE

SEQ ID NO: 437941 - protein, 9 aa, Influenza virus
ECPKYVRST

SEQ ID NO: 437942 - protein, 9 aa, Influenza virus
ECPRYVKSE

SEQ ID NO: 437943 - protein, 9 aa, Influenza virus
ECQLNEGIM

SEQ ID NO: 437944 - protein, 9 aa, Influenza virus
ECQLNEGVI

SEQ ID NO: 437945 - protein, 9 aa, Influenza virus
ECQLNEGVM

SEQ ID NO: 437946 - protein, 9 aa, Influenza virus
ECRFYALSQ

SEQ ID NO: 437947 - protein, 9 aa, Influenza virus
ECRMFALSQ

SEQ ID NO: 437948 - protein, 9 aa, Influenza virus
ECRTFFLTH

SEQ ID NO: 437949 - protein, 9 aa, Influenza virus
ECRTFFLTQ

SEQ ID NO: 437950 - protein, 9 aa, Influenza virus
ECSCYGHDS

SEQ ID NO: 437951 - protein, 9 aa, Influenza virus
ECSCYGHNQ

SEQ ID NO: 437952 - protein, 9 aa, Influenza virus
ECSCYGHNS

SEQ ID NO: 437953 - protein, 9 aa, Influenza virus
ECSCYGHSQ

SEQ ID NO: 437954 - protein, 9 aa, Influenza virus
ECSCYMDID

SEQ ID NO: 437955 - protein, 9 aa, Influenza virus
ECSCYPDAG

SEQ ID NO: 437956 - protein, 9 aa, Influenza virus
ECSCYPDAS

SEQ ID NO: 437957 - protein, 9 aa, Influenza virus
ECSCYPDSG

SEQ ID NO: 437958 - protein, 9 aa, Influenza virus
ECSCYPNAG

SEQ ID NO: 437959 - protein, 9 aa, Influenza virus
ECSCYPNDG

SEQ ID NO: 437960 - protein, 9 aa, Influenza virus
ECSCYPNEG

SEQ ID NO: 437961 - protein, 9 aa, Influenza virus
ECSCYPNLG

SEQ ID NO: 437962 - protein, 9 aa, Influenza virus
ECSCYPNMG

SEQ ID NO: 437963 - protein, 9 aa, Influenza virus
ECSCYPNSG

SEQ ID NO: 437964 - protein, 9 aa, Influenza virus
ECSCYPQYP

SEQ ID NO: 437965 - protein, 9 aa, Influenza virus
ECSCYPRFP

SEQ ID NO: 437966 - protein, 9 aa, Influenza virus
ECSCYPRSP

SEQ ID NO: 437967 - protein, 9 aa, Influenza virus
ECSCYPRYP

SEQ ID NO: 437968 - protein, 9 aa, Influenza virus
ECSCYPRYS

SEQ ID NO: 437969 - protein, 9 aa, Influenza virus
ECSCYPSGE

SEQ ID NO: 437970 - protein, 9 aa, Influenza virus
ECSCYPSGT

SEQ ID NO: 437971 - protein, 9 aa, Influenza virus
ECSCYVDID

SEQ ID NO: 437972 - protein, 9 aa, Influenza virus
ECSCYVDTD

SEQ ID NO: 437973 - protein, 9 aa, Influenza virus
ECSCYVDVD

SEQ ID NO: 437974 - protein, 9 aa, Influenza virus
ECVCHDGTC

SEQ ID NO: 437975 - protein, 9 aa, Influenza virus
ECVCHDGVC

SEQ ID NO: 437976 - protein, 9 aa, Influenza virus
ECVCHKGIC

SEQ ID NO: 437977 - protein, 9 aa, Influenza virus
ECVCHKGVC

SEQ ID NO: 437978 - protein, 9 aa, Influenza virus
ECVCHNGIC

SEQ ID NO: 437979 - protein, 9 aa, Influenza virus
ECVCHNGTC

SEQ ID NO: 437980 - protein, 9 aa, Influenza virus
ECVCHNGVC

SEQ ID NO: 437981 - protein, 9 aa, Influenza virus
ECVCHNSTC

SEQ ID NO: 437982 - protein, 9 aa, Influenza virus
ECVCHSGIC

SEQ ID NO: 437983 - protein, 9 aa, Influenza virus
ECVCINGIC

SEQ ID NO: 437984 - protein, 9 aa, Influenza virus
ECVCINGSC

SEQ ID NO: 437985 - protein, 9 aa, Influenza virus
ECVCINGTC

SEQ ID NO: 437986 - protein, 9 aa, Influenza virus
ECVCISGTC

SEQ ID NO: 437987 - protein, 9 aa, Influenza virus
ECVCMNGSC

SEQ ID NO: 437988 - protein, 9 aa, Influenza virus
ECVCQDEFC

SEQ ID NO: 437989 - protein, 9 aa, Influenza virus
ECVCRDNWN

SEQ ID NO: 437990 - protein, 9 aa, Influenza virus
ECVCRDNWR

SEQ ID NO: 437991 - protein, 9 aa, Influenza virus
ECVCRDNWT

SEQ ID NO: 437992 - protein, 9 aa, Influenza virus
ECVCVNGSC

SEQ ID NO: 437993 - protein, 9 aa, Influenza virus
ECVGWSSTS

SEQ ID NO: 437994 - protein, 9 aa, Influenza virus
ECVRHNGTC

SEQ ID NO: 437995 - protein, 9 aa, Influenza virus
ECVSHNGTW

SEQ ID NO: 437996 - protein, 9 aa, Influenza virus
ECYNPCFYV

SEQ ID NO: 437997 - protein, 9 aa, Influenza virus
ECYRACFYV

SEQ ID NO: 437998 - protein, 9 aa, Influenza virus
ECYWVMTDG

SEQ ID NO: 437999 - protein, 9 aa, Influenza virus
EDCMIKAVR

SEQ ID NO: 438000 - protein, 9 aa, Influenza virus
EDCMMKAVR

SEQ ID NO: 438001 - protein, 9 aa, Influenza virus
EDCMVKAVR

SEQ ID NO: 438002 - protein, 9 aa, Influenza virus
EDCTGCFEI

SEQ ID NO: 438003 - protein, 9 aa, Influenza virus
EDDVWMGRT

SEQ ID NO: 438004 - protein, 9 aa, Influenza virus
EDEQMYQKC

SEQ ID NO: 438005 - protein, 9 aa, Influenza virus
EDEQMYQRC

SEQ ID NO: 438006 - protein, 9 aa, Influenza virus
EDESRIERQ

SEQ ID NO: 438007 - protein, 9 aa, Influenza virus
EDEVWWTSN

SEQ ID NO: 438008 - protein, 9 aa, Influenza virus
EDFQLIPMI

SEQ ID NO: 438009 - protein, 9 aa, Influenza virus
EDFVRQCFN

SEQ ID NO: 438010 - protein, 9 aa, Influenza virus
EDGDIIFLW

SEQ ID NO: 438011 - protein, 9 aa, Influenza virus
EDGFIDVWT

SEQ ID NO: 438012 - protein, 9 aa, Influenza virus
EDGFLDVWT

SEQ ID NO: 438013 - protein, 9 aa, Influenza virus
EDGFLGVWT

SEQ ID NO: 438014 - protein, 9 aa, Influenza virus
EDGKGCFDL

SEQ ID NO: 438015 - protein, 9 aa, Influenza virus
EDGKGCFEI

SEQ ID NO: 438016 - protein, 9 aa, Influenza virus
EDGKGCFEL

SEQ ID NO: 438017 - protein, 9 aa, Influenza virus
EDGLLDVWT

SEQ ID NO: 438018 - protein, 9 aa, Influenza virus
EDGNGCFEI

SEQ ID NO: 438019 - protein, 9 aa, Influenza virus
EDGNGCFEL

SEQ ID NO: 438020 - protein, 9 aa, Influenza virus
EDGNIIFLW

SEQ ID NO: 438021 - protein, 9 aa, Influenza virus
EDGRGCFEI

SEQ ID NO: 438022 - protein, 9 aa, Influenza virus
EDGSIGKVC

SEQ ID NO: 438023 - protein, 9 aa, Influenza virus
EDGSSSSNC

SEQ ID NO: 438024 - protein, 9 aa, Influenza virus
EDGTGCFEI

SEQ ID NO: 438025 - protein, 9 aa, Influenza virus
EDGTGCFEL

SEQ ID NO: 438026 - protein, 9 aa, Influenza virus
EDGVYKALS

SEQ ID NO: 438027 - protein, 9 aa, Influenza virus
EDILRTQES

SEQ ID NO: 438028 - protein, 9 aa, Influenza virus
EDKGNGCFE

SEQ ID NO: 438029 - protein, 9 aa, Influenza virus
EDKRYGPAL

SEQ ID NO: 438030 - protein, 9 aa, Influenza virus
EDKVWWTSN

SEQ ID NO: 438031 - protein, 9 aa, Influenza virus
EDLGNGCFK

SEQ ID NO: 438032 - protein, 9 aa, Influenza virus
EDLIFLARS

SEQ ID NO: 438033 - protein, 9 aa, Influenza virus
EDLIFMARS

SEQ ID NO: 438034 - protein, 9 aa, Influenza virus
EDLIFSARS

SEQ ID NO: 438035 - protein, 9 aa, Influenza virus
EDLTFLARS

SEQ ID NO: 438036 - protein, 9 aa, Influenza virus
EDLWAYNAE

SEQ ID NO: 438037 - protein, 9 aa, Influenza virus
EDMGNGCFK

SEQ ID NO: 438038 - protein, 9 aa, Influenza virus
EDMGNGCFR

SEQ ID NO: 438039 - protein, 9 aa, Influenza virus
EDMGNGCFT

SEQ ID NO: 438040 - protein, 9 aa, Influenza virus
EDMGNGCLK

SEQ ID NO: 438041 - protein, 9 aa, Influenza virus
EDNIYKILS

SEQ ID NO: 438042 - protein, 9 aa, Influenza virus
EDNVYKALS

SEQ ID NO: 438043 - protein, 9 aa, Influenza virus
EDNVYKILS

SEQ ID NO: 438044 - protein, 9 aa, Influenza virus
EDNVYKVLA

SEQ ID NO: 438045 - protein, 9 aa, Influenza virus
EDNVYKVLS

SEQ ID NO: 438046 - protein, 9 aa, Influenza virus
EDNVYRALS

SEQ ID NO: 438047 - protein, 9 aa, Influenza virus
EDPAAPHGL

SEQ ID NO: 438048 - protein, 9 aa, Influenza virus
EDPDHEGEG

SEQ ID NO: 438049 - protein, 9 aa, Influenza virus
EDPGAPHGL

SEQ ID NO: 438050 - protein, 9 aa, Influenza virus
EDPNAPHKL

SEQ ID NO: 438051 - protein, 9 aa, Influenza virus
EDPNAPNKF

SEQ ID NO: 438052 - protein, 9 aa, Influenza virus
EDPNAPNKL

SEQ ID NO: 438053 - protein, 9 aa, Influenza virus
EDPNHEGEG

SEQ ID NO: 438054 - protein, 9 aa, Influenza virus
EDPSAPHGL

SEQ ID NO: 438055 - protein, 9 aa, Influenza virus
EDPSAPHRL

SEQ ID NO: 438056 - protein, 9 aa, Influenza virus
EDPSHEGEG

SEQ ID NO: 438057 - protein, 9 aa, Influenza virus
EDPTAPHGL

SEQ ID NO: 438058 - protein, 9 aa, Influenza virus
EDQGNGCFE

SEQ ID NO: 438059 - protein, 9 aa, Influenza virus
EDQIQDIWA

SEQ ID NO: 438060 - protein, 9 aa, Influenza virus
EDQITDIWA

SEQ ID NO: 438061 - protein, 9 aa, Influenza virus
EDRGNGCFE

SEQ ID NO: 438062 - protein, 9 aa, Influenza virus
EDRMIKAVR

SEQ ID NO: 438063 - protein, 9 aa, Influenza virus
EDRRYGPAL

SEQ ID NO: 438064 - protein, 9 aa, Influenza virus
EDRTPYRSL

SEQ ID NO: 438065 - protein, 9 aa, Influenza virus
EDRVWWTSN

SEQ ID NO: 438066 - protein, 9 aa, Influenza virus
EDSDILVTR

SEQ ID NO: 438067 - protein, 9 aa, Influenza virus
EDSDVLVTR

SEQ ID NO: 438068 - protein, 9 aa, Influenza virus
EDSRSGYET

SEQ ID NO: 438069 - protein, 9 aa, Influenza virus
EDSSSNSNC

SEQ ID NO: 438070 - protein, 9 aa, Influenza virus
EDSSSSSNC

SEQ ID NO: 438071 - protein, 9 aa, Influenza virus
EDTHIHIFS

SEQ ID NO: 438072 - protein, 9 aa, Influenza virus
EDTIEERFE

SEQ ID NO: 438073 - protein, 9 aa, Influenza virus
EDTKIDLWS

SEQ ID NO: 438074 - protein, 9 aa, Influenza virus
EDTKVDLWS

SEQ ID NO: 438075 - protein, 9 aa, Influenza virus
EDYKEESQL

SEQ ID NO: 438076 - protein, 9 aa, Influenza virus
EDYREESQL

SEQ ID NO: 438077 - protein, 9 aa, Influenza virus
EEAKLEKSR

SEQ ID NO: 438078 - protein, 9 aa, Influenza virus
EEAKLERSK

SEQ ID NO: 438079 - protein, 9 aa, Influenza virus
EEAKYVEWT

SEQ ID NO: 438080 - protein, 9 aa, Influenza virus
EEAKYVWWA

SEQ ID NO: 438081 - protein, 9 aa, Influenza virus
EEAKYVWWT

SEQ ID NO: 438082 - protein, 9 aa, Influenza virus
EEALKGSAR

SEQ ID NO: 438083 - protein, 9 aa, Influenza virus
EEALLNRLN

SEQ ID NO: 438084 - protein, 9 aa, Influenza virus
EEALLNRLS

SEQ ID NO: 438085 - protein, 9 aa, Influenza virus
EEALQGSAR

SEQ ID NO: 438086 - protein, 9 aa, Influenza virus
EEALRQIIR

SEQ ID NO: 438087 - protein, 9 aa, Influenza virus
EEALRQILR

SEQ ID NO: 438088 - protein, 9 aa, Influenza virus
EEALRQKIM

SEQ ID NO: 438089 - protein, 9 aa, Influenza virus
EEAMQNRIQ

SEQ ID NO: 438090 - protein, 9 aa, Influenza virus
EEAPLNRLN

SEQ ID NO: 438091 - protein, 9 aa, Influenza virus
EECLINDPW

SEQ ID NO: 438092 - protein, 9 aa, Influenza virus
EECMIKAVR

SEQ ID NO: 438093 - protein, 9 aa, Influenza virus
EECSCYGHD

SEQ ID NO: 438094 - protein, 9 aa, Influenza virus
EECSCYGHN

SEQ ID NO: 438095 - protein, 9 aa, Influenza virus
EECSCYGHS

SEQ ID NO: 438096 - protein, 9 aa, Influenza virus
EECSCYMDI

SEQ ID NO: 438097 - protein, 9 aa, Influenza virus
EECSCYPDA

SEQ ID NO: 438098 - protein, 9 aa, Influenza virus
EECSCYPDS

SEQ ID NO: 438099 - protein, 9 aa, Influenza virus
EECSCYPDT

SEQ ID NO: 438100 - protein, 9 aa, Influenza virus
EECSCYPES

SEQ ID NO: 438101 - protein, 9 aa, Influenza virus
EECSCYPNA

SEQ ID NO: 438102 - protein, 9 aa, Influenza virus
EECSCYPND

SEQ ID NO: 438103 - protein, 9 aa, Influenza virus
EECSCYPNE

SEQ ID NO: 438104 - protein, 9 aa, Influenza virus
EECSCYPNL

SEQ ID NO: 438105 - protein, 9 aa, Influenza virus
EECSCYPNM

SEQ ID NO: 438106 - protein, 9 aa, Influenza virus
EECSCYPNS

SEQ ID NO: 438107 - protein, 9 aa, Influenza virus
EECSCYPQH

SEQ ID NO: 438108 - protein, 9 aa, Influenza virus
EECSCYPQY

SEQ ID NO: 438109 - protein, 9 aa, Influenza virus
EECSCYPRF

SEQ ID NO: 438110 - protein, 9 aa, Influenza virus
EECSCYPRH

SEQ ID NO: 438111 - protein, 9 aa, Influenza virus
EECSCYPRS

SEQ ID NO: 438112 - protein, 9 aa, Influenza virus
EECSCYPRY

SEQ ID NO: 438113 - protein, 9 aa, Influenza virus
EECSCYPSG

SEQ ID NO: 438114 - protein, 9 aa, Influenza virus
EECSCYPSY

SEQ ID NO: 438115 - protein, 9 aa, Influenza virus
EECSCYSRY

SEQ ID NO: 438116 - protein, 9 aa, Influenza virus
EECSCYVDI

SEQ ID NO: 438117 - protein, 9 aa, Influenza virus
EECSCYVDT

SEQ ID NO: 438118 - protein, 9 aa, Influenza virus
EECSCYVDV

SEQ ID NO: 438119 - protein, 9 aa, Influenza virus
EECYRACFY

SEQ ID NO: 438120 - protein, 9 aa, Influenza virus
EEDCTGCFE

SEQ ID NO: 438121 - protein, 9 aa, Influenza virus
EEDGKGCFE

SEQ ID NO: 438122 - protein, 9 aa, Influenza virus
EEDGNGCFE

SEQ ID NO: 438123 - protein, 9 aa, Influenza virus
EEDGRGCFE

SEQ ID NO: 438124 - protein, 9 aa, Influenza virus
EEDGTGCFE

SEQ ID NO: 438125 - protein, 9 aa, Influenza virus
EEEAKLEKS

SEQ ID NO: 438126 - protein, 9 aa, Influenza virus
EEEAKLERS

SEQ ID NO: 438127 - protein, 9 aa, Influenza virus
EEELLTGNL

SEQ ID NO: 438128 - protein, 9 aa, Influenza virus
EEEMLTGNL

SEQ ID NO: 438129 - protein, 9 aa, Influenza virus
EEESDEALK

SEQ ID NO: 438130 - protein, 9 aa, Influenza virus
EEESKIERQ

SEQ ID NO: 438131 - protein, 9 aa, Influenza virus
EEESKLERQ

SEQ ID NO: 438132 - protein, 9 aa, Influenza virus
EEESKLKRN

SEQ ID NO: 438133 - protein, 9 aa, Influenza virus
EEESKLKRQ

SEQ ID NO: 438134 - protein, 9 aa, Influenza virus
EEESKLNRN

SEQ ID NO: 438135 - protein, 9 aa, Influenza virus
EEESKLNRS

SEQ ID NO: 438136 - protein, 9 aa, Influenza virus
EEESKLNRT

SEQ ID NO: 438137 - protein, 9 aa, Influenza virus
EEESRIERQ

SEQ ID NO: 438138 - protein, 9 aa, Influenza virus
EEESRLNRN

SEQ ID NO: 438139 - protein, 9 aa, Influenza virus
EEEVLTGNL

SEQ ID NO: 438140 - protein, 9 aa, Influenza virus
EEFVRQCFN

SEQ ID NO: 438141 - protein, 9 aa, Influenza virus
EEGDIIFLW

SEQ ID NO: 438142 - protein, 9 aa, Influenza virus
EEGSIGKVC

SEQ ID NO: 438143 - protein, 9 aa, Influenza virus
EEGTGIAAD

SEQ ID NO: 438144 - protein, 9 aa, Influenza virus
EEGTGVAAD

SEQ ID NO: 438145 - protein, 9 aa, Influenza virus
EEGTSIWTS

SEQ ID NO: 438146 - protein, 9 aa, Influenza virus
EEHPNAGKD

SEQ ID NO: 438147 - protein, 9 aa, Influenza virus
EEHPSAGKD

SEQ ID NO: 438148 - protein, 9 aa, Influenza virus
EEHPSAGRD

SEQ ID NO: 438149 - protein, 9 aa, Influenza virus
EEHPSTGKD

SEQ ID NO: 438150 - protein, 9 aa, Influenza virus
EEISETQGT

SEQ ID NO: 438151 - protein, 9 aa, Influenza virus
EEKTSIWTS

SEQ ID NO: 438152 - protein, 9 aa, Influenza virus
EEKVWWTSN

SEQ ID NO: 438153 - protein, 9 aa, Influenza virus
EELKEQLST

SEQ ID NO: 438154 - protein, 9 aa, Influenza virus
EELKHLLNR

SEQ ID NO: 438155 - protein, 9 aa, Influenza virus
EELKHLLSR

SEQ ID NO: 438156 - protein, 9 aa, Influenza virus
EELKHLLSS

SEQ ID NO: 438157 - protein, 9 aa, Influenza virus
EELKHLMSS

SEQ ID NO: 438158 - protein, 9 aa, Influenza virus
EELKSLFSS

SEQ ID NO: 438159 - protein, 9 aa, Influenza virus
EELLTGNLQ

SEQ ID NO: 438160 - protein, 9 aa, Influenza virus
EELREHLSS

SEQ ID NO: 438161 - protein, 9 aa, Influenza virus
EELREQLSS

SEQ ID NO: 438162 - protein, 9 aa, Influenza virus
EELREQLST

SEQ ID NO: 438163 - protein, 9 aa, Influenza virus
EELRFLFSS

SEQ ID NO: 438164 - protein, 9 aa, Influenza virus
EELRFVFSI

SEQ ID NO: 438165 - protein, 9 aa, Influenza virus
EELRFVFSN

SEQ ID NO: 438166 - protein, 9 aa, Influenza virus
EELRFVFSS

SEQ ID NO: 438167 - protein, 9 aa, Influenza virus
EELRRQKSL

SEQ ID NO: 438168 - protein, 9 aa, Influenza virus
EELRRQKWW

SEQ ID NO: 438169 - protein, 9 aa, Influenza virus
EELRSLFSS

SEQ ID NO: 438170 - protein, 9 aa, Influenza virus
EELVHGGID

SEQ ID NO: 438171 - protein, 9 aa, Influenza virus
EELVHGGIN

SEQ ID NO: 438172 - protein, 9 aa, Influenza virus
EELVHGGVD

SEQ ID NO: 438173 - protein, 9 aa, Influenza virus
EELVHGQVN

SEQ ID NO: 438174 - protein, 9 aa, Influenza virus
EELVHRGID

SEQ ID NO: 438175 - protein, 9 aa, Influenza virus
EELWAYNAE

SEQ ID NO: 438176 - protein, 9 aa, Influenza virus
EEMLTGNLQ

SEQ ID NO: 438177 - protein, 9 aa, Influenza virus
EENPSAGKD

SEQ ID NO: 438178 - protein, 9 aa, Influenza virus
EENSTYKIL

SEQ ID NO: 438179 - protein, 9 aa, Influenza virus
EENTSYKIL

SEQ ID NO: 438180 - protein, 9 aa, Influenza virus
EENTTYKIL

SEQ ID NO: 438181 - protein, 9 aa, Influenza virus
EENTTYRIL

SEQ ID NO: 438182 - protein, 9 aa, Influenza virus
EEPLKGSAK

SEQ ID NO: 438183 - protein, 9 aa, Influenza virus
EEPLRQILR

SEQ ID NO: 438184 - protein, 9 aa, Influenza virus
EEQAVDICK

SEQ ID NO: 438185 - protein, 9 aa, Influenza virus
EEQAVGICK

SEQ ID NO: 438186 - protein, 9 aa, Influenza virus
EEQAVNICK

SEQ ID NO: 438187 - protein, 9 aa, Influenza virus
EERGNPGVK

SEQ ID NO: 438188 - protein, 9 aa, Influenza virus
EERGSPGVK

SEQ ID NO: 438189 - protein, 9 aa, Influenza virus
EERNSIWTS

SEQ ID NO: 438190 - protein, 9 aa, Influenza virus
EERTSIWTS

SEQ ID NO: 438191 - protein, 9 aa, Influenza virus
EESDEALKM

SEQ ID NO: 438192 - protein, 9 aa, Influenza virus
EESECVCHN

SEQ ID NO: 438193 - protein, 9 aa, Influenza virus
EESHPGIFE

SEQ ID NO: 438194 - protein, 9 aa, Influenza virus
EESHPGIFG

SEQ ID NO: 438195 - protein, 9 aa, Influenza virus
EESHPGLFE

SEQ ID NO: 438196 - protein, 9 aa, Influenza virus
EESKIERQK

SEQ ID NO: 438197 - protein, 9 aa, Influenza virus
EESKINRQE

SEQ ID NO: 438198 - protein, 9 aa, Influenza virus
EESKLERQK

SEQ ID NO: 438199 - protein, 9 aa, Influenza virus
EESKLERQR

SEQ ID NO: 438200 - protein, 9 aa, Influenza virus
EESKLKRNE

SEQ ID NO: 438201 - protein, 9 aa, Influenza virus
EESKLKRQE

SEQ ID NO: 438202 - protein, 9 aa, Influenza virus
EESKLNKNE

SEQ ID NO: 438203 - protein, 9 aa, Influenza virus
EESKLNRNE

SEQ ID NO: 438204 - protein, 9 aa, Influenza virus
EESKLNRQE

SEQ ID NO: 438205 - protein, 9 aa, Influenza virus
EESKLNRSE

SEQ ID NO: 438206 - protein, 9 aa, Influenza virus
EESKLNRTE

SEQ ID NO: 438207 - protein, 9 aa, Influenza virus
EESLLNRLS

SEQ ID NO: 438208 - protein, 9 aa, Influenza virus
EESLRQILR

SEQ ID NO: 438209 - protein, 9 aa, Influenza virus
EESLRQVLR

SEQ ID NO: 438210 - protein, 9 aa, Influenza virus
EESQLKKQE

SEQ ID NO: 438211 - protein, 9 aa, Influenza virus
EESQLKRQE

SEQ ID NO: 438212 - protein, 9 aa, Influenza virus
EESRARIKT

SEQ ID NO: 438213 - protein, 9 aa, Influenza virus
EESRIERQK

SEQ ID NO: 438214 - protein, 9 aa, Influenza virus
EESRINRQE

SEQ ID NO: 438215 - protein, 9 aa, Influenza virus
EESRLNRNE

SEQ ID NO: 438216 - protein, 9 aa, Influenza virus
EESRLNRQE

SEQ ID NO: 438217 - protein, 9 aa, Influenza virus
EESSIGKVC

SEQ ID NO: 438218 - protein, 9 aa, Influenza virus
EETHIHIFS

SEQ ID NO: 438219 - protein, 9 aa, Influenza virus
EETIEEKFE

SEQ ID NO: 438220 - protein, 9 aa, Influenza virus
EETIEERFE

SEQ ID NO: 438221 - protein, 9 aa, Influenza virus
EETLKGSAR

SEQ ID NO: 438222 - protein, 9 aa, Influenza virus
EETLRKILR

SEQ ID NO: 438223 - protein, 9 aa, Influenza virus
EETLRQILR

SEQ ID NO: 438224 - protein, 9 aa, Influenza virus
EETVEERFE

SEQ ID NO: 438225 - protein, 9 aa, Influenza virus
EETYKILTI

SEQ ID NO: 438226 - protein, 9 aa, Influenza virus
EEVKYVWWT

SEQ ID NO: 438227 - protein, 9 aa, Influenza virus
EEVLKGSAR

SEQ ID NO: 438228 - protein, 9 aa, Influenza virus
EEVLTGNLQ

SEQ ID NO: 438229 - protein, 9 aa, Influenza virus
EEVSEAQGT

SEQ ID NO: 438230 - protein, 9 aa, Influenza virus
EEVSETQGI

SEQ ID NO: 438231 - protein, 9 aa, Influenza virus
EEVSETQGM

SEQ ID NO: 438232 - protein, 9 aa, Influenza virus
EEVSETQGT

SEQ ID NO: 438233 - protein, 9 aa, Influenza virus
EEVTNATET

SEQ ID NO: 438234 - protein, 9 aa, Influenza virus
EEWSCYGHS

SEQ ID NO: 438235 - protein, 9 aa, Influenza virus
EEYGKGRIF

SEQ ID NO: 438236 - protein, 9 aa, Influenza virus
EEYGRGRIF

SEQ ID NO: 438237 - protein, 9 aa, Influenza virus
EEYVEDTKI

SEQ ID NO: 438238 - protein, 9 aa, Influenza virus
EFCYTLITD

SEQ ID NO: 438239 - protein, 9 aa, Influenza virus
EFCYTLMTD

SEQ ID NO: 438240 - protein, 9 aa, Influenza virus
EFCYTLVTD

SEQ ID NO: 438241 - protein, 9 aa, Influenza virus
EFDEIGEDV

SEQ ID NO: 438242 - protein, 9 aa, Influenza virus
EFEPFQSLI

SEQ ID NO: 438243 - protein, 9 aa, Influenza virus
EFEPFQSLV

SEQ ID NO: 438244 - protein, 9 aa, Influenza virus
EFEQVEGRI

SEQ ID NO: 438245 - protein, 9 aa, Influenza virus
EFEQVEGRT

SEQ ID NO: 438246 - protein, 9 aa, Influenza virus
EFESIESEF

SEQ ID NO: 438247 - protein, 9 aa, Influenza virus
EFEVMNHEF

SEQ ID NO: 438248 - protein, 9 aa, Influenza virus
EFEVVDHEF

SEQ ID NO: 438249 - protein, 9 aa, Influenza virus
EFEVVNHEF

SEQ ID NO: 438250 - protein, 9 aa, Influenza virus
EFFNNTEPL

SEQ ID NO: 438251 - protein, 9 aa, Influenza virus
EFGNLERRL

SEQ ID NO: 438252 - protein, 9 aa, Influenza virus
EFGQVEGRI

SEQ ID NO: 438253 - protein, 9 aa, Influenza virus
EFGVVNHEF

SEQ ID NO: 438254 - protein, 9 aa, Influenza virus
EFGYLLKGE

SEQ ID NO: 438255 - protein, 9 aa, Influenza virus
EFGYLLRGE

SEQ ID NO: 438256 - protein, 9 aa, Influenza virus
EFHDSNVKN

SEQ ID NO: 438257 - protein, 9 aa, Influenza virus
EFIAEQFTW

SEQ ID NO: 438258 - protein, 9 aa, Influenza virus
EFICVGWSS

SEQ ID NO: 438259 - protein, 9 aa, Influenza virus
EFKADLIIE

SEQ ID NO: 438260 - protein, 9 aa, Influenza virus
EFKMNPNKK

SEQ ID NO: 438261 - protein, 9 aa, Influenza virus
EFKMNPNQK

SEQ ID NO: 438262 - protein, 9 aa, Influenza virus
EFLCVGWSS

SEQ ID NO: 438263 - protein, 9 aa, Influenza virus
EFLGQWDWP

SEQ ID NO: 438264 - protein, 9 aa, Influenza virus
EFLGQWNWP

SEQ ID NO: 438265 - protein, 9 aa, Influenza virus
EFLNNTEPL

SEQ ID NO: 438266 - protein, 9 aa, Influenza virus
EFLVALENQ

SEQ ID NO: 438267 - protein, 9 aa, Influenza virus
EFLVAMENQ

SEQ ID NO: 438268 - protein, 9 aa, Influenza virus
EFLVAVENQ

SEQ ID NO: 438269 - protein, 9 aa, Influenza virus
EFNEIEHQI

SEQ ID NO: 438270 - protein, 9 aa, Influenza virus
EFNEIEQQI

SEQ ID NO: 438271 - protein, 9 aa, Influenza virus
EFNEIEYQI

SEQ ID NO: 438272 - protein, 9 aa, Influenza virus
EFNEVEQQI

SEQ ID NO: 438273 - protein, 9 aa, Influenza virus
EFNKACELT

SEQ ID NO: 438274 - protein, 9 aa, Influenza virus
EFNNLEKRL

SEQ ID NO: 438275 - protein, 9 aa, Influenza virus
EFNNLERRL

SEQ ID NO: 438276 - protein, 9 aa, Influenza virus
EFNQVEKRI

SEQ ID NO: 438277 - protein, 9 aa, Influenza virus
EFNQVENRI

SEQ ID NO: 438278 - protein, 9 aa, Influenza virus
EFNQVEQRI

SEQ ID NO: 438279 - protein, 9 aa, Influenza virus
EFPSTGNHG

SEQ ID NO: 438280 - protein, 9 aa, Influenza virus
EFQLIPMIS

SEQ ID NO: 438281 - protein, 9 aa, Influenza virus
EFSEIEGRI

SEQ ID NO: 438282 - protein, 9 aa, Influenza virus
EFSEIEHQI

SEQ ID NO: 438283 - protein, 9 aa, Influenza virus
EFSEIEQQI

SEQ ID NO: 438284 - protein, 9 aa, Influenza virus
EFSETEHQI

SEQ ID NO: 438285 - protein, 9 aa, Influenza virus
EFSEVEGRI

SEQ ID NO: 438286 - protein, 9 aa, Influenza virus
EFSEVEIRI

SEQ ID NO: 438287 - protein, 9 aa, Influenza virus
EFSEVESRI

SEQ ID NO: 438288 - protein, 9 aa, Influenza virus
EFSEVETRI

SEQ ID NO: 438289 - protein, 9 aa, Influenza virus
EFSEVGSRI

SEQ ID NO: 438290 - protein, 9 aa, Influenza virus
EFSKVETRI

SEQ ID NO: 438291 - protein, 9 aa, Influenza virus
EFSLTDPKL

SEQ ID NO: 438292 - protein, 9 aa, Influenza virus
EFSLTDPRF

SEQ ID NO: 438293 - protein, 9 aa, Influenza virus
EFSLTDPRL

SEQ ID NO: 438294 - protein, 9 aa, Influenza virus
EFSNLEKRI

SEQ ID NO: 438295 - protein, 9 aa, Influenza virus
EFSNLEKRL

SEQ ID NO: 438296 - protein, 9 aa, Influenza virus
EFSNLERRI

SEQ ID NO: 438297 - protein, 9 aa, Influenza virus
EFSNLERRL

SEQ ID NO: 438298 - protein, 9 aa, Influenza virus
EFSQVEQRI

SEQ ID NO: 438299 - protein, 9 aa, Influenza virus
EFSQVERRI

SEQ ID NO: 438300 - protein, 9 aa, Influenza virus
EFSSLERRI

SEQ ID NO: 438301 - protein, 9 aa, Influenza virus
EFTEVEGRI

SEQ ID NO: 438302 - protein, 9 aa, Influenza virus
EFTEVEKQI

SEQ ID NO: 438303 - protein, 9 aa, Influenza virus
EFTEVEQQI

SEQ ID NO: 438304 - protein, 9 aa, Influenza virus
EFTSFFYRY

SEQ ID NO: 438305 - protein, 9 aa, Influenza virus
EFVRQCFNP

SEQ ID NO: 438306 - protein, 9 aa, Influenza virus
EFWHKCDDE

SEQ ID NO: 438307 - protein, 9 aa, Influenza virus
EFWHKCDND

SEQ ID NO: 438308 - protein, 9 aa, Influenza virus
EFWHKCDNE

SEQ ID NO: 438309 - protein, 9 aa, Influenza virus
EFWHKCNNE

SEQ ID NO: 438310 - protein, 9 aa, Influenza virus
EFYHKCDDE

SEQ ID NO: 438311 - protein, 9 aa, Influenza virus
EFYHKCDNE

SEQ ID NO: 438312 - protein, 9 aa, Influenza virus
EFYHKCNDE

SEQ ID NO: 438313 - protein, 9 aa, Influenza virus
EGADVCYPG

SEQ ID NO: 438314 - protein, 9 aa, Influenza virus
EGALRQKIM

SEQ ID NO: 438315 - protein, 9 aa, Influenza virus
EGAYKILTI

SEQ ID NO: 438316 - protein, 9 aa, Influenza virus
EGDCYRACF

SEQ ID NO: 438317 - protein, 9 aa, Influenza virus
EGDGCFNFF

SEQ ID NO: 438318 - protein, 9 aa, Influenza virus
EGDGCFNLL

SEQ ID NO: 438319 - protein, 9 aa, Influenza virus
EGDGCFSIL

SEQ ID NO: 438320 - protein, 9 aa, Influenza virus
EGDGCFSLL

SEQ ID NO: 438321 - protein, 9 aa, Influenza virus
EGDIIFLWG

SEQ ID NO: 438322 - protein, 9 aa, Influenza virus
EGECFYSGG

SEQ ID NO: 438323 - protein, 9 aa, Influenza virus
EGECYRACF

SEQ ID NO: 438324 - protein, 9 aa, Influenza virus
EGEGIPLHD

SEQ ID NO: 438325 - protein, 9 aa, Influenza virus
EGEGIPLYD

SEQ ID NO: 438326 - protein, 9 aa, Influenza virus
EGEQIIVTR

SEQ ID NO: 438327 - protein, 9 aa, Influenza virus
EGFAPFSKD

SEQ ID NO: 438328 - protein, 9 aa, Influenza virus
EGFEEFTMV

SEQ ID NO: 438329 - protein, 9 aa, Influenza virus
EGFSAESRK

SEQ ID NO: 438330 - protein, 9 aa, Influenza virus
EGFVRQCFN

SEQ ID NO: 438331 - protein, 9 aa, Influenza virus
EGGWCGMID

SEQ ID NO: 438332 - protein, 9 aa, Influenza virus
EGGWPGLIN

SEQ ID NO: 438333 - protein, 9 aa, Influenza virus
EGGWPGLVA

SEQ ID NO: 438334 - protein, 9 aa, Influenza virus
EGGWQGLVD

SEQ ID NO: 438335 - protein, 9 aa, Influenza virus
EGGWQGMID

SEQ ID NO: 438336 - protein, 9 aa, Influenza virus
EGGWQGMVD

SEQ ID NO: 438337 - protein, 9 aa, Influenza virus
EGGWSGLIA

SEQ ID NO: 438338 - protein, 9 aa, Influenza virus
EGGWSGLVA

SEQ ID NO: 438339 - protein, 9 aa, Influenza virus
EGGWSGMID

SEQ ID NO: 438340 - protein, 9 aa, Influenza virus
EGGWTGLID

SEQ ID NO: 438341 - protein, 9 aa, Influenza virus
EGGWTGMID

SEQ ID NO: 438342 - protein, 9 aa, Influenza virus
EGGWTGMVD

SEQ ID NO: 438343 - protein, 9 aa, Influenza virus
EGGWTGMVN

SEQ ID NO: 438344 - protein, 9 aa, Influenza virus
EGHIEECSC

SEQ ID NO: 438345 - protein, 9 aa, Influenza virus
EGIAADYKS

SEQ ID NO: 438346 - protein, 9 aa, Influenza virus
EGICYPGSI

SEQ ID NO: 438347 - protein, 9 aa, Influenza virus
EGICYPGSV

SEQ ID NO: 438348 - protein, 9 aa, Influenza virus
EGIGIAADR

SEQ ID NO: 438349 - protein, 9 aa, Influenza virus
EGIGQAADL

SEQ ID NO: 438350 - protein, 9 aa, Influenza virus
EGIILGNPK

SEQ ID NO: 438351 - protein, 9 aa, Influenza virus
EGIKLKSED

SEQ ID NO: 438352 - protein, 9 aa, Influenza virus
EGIKLKTED

SEQ ID NO: 438353 - protein, 9 aa, Influenza virus
EGIMNTSKP

SEQ ID NO: 438354 - protein, 9 aa, Influenza virus
EGIPLHDAI

SEQ ID NO: 438355 - protein, 9 aa, Influenza virus
EGIPLYDAI

SEQ ID NO: 438356 - protein, 9 aa, Influenza virus
EGIPLYDAV

SEQ ID NO: 438357 - protein, 9 aa, Influenza virus
EGIYKILTI

SEQ ID NO: 438358 - protein, 9 aa, Influenza virus
EGKHIVERI

SEQ ID NO: 438359 - protein, 9 aa, Influenza virus
EGKIAHISP

SEQ ID NO: 438360 - protein, 9 aa, Influenza virus
EGKIIHISP

SEQ ID NO: 438361 - protein, 9 aa, Influenza virus
EGKISHISP

SEQ ID NO: 438362 - protein, 9 aa, Influenza virus
EGKIVHIGP

SEQ ID NO: 438363 - protein, 9 aa, Influenza virus
EGKIVHISP

SEQ ID NO: 438364 - protein, 9 aa, Influenza virus
EGKIVHVSP

SEQ ID NO: 438365 - protein, 9 aa, Influenza virus
EGKLSQMSK

SEQ ID NO: 438366 - protein, 9 aa, Influenza virus
EGKLSQMSR

SEQ ID NO: 438367 - protein, 9 aa, Influenza virus
EGKVECICR

SEQ ID NO: 438368 - protein, 9 aa, Influenza virus
EGKVECVCR

SEQ ID NO: 438369 - protein, 9 aa, Influenza virus
EGKVVHISP

SEQ ID NO: 438370 - protein, 9 aa, Influenza virus
EGLIDGWYG

SEQ ID NO: 438371 - protein, 9 aa, Influenza virus
EGLILGNPK

SEQ ID NO: 438372 - protein, 9 aa, Influenza virus
EGLILSNPK

SEQ ID NO: 438373 - protein, 9 aa, Influenza virus
EGLINGWYG

SEQ ID NO: 438374 - protein, 9 aa, Influenza virus
EGLIYGNPS

SEQ ID NO: 438375 - protein, 9 aa, Influenza virus
EGLPQSGRI

SEQ ID NO: 438376 - protein, 9 aa, Influenza virus
EGLVDGWYG

SEQ ID NO: 438377 - protein, 9 aa, Influenza virus
EGLVLGNPK

SEQ ID NO: 438378 - protein, 9 aa, Influenza virus
EGLVYGNPA

SEQ ID NO: 438379 - protein, 9 aa, Influenza virus
EGLVYGNPS

SEQ ID NO: 438380 - protein, 9 aa, Influenza virus
EGLWAYNAE

SEQ ID NO: 438381 - protein, 9 aa, Influenza virus
EGMCYPGFV

SEQ ID NO: 438382 - protein, 9 aa, Influenza virus
EGMCYPGSI

SEQ ID NO: 438383 - protein, 9 aa, Influenza virus
EGMCYPGSV

SEQ ID NO: 438384 - protein, 9 aa, Influenza virus
EGMGQAADL

SEQ ID NO: 438385 - protein, 9 aa, Influenza virus
EGMIDGWYG

SEQ ID NO: 438386 - protein, 9 aa, Influenza virus
EGMMDGWYG

SEQ ID NO: 438387 - protein, 9 aa, Influenza virus
EGMVDGWYG

SEQ ID NO: 438388 - protein, 9 aa, Influenza virus
EGMVNGWYG

SEQ ID NO: 438389 - protein, 9 aa, Influenza virus
EGNDVCYPG

SEQ ID NO: 438390 - protein, 9 aa, Influenza virus
EGNGCFELL

SEQ ID NO: 438391 - protein, 9 aa, Influenza virus
EGNGCFTFY

SEQ ID NO: 438392 - protein, 9 aa, Influenza virus
EGNILRTQE

SEQ ID NO: 438393 - protein, 9 aa, Influenza virus
EGQRSWMKI

SEQ ID NO: 438394 - protein, 9 aa, Influenza virus
EGRGQAADL

SEQ ID NO: 438395 - protein, 9 aa, Influenza virus
EGRIQDLEK

SEQ ID NO: 438396 - protein, 9 aa, Influenza virus
EGRIQDLER

SEQ ID NO: 438397 - protein, 9 aa, Influenza virus
EGRLIQNSI

SEQ ID NO: 438398 - protein, 9 aa, Influenza virus
EGRLIQNSL

SEQ ID NO: 438399 - protein, 9 aa, Influenza virus
EGRLIQNSM

SEQ ID NO: 438400 - protein, 9 aa, Influenza virus
EGRNPGNAE

SEQ ID NO: 438401 - protein, 9 aa, Influenza virus
EGRRKTNLY

SEQ ID NO: 438402 - protein, 9 aa, Influenza virus
EGRRRTNLY

SEQ ID NO: 438403 - protein, 9 aa, Influenza virus
EGRTSDMRA

SEQ ID NO: 438404 - protein, 9 aa, Influenza virus
EGRTSDMRT

SEQ ID NO: 438405 - protein, 9 aa, Influenza virus
EGRWPGLVA

SEQ ID NO: 438406 - protein, 9 aa, Influenza virus
EGSDVCYPG

SEQ ID NO: 438407 - protein, 9 aa, Influenza virus
EGSIGKVCR

SEQ ID NO: 438408 - protein, 9 aa, Influenza virus
EGSINTRLP

SEQ ID NO: 438409 - protein, 9 aa, Influenza virus
EGSYFFGDN

SEQ ID NO: 438410 - protein, 9 aa, Influenza virus
EGTAADYKS

SEQ ID NO: 438411 - protein, 9 aa, Influenza virus
EGTDICYPG

SEQ ID NO: 438412 - protein, 9 aa, Influenza virus
EGTDVCYPG

SEQ ID NO: 438413 - protein, 9 aa, Influenza virus
EGTGIAADK

SEQ ID NO: 438414 - protein, 9 aa, Influenza virus
EGTGIAADR

SEQ ID NO: 438415 - protein, 9 aa, Influenza virus
EGTGIVADR

SEQ ID NO: 438416 - protein, 9 aa, Influenza virus
EGTGMAADQ

SEQ ID NO: 438417 - protein, 9 aa, Influenza virus
EGTGMAADR

SEQ ID NO: 438418 - protein, 9 aa, Influenza virus
EGTGQAADL

SEQ ID NO: 438419 - protein, 9 aa, Influenza virus
EGTGTAADL

SEQ ID NO: 438420 - protein, 9 aa, Influenza virus
EGTIVSSLP

SEQ ID NO: 438421 - protein, 9 aa, Influenza virus
EGTSIWTSS

SEQ ID NO: 438422 - protein, 9 aa, Influenza virus
EGTTASCQN

SEQ ID NO: 438423 - protein, 9 aa, Influenza virus
EGTYKILTI

SEQ ID NO: 438424 - protein, 9 aa, Influenza virus
EGVCYPGSI

SEQ ID NO: 438425 - protein, 9 aa, Influenza virus
EGVINTSKP

SEQ ID NO: 438426 - protein, 9 aa, Influenza virus
EGVMNTSKP

SEQ ID NO: 438427 - protein, 9 aa, Influenza virus
EGWIDSPNH

SEQ ID NO: 438428 - protein, 9 aa, Influenza virus
EGWIGGNPA

SEQ ID NO: 438429 - protein, 9 aa, Influenza virus
EGWILGNPK

SEQ ID NO: 438430 - protein, 9 aa, Influenza virus
EGWILGNPQ

SEQ ID NO: 438431 - protein, 9 aa, Influenza virus
EGWILGNPR

SEQ ID NO: 438432 - protein, 9 aa, Influenza virus
EGWINSPNH

SEQ ID NO: 438433 - protein, 9 aa, Influenza virus
EGWINSPSQ

SEQ ID NO: 438434 - protein, 9 aa, Influenza virus
EGWIVGNPA

SEQ ID NO: 438435 - protein, 9 aa, Influenza virus
EGWIVGNPS

SEQ ID NO: 438436 - protein, 9 aa, Influenza virus
EGWVVIAKD

SEQ ID NO: 438437 - protein, 9 aa, Influenza virus
EGWVVIAQD

SEQ ID NO: 438438 - protein, 9 aa, Influenza virus
EGWVVIEKD

SEQ ID NO: 438439 - protein, 9 aa, Influenza virus
EGWVVVAKD

SEQ ID NO: 438440 - protein, 9 aa, Influenza virus
EGYEEFTIV

SEQ ID NO: 438441 - protein, 9 aa, Influenza virus
EGYEEFTLV

SEQ ID NO: 438442 - protein, 9 aa, Influenza virus
EGYEEFTMI

SEQ ID NO: 438443 - protein, 9 aa, Influenza virus
EGYEEFTMV

SEQ ID NO: 438444 - protein, 9 aa, Influenza virus
EGYSLVGID

SEQ ID NO: 438445 - protein, 9 aa, Influenza virus
EGYSLVGVD

SEQ ID NO: 438446 - protein, 9 aa, Influenza virus
EHDANVRNL

SEQ ID NO: 438447 - protein, 9 aa, Influenza virus
EHDSNVENL

SEQ ID NO: 438448 - protein, 9 aa, Influenza virus
EHDSNVKNL

SEQ ID NO: 438449 - protein, 9 aa, Influenza virus
EHEEVTNAT

SEQ ID NO: 438450 - protein, 9 aa, Influenza virus
EHGSGYAAD

SEQ ID NO: 438451 - protein, 9 aa, Influenza virus
EHLIIWGIH

SEQ ID NO: 438452 - protein, 9 aa, Influenza virus
EHLIMWGIH

SEQ ID NO: 438453 - protein, 9 aa, Influenza virus
EHLITWGIH

SEQ ID NO: 438454 - protein, 9 aa, Influenza virus
EHLIVWGIH

SEQ ID NO: 438455 - protein, 9 aa, Influenza virus
EHLSSVSSF

SEQ ID NO: 438456 - protein, 9 aa, Influenza virus
EHLVMWGIH

SEQ ID NO: 438457 - protein, 9 aa, Influenza virus
EHNGILCAT

SEQ ID NO: 438458 - protein, 9 aa, Influenza virus
EHNGLLCAT

SEQ ID NO: 438459 - protein, 9 aa, Influenza virus
EHNGMLCAT

SEQ ID NO: 438460 - protein, 9 aa, Influenza virus
EHNGVLCAT

SEQ ID NO: 438461 - protein, 9 aa, Influenza virus
EHPNAGKDP

SEQ ID NO: 438462 - protein, 9 aa, Influenza virus
EHPSAGKDP

SEQ ID NO: 438463 - protein, 9 aa, Influenza virus
EHPSAGRDP

SEQ ID NO: 438464 - protein, 9 aa, Influenza virus
EHPSTGKDP

SEQ ID NO: 438465 - protein, 9 aa, Influenza virus
EHQIGNVIN

SEQ ID NO: 438466 - protein, 9 aa, Influenza virus
EHQISNVIN

SEQ ID NO: 438467 - protein, 9 aa, Influenza virus
EHSNGTIHD

SEQ ID NO: 438468 - protein, 9 aa, Influenza virus
EHSNGTTHD

SEQ ID NO: 438469 - protein, 9 aa, Influenza virus
EHTAYSQIT

SEQ ID NO: 438470 - protein, 9 aa, Influenza virus
EHTSKYVCT

SEQ ID NO: 438471 - protein, 9 aa, Influenza virus
EHTSQYLCT

SEQ ID NO: 438472 - protein, 9 aa, Influenza virus
EHTSRYICT

SEQ ID NO: 438473 - protein, 9 aa, Influenza virus
EHTSRYVCT

SEQ ID NO: 438474 - protein, 9 aa, Influenza virus
EIALSYSAG

SEQ ID NO: 438475 - protein, 9 aa, Influenza virus
EIAQKLEDV

SEQ ID NO: 438476 - protein, 9 aa, Influenza virus
EIAQRLEDV

SEQ ID NO: 438477 - protein, 9 aa, Influenza virus
EIAQRLEGV

SEQ ID NO: 438478 - protein, 9 aa, Influenza virus
EIAQRLENV

SEQ ID NO: 438479 - protein, 9 aa, Influenza virus
EIAQRLESV

SEQ ID NO: 438480 - protein, 9 aa, Influenza virus
EIASWAGNI

SEQ ID NO: 438481 - protein, 9 aa, Influenza virus
EICFMYSDF

SEQ ID NO: 438482 - protein, 9 aa, Influenza virus
EICIAWSSS

SEQ ID NO: 438483 - protein, 9 aa, Influenza virus
EICIGYLSN

SEQ ID NO: 438484 - protein, 9 aa, Influenza virus
EICIGYMSN

SEQ ID NO: 438485 - protein, 9 aa, Influenza virus
EICVAWSSS

SEQ ID NO: 438486 - protein, 9 aa, Influenza virus
EICVAWSST

SEQ ID NO: 438487 - protein, 9 aa, Influenza virus
EIDGIKLKS

SEQ ID NO: 438488 - protein, 9 aa, Influenza virus
EIDRSFRPN

SEQ ID NO: 438489 - protein, 9 aa, Influenza virus
EIEDLIFLA

SEQ ID NO: 438490 - protein, 9 aa, Influenza virus
EIEDLIFLT

SEQ ID NO: 438491 - protein, 9 aa, Influenza virus
EIEDLIFMA

SEQ ID NO: 438492 - protein, 9 aa, Influenza virus
EIEDLIFSA

SEQ ID NO: 438493 - protein, 9 aa, Influenza virus
EIEDLTFLA

SEQ ID NO: 438494 - protein, 9 aa, Influenza virus
EIEGICYPG

SEQ ID NO: 438495 - protein, 9 aa, Influenza virus
EIEGIKLES

SEQ ID NO: 438496 - protein, 9 aa, Influenza virus
EIEGIKLKS

SEQ ID NO: 438497 - protein, 9 aa, Influenza virus
EIEGIKLKT

SEQ ID NO: 438498 - protein, 9 aa, Influenza virus
EIEGIRLKS

SEQ ID NO: 438499 - protein, 9 aa, Influenza virus
EIEGRIQDL

SEQ ID NO: 438500 - protein, 9 aa, Influenza virus
EIEHQIGNV

SEQ ID NO: 438501 - protein, 9 aa, Influenza virus
EIEHQISNV

SEQ ID NO: 438502 - protein, 9 aa, Influenza virus
EIEKQIGNV

SEQ ID NO: 438503 - protein, 9 aa, Influenza virus
EIEQQIGNV

SEQ ID NO: 438504 - protein, 9 aa, Influenza virus
EIEYQIGNV

SEQ ID NO: 438505 - protein, 9 aa, Influenza virus
EIFHKCDDD

SEQ ID NO: 438506 - protein, 9 aa, Influenza virus
EIFHKCDDH

SEQ ID NO: 438507 - protein, 9 aa, Influenza virus
EIFHKCDDQ

SEQ ID NO: 438508 - protein, 9 aa, Influenza virus
EIFHKCDDR

SEQ ID NO: 438509 - protein, 9 aa, Influenza virus
EIFHKCDNQ

SEQ ID NO: 438510 - protein, 9 aa, Influenza virus
EIFHQCDND

SEQ ID NO: 438511 - protein, 9 aa, Influenza virus
EIFHQCDNN

SEQ ID NO: 438512 - protein, 9 aa, Influenza virus
EIFHRCDDQ

SEQ ID NO: 438513 - protein, 9 aa, Influenza virus
EIGAPQLNP

SEQ ID NO: 438514 - protein, 9 aa, Influenza virus
EIGARIGEG

SEQ ID NO: 438515 - protein, 9 aa, Influenza virus
EIGEDIAPI

SEQ ID NO: 438516 - protein, 9 aa, Influenza virus
EIGEDLAPI

SEQ ID NO: 438517 - protein, 9 aa, Influenza virus
EIGEDVAPI

SEQ ID NO: 438518 - protein, 9 aa, Influenza virus
EIGNGCFEF

SEQ ID NO: 438519 - protein, 9 aa, Influenza virus
EIGTRIGDG

SEQ ID NO: 438520 - protein, 9 aa, Influenza virus
EIGVTRREI

SEQ ID NO: 438521 - protein, 9 aa, Influenza virus
EIGVTRREV

SEQ ID NO: 438522 - protein, 9 aa, Influenza virus
EIHIYYLEK

SEQ ID NO: 438523 - protein, 9 aa, Influenza virus
EIIEGRDRA

SEQ ID NO: 438524 - protein, 9 aa, Influenza virus
EIIEGRDRI

SEQ ID NO: 438525 - protein, 9 aa, Influenza virus
EIIEGRDRN

SEQ ID NO: 438526 - protein, 9 aa, Influenza virus
EIIEGRDRT

SEQ ID NO: 438527 - protein, 9 aa, Influenza virus
EIIIRMMEN

SEQ ID NO: 438528 - protein, 9 aa, Influenza virus
EIILWFSFG

SEQ ID NO: 438529 - protein, 9 aa, Influenza virus
EIITHFQRK

SEQ ID NO: 438530 - protein, 9 aa, Influenza virus
EIITIGSIC

SEQ ID NO: 438531 - protein, 9 aa, Influenza virus
EIKCQTPLG

SEQ ID NO: 438532 - protein, 9 aa, Influenza virus
EIKGVELSS

SEQ ID NO: 438533 - protein, 9 aa, Influenza virus
EIKGVKLSN

SEQ ID NO: 438534 - protein, 9 aa, Influenza virus
EIKGVKLSS

SEQ ID NO: 438535 - protein, 9 aa, Influenza virus
EIKMNPNQK

SEQ ID NO: 438536 - protein, 9 aa, Influenza virus
EILKVPNAE

SEQ ID NO: 438537 - protein, 9 aa, Influenza virus
EILLIEDGW

SEQ ID NO: 438538 - protein, 9 aa, Influenza virus
EILLIEEGW

SEQ ID NO: 438539 - protein, 9 aa, Influenza virus
EILNNKNWS

SEQ ID NO: 438540 - protein, 9 aa, Influenza virus
EILRTQESE

SEQ ID NO: 438541 - protein, 9 aa, Influenza virus
EILTKITVD

SEQ ID NO: 438542 - protein, 9 aa, Influenza virus
EILTKTTVD

SEQ ID NO: 438543 - protein, 9 aa, Influenza virus
EILTRTTVD

SEQ ID NO: 438544 - protein, 9 aa, Influenza virus
EILVALENQ

SEQ ID NO: 438545 - protein, 9 aa, Influenza virus
EIMRIWRQA

SEQ ID NO: 438546 - protein, 9 aa, Influenza virus
EIMYLNNTT

SEQ ID NO: 438547 - protein, 9 aa, Influenza virus
EINGIKLKS

SEQ ID NO: 438548 - protein, 9 aa, Influenza virus
EINGPDSVL

SEQ ID NO: 438549 - protein, 9 aa, Influenza virus
EINGPESVL

SEQ ID NO: 438550 - protein, 9 aa, Influenza virus
EINRIFRPN

SEQ ID NO: 438551 - protein, 9 aa, Influenza virus
EINRNFKPN

SEQ ID NO: 438552 - protein, 9 aa, Influenza virus
EINRSFKPN

SEQ ID NO: 438553 - protein, 9 aa, Influenza virus
EINRSFRPN

SEQ ID NO: 438554 - protein, 9 aa, Influenza virus
EINTWARNI

SEQ ID NO: 438555 - protein, 9 aa, Influenza virus
EIPSWAGNI

SEQ ID NO: 438556 - protein, 9 aa, Influenza virus
EIPSWEGNI

SEQ ID NO: 438557 - protein, 9 aa, Influenza virus
EIPTWAGNI

SEQ ID NO: 438558 - protein, 9 aa, Influenza virus
EIRAFSFQL

SEQ ID NO: 438559 - protein, 9 aa, Influenza virus
EIRASVGKM

SEQ ID NO: 438560 - protein, 9 aa, Influenza virus
EIRASVGRM

SEQ ID NO: 438561 - protein, 9 aa, Influenza virus
EIRIAWSSS

SEQ ID NO: 438562 - protein, 9 aa, Influenza virus
EIRINMINS

SEQ ID NO: 438563 - protein, 9 aa, Influenza virus
EIRRIWRQA

SEQ ID NO: 438564 - protein, 9 aa, Influenza virus
EIRRVWRQA

SEQ ID NO: 438565 - protein, 9 aa, Influenza virus
EIRSSVGKM

SEQ ID NO: 438566 - protein, 9 aa, Influenza virus
EIRTFSFQF

SEQ ID NO: 438567 - protein, 9 aa, Influenza virus
EIRTFSFQL

SEQ ID NO: 438568 - protein, 9 aa, Influenza virus
EISETQGTE

SEQ ID NO: 438569 - protein, 9 aa, Influenza virus
EISFQGGHI

SEQ ID NO: 438570 - protein, 9 aa, Influenza virus
EISFTITGD

SEQ ID NO: 438571 - protein, 9 aa, Influenza virus
EISHCRATE

SEQ ID NO: 438572 - protein, 9 aa, Influenza virus
EITFHGAKE

SEQ ID NO: 438573 - protein, 9 aa, Influenza virus
EITFYGAKE

SEQ ID NO: 438574 - protein, 9 aa, Influenza virus
EITGIDKVC

SEQ ID NO: 438575 - protein, 9 aa, Influenza virus
EITGINKVC

SEQ ID NO: 438576 - protein, 9 aa, Influenza virus
EITTHFQRK

SEQ ID NO: 438577 - protein, 9 aa, Influenza virus
EITTKINNI

SEQ ID NO: 438578 - protein, 9 aa, Influenza virus
EIVDNKNWS

SEQ ID NO: 438579 - protein, 9 aa, Influenza virus
EIVDNNNWS

SEQ ID NO: 438580 - protein, 9 aa, Influenza virus
EIVDNSNWS

SEQ ID NO: 438581 - protein, 9 aa, Influenza virus
EIVGNDNWS

SEQ ID NO: 438582 - protein, 9 aa, Influenza virus
EIVSNDNWS

SEQ ID NO: 438583 - protein, 9 aa, Influenza virus
EIVTHFQRK

SEQ ID NO: 438584 - protein, 9 aa, Influenza virus
EIVYLNDTI

SEQ ID NO: 438585 - protein, 9 aa, Influenza virus
EIVYLNNTI

SEQ ID NO: 438586 - protein, 9 aa, Influenza virus
EIVYLNNTT

SEQ ID NO: 438587 - protein, 9 aa, Influenza virus
EIVYLNSTT

SEQ ID NO: 438588 - protein, 9 aa, Influenza virus
EIWSYNAEF

SEQ ID NO: 438589 - protein, 9 aa, Influenza virus
EIWSYNAEL

SEQ ID NO: 438590 - protein, 9 aa, Influenza virus
EIYNETVRL

SEQ ID NO: 438591 - protein, 9 aa, Influenza virus
EKAIWTSGS

SEQ ID NO: 438592 - protein, 9 aa, Influenza virus
EKAMKEHGE

SEQ ID NO: 438593 - protein, 9 aa, Influenza virus
EKAMKEYGE

SEQ ID NO: 438594 - protein, 9 aa, Influenza virus
EKANKIKAE

SEQ ID NO: 438595 - protein, 9 aa, Influenza virus
EKANKIKSE

SEQ ID NO: 438596 - protein, 9 aa, Influenza virus
EKANKIKTE

SEQ ID NO: 438597 - protein, 9 aa, Influenza virus
EKANVLIGQ

SEQ ID NO: 438598 - protein, 9 aa, Influenza virus
EKASKIKSE

SEQ ID NO: 438599 - protein, 9 aa, Influenza virus
EKDLTKEFF

SEQ ID NO: 438600 - protein, 9 aa, Influenza virus
EKDMTKEFF

SEQ ID NO: 438601 - protein, 9 aa, Influenza virus
EKDMTREFF

SEQ ID NO: 438602 - protein, 9 aa, Influenza virus
EKDNAVRFG

SEQ ID NO: 438603 - protein, 9 aa, Influenza virus
EKEEVINAT

SEQ ID NO: 438604 - protein, 9 aa, Influenza virus
EKEEVTNAT

SEQ ID NO: 438605 - protein, 9 aa, Influenza virus
EKEFEQVEG

SEQ ID NO: 438606 - protein, 9 aa, Influenza virus
EKEFGQVEG

SEQ ID NO: 438607 - protein, 9 aa, Influenza virus
EKEFSEIEG

SEQ ID NO: 438608 - protein, 9 aa, Influenza virus
EKEFSEVEG

SEQ ID NO: 438609 - protein, 9 aa, Influenza virus
EKEGYSLVG

SEQ ID NO: 438610 - protein, 9 aa, Influenza virus
EKEKEICSV

SEQ ID NO: 438611 - protein, 9 aa, Influenza virus
EKENSYPKI

SEQ ID NO: 438612 - protein, 9 aa, Influenza virus
EKENSYPMI

SEQ ID NO: 438613 - protein, 9 aa, Influenza virus
EKESKLNRN

SEQ ID NO: 438614 - protein, 9 aa, Influenza virus
EKESTQKAI

SEQ ID NO: 438615 - protein, 9 aa, Influenza virus
EKFFPSSSY

SEQ ID NO: 438616 - protein, 9 aa, Influenza virus
EKFHQIEKE

SEQ ID NO: 438617 - protein, 9 aa, Influenza virus
EKGAKQEEN

SEQ ID NO: 438618 - protein, 9 aa, Influenza virus
EKGIEVVNA

SEQ ID NO: 438619 - protein, 9 aa, Influenza virus
EKGKVVKSV

SEQ ID NO: 438620 - protein, 9 aa, Influenza virus
EKGNPGVKG

SEQ ID NO: 438621 - protein, 9 aa, Influenza virus
EKGNQGVKG

SEQ ID NO: 438622 - protein, 9 aa, Influenza virus
EKGPKQEEN

SEQ ID NO: 438623 - protein, 9 aa, Influenza virus
EKGTKQEEN

SEQ ID NO: 438624 - protein, 9 aa, Influenza virus
EKGVEVVNA

SEQ ID NO: 438625 - protein, 9 aa, Influenza virus
EKHLAYCNT

SEQ ID NO: 438626 - protein, 9 aa, Influenza virus
EKHPAYCNT

SEQ ID NO: 438627 - protein, 9 aa, Influenza virus
EKHSAYCNT

SEQ ID NO: 438628 - protein, 9 aa, Influenza virus
EKIEKIRPL

SEQ ID NO: 438629 - protein, 9 aa, Influenza virus
EKIHTRGLF

SEQ ID NO: 438630 - protein, 9 aa, Influenza virus
EKIKILPRD

SEQ ID NO: 438631 - protein, 9 aa, Influenza virus
EKIRNGTYD

SEQ ID NO: 438632 - protein, 9 aa, Influenza virus
EKIRTRGLF

SEQ ID NO: 438633 - protein, 9 aa, Influenza virus
EKIRVKRRP

SEQ ID NO: 438634 - protein, 9 aa, Influenza virus
EKITNKVNN

SEQ ID NO: 438635 - protein, 9 aa, Influenza virus
EKIVTVTHA

SEQ ID NO: 438636 - protein, 9 aa, Influenza virus
EKKAKLANV

SEQ ID NO: 438637 - protein, 9 aa, Influenza virus
EKKINMIND

SEQ ID NO: 438638 - protein, 9 aa, Influenza virus
EKLEQSGLP

SEQ ID NO: 438639 - protein, 9 aa, Influenza virus
EKLTIIYSS

SEQ ID NO: 438640 - protein, 9 aa, Influenza virus
EKLTITYSS

SEQ ID NO: 438641 - protein, 9 aa, Influenza virus
EKLVLATGL

SEQ ID NO: 438642 - protein, 9 aa, Influenza virus
EKLVLATGP

SEQ ID NO: 438643 - protein, 9 aa, Influenza virus
EKMNGNYDS

SEQ ID NO: 438644 - protein, 9 aa, Influenza virus
EKMNIQFTA

SEQ ID NO: 438645 - protein, 9 aa, Influenza virus
EKMNIQFTS

SEQ ID NO: 438646 - protein, 9 aa, Influenza virus
EKMNTQFTA

SEQ ID NO: 438647 - protein, 9 aa, Influenza virus
EKMNTQFTV

SEQ ID NO: 438648 - protein, 9 aa, Influenza virus
EKMVLSAFD

SEQ ID NO: 438649 - protein, 9 aa, Influenza virus
EKNALGDCP

SEQ ID NO: 438650 - protein, 9 aa, Influenza virus
EKNALYGTQ

SEQ ID NO: 438651 - protein, 9 aa, Influenza virus
EKNATASFI

SEQ ID NO: 438652 - protein, 9 aa, Influenza virus
EKNDLYGTQ

SEQ ID NO: 438653 - protein, 9 aa, Influenza virus
EKNELYGTQ

SEQ ID NO: 438654 - protein, 9 aa, Influenza virus
EKNITEIVY

SEQ ID NO: 438655 - protein, 9 aa, Influenza virus
EKNITKIVY

SEQ ID NO: 438656 - protein, 9 aa, Influenza virus
EKNITVTHA

SEQ ID NO: 438657 - protein, 9 aa, Influenza virus
EKNITVTHS

SEQ ID NO: 438658 - protein, 9 aa, Influenza virus
EKNPALRMK

SEQ ID NO: 438659 - protein, 9 aa, Influenza virus
EKNPAYCNT

SEQ ID NO: 438660 - protein, 9 aa, Influenza virus
EKNPSLRMK

SEQ ID NO: 438661 - protein, 9 aa, Influenza virus
EKNVTVTHA

SEQ ID NO: 438662 - protein, 9 aa, Influenza virus
EKNVTVTHS

SEQ ID NO: 438663 - protein, 9 aa, Influenza virus
EKNVTVTRA

SEQ ID NO: 438664 - protein, 9 aa, Influenza virus
EKPFQNVNK

SEQ ID NO: 438665 - protein, 9 aa, Influenza virus
EKQIGNVIN

SEQ ID NO: 438666 - protein, 9 aa, Influenza virus
EKQLGNVIN

SEQ ID NO: 438667 - protein, 9 aa, Influenza virus
EKQTRGIFG

SEQ ID NO: 438668 - protein, 9 aa, Influenza virus
EKQTRGLFG

SEQ ID NO: 438669 - protein, 9 aa, Influenza virus
EKRGLFGAI

SEQ ID NO: 438670 - protein, 9 aa, Influenza virus
EKRIENLNK

SEQ ID NO: 438671 - protein, 9 aa, Influenza virus
EKRINMIAD

SEQ ID NO: 438672 - protein, 9 aa, Influenza virus
EKRINMIND

SEQ ID NO: 438673 - protein, 9 aa, Influenza virus
EKRINMISD

SEQ ID NO: 438674 - protein, 9 aa, Influenza virus
EKRINMLAD

SEQ ID NO: 438675 - protein, 9 aa, Influenza virus
EKRINVIND

SEQ ID NO: 438676 - protein, 9 aa, Influenza virus
EKRLENLDK

SEQ ID NO: 438677 - protein, 9 aa, Influenza virus
EKRLENLNK

SEQ ID NO: 438678 - protein, 9 aa, Influenza virus
EKRLGNLNK

SEQ ID NO: 438679 - protein, 9 aa, Influenza virus
EKRRKKRGL

SEQ ID NO: 438680 - protein, 9 aa, Influenza virus
EKRTNMIND

SEQ ID NO: 438681 - protein, 9 aa, Influenza virus
EKSHPGIFE

SEQ ID NO: 438682 - protein, 9 aa, Influenza virus
EKSNKIKSE

SEQ ID NO: 438683 - protein, 9 aa, Influenza virus
EKSRINGVK

SEQ ID NO: 438684 - protein, 9 aa, Influenza virus
EKTHIHIFS

SEQ ID NO: 438685 - protein, 9 aa, Influenza virus
EKTHNGKLC

SEQ ID NO: 438686 - protein, 9 aa, Influenza virus
EKTHNGRLC

SEQ ID NO: 438687 - protein, 9 aa, Influenza virus
EKTIWTSGS

SEQ ID NO: 438688 - protein, 9 aa, Influenza virus
EKTLDLHDS

SEQ ID NO: 438689 - protein, 9 aa, Influenza virus
EKTMKEYGE

SEQ ID NO: 438690 - protein, 9 aa, Influenza virus
EKTNDKYHQ

SEQ ID NO: 438691 - protein, 9 aa, Influenza virus
EKTNEKFHQ

SEQ ID NO: 438692 - protein, 9 aa, Influenza virus
EKTNEKYHQ

SEQ ID NO: 438693 - protein, 9 aa, Influenza virus
EKTNKQFEL

SEQ ID NO: 438694 - protein, 9 aa, Influenza virus
EKTNQQFEL

SEQ ID NO: 438695 - protein, 9 aa, Influenza virus
EKTNQQFKL

SEQ ID NO: 438696 - protein, 9 aa, Influenza virus
EKTNTEFES

SEQ ID NO: 438697 - protein, 9 aa, Influenza virus
EKTNTQFEL

SEQ ID NO: 438698 - protein, 9 aa, Influenza virus
EKTSWSYIV

SEQ ID NO: 438699 - protein, 9 aa, Influenza virus
EKVDTIIEN

SEQ ID NO: 438700 - protein, 9 aa, Influenza virus
EKVDTIIES

SEQ ID NO: 438701 - protein, 9 aa, Influenza virus
EKVDTLLEN

SEQ ID NO: 438702 - protein, 9 aa, Influenza virus
EKVDTLLES

SEQ ID NO: 438703 - protein, 9 aa, Influenza virus
EKVEGRIQD

SEQ ID NO: 438704 - protein, 9 aa, Influenza virus
EKVHNGKLC

SEQ ID NO: 438705 - protein, 9 aa, Influenza virus
EKVKILARN

SEQ ID NO: 438706 - protein, 9 aa, Influenza virus
EKVKILPKD

SEQ ID NO: 438707 - protein, 9 aa, Influenza virus
EKVKILPRD

SEQ ID NO: 438708 - protein, 9 aa, Influenza virus
EKVNTLLEN

SEQ ID NO: 438709 - protein, 9 aa, Influenza virus
EKVRILPKD

SEQ ID NO: 438710 - protein, 9 aa, Influenza virus
EKVRLQLRD

SEQ ID NO: 438711 - protein, 9 aa, Influenza virus
EKVRMQLRD

SEQ ID NO: 438712 - protein, 9 aa, Influenza virus
EKVRNGTYD

SEQ ID NO: 438713 - protein, 9 aa, Influenza virus
EKVRRQLRE

SEQ ID NO: 438714 - protein, 9 aa, Influenza virus
EKVTNATET

SEQ ID NO: 438715 - protein, 9 aa, Influenza virus
EKVWWTSNS

SEQ ID NO: 438716 - protein, 9 aa, Influenza virus
EKWPIGESP

SEQ ID NO: 438717 - protein, 9 aa, Influenza virus
EKYGSGRIF

SEQ ID NO: 438718 - protein, 9 aa, Influenza virus
EKYGTGRIF

SEQ ID NO: 438719 - protein, 9 aa, Influenza virus
EKYHQIEKE

SEQ ID NO: 438720 - protein, 9 aa, Influenza virus
EKYVEDTKI

SEQ ID NO: 438721 - protein, 9 aa, Influenza virus
EKYVEDTKV

SEQ ID NO: 438722 - protein, 9 aa, Influenza virus
ELAEKAMKE

SEQ ID NO: 438723 - protein, 9 aa, Influenza virus
ELAEKTMKE

SEQ ID NO: 438724 - protein, 9 aa, Influenza virus
ELAERAMKE

SEQ ID NO: 438725 - protein, 9 aa, Influenza virus
ELCPKPLKL

SEQ ID NO: 438726 - protein, 9 aa, Influenza virus
ELCPSPLKL

SEQ ID NO: 438727 - protein, 9 aa, Influenza virus
ELCPSPLRL

SEQ ID NO: 438728 - protein, 9 aa, Influenza virus
ELCSSPLRL

SEQ ID NO: 438729 - protein, 9 aa, Influenza virus
ELCTINSWH

SEQ ID NO: 438730 - protein, 9 aa, Influenza virus
ELDEIGEDI

SEQ ID NO: 438731 - protein, 9 aa, Influenza virus
ELDEIGEDL

SEQ ID NO: 438732 - protein, 9 aa, Influenza virus
ELDEIGEDV

SEQ ID NO: 438733 - protein, 9 aa, Influenza virus
ELDNNGELR

SEQ ID NO: 438734 - protein, 9 aa, Influenza virus
ELEIGARIG

SEQ ID NO: 438735 - protein, 9 aa, Influenza virus
ELEIGTRIG

SEQ ID NO: 438736 - protein, 9 aa, Influenza virus
ELFHKCDDD

SEQ ID NO: 438737 - protein, 9 aa, Influenza virus
ELFVLMENE

SEQ ID NO: 438738 - protein, 9 aa, Influenza virus
ELGAPLVLD

SEQ ID NO: 438739 - protein, 9 aa, Influenza virus
ELGDAPFLD

SEQ ID NO: 438740 - protein, 9 aa, Influenza virus
ELGDCSIAG

SEQ ID NO: 438741 - protein, 9 aa, Influenza virus
ELGDCSITG

SEQ ID NO: 438742 - protein, 9 aa, Influenza virus
ELGIPFHLG

SEQ ID NO: 438743 - protein, 9 aa, Influenza virus
ELGNGCFEF

SEQ ID NO: 438744 - protein, 9 aa, Influenza virus
ELGSPLVLD

SEQ ID NO: 438745 - protein, 9 aa, Influenza virus
ELGVPFHLA

SEQ ID NO: 438746 - protein, 9 aa, Influenza virus
ELGVPFHLG

SEQ ID NO: 438747 - protein, 9 aa, Influenza virus
ELGVPFYLG

SEQ ID NO: 438748 - protein, 9 aa, Influenza virus
ELGVSFHLG

SEQ ID NO: 438749 - protein, 9 aa, Influenza virus
ELIDNEFNE

SEQ ID NO: 438750 - protein, 9 aa, Influenza virus
ELIDNEFSE

SEQ ID NO: 438751 - protein, 9 aa, Influenza virus
ELIDNEFTE

SEQ ID NO: 438752 - protein, 9 aa, Influenza virus
ELIDSEFNE

SEQ ID NO: 438753 - protein, 9 aa, Influenza virus
ELIGKTSWS

SEQ ID NO: 438754 - protein, 9 aa, Influenza virus
ELINNEFNE

SEQ ID NO: 438755 - protein, 9 aa, Influenza virus
ELINPNKWG

SEQ ID NO: 438756 - protein, 9 aa, Influenza virus
ELINPSKWG

SEQ ID NO: 438757 - protein, 9 aa, Influenza virus
ELIPPSKWG

SEQ ID NO: 438758 - protein, 9 aa, Influenza virus
ELIRGMPKE

SEQ ID NO: 438759 - protein, 9 aa, Influenza virus
ELIRGMPQE

SEQ ID NO: 438760 - protein, 9 aa, Influenza virus
ELIRGQPKE

SEQ ID NO: 438761 - protein, 9 aa, Influenza virus
ELIRGRKQE

SEQ ID NO: 438762 - protein, 9 aa, Influenza virus
ELIRGRPEE

SEQ ID NO: 438763 - protein, 9 aa, Influenza virus
ELIRGRPKE

SEQ ID NO: 438764 - protein, 9 aa, Influenza virus
ELIRGRPQE

SEQ ID NO: 438765 - protein, 9 aa, Influenza virus
ELIRGRPRE

SEQ ID NO: 438766 - protein, 9 aa, Influenza virus
ELIRGRQQE

SEQ ID NO: 438767 - protein, 9 aa, Influenza virus
ELIRGRSQE

SEQ ID NO: 438768 - protein, 9 aa, Influenza virus
ELIRMIKRG

SEQ ID NO: 438769 - protein, 9 aa, Influenza virus
ELIRMVKRG

SEQ ID NO: 438770 - protein, 9 aa, Influenza virus
ELISPNKWG

SEQ ID NO: 438771 - protein, 9 aa, Influenza virus
ELISPSKWG

SEQ ID NO: 438772 - protein, 9 aa, Influenza virus
ELIVLLENQ

SEQ ID NO: 438773 - protein, 9 aa, Influenza virus
ELKEQLSTV

SEQ ID NO: 438774 - protein, 9 aa, Influenza virus
ELKHLLNRI

SEQ ID NO: 438775 - protein, 9 aa, Influenza virus
ELKHLLSRI

SEQ ID NO: 438776 - protein, 9 aa, Influenza virus
ELKHLLSRT

SEQ ID NO: 438777 - protein, 9 aa, Influenza virus
ELKHLLSST

SEQ ID NO: 438778 - protein, 9 aa, Influenza virus
ELKHLMSST

SEQ ID NO: 438779 - protein, 9 aa, Influenza virus
ELKSLFSSI

SEQ ID NO: 438780 - protein, 9 aa, Influenza virus
ELKWLISKS

SEQ ID NO: 438781 - protein, 9 aa, Influenza virus
ELKWLVSKD

SEQ ID NO: 438782 - protein, 9 aa, Influenza virus
ELKWLVSKN

SEQ ID NO: 438783 - protein, 9 aa, Influenza virus
ELKWLVSKS

SEQ ID NO: 438784 - protein, 9 aa, Influenza virus
ELKWLVSKT

SEQ ID NO: 438785 - protein, 9 aa, Influenza virus
ELLHKCNDS

SEQ ID NO: 438786 - protein, 9 aa, Influenza virus
ELLHKCNNS

SEQ ID NO: 438787 - protein, 9 aa, Influenza virus
ELLHKCNNT

SEQ ID NO: 438788 - protein, 9 aa, Influenza virus
ELLIAMENQ

SEQ ID NO: 438789 - protein, 9 aa, Influenza virus
ELLILLENE

SEQ ID NO: 438790 - protein, 9 aa, Influenza virus
ELLVALENQ

SEQ ID NO: 438791 - protein, 9 aa, Influenza virus
ELLVAMENQ

SEQ ID NO: 438792 - protein, 9 aa, Influenza virus
ELLVLIENE

SEQ ID NO: 438793 - protein, 9 aa, Influenza virus
ELLVLIENQ

SEQ ID NO: 438794 - protein, 9 aa, Influenza virus
ELLVLLENE

SEQ ID NO: 438795 - protein, 9 aa, Influenza virus
ELLVLLENG

SEQ ID NO: 438796 - protein, 9 aa, Influenza virus
ELLVLLENQ

SEQ ID NO: 438797 - protein, 9 aa, Influenza virus
ELLVLLGNQ

SEQ ID NO: 438798 - protein, 9 aa, Influenza virus
ELLVLMENE

SEQ ID NO: 438799 - protein, 9 aa, Influenza virus
ELNNNGELR

SEQ ID NO: 438800 - protein, 9 aa, Influenza virus
ELPFQNLSP

SEQ ID NO: 438801 - protein, 9 aa, Influenza virus
ELPFTIDKS

SEQ ID NO: 438802 - protein, 9 aa, Influenza virus
ELPFTIDKY

SEQ ID NO: 438803 - protein, 9 aa, Influenza virus
ELPSFGVSG

SEQ ID NO: 438804 - protein, 9 aa, Influenza virus
ELRDCKIEA

SEQ ID NO: 438805 - protein, 9 aa, Influenza virus
ELRDCKVEA

SEQ ID NO: 438806 - protein, 9 aa, Influenza virus
ELRDCSIAG

SEQ ID NO: 438807 - protein, 9 aa, Influenza virus
ELREHLSSV

SEQ ID NO: 438808 - protein, 9 aa, Influenza virus
ELREQLSSV

SEQ ID NO: 438809 - protein, 9 aa, Influenza virus
ELREQLSTV

SEQ ID NO: 438810 - protein, 9 aa, Influenza virus
ELRFLFSSI

SEQ ID NO: 438811 - protein, 9 aa, Influenza virus
ELRFVFSIA

SEQ ID NO: 438812 - protein, 9 aa, Influenza virus
ELRFVFSNA

SEQ ID NO: 438813 - protein, 9 aa, Influenza virus
ELRFVFSSA

SEQ ID NO: 438814 - protein, 9 aa, Influenza virus
ELRHLFSGI

SEQ ID NO: 438815 - protein, 9 aa, Influenza virus
ELRHLFSGV

SEQ ID NO: 438816 - protein, 9 aa, Influenza virus
ELRRCLLQS

SEQ ID NO: 438817 - protein, 9 aa, Influenza virus
ELRRIWRQA

SEQ ID NO: 438818 - protein, 9 aa, Influenza virus
ELRRQKSLI

SEQ ID NO: 438819 - protein, 9 aa, Influenza virus
ELRRQKWWV

SEQ ID NO: 438820 - protein, 9 aa, Influenza virus
ELRSGYWAI

SEQ ID NO: 438821 - protein, 9 aa, Influenza virus
ELRSKYWAI

SEQ ID NO: 438822 - protein, 9 aa, Influenza virus
ELRSLFSSI

SEQ ID NO: 438823 - protein, 9 aa, Influenza virus
ELRSRYWAI

SEQ ID NO: 438824 - protein, 9 aa, Influenza virus
ELSFTITGD

SEQ ID NO: 438825 - protein, 9 aa, Influenza virus
ELSFTVTGD

SEQ ID NO: 438826 - protein, 9 aa, Influenza virus
ELSSGYKDV

SEQ ID NO: 438827 - protein, 9 aa, Influenza virus
ELSSMGVYQ

SEQ ID NO: 438828 - protein, 9 aa, Influenza virus
ELVETNHTD

SEQ ID NO: 438829 - protein, 9 aa, Influenza virus
ELVHGGIDP

SEQ ID NO: 438830 - protein, 9 aa, Influenza virus
ELVHGGINP

SEQ ID NO: 438831 - protein, 9 aa, Influenza virus
ELVHGGVDP

SEQ ID NO: 438832 - protein, 9 aa, Influenza virus
ELVHGQVNP

SEQ ID NO: 438833 - protein, 9 aa, Influenza virus
ELVHRGIDP

SEQ ID NO: 438834 - protein, 9 aa, Influenza virus
ELVRGRPKE

SEQ ID NO: 438835 - protein, 9 aa, Influenza virus
ELVRKTRFL

SEQ ID NO: 438836 - protein, 9 aa, Influenza virus
ELVRMIKRG

SEQ ID NO: 438837 - protein, 9 aa, Influenza virus
ELWAYNAEL

SEQ ID NO: 438838 - protein, 9 aa, Influenza virus
ELWQCYYLL

SEQ ID NO: 438839 - protein, 9 aa, Influenza virus
ELWSYNAEL

SEQ ID NO: 438840 - protein, 9 aa, Influenza virus
ELYGTQSLS

SEQ ID NO: 438841 - protein, 9 aa, Influenza virus
EMCAAWSSS

SEQ ID NO: 438842 - protein, 9 aa, Influenza virus
EMCHGTQIG

SEQ ID NO: 438843 - protein, 9 aa, Influenza virus
EMCHSTQIG

SEQ ID NO: 438844 - protein, 9 aa, Influenza virus
EMCHSTRIG

SEQ ID NO: 438845 - protein, 9 aa, Influenza virus
EMDKLFERV

SEQ ID NO: 438846 - protein, 9 aa, Influenza virus
EMDKLYERV

SEQ ID NO: 438847 - protein, 9 aa, Influenza virus
EMDKLYTRV

SEQ ID NO: 438848 - protein, 9 aa, Influenza virus
EMEGICYPG

SEQ ID NO: 438849 - protein, 9 aa, Influenza virus
EMEGVCYPG

SEQ ID NO: 438850 - protein, 9 aa, Influenza virus
EMGLAPSPY

SEQ ID NO: 438851 - protein, 9 aa, Influenza virus
EMGNGCFEF

SEQ ID NO: 438852 - protein, 9 aa, Influenza virus
EMGNGCFKI

SEQ ID NO: 438853 - protein, 9 aa, Influenza virus
EMGQAPSPY

SEQ ID NO: 438854 - protein, 9 aa, Influenza virus
EMIDNEFNE

SEQ ID NO: 438855 - protein, 9 aa, Influenza virus
EMIRGEPEE

SEQ ID NO: 438856 - protein, 9 aa, Influenza virus
EMIRGKPEE

SEQ ID NO: 438857 - protein, 9 aa, Influenza virus
EMIRGKPKE

SEQ ID NO: 438858 - protein, 9 aa, Influenza virus
EMIRGQPKE

SEQ ID NO: 438859 - protein, 9 aa, Influenza virus
EMIRGRPEE

SEQ ID NO: 438860 - protein, 9 aa, Influenza virus
EMIWDANGW

SEQ ID NO: 438861 - protein, 9 aa, Influenza virus
EMIWDPDGW

SEQ ID NO: 438862 - protein, 9 aa, Influenza virus
EMIWDPNGW

SEQ ID NO: 438863 - protein, 9 aa, Influenza virus
EMKKLYERV

SEQ ID NO: 438864 - protein, 9 aa, Influenza virus
EMKWLLSNA

SEQ ID NO: 438865 - protein, 9 aa, Influenza virus
EMKWLLSNN

SEQ ID NO: 438866 - protein, 9 aa, Influenza virus
EMKWLLSNS

SEQ ID NO: 438867 - protein, 9 aa, Influenza virus
EMKWLLSNT

SEQ ID NO: 438868 - protein, 9 aa, Influenza virus
EMKWLLSSK

SEQ ID NO: 438869 - protein, 9 aa, Influenza virus
EMKWLLSSS

SEQ ID NO: 438870 - protein, 9 aa, Influenza virus
EMKWLLSST

SEQ ID NO: 438871 - protein, 9 aa, Influenza virus
EMKWLSSSG

SEQ ID NO: 438872 - protein, 9 aa, Influenza virus
EMKWLSSSM

SEQ ID NO: 438873 - protein, 9 aa, Influenza virus
EMLKIHNAG

SEQ ID NO: 438874 - protein, 9 aa, Influenza virus
EMLKIPNAE

SEQ ID NO: 438875 - protein, 9 aa, Influenza virus
EMLKIPNAG

SEQ ID NO: 438876 - protein, 9 aa, Influenza virus
EMLKVPDAE

SEQ ID NO: 438877 - protein, 9 aa, Influenza virus
EMLKVPNAE

SEQ ID NO: 438878 - protein, 9 aa, Influenza virus
EMLKVPNAG

SEQ ID NO: 438879 - protein, 9 aa, Influenza virus
EMLKVPNAL

SEQ ID NO: 438880 - protein, 9 aa, Influenza virus
EMLNLYDRV

SEQ ID NO: 438881 - protein, 9 aa, Influenza virus
EMLNLYERV

SEQ ID NO: 438882 - protein, 9 aa, Influenza virus
EMLRIPNAG

SEQ ID NO: 438883 - protein, 9 aa, Influenza virus
EMLTGNLQT

SEQ ID NO: 438884 - protein, 9 aa, Influenza virus
EMNKLFEKT

SEQ ID NO: 438885 - protein, 9 aa, Influenza virus
EMNKLFERT

SEQ ID NO: 438886 - protein, 9 aa, Influenza virus
EMNKLFERV

SEQ ID NO: 438887 - protein, 9 aa, Influenza virus
EMNKLYEKV

SEQ ID NO: 438888 - protein, 9 aa, Influenza virus
EMNKLYERV

SEQ ID NO: 438889 - protein, 9 aa, Influenza virus
EMNRLFERV

SEQ ID NO: 438890 - protein, 9 aa, Influenza virus
EMRRCLLQS

SEQ ID NO: 438891 - protein, 9 aa, Influenza virus
EMRTFSFQL

SEQ ID NO: 438892 - protein, 9 aa, Influenza virus
EMSFQGRGV

SEQ ID NO: 438893 - protein, 9 aa, Influenza virus
EMSKLFEKT

SEQ ID NO: 438894 - protein, 9 aa, Influenza virus
EMSKLFERT

SEQ ID NO: 438895 - protein, 9 aa, Influenza virus
EMSKLFERV

SEQ ID NO: 438896 - protein, 9 aa, Influenza virus
EMSKLYERV

SEQ ID NO: 438897 - protein, 9 aa, Influenza virus
EMTDSEMLN

SEQ ID NO: 438898 - protein, 9 aa, Influenza virus
EMTFHGAKE

SEQ ID NO: 438899 - protein, 9 aa, Influenza virus
EMTLDFHDS

SEQ ID NO: 438900 - protein, 9 aa, Influenza virus
EMVWDANGW

SEQ ID NO: 438901 - protein, 9 aa, Influenza virus
EMVWDPNGW

SEQ ID NO: 438902 - protein, 9 aa, Influenza virus
EMWPIGESP

SEQ ID NO: 438903 - protein, 9 aa, Influenza virus
EMWSYNAEL

SEQ ID NO: 438904 - protein, 9 aa, Influenza virus
EMYNETVRV

SEQ ID NO: 438905 - protein, 9 aa, Influenza virus
ENAEDIGNG

SEQ ID NO: 438906 - protein, 9 aa, Influenza virus
ENAEDKGNG

SEQ ID NO: 438907 - protein, 9 aa, Influenza virus
ENAEDMGDG

SEQ ID NO: 438908 - protein, 9 aa, Influenza virus
ENAEDMGGG

SEQ ID NO: 438909 - protein, 9 aa, Influenza virus
ENAEDMGNG

SEQ ID NO: 438910 - protein, 9 aa, Influenza virus
ENAEDQGNG

SEQ ID NO: 438911 - protein, 9 aa, Influenza virus
ENAEDRGNG

SEQ ID NO: 438912 - protein, 9 aa, Influenza virus
ENAEEDCTG

SEQ ID NO: 438913 - protein, 9 aa, Influenza virus
ENAEEDGNG

SEQ ID NO: 438914 - protein, 9 aa, Influenza virus
ENAEEDGTG

SEQ ID NO: 438915 - protein, 9 aa, Influenza virus
ENAEEMGNG

SEQ ID NO: 438916 - protein, 9 aa, Influenza virus
ENAIDAGDG

SEQ ID NO: 438917 - protein, 9 aa, Influenza virus
ENAIDNGDG

SEQ ID NO: 438918 - protein, 9 aa, Influenza virus
ENAIDTGDG

SEQ ID NO: 438919 - protein, 9 aa, Influenza virus
ENALDTGDG

SEQ ID NO: 438920 - protein, 9 aa, Influenza virus
ENATASFIY

SEQ ID NO: 438921 - protein, 9 aa, Influenza virus
ENATATVYY

SEQ ID NO: 438922 - protein, 9 aa, Influenza virus
ENAVDTGDG

SEQ ID NO: 438923 - protein, 9 aa, Influenza virus
ENDKTLDLH

SEQ ID NO: 438924 - protein, 9 aa, Influenza virus
ENDKTLDMH

SEQ ID NO: 438925 - protein, 9 aa, Influenza virus
ENDKTLNMH

SEQ ID NO: 438926 - protein, 9 aa, Influenza virus
ENDRTLDLH

SEQ ID NO: 438927 - protein, 9 aa, Influenza virus
ENDVPVTSS

SEQ ID NO: 438928 - protein, 9 aa, Influenza virus
ENDVWMGRT

SEQ ID NO: 438929 - protein, 9 aa, Influenza virus
ENEKTLDLH

SEQ ID NO: 438930 - protein, 9 aa, Influenza virus
ENEMTLDFH

SEQ ID NO: 438931 - protein, 9 aa, Influenza virus
ENERTLDFH

SEQ ID NO: 438932 - protein, 9 aa, Influenza virus
ENERTLDLH

SEQ ID NO: 438933 - protein, 9 aa, Influenza virus
ENERTLDMH

SEQ ID NO: 438934 - protein, 9 aa, Influenza virus
ENERTLDQH

SEQ ID NO: 438935 - protein, 9 aa, Influenza virus
ENERTLDYH

SEQ ID NO: 438936 - protein, 9 aa, Influenza virus
ENERTLGFH

SEQ ID NO: 438937 - protein, 9 aa, Influenza virus
ENERTLYFH

SEQ ID NO: 438938 - protein, 9 aa, Influenza virus
ENFVRQCFN

SEQ ID NO: 438939 - protein, 9 aa, Influenza virus
ENGDIIFLW

SEQ ID NO: 438940 - protein, 9 aa, Influenza virus
ENGNGCFEL

SEQ ID NO: 438941 - protein, 9 aa, Influenza virus
ENGRTLDLH

SEQ ID NO: 438942 - protein, 9 aa, Influenza virus
ENGRTLDMH

SEQ ID NO: 438943 - protein, 9 aa, Influenza virus
ENGRTLGLH

SEQ ID NO: 438944 - protein, 9 aa, Influenza virus
ENGTSVKTL

SEQ ID NO: 438945 - protein, 9 aa, Influenza virus
ENGTYDYPK

SEQ ID NO: 438946 - protein, 9 aa, Influenza virus
ENGVPVTSS

SEQ ID NO: 438947 - protein, 9 aa, Influenza virus
ENGVPVTST

SEQ ID NO: 438948 - protein, 9 aa, Influenza virus
ENGWEGLID

SEQ ID NO: 438949 - protein, 9 aa, Influenza virus
ENGWEGLIN

SEQ ID NO: 438950 - protein, 9 aa, Influenza virus
ENGWEGLVD

SEQ ID NO: 438951 - protein, 9 aa, Influenza virus
ENGWEGMID

SEQ ID NO: 438952 - protein, 9 aa, Influenza virus
ENGWEGMMD

SEQ ID NO: 438953 - protein, 9 aa, Influenza virus
ENGWEGMVD

SEQ ID NO: 438954 - protein, 9 aa, Influenza virus
ENGWEGMVN

SEQ ID NO: 438955 - protein, 9 aa, Influenza virus
ENGWQGLID

SEQ ID NO: 438956 - protein, 9 aa, Influenza virus
ENIAPEKVD

SEQ ID NO: 438957 - protein, 9 aa, Influenza virus
ENKHSNGTK

SEQ ID NO: 438958 - protein, 9 aa, Influenza virus
ENKKYGPAL

SEQ ID NO: 438959 - protein, 9 aa, Influenza virus
ENKRYGPAL

SEQ ID NO: 438960 - protein, 9 aa, Influenza virus
ENKYVNNTT

SEQ ID NO: 438961 - protein, 9 aa, Influenza virus
ENLDKKMED

SEQ ID NO: 438962 - protein, 9 aa, Influenza virus
ENLEELRFV

SEQ ID NO: 438963 - protein, 9 aa, Influenza virus
ENLFDEVRR

SEQ ID NO: 438964 - protein, 9 aa, Influenza virus
ENLIAPWYG

SEQ ID NO: 438965 - protein, 9 aa, Influenza virus
ENLNKKIDD

SEQ ID NO: 438966 - protein, 9 aa, Influenza virus
ENLNKKMED

SEQ ID NO: 438967 - protein, 9 aa, Influenza virus
ENLNKKVDD

SEQ ID NO: 438968 - protein, 9 aa, Influenza virus
ENLNKKVED

SEQ ID NO: 438969 - protein, 9 aa, Influenza virus
ENLNKRMED

SEQ ID NO: 438970 - protein, 9 aa, Influenza virus
ENLNKRVDD

SEQ ID NO: 438971 - protein, 9 aa, Influenza virus
ENLNRKMED

SEQ ID NO: 438972 - protein, 9 aa, Influenza virus
ENLNRKVDD

SEQ ID NO: 438973 - protein, 9 aa, Influenza virus
ENLQAYQKR

SEQ ID NO: 438974 - protein, 9 aa, Influenza virus
ENLQTYQKR

SEQ ID NO: 438975 - protein, 9 aa, Influenza virus
ENLWAYNAE

SEQ ID NO: 438976 - protein, 9 aa, Influenza virus
ENMAPEKID

SEQ ID NO: 438977 - protein, 9 aa, Influenza virus
ENMAPEKMD

SEQ ID NO: 438978 - protein, 9 aa, Influenza virus
ENMAPEKVD

SEQ ID NO: 438979 - protein, 9 aa, Influenza virus
ENNTWGNQT

SEQ ID NO: 438980 - protein, 9 aa, Influenza virus
ENNTWVNQT

SEQ ID NO: 438981 - protein, 9 aa, Influenza virus
ENNVPVTSS

SEQ ID NO: 438982 - protein, 9 aa, Influenza virus
ENNVTVTSS

SEQ ID NO: 438983 - protein, 9 aa, Influenza virus
ENPAHKSQL

SEQ ID NO: 438984 - protein, 9 aa, Influenza virus
ENPSAGKDP

SEQ ID NO: 438985 - protein, 9 aa, Influenza virus
ENPSHEGEG

SEQ ID NO: 438986 - protein, 9 aa, Influenza virus
ENPVHKSQL

SEQ ID NO: 438987 - protein, 9 aa, Influenza virus
ENQEELKSL

SEQ ID NO: 438988 - protein, 9 aa, Influenza virus
ENQEELRFL

SEQ ID NO: 438989 - protein, 9 aa, Influenza virus
ENQEELRSL

SEQ ID NO: 438990 - protein, 9 aa, Influenza virus
ENQHIIDLA

SEQ ID NO: 438991 - protein, 9 aa, Influenza virus
ENQHTIDLA

SEQ ID NO: 438992 - protein, 9 aa, Influenza virus
ENQHTIDLT

SEQ ID NO: 438993 - protein, 9 aa, Influenza virus
ENQHTIDMA

SEQ ID NO: 438994 - protein, 9 aa, Influenza virus
ENQHTIDMT

SEQ ID NO: 438995 - protein, 9 aa, Influenza virus
ENQHTIDVT

SEQ ID NO: 438996 - protein, 9 aa, Influenza virus
ENQHTIHLT

SEQ ID NO: 438997 - protein, 9 aa, Influenza virus
ENQKILDEH

SEQ ID NO: 438998 - protein, 9 aa, Influenza virus
ENQKPLDEH

SEQ ID NO: 438999 - protein, 9 aa, Influenza virus
ENQKTLDEH

SEQ ID NO: 439000 - protein, 9 aa, Influenza virus
ENQKTLDKH

SEQ ID NO: 439001 - protein, 9 aa, Influenza virus
ENQNPRIFL

SEQ ID NO: 439002 - protein, 9 aa, Influenza virus
ENQNPRMFL

SEQ ID NO: 439003 - protein, 9 aa, Influenza virus
ENQNPRVFL

SEQ ID NO: 439004 - protein, 9 aa, Influenza virus
ENRINMLAD

SEQ ID NO: 439005 - protein, 9 aa, Influenza virus
ENRMVIAST

SEQ ID NO: 439006 - protein, 9 aa, Influenza virus
ENRMVLAST

SEQ ID NO: 439007 - protein, 9 aa, Influenza virus
ENRVWWTSN

SEQ ID NO: 439008 - protein, 9 aa, Influenza virus
ENSDVLVTR

SEQ ID NO: 439009 - protein, 9 aa, Influenza virus
ENSFEQITF

SEQ ID NO: 439010 - protein, 9 aa, Influenza virus
ENSHPGIFE

SEQ ID NO: 439011 - protein, 9 aa, Influenza virus
ENSQGSGYA

SEQ ID NO: 439012 - protein, 9 aa, Influenza virus
ENSTYKILS

SEQ ID NO: 439013 - protein, 9 aa, Influenza virus
ENSVIEKMN

SEQ ID NO: 439014 - protein, 9 aa, Influenza virus
ENSVLWTSN

SEQ ID NO: 439015 - protein, 9 aa, Influenza virus
ENTGSYVRL

SEQ ID NO: 439016 - protein, 9 aa, Influenza virus
ENTHIHIFS

SEQ ID NO: 439017 - protein, 9 aa, Influenza virus
ENTSYKILS

SEQ ID NO: 439018 - protein, 9 aa, Influenza virus
ENTTWVNQT

SEQ ID NO: 439019 - protein, 9 aa, Influenza virus
ENTTYKILS

SEQ ID NO: 439020 - protein, 9 aa, Influenza virus
ENTTYRILS

SEQ ID NO: 439021 - protein, 9 aa, Influenza virus
ENTYVNKTT

SEQ ID NO: 439022 - protein, 9 aa, Influenza virus
ENTYVNNTT

SEQ ID NO: 439023 - protein, 9 aa, Influenza virus
EPALIVWGV

SEQ ID NO: 439024 - protein, 9 aa, Influenza virus
EPDECRFYA

SEQ ID NO: 439025 - protein, 9 aa, Influenza virus
EPDTYDFNE

SEQ ID NO: 439026 - protein, 9 aa, Influenza virus
EPFISCSHF

SEQ ID NO: 439027 - protein, 9 aa, Influenza virus
EPFISCSHL

SEQ ID NO: 439028 - protein, 9 aa, Influenza virus
EPFISCSHM

SEQ ID NO: 439029 - protein, 9 aa, Influenza virus
EPFISCSHS

SEQ ID NO: 439030 - protein, 9 aa, Influenza virus
EPFISCSPL

SEQ ID NO: 439031 - protein, 9 aa, Influenza virus
EPFISCSQL

SEQ ID NO: 439032 - protein, 9 aa, Influenza virus
EPFQSLIPK

SEQ ID NO: 439033 - protein, 9 aa, Influenza virus
EPFQSLVPK

SEQ ID NO: 439034 - protein, 9 aa, Influenza virus
EPFQSLVPR

SEQ ID NO: 439035 - protein, 9 aa, Influenza virus
EPFVACGPA

SEQ ID NO: 439036 - protein, 9 aa, Influenza virus
EPFVACGPS

SEQ ID NO: 439037 - protein, 9 aa, Influenza virus
EPFVACGPT

SEQ ID NO: 439038 - protein, 9 aa, Influenza virus
EPFVACSPS

SEQ ID NO: 439039 - protein, 9 aa, Influenza virus
EPFVSCGPS

SEQ ID NO: 439040 - protein, 9 aa, Influenza virus
EPFVSCSHL

SEQ ID NO: 439041 - protein, 9 aa, Influenza virus
EPGSGDWPD

SEQ ID NO: 439042 - protein, 9 aa, Influenza virus
EPGSGNWPD

SEQ ID NO: 439043 - protein, 9 aa, Influenza virus
EPGTFDIEG

SEQ ID NO: 439044 - protein, 9 aa, Influenza virus
EPGTFDIGG

SEQ ID NO: 439045 - protein, 9 aa, Influenza virus
EPGTFDLEG

SEQ ID NO: 439046 - protein, 9 aa, Influenza virus
EPGTFDLGG

SEQ ID NO: 439047 - protein, 9 aa, Influenza virus
EPGVKGFGF

SEQ ID NO: 439048 - protein, 9 aa, Influenza virus
EPISLGDCS

SEQ ID NO: 439049 - protein, 9 aa, Influenza virus
EPKGLFGAI

SEQ ID NO: 439050 - protein, 9 aa, Influenza virus
EPLCDVSGF

SEQ ID NO: 439051 - protein, 9 aa, Influenza virus
EPLCEVSGF

SEQ ID NO: 439052 - protein, 9 aa, Influenza virus
EPLCNVSGF

SEQ ID NO: 439053 - protein, 9 aa, Influenza virus
EPLKGSAKH

SEQ ID NO: 439054 - protein, 9 aa, Influenza virus
EPMGFRYSG

SEQ ID NO: 439055 - protein, 9 aa, Influenza virus
EPNGCIEGK

SEQ ID NO: 439056 - protein, 9 aa, Influenza virus
EPNGCIESK

SEQ ID NO: 439057 - protein, 9 aa, Influenza virus
EPNGSIEGK

SEQ ID NO: 439058 - protein, 9 aa, Influenza virus
EPNGYIEGK

SEQ ID NO: 439059 - protein, 9 aa, Influenza virus
EPRGLFGAI

SEQ ID NO: 439060 - protein, 9 aa, Influenza virus
EPSGYAQTD

SEQ ID NO: 439061 - protein, 9 aa, Influenza virus
EPTGYAQTD

SEQ ID NO: 439062 - protein, 9 aa, Influenza virus
EPYPGNNNN

SEQ ID NO: 439063 - protein, 9 aa, Influenza virus
EPYVSCDPD

SEQ ID NO: 439064 - protein, 9 aa, Influenza virus
EPYVSCDPI

SEQ ID NO: 439065 - protein, 9 aa, Influenza virus
EPYVSCDPK

SEQ ID NO: 439066 - protein, 9 aa, Influenza virus
EPYVSCDPL

SEQ ID NO: 439067 - protein, 9 aa, Influenza virus
EPYVSCDPN

SEQ ID NO: 439068 - protein, 9 aa, Influenza virus
EPYVSCDPS

SEQ ID NO: 439069 - protein, 9 aa, Influenza virus
EPYVSCDPT

SEQ ID NO: 439070 - protein, 9 aa, Influenza virus
EPYVSCEPD

SEQ ID NO: 439071 - protein, 9 aa, Influenza virus
EQAAEAIEV

SEQ ID NO: 439072 - protein, 9 aa, Influenza virus
EQAAEAMDI

SEQ ID NO: 439073 - protein, 9 aa, Influenza virus
EQAAEAMEI

SEQ ID NO: 439074 - protein, 9 aa, Influenza virus
EQAAEAMEV

SEQ ID NO: 439075 - protein, 9 aa, Influenza virus
EQAKLYGSG

SEQ ID NO: 439076 - protein, 9 aa, Influenza virus
EQAVDICKA

SEQ ID NO: 439077 - protein, 9 aa, Influenza virus
EQAVGICKA

SEQ ID NO: 439078 - protein, 9 aa, Influenza virus
EQAVNICKA

SEQ ID NO: 439079 - protein, 9 aa, Influenza virus
EQEEVTNAT

SEQ ID NO: 439080 - protein, 9 aa, Influenza virus
EQFPVQTDE

SEQ ID NO: 439081 - protein, 9 aa, Influenza virus
EQFTWNGVK

SEQ ID NO: 439082 - protein, 9 aa, Influenza virus
EQGMGMAAD

SEQ ID NO: 439083 - protein, 9 aa, Influenza virus
EQGSGFAAD

SEQ ID NO: 439084 - protein, 9 aa, Influenza virus
EQGSGYAAD

SEQ ID NO: 439085 - protein, 9 aa, Influenza virus
EQGSGYAAN

SEQ ID NO: 439086 - protein, 9 aa, Influenza virus
EQGTGIAAD

SEQ ID NO: 439087 - protein, 9 aa, Influenza virus
EQGTGIAAE

SEQ ID NO: 439088 - protein, 9 aa, Influenza virus
EQGVGIAAD

SEQ ID NO: 439089 - protein, 9 aa, Influenza virus
EQGVGMAAD

SEQ ID NO: 439090 - protein, 9 aa, Influenza virus
EQGYGYAAD

SEQ ID NO: 439091 - protein, 9 aa, Influenza virus
EQIADAQHR

SEQ ID NO: 439092 - protein, 9 aa, Influenza virus
EQIADSHHR

SEQ ID NO: 439093 - protein, 9 aa, Influenza virus
EQIADSQHK

SEQ ID NO: 439094 - protein, 9 aa, Influenza virus
EQIADSQHR

SEQ ID NO: 439095 - protein, 9 aa, Influenza virus
EQIIVTREP

SEQ ID NO: 439096 - protein, 9 aa, Influenza virus
EQIKLYGSG

SEQ ID NO: 439097 - protein, 9 aa, Influenza virus
EQITFLQAL

SEQ ID NO: 439098 - protein, 9 aa, Influenza virus
EQITFMQAL

SEQ ID NO: 439099 - protein, 9 aa, Influenza virus
EQIVVTREP

SEQ ID NO: 439100 - protein, 9 aa, Influenza virus
EQKQEFKMN

SEQ ID NO: 439101 - protein, 9 aa, Influenza virus
EQKVPVTQT

SEQ ID NO: 439102 - protein, 9 aa, Influenza virus
EQLGSWSWH

SEQ ID NO: 439103 - protein, 9 aa, Influenza virus
EQLSQKFEE

SEQ ID NO: 439104 - protein, 9 aa, Influenza virus
EQLSSVSSF

SEQ ID NO: 439105 - protein, 9 aa, Influenza virus
EQLSTVSSF

SEQ ID NO: 439106 - protein, 9 aa, Influenza virus
EQLYTPGGE

SEQ ID NO: 439107 - protein, 9 aa, Influenza virus
EQMAGSSEQ

SEQ ID NO: 439108 - protein, 9 aa, Influenza virus
EQMETDGDR

SEQ ID NO: 439109 - protein, 9 aa, Influenza virus
EQMETDGER

SEQ ID NO: 439110 - protein, 9 aa, Influenza virus
EQMETGGER

SEQ ID NO: 439111 - protein, 9 aa, Influenza virus
EQMETSGER

SEQ ID NO: 439112 - protein, 9 aa, Influenza virus
EQMYQKCCN

SEQ ID NO: 439113 - protein, 9 aa, Influenza virus
EQMYQKCCS

SEQ ID NO: 439114 - protein, 9 aa, Influenza virus
EQMYQKCCT

SEQ ID NO: 439115 - protein, 9 aa, Influenza virus
EQMYQRCCN

SEQ ID NO: 439116 - protein, 9 aa, Influenza virus
EQMYTPGGE

SEQ ID NO: 439117 - protein, 9 aa, Influenza virus
EQMYTPGGG

SEQ ID NO: 439118 - protein, 9 aa, Influenza virus
EQMYTPGGK

SEQ ID NO: 439119 - protein, 9 aa, Influenza virus
EQNFPQTTN

SEQ ID NO: 439120 - protein, 9 aa, Influenza virus
EQNIPVTQT

SEQ ID NO: 439121 - protein, 9 aa, Influenza virus
EQNIPVTQV

SEQ ID NO: 439122 - protein, 9 aa, Influenza virus
EQNKLYGAG

SEQ ID NO: 439123 - protein, 9 aa, Influenza virus
EQNKLYGTG

SEQ ID NO: 439124 - protein, 9 aa, Influenza virus
EQNVPVTQA

SEQ ID NO: 439125 - protein, 9 aa, Influenza virus
EQNVPVTQT

SEQ ID NO: 439126 - protein, 9 aa, Influenza virus
EQNVPVTQV

SEQ ID NO: 439127 - protein, 9 aa, Influenza virus
EQNVTVTHA

SEQ ID NO: 439128 - protein, 9 aa, Influenza virus
EQQGRMDYY

SEQ ID NO: 439129 - protein, 9 aa, Influenza virus
EQQIGNVIN

SEQ ID NO: 439130 - protein, 9 aa, Influenza virus
EQRINMLAD

SEQ ID NO: 439131 - protein, 9 aa, Influenza virus
EQSGLPVGG

SEQ ID NO: 439132 - protein, 9 aa, Influenza virus
EQSKMQFSS

SEQ ID NO: 439133 - protein, 9 aa, Influenza virus
EQSRMQFSS

SEQ ID NO: 439134 - protein, 9 aa, Influenza virus
EQTALYKNA

SEQ ID NO: 439135 - protein, 9 aa, Influenza virus
EQTDLYKVA

SEQ ID NO: 439136 - protein, 9 aa, Influenza virus
EQTKLYGNG

SEQ ID NO: 439137 - protein, 9 aa, Influenza virus
EQTKLYGSG

SEQ ID NO: 439138 - protein, 9 aa, Influenza virus
EQTKLYKNT

SEQ ID NO: 439139 - protein, 9 aa, Influenza virus
EQTRLYGSG

SEQ ID NO: 439140 - protein, 9 aa, Influenza virus
EQTTLYKNA

SEQ ID NO: 439141 - protein, 9 aa, Influenza virus
EQVAGSSEQ

SEQ ID NO: 439142 - protein, 9 aa, Influenza virus
EQVDTIMEK

SEQ ID NO: 439143 - protein, 9 aa, Influenza virus
EQVDTIMER

SEQ ID NO: 439144 - protein, 9 aa, Influenza virus
EQVDTIREK

SEQ ID NO: 439145 - protein, 9 aa, Influenza virus
EQVEGRIQD

SEQ ID NO: 439146 - protein, 9 aa, Influenza virus
EQVEGRIQY

SEQ ID NO: 439147 - protein, 9 aa, Influenza virus
EQVEGRTQD

SEQ ID NO: 439148 - protein, 9 aa, Influenza virus
EQVIVTREP

SEQ ID NO: 439149 - protein, 9 aa, Influenza virus
EREAKLFVL

SEQ ID NO: 439150 - protein, 9 aa, Influenza virus
EREEVTNAT

SEQ ID NO: 439151 - protein, 9 aa, Influenza virus
EREGGRRRK

SEQ ID NO: 439152 - protein, 9 aa, Influenza virus
EREGYSLVG

SEQ ID NO: 439153 - protein, 9 aa, Influenza virus
ERELVRKTR

SEQ ID NO: 439154 - protein, 9 aa, Influenza virus
EREVEVVNA

SEQ ID NO: 439155 - protein, 9 aa, Influenza virus
ERGEDTIEE

SEQ ID NO: 439156 - protein, 9 aa, Influenza virus
ERGEETIEE

SEQ ID NO: 439157 - protein, 9 aa, Influenza virus
ERGEETVEE

SEQ ID NO: 439158 - protein, 9 aa, Influenza virus
ERGIEVVNA

SEQ ID NO: 439159 - protein, 9 aa, Influenza virus
ERGKLKRRA

SEQ ID NO: 439160 - protein, 9 aa, Influenza virus
ERGLFGAIA

SEQ ID NO: 439161 - protein, 9 aa, Influenza virus
ERGLQRRRF

SEQ ID NO: 439162 - protein, 9 aa, Influenza virus
ERGNHGVKG

SEQ ID NO: 439163 - protein, 9 aa, Influenza virus
ERGNPGVKG

SEQ ID NO: 439164 - protein, 9 aa, Influenza virus
ERGNQGVKG

SEQ ID NO: 439165 - protein, 9 aa, Influenza virus
ERGSPGVKG

SEQ ID NO: 439166 - protein, 9 aa, Influenza virus
ERGTKQEEN

SEQ ID NO: 439167 - protein, 9 aa, Influenza virus
ERGTQGVKG

SEQ ID NO: 439168 - protein, 9 aa, Influenza virus
ERGVEVVDA

SEQ ID NO: 439169 - protein, 9 aa, Influenza virus
ERGVEVVNA

SEQ ID NO: 439170 - protein, 9 aa, Influenza virus
ERILDFHDS

SEQ ID NO: 439171 - protein, 9 aa, Influenza virus
ERILEEESD

SEQ ID NO: 439172 - protein, 9 aa, Influenza virus
ERIMFESNG

SEQ ID NO: 439173 - protein, 9 aa, Influenza virus
ERIRNNTYD

SEQ ID NO: 439174 - protein, 9 aa, Influenza virus
ERITFESNG

SEQ ID NO: 439175 - protein, 9 aa, Influenza virus
ERITFESSG

SEQ ID NO: 439176 - protein, 9 aa, Influenza virus
ERLGSWSWH

SEQ ID NO: 439177 - protein, 9 aa, Influenza virus
ERLTITYSS

SEQ ID NO: 439178 - protein, 9 aa, Influenza virus
ERLVLATGL

SEQ ID NO: 439179 - protein, 9 aa, Influenza virus
ERMCNILKG

SEQ ID NO: 439180 - protein, 9 aa, Influenza virus
ERMVLSAFD

SEQ ID NO: 439181 - protein, 9 aa, Influenza virus
ERMYQKCCN

SEQ ID NO: 439182 - protein, 9 aa, Influenza virus
ERNALGDCP

SEQ ID NO: 439183 - protein, 9 aa, Influenza virus
ERNALGNCP

SEQ ID NO: 439184 - protein, 9 aa, Influenza virus
ERNDLYGTQ

SEQ ID NO: 439185 - protein, 9 aa, Influenza virus
ERNITEIVY

SEQ ID NO: 439186 - protein, 9 aa, Influenza virus
ERNSIWTSS

SEQ ID NO: 439187 - protein, 9 aa, Influenza virus
ERNVTETLY

SEQ ID NO: 439188 - protein, 9 aa, Influenza virus
ERNVTVTHA

SEQ ID NO: 439189 - protein, 9 aa, Influenza virus
ERNVTVTHS

SEQ ID NO: 439190 - protein, 9 aa, Influenza virus
ERPKEIEGI

SEQ ID NO: 439191 - protein, 9 aa, Influenza virus
ERPKEMEGI

SEQ ID NO: 439192 - protein, 9 aa, Influenza virus
ERPKEMEGV

SEQ ID NO: 439193 - protein, 9 aa, Influenza virus
ERPSAPEGM

SEQ ID NO: 439194 - protein, 9 aa, Influenza virus
ERPSIWTSS

SEQ ID NO: 439195 - protein, 9 aa, Influenza virus
ERPTAVDTC

SEQ ID NO: 439196 - protein, 9 aa, Influenza virus
ERQEIVDNN

SEQ ID NO: 439197 - protein, 9 aa, Influenza virus
ERQEIVDNR

SEQ ID NO: 439198 - protein, 9 aa, Influenza virus
ERQEIVDNS

SEQ ID NO: 439199 - protein, 9 aa, Influenza virus
ERQEIVGNN

SEQ ID NO: 439200 - protein, 9 aa, Influenza virus
ERQIGNVIN

SEQ ID NO: 439201 - protein, 9 aa, Influenza virus
ERQKINGVK

SEQ ID NO: 439202 - protein, 9 aa, Influenza virus
ERQKISGVK

SEQ ID NO: 439203 - protein, 9 aa, Influenza virus
ERQKVNGVK

SEQ ID NO: 439204 - protein, 9 aa, Influenza virus
ERQRINGVK

SEQ ID NO: 439205 - protein, 9 aa, Influenza virus
ERQTRGIFG

SEQ ID NO: 439206 - protein, 9 aa, Influenza virus
ERQTRGLFG

SEQ ID NO: 439207 - protein, 9 aa, Influenza virus
ERRIENLNK

SEQ ID NO: 439208 - protein, 9 aa, Influenza virus
ERRIENLNR

SEQ ID NO: 439209 - protein, 9 aa, Influenza virus
ERRIESLNK

SEQ ID NO: 439210 - protein, 9 aa, Influenza virus
ERRINMLAD

SEQ ID NO: 439211 - protein, 9 aa, Influenza virus
ERRLENLNK

SEQ ID NO: 439212 - protein, 9 aa, Influenza virus
ERRLTTTIK

SEQ ID NO: 439213 - protein, 9 aa, Influenza virus
ERRNKYLEE

SEQ ID NO: 439214 - protein, 9 aa, Influenza virus
ERRNRYLEE

SEQ ID NO: 439215 - protein, 9 aa, Influenza virus
ERRNSSDIC

SEQ ID NO: 439216 - protein, 9 aa, Influenza virus
ERRRKKRGL

SEQ ID NO: 439217 - protein, 9 aa, Influenza virus
ERSKINEVK

SEQ ID NO: 439218 - protein, 9 aa, Influenza virus
ERSKINGVI

SEQ ID NO: 439219 - protein, 9 aa, Influenza virus
ERSKINGVK

SEQ ID NO: 439220 - protein, 9 aa, Influenza virus
ERSKINGVR

SEQ ID NO: 439221 - protein, 9 aa, Influenza virus
ERTHIHIFS

SEQ ID NO: 439222 - protein, 9 aa, Influenza virus
ERTHNGKLC

SEQ ID NO: 439223 - protein, 9 aa, Influenza virus
ERTIWTSGS

SEQ ID NO: 439224 - protein, 9 aa, Influenza virus
ERTKEMEGI

SEQ ID NO: 439225 - protein, 9 aa, Influenza virus
ERTLDFHDF

SEQ ID NO: 439226 - protein, 9 aa, Influenza virus
ERTLDFHDL

SEQ ID NO: 439227 - protein, 9 aa, Influenza virus
ERTLDFHDS

SEQ ID NO: 439228 - protein, 9 aa, Influenza virus
ERTLDLHDA

SEQ ID NO: 439229 - protein, 9 aa, Influenza virus
ERTLDLHDS

SEQ ID NO: 439230 - protein, 9 aa, Influenza virus
ERTLDMHDA

SEQ ID NO: 439231 - protein, 9 aa, Influenza virus
ERTLDQHDA

SEQ ID NO: 439232 - protein, 9 aa, Influenza virus
ERTLDYHDF

SEQ ID NO: 439233 - protein, 9 aa, Influenza virus
ERTLDYHDS

SEQ ID NO: 439234 - protein, 9 aa, Influenza virus
ERTLYFHDS

SEQ ID NO: 439235 - protein, 9 aa, Influenza virus
ERTNEKFHQ

SEQ ID NO: 439236 - protein, 9 aa, Influenza virus
ERTNEKYHQ

SEQ ID NO: 439237 - protein, 9 aa, Influenza virus
ERTNQQFEL

SEQ ID NO: 439238 - protein, 9 aa, Influenza virus
ERTSIWTSS

SEQ ID NO: 439239 - protein, 9 aa, Influenza virus
ERTTFESNG

SEQ ID NO: 439240 - protein, 9 aa, Influenza virus
ERVDTIIES

SEQ ID NO: 439241 - protein, 9 aa, Influenza virus
ERVDTIMEK

SEQ ID NO: 439242 - protein, 9 aa, Influenza virus
ERVDTLLEN

SEQ ID NO: 439243 - protein, 9 aa, Influenza virus
ERVKKQLRE

SEQ ID NO: 439244 - protein, 9 aa, Influenza virus
ERVKMFDFI

SEQ ID NO: 439245 - protein, 9 aa, Influenza virus
ERVKMFDFS

SEQ ID NO: 439246 - protein, 9 aa, Influenza virus
ERVKMFDFT

SEQ ID NO: 439247 - protein, 9 aa, Influenza virus
ERVKRQLRE

SEQ ID NO: 439248 - protein, 9 aa, Influenza virus
ERVRHQLRE

SEQ ID NO: 439249 - protein, 9 aa, Influenza virus
ERVRKQLRE

SEQ ID NO: 439250 - protein, 9 aa, Influenza virus
ERVRKQLRQ

SEQ ID NO: 439251 - protein, 9 aa, Influenza virus
ERVRNGTYD

SEQ ID NO: 439252 - protein, 9 aa, Influenza virus
ERVRRQLRE

SEQ ID NO: 439253 - protein, 9 aa, Influenza virus
ERYVEDTKI

SEQ ID NO: 439254 - protein, 9 aa, Influenza virus
ESADMSIGI

SEQ ID NO: 439255 - protein, 9 aa, Influenza virus
ESADMSIGV

SEQ ID NO: 439256 - protein, 9 aa, Influenza virus
ESAVLRGFL

SEQ ID NO: 439257 - protein, 9 aa, Influenza virus
ESCEGECFY

SEQ ID NO: 439258 - protein, 9 aa, Influenza virus
ESDEALKMT

SEQ ID NO: 439259 - protein, 9 aa, Influenza virus
ESDGAFLAP

SEQ ID NO: 439260 - protein, 9 aa, Influenza virus
ESDVPVTSS

SEQ ID NO: 439261 - protein, 9 aa, Influenza virus
ESECACANG

SEQ ID NO: 439262 - protein, 9 aa, Influenza virus
ESECACING

SEQ ID NO: 439263 - protein, 9 aa, Influenza virus
ESECACVNG

SEQ ID NO: 439264 - protein, 9 aa, Influenza virus
ESECICING

SEQ ID NO: 439265 - protein, 9 aa, Influenza virus
ESECQCIDG

SEQ ID NO: 439266 - protein, 9 aa, Influenza virus
ESECQCIGG

SEQ ID NO: 439267 - protein, 9 aa, Influenza virus
ESECQCISG

SEQ ID NO: 439268 - protein, 9 aa, Influenza virus
ESECQCLYG

SEQ ID NO: 439269 - protein, 9 aa, Influenza virus
ESECQRIDG

SEQ ID NO: 439270 - protein, 9 aa, Influenza virus
ESECVCHKG

SEQ ID NO: 439271 - protein, 9 aa, Influenza virus
ESECVCHNG

SEQ ID NO: 439272 - protein, 9 aa, Influenza virus
ESECVCHNS

SEQ ID NO: 439273 - protein, 9 aa, Influenza virus
ESECVCHSG

SEQ ID NO: 439274 - protein, 9 aa, Influenza virus
ESECVCIDG

SEQ ID NO: 439275 - protein, 9 aa, Influenza virus
ESECVCINE

SEQ ID NO: 439276 - protein, 9 aa, Influenza virus
ESECVCING

SEQ ID NO: 439277 - protein, 9 aa, Influenza virus
ESECVCISG

SEQ ID NO: 439278 - protein, 9 aa, Influenza virus
ESECVCMNG

SEQ ID NO: 439279 - protein, 9 aa, Influenza virus
ESECVCQDE

SEQ ID NO: 439280 - protein, 9 aa, Influenza virus
ESECVCVNG

SEQ ID NO: 439281 - protein, 9 aa, Influenza virus
ESECVRHNG

SEQ ID NO: 439282 - protein, 9 aa, Influenza virus
ESEFNEIEH

SEQ ID NO: 439283 - protein, 9 aa, Influenza virus
ESEFNEIEY

SEQ ID NO: 439284 - protein, 9 aa, Influenza virus
ESEFSEIEH

SEQ ID NO: 439285 - protein, 9 aa, Influenza virus
ESEFSETEH

SEQ ID NO: 439286 - protein, 9 aa, Influenza virus
ESEMNKLYE

SEQ ID NO: 439287 - protein, 9 aa, Influenza virus
ESEQIIVTR

SEQ ID NO: 439288 - protein, 9 aa, Influenza virus
ESEQIVVTR

SEQ ID NO: 439289 - protein, 9 aa, Influenza virus
ESEQVIVTR

SEQ ID NO: 439290 - protein, 9 aa, Influenza virus
ESGGIDKEP

SEQ ID NO: 439291 - protein, 9 aa, Influenza virus
ESGGIDKES

SEQ ID NO: 439292 - protein, 9 aa, Influenza virus
ESGGIDKIG

SEQ ID NO: 439293 - protein, 9 aa, Influenza virus
ESGGIDKIS

SEQ ID NO: 439294 - protein, 9 aa, Influenza virus
ESGGIDKVS

SEQ ID NO: 439295 - protein, 9 aa, Influenza virus
ESGGISKIS

SEQ ID NO: 439296 - protein, 9 aa, Influenza virus
ESGGISKMS

SEQ ID NO: 439297 - protein, 9 aa, Influenza virus
ESGRLIDFL

SEQ ID NO: 439298 - protein, 9 aa, Influenza virus
ESGRLMDFL

SEQ ID NO: 439299 - protein, 9 aa, Influenza virus
ESGVLWTSN

SEQ ID NO: 439300 - protein, 9 aa, Influenza virus
ESHCRIIQN

SEQ ID NO: 439301 - protein, 9 aa, Influenza virus
ESHGKIIQN

SEQ ID NO: 439302 - protein, 9 aa, Influenza virus
ESHGRIIQN

SEQ ID NO: 439303 - protein, 9 aa, Influenza virus
ESHGRTIQN

SEQ ID NO: 439304 - protein, 9 aa, Influenza virus
ESIAWSATA

SEQ ID NO: 439305 - protein, 9 aa, Influenza virus
ESIEECLIN

SEQ ID NO: 439306 - protein, 9 aa, Influenza virus
ESIESEFNE

SEQ ID NO: 439307 - protein, 9 aa, Influenza virus
ESIESEFSE

SEQ ID NO: 439308 - protein, 9 aa, Influenza virus
ESIIEAESS

SEQ ID NO: 439309 - protein, 9 aa, Influenza virus
ESIKNGTYD

SEQ ID NO: 439310 - protein, 9 aa, Influenza virus
ESIRNGTYD

SEQ ID NO: 439311 - protein, 9 aa, Influenza virus
ESIRNGTYN

SEQ ID NO: 439312 - protein, 9 aa, Influenza virus
ESIRNNTYD

SEQ ID NO: 439313 - protein, 9 aa, Influenza virus
ESIRNNTYN

SEQ ID NO: 439314 - protein, 9 aa, Influenza virus
ESKCFWKGG

SEQ ID NO: 439315 - protein, 9 aa, Influenza virus
ESKCFWKSG

SEQ ID NO: 439316 - protein, 9 aa, Influenza virus
ESKCFWRGG

SEQ ID NO: 439317 - protein, 9 aa, Influenza virus
ESKIERQKI

SEQ ID NO: 439318 - protein, 9 aa, Influenza virus
ESKIERQKV

SEQ ID NO: 439319 - protein, 9 aa, Influenza virus
ESKINRQEI

SEQ ID NO: 439320 - protein, 9 aa, Influenza virus
ESKLERQKI

SEQ ID NO: 439321 - protein, 9 aa, Influenza virus
ESKLERQRI

SEQ ID NO: 439322 - protein, 9 aa, Influenza virus
ESKLKRNEI

SEQ ID NO: 439323 - protein, 9 aa, Influenza virus
ESKLKRQEI

SEQ ID NO: 439324 - protein, 9 aa, Influenza virus
ESKLNRNEI

SEQ ID NO: 439325 - protein, 9 aa, Influenza virus
ESKLNRQEI

SEQ ID NO: 439326 - protein, 9 aa, Influenza virus
ESKLNRSEI

SEQ ID NO: 439327 - protein, 9 aa, Influenza virus
ESKLNRTEI

SEQ ID NO: 439328 - protein, 9 aa, Influenza virus
ESKLSQMSK

SEQ ID NO: 439329 - protein, 9 aa, Influenza virus
ESLLLATGM

SEQ ID NO: 439330 - protein, 9 aa, Influenza virus
ESLLNRLSI

SEQ ID NO: 439331 - protein, 9 aa, Influenza virus
ESLMLATGM

SEQ ID NO: 439332 - protein, 9 aa, Influenza virus
ESLNKKMED

SEQ ID NO: 439333 - protein, 9 aa, Influenza virus
ESLNNKVDD

SEQ ID NO: 439334 - protein, 9 aa, Influenza virus
ESLQNRIQI

SEQ ID NO: 439335 - protein, 9 aa, Influenza virus
ESLQNRIRI

SEQ ID NO: 439336 - protein, 9 aa, Influenza virus
ESLRLAIGL

SEQ ID NO: 439337 - protein, 9 aa, Influenza virus
ESLRLALGL

SEQ ID NO: 439338 - protein, 9 aa, Influenza virus
ESLRLAVGL

SEQ ID NO: 439339 - protein, 9 aa, Influenza virus
ESMGFRYSG

SEQ ID NO: 439340 - protein, 9 aa, Influenza virus
ESMIEAESS

SEQ ID NO: 439341 - protein, 9 aa, Influenza virus
ESMVEAESS

SEQ ID NO: 439342 - protein, 9 aa, Influenza virus
ESNGAFIAP

SEQ ID NO: 439343 - protein, 9 aa, Influenza virus
ESNGAFLAP

SEQ ID NO: 439344 - protein, 9 aa, Influenza virus
ESNGGFLAP

SEQ ID NO: 439345 - protein, 9 aa, Influenza virus
ESNGGLIAP

SEQ ID NO: 439346 - protein, 9 aa, Influenza virus
ESNGGLLAP

SEQ ID NO: 439347 - protein, 9 aa, Influenza virus
ESNGNFIAP

SEQ ID NO: 439348 - protein, 9 aa, Influenza virus
ESNGNLIAP

SEQ ID NO: 439349 - protein, 9 aa, Influenza virus
ESNGNLVAP

SEQ ID NO: 439350 - protein, 9 aa, Influenza virus
ESNGVFLAP

SEQ ID NO: 439351 - protein, 9 aa, Influenza virus
ESNVLWTSN

SEQ ID NO: 439352 - protein, 9 aa, Influenza virus
ESNVTVTNS

SEQ ID NO: 439353 - protein, 9 aa, Influenza virus
ESNVTVTSS

SEQ ID NO: 439354 - protein, 9 aa, Influenza virus
ESQLKKQEI

SEQ ID NO: 439355 - protein, 9 aa, Influenza virus
ESQLKRQEI

SEQ ID NO: 439356 - protein, 9 aa, Influenza virus
ESRARIKTR

SEQ ID NO: 439357 - protein, 9 aa, Influenza virus
ESRGLFGAI

SEQ ID NO: 439358 - protein, 9 aa, Influenza virus
ESRIERQKI

SEQ ID NO: 439359 - protein, 9 aa, Influenza virus
ESRINMINS

SEQ ID NO: 439360 - protein, 9 aa, Influenza virus
ESRINRQEI

SEQ ID NO: 439361 - protein, 9 aa, Influenza virus
ESRINTINS

SEQ ID NO: 439362 - protein, 9 aa, Influenza virus
ESRKLLLIA

SEQ ID NO: 439363 - protein, 9 aa, Influenza virus
ESRKLLLIT

SEQ ID NO: 439364 - protein, 9 aa, Influenza virus
ESRKLLLIV

SEQ ID NO: 439365 - protein, 9 aa, Influenza virus
ESRKLLLVV

SEQ ID NO: 439366 - protein, 9 aa, Influenza virus
ESRKMLLIV

SEQ ID NO: 439367 - protein, 9 aa, Influenza virus
ESRLNRNEI

SEQ ID NO: 439368 - protein, 9 aa, Influenza virus
ESRLNRQEI

SEQ ID NO: 439369 - protein, 9 aa, Influenza virus
ESRNPGNAE

SEQ ID NO: 439370 - protein, 9 aa, Influenza virus
ESRSGFEMI

SEQ ID NO: 439371 - protein, 9 aa, Influenza virus
ESRSGFEMV

SEQ ID NO: 439372 - protein, 9 aa, Influenza virus
ESRSGYETF

SEQ ID NO: 439373 - protein, 9 aa, Influenza virus
ESRSNIFNM

SEQ ID NO: 439374 - protein, 9 aa, Influenza virus
ESSCTCIKG

SEQ ID NO: 439375 - protein, 9 aa, Influenza virus
ESSCTCILG

SEQ ID NO: 439376 - protein, 9 aa, Influenza virus
ESSCTCIQG

SEQ ID NO: 439377 - protein, 9 aa, Influenza virus
ESSCTCIRG

SEQ ID NO: 439378 - protein, 9 aa, Influenza virus
ESSCVCIKG

SEQ ID NO: 439379 - protein, 9 aa, Influenza virus
ESSCVCMKG

SEQ ID NO: 439380 - protein, 9 aa, Influenza virus
ESSCVCMNG

SEQ ID NO: 439381 - protein, 9 aa, Influenza virus
ESSCVCVKG

SEQ ID NO: 439382 - protein, 9 aa, Influenza virus
ESSDVLVTR

SEQ ID NO: 439383 - protein, 9 aa, Influenza virus
ESSFEQITF

SEQ ID NO: 439384 - protein, 9 aa, Influenza virus
ESSFYAEME

SEQ ID NO: 439385 - protein, 9 aa, Influenza virus
ESSFYAEMK

SEQ ID NO: 439386 - protein, 9 aa, Influenza virus
ESSGGLLAP

SEQ ID NO: 439387 - protein, 9 aa, Influenza virus
ESSIGKVCR

SEQ ID NO: 439388 - protein, 9 aa, Influenza virus
ESSIKEKDM

SEQ ID NO: 439389 - protein, 9 aa, Influenza virus
ESSTYQNNF

SEQ ID NO: 439390 - protein, 9 aa, Influenza virus
ESSVFWTSN

SEQ ID NO: 439391 - protein, 9 aa, Influenza virus
ESSVKEKDL

SEQ ID NO: 439392 - protein, 9 aa, Influenza virus
ESSVKEKDM

SEQ ID NO: 439393 - protein, 9 aa, Influenza virus
ESSVLWTSN

SEQ ID NO: 439394 - protein, 9 aa, Influenza virus
ESSVREKDM

SEQ ID NO: 439395 - protein, 9 aa, Influenza virus
ESTGNFIAP

SEQ ID NO: 439396 - protein, 9 aa, Influenza virus
ESTGNLIAP

SEQ ID NO: 439397 - protein, 9 aa, Influenza virus
ESTGNLVAP

SEQ ID NO: 439398 - protein, 9 aa, Influenza virus
ESTQAAIDQ

SEQ ID NO: 439399 - protein, 9 aa, Influenza virus
ESTQKAIDG

SEQ ID NO: 439400 - protein, 9 aa, Influenza virus
ESTQKAIDQ

SEQ ID NO: 439401 - protein, 9 aa, Influenza virus
ESTQKAIDR

SEQ ID NO: 439402 - protein, 9 aa, Influenza virus
ESTQKAING

SEQ ID NO: 439403 - protein, 9 aa, Influenza virus
ESTQKAMDG

SEQ ID NO: 439404 - protein, 9 aa, Influenza virus
ESTQKAVDG

SEQ ID NO: 439405 - protein, 9 aa, Influenza virus
ESTQRAIDG

SEQ ID NO: 439406 - protein, 9 aa, Influenza virus
ESVAWSASA

SEQ ID NO: 439407 - protein, 9 aa, Influenza virus
ESVAWSATA

SEQ ID NO: 439408 - protein, 9 aa, Influenza virus
ESVGWSATA

SEQ ID NO: 439409 - protein, 9 aa, Influenza virus
ESVKNGTYD

SEQ ID NO: 439410 - protein, 9 aa, Influenza virus
ESVKNGTYN

SEQ ID NO: 439411 - protein, 9 aa, Influenza virus
ESVLINTYQ

SEQ ID NO: 439412 - protein, 9 aa, Influenza virus
ESVLVNTYQ

SEQ ID NO: 439413 - protein, 9 aa, Influenza virus
ESVRNGTYD

SEQ ID NO: 439414 - protein, 9 aa, Influenza virus
ESVRNGTYK

SEQ ID NO: 439415 - protein, 9 aa, Influenza virus
ESVRNGTYN

SEQ ID NO: 439416 - protein, 9 aa, Influenza virus
ESYGRIIQN

SEQ ID NO: 439417 - protein, 9 aa, Influenza virus
ETEHQIGNV

SEQ ID NO: 439418 - protein, 9 aa, Influenza virus
ETEQTKLYK

SEQ ID NO: 439419 - protein, 9 aa, Influenza virus
ETFKVIGGW

SEQ ID NO: 439420 - protein, 9 aa, Influenza virus
ETFRVIDGW

SEQ ID NO: 439421 - protein, 9 aa, Influenza virus
ETFRVIGGW

SEQ ID NO: 439422 - protein, 9 aa, Influenza virus
ETFRVISGW

SEQ ID NO: 439423 - protein, 9 aa, Influenza virus
ETFVNITNV

SEQ ID NO: 439424 - protein, 9 aa, Influenza virus
ETFVNVTHV

SEQ ID NO: 439425 - protein, 9 aa, Influenza virus
ETFVNVTNV

SEQ ID NO: 439426 - protein, 9 aa, Influenza virus
ETGALQLNP

SEQ ID NO: 439427 - protein, 9 aa, Influenza virus
ETGAPQLNP

SEQ ID NO: 439428 - protein, 9 aa, Influenza virus
ETGNGCFEF

SEQ ID NO: 439429 - protein, 9 aa, Influenza virus
ETGVPVTSS

SEQ ID NO: 439430 - protein, 9 aa, Influenza virus
ETGVWWTSN

SEQ ID NO: 439431 - protein, 9 aa, Influenza virus
ETGYICSKF

SEQ ID NO: 439432 - protein, 9 aa, Influenza virus
ETGYVCGKF

SEQ ID NO: 439433 - protein, 9 aa, Influenza virus
ETGYVCSKF

SEQ ID NO: 439434 - protein, 9 aa, Influenza virus
ETHIHIFSF

SEQ ID NO: 439435 - protein, 9 aa, Influenza virus
ETIEEKFEI

SEQ ID NO: 439436 - protein, 9 aa, Influenza virus
ETIEERFEI

SEQ ID NO: 439437 - protein, 9 aa, Influenza virus
ETIIETGYV

SEQ ID NO: 439438 - protein, 9 aa, Influenza virus
ETIKNGTYD

SEQ ID NO: 439439 - protein, 9 aa, Influenza virus
ETIKNGTYN

SEQ ID NO: 439440 - protein, 9 aa, Influenza virus
ETILETGYI

SEQ ID NO: 439441 - protein, 9 aa, Influenza virus
ETILETGYV

SEQ ID NO: 439442 - protein, 9 aa, Influenza virus
ETILETRYV

SEQ ID NO: 439443 - protein, 9 aa, Influenza virus
ETIRNGTYD

SEQ ID NO: 439444 - protein, 9 aa, Influenza virus
ETIRNGTYN

SEQ ID NO: 439445 - protein, 9 aa, Influenza virus
ETIVETGYV

SEQ ID NO: 439446 - protein, 9 aa, Influenza virus
ETKAPQLNP

SEQ ID NO: 439447 - protein, 9 aa, Influenza virus
ETKCQSPLG

SEQ ID NO: 439448 - protein, 9 aa, Influenza virus
ETKCQTPLG

SEQ ID NO: 439449 - protein, 9 aa, Influenza virus
ETKGLFGAI

SEQ ID NO: 439450 - protein, 9 aa, Influenza virus
ETLKGSARH

SEQ ID NO: 439451 - protein, 9 aa, Influenza virus
ETLKIRTNG

SEQ ID NO: 439452 - protein, 9 aa, Influenza virus
ETLKVESNG

SEQ ID NO: 439453 - protein, 9 aa, Influenza virus
ETLNIESNG

SEQ ID NO: 439454 - protein, 9 aa, Influenza virus
ETLNVESNG

SEQ ID NO: 439455 - protein, 9 aa, Influenza virus
ETNGNYGPI

SEQ ID NO: 439456 - protein, 9 aa, Influenza virus
ETNHTDELC

SEQ ID NO: 439457 - protein, 9 aa, Influenza virus
ETNHTGTYC

SEQ ID NO: 439458 - protein, 9 aa, Influenza virus
ETNKFAAIC

SEQ ID NO: 439459 - protein, 9 aa, Influenza virus
ETNKFASIC

SEQ ID NO: 439460 - protein, 9 aa, Influenza virus
ETNKLAAIC

SEQ ID NO: 439461 - protein, 9 aa, Influenza virus
ETQCQTPLG

SEQ ID NO: 439462 - protein, 9 aa, Influenza virus
ETQTRGIFG

SEQ ID NO: 439463 - protein, 9 aa, Influenza virus
ETRCQTPLG

SEQ ID NO: 439464 - protein, 9 aa, Influenza virus
ETRGLFGAI

SEQ ID NO: 439465 - protein, 9 aa, Influenza virus
ETRINMINS

SEQ ID NO: 439466 - protein, 9 aa, Influenza virus
ETRVWWTSN

SEQ ID NO: 439467 - protein, 9 aa, Influenza virus
ETSHTGTYC

SEQ ID NO: 439468 - protein, 9 aa, Influenza virus
ETTGRNCTI

SEQ ID NO: 439469 - protein, 9 aa, Influenza virus
ETTGRNCTV

SEQ ID NO: 439470 - protein, 9 aa, Influenza virus
ETTHTGTYC

SEQ ID NO: 439471 - protein, 9 aa, Influenza virus
ETVEERFEI

SEQ ID NO: 439472 - protein, 9 aa, Influenza virus
ETVEITGID

SEQ ID NO: 439473 - protein, 9 aa, Influenza virus
ETVEITGIN

SEQ ID NO: 439474 - protein, 9 aa, Influenza virus
ETVNTLIEQ

SEQ ID NO: 439475 - protein, 9 aa, Influenza virus
ETVNTLSEQ

SEQ ID NO: 439476 - protein, 9 aa, Influenza virus
ETVNTLTEQ

SEQ ID NO: 439477 - protein, 9 aa, Influenza virus
ETWPIGESP

SEQ ID NO: 439478 - protein, 9 aa, Influenza virus
ETWPVGESP

SEQ ID NO: 439479 - protein, 9 aa, Influenza virus
ETYKILTIY

SEQ ID NO: 439480 - protein, 9 aa, Influenza virus
ETYVLSIIP

SEQ ID NO: 439481 - protein, 9 aa, Influenza virus
ETYVLSIVP

SEQ ID NO: 439482 - protein, 9 aa, Influenza virus
ETYVLSVIP

SEQ ID NO: 439483 - protein, 9 aa, Influenza virus
EVALGYSTG

SEQ ID NO: 439484 - protein, 9 aa, Influenza virus
EVALSYSAG

SEQ ID NO: 439485 - protein, 9 aa, Influenza virus
EVALSYSTG

SEQ ID NO: 439486 - protein, 9 aa, Influenza virus
EVCFMYSDF

SEQ ID NO: 439487 - protein, 9 aa, Influenza virus
EVCLKWDLM

SEQ ID NO: 439488 - protein, 9 aa, Influenza virus
EVCLKWELM

SEQ ID NO: 439489 - protein, 9 aa, Influenza virus
EVDNNGELR

SEQ ID NO: 439490 - protein, 9 aa, Influenza virus
EVEGRIQDL

SEQ ID NO: 439491 - protein, 9 aa, Influenza virus
EVEKQIGNV

SEQ ID NO: 439492 - protein, 9 aa, Influenza virus
EVEKQLGNV

SEQ ID NO: 439493 - protein, 9 aa, Influenza virus
EVENEIRTF

SEQ ID NO: 439494 - protein, 9 aa, Influenza virus
EVEQEIRAF

SEQ ID NO: 439495 - protein, 9 aa, Influenza virus
EVEQEIRTF

SEQ ID NO: 439496 - protein, 9 aa, Influenza virus
EVEQEMRTF

SEQ ID NO: 439497 - protein, 9 aa, Influenza virus
EVEQQIGNV

SEQ ID NO: 439498 - protein, 9 aa, Influenza virus
EVERQIGNV

SEQ ID NO: 439499 - protein, 9 aa, Influenza virus
EVESEIRTF

SEQ ID NO: 439500 - protein, 9 aa, Influenza virus
EVETYVLSI

SEQ ID NO: 439501 - protein, 9 aa, Influenza virus
EVEVVNATE

SEQ ID NO: 439502 - protein, 9 aa, Influenza virus
EVFVIREPC

SEQ ID NO: 439503 - protein, 9 aa, Influenza virus
EVFVIREPF

SEQ ID NO: 439504 - protein, 9 aa, Influenza virus
EVGAKILTS

SEQ ID NO: 439505 - protein, 9 aa, Influenza virus
EVGARIITS

SEQ ID NO: 439506 - protein, 9 aa, Influenza virus
EVGARILTS

SEQ ID NO: 439507 - protein, 9 aa, Influenza virus
EVGNGCFEF

SEQ ID NO: 439508 - protein, 9 aa, Influenza virus
EVGTRWMKI

SEQ ID NO: 439509 - protein, 9 aa, Influenza virus
EVGYLCAGI

SEQ ID NO: 439510 - protein, 9 aa, Influenza virus
EVHIYYLEK

SEQ ID NO: 439511 - protein, 9 aa, Influenza virus
EVHMYYLEK

SEQ ID NO: 439512 - protein, 9 aa, Influenza virus
EVHTYYLEK

SEQ ID NO: 439513 - protein, 9 aa, Influenza virus
EVHVYYLEK

SEQ ID NO: 439514 - protein, 9 aa, Influenza virus
EVILWFSFG

SEQ ID NO: 439515 - protein, 9 aa, Influenza virus
EVITAQELV

SEQ ID NO: 439516 - protein, 9 aa, Influenza virus
EVKLEENTT

SEQ ID NO: 439517 - protein, 9 aa, Influenza virus
EVKRRLSAN

SEQ ID NO: 439518 - protein, 9 aa, Influenza virus
EVKRRLSTN

SEQ ID NO: 439519 - protein, 9 aa, Influenza virus
EVKYVWWTS

SEQ ID NO: 439520 - protein, 9 aa, Influenza virus
EVLFIEDGW

SEQ ID NO: 439521 - protein, 9 aa, Influenza virus
EVLFQGGHI

SEQ ID NO: 439522 - protein, 9 aa, Influenza virus
EVLHLTQGA

SEQ ID NO: 439523 - protein, 9 aa, Influenza virus
EVLHLTQGT

SEQ ID NO: 439524 - protein, 9 aa, Influenza virus
EVLKGSARH

SEQ ID NO: 439525 - protein, 9 aa, Influenza virus
EVLKVPDAE

SEQ ID NO: 439526 - protein, 9 aa, Influenza virus
EVLKVPNAE

SEQ ID NO: 439527 - protein, 9 aa, Influenza virus
EVLLIEDGW

SEQ ID NO: 439528 - protein, 9 aa, Influenza virus
EVLNNKHWS

SEQ ID NO: 439529 - protein, 9 aa, Influenza virus
EVLNNKNWS

SEQ ID NO: 439530 - protein, 9 aa, Influenza virus
EVLNNMNWS

SEQ ID NO: 439531 - protein, 9 aa, Influenza virus
EVLNNRNWS

SEQ ID NO: 439532 - protein, 9 aa, Influenza virus
EVLTGNLQA

SEQ ID NO: 439533 - protein, 9 aa, Influenza virus
EVLTGNLQT

SEQ ID NO: 439534 - protein, 9 aa, Influenza virus
EVLWTSNSI

SEQ ID NO: 439535 - protein, 9 aa, Influenza virus
EVNGPESVL

SEQ ID NO: 439536 - protein, 9 aa, Influenza virus
EVNSWHIFS

SEQ ID NO: 439537 - protein, 9 aa, Influenza virus
EVNSWHILS

SEQ ID NO: 439538 - protein, 9 aa, Influenza virus
EVPAQNAIS

SEQ ID NO: 439539 - protein, 9 aa, Influenza virus
EVPGWSWDD

SEQ ID NO: 439540 - protein, 9 aa, Influenza virus
EVPGWSWGD

SEQ ID NO: 439541 - protein, 9 aa, Influenza virus
EVPSPYNSR

SEQ ID NO: 439542 - protein, 9 aa, Influenza virus
EVRRIWRQA

SEQ ID NO: 439543 - protein, 9 aa, Influenza virus
EVRRRLSAN

SEQ ID NO: 439544 - protein, 9 aa, Influenza virus
EVRRRLSTN

SEQ ID NO: 439545 - protein, 9 aa, Influenza virus
EVRRRLSVN

SEQ ID NO: 439546 - protein, 9 aa, Influenza virus
EVSEAQGTE

SEQ ID NO: 439547 - protein, 9 aa, Influenza virus
EVSETQGIE

SEQ ID NO: 439548 - protein, 9 aa, Influenza virus
EVSETQGME

SEQ ID NO: 439549 - protein, 9 aa, Influenza virus
EVSETQGTE

SEQ ID NO: 439550 - protein, 9 aa, Influenza virus
EVSFQGGHI

SEQ ID NO: 439551 - protein, 9 aa, Influenza virus
EVSFQGRGV

SEQ ID NO: 439552 - protein, 9 aa, Influenza virus
EVSFRGGHI

SEQ ID NO: 439553 - protein, 9 aa, Influenza virus
EVSFRGRGV

SEQ ID NO: 439554 - protein, 9 aa, Influenza virus
EVSHCRATE

SEQ ID NO: 439555 - protein, 9 aa, Influenza virus
EVSLSYSTG

SEQ ID NO: 439556 - protein, 9 aa, Influenza virus
EVSSWHILS

SEQ ID NO: 439557 - protein, 9 aa, Influenza virus
EVSWTSNSI

SEQ ID NO: 439558 - protein, 9 aa, Influenza virus
EVTNATELV

SEQ ID NO: 439559 - protein, 9 aa, Influenza virus
EVTNATETV

SEQ ID NO: 439560 - protein, 9 aa, Influenza virus
EVTTHFQRK

SEQ ID NO: 439561 - protein, 9 aa, Influenza virus
EVVAAQELV

SEQ ID NO: 439562 - protein, 9 aa, Influenza virus
EVVDATETV

SEQ ID NO: 439563 - protein, 9 aa, Influenza virus
EVVFPNEVG

SEQ ID NO: 439564 - protein, 9 aa, Influenza virus
EVVNATETV

SEQ ID NO: 439565 - protein, 9 aa, Influenza virus
EVVSAKELV

SEQ ID NO: 439566 - protein, 9 aa, Influenza virus
EVVTAQELV

SEQ ID NO: 439567 - protein, 9 aa, Influenza virus
EVWIGRTKS

SEQ ID NO: 439568 - protein, 9 aa, Influenza virus
EVWSYNADL

SEQ ID NO: 439569 - protein, 9 aa, Influenza virus
EVWSYNAEF

SEQ ID NO: 439570 - protein, 9 aa, Influenza virus
EVWSYNAEL

SEQ ID NO: 439571 - protein, 9 aa, Influenza virus
EVWWTSNSI

SEQ ID NO: 439572 - protein, 9 aa, Influenza virus
EVYNETVRL

SEQ ID NO: 439573 - protein, 9 aa, Influenza virus
EVYNETVRV

SEQ ID NO: 439574 - protein, 9 aa, Influenza virus
EVYSETVRV

SEQ ID NO: 439575 - protein, 9 aa, Influenza virus
EWDIFIERP

SEQ ID NO: 439576 - protein, 9 aa, Influenza virus
EWDVFIERP

SEQ ID NO: 439577 - protein, 9 aa, Influenza virus
EWDVFVERP

SEQ ID NO: 439578 - protein, 9 aa, Influenza virus
EWDVYIERP

SEQ ID NO: 439579 - protein, 9 aa, Influenza virus
EWGNGCFEF

SEQ ID NO: 439580 - protein, 9 aa, Influenza virus
EWIKTRPIL

SEQ ID NO: 439581 - protein, 9 aa, Influenza virus
EWLHVCITG

SEQ ID NO: 439582 - protein, 9 aa, Influenza virus
EWLKTRPIL

SEQ ID NO: 439583 - protein, 9 aa, Influenza virus
EWMHICMTG

SEQ ID NO: 439584 - protein, 9 aa, Influenza virus
EWMHVCITG

SEQ ID NO: 439585 - protein, 9 aa, Influenza virus
EWMHVCMAG

SEQ ID NO: 439586 - protein, 9 aa, Influenza virus
EWMHVCMTG

SEQ ID NO: 439587 - protein, 9 aa, Influenza virus
EWSGYSGSF

SEQ ID NO: 439588 - protein, 9 aa, Influenza virus
EWSKRYELE

SEQ ID NO: 439589 - protein, 9 aa, Influenza virus
EWSRRYELE

SEQ ID NO: 439590 - protein, 9 aa, Influenza virus
EWSWDDGAI

SEQ ID NO: 439591 - protein, 9 aa, Influenza virus
EWSYIIEKE

SEQ ID NO: 439592 - protein, 9 aa, Influenza virus
EWSYIMEKE

SEQ ID NO: 439593 - protein, 9 aa, Influenza virus
EWSYIMEKK

SEQ ID NO: 439594 - protein, 9 aa, Influenza virus
EWSYIVEKA

SEQ ID NO: 439595 - protein, 9 aa, Influenza virus
EWSYIVEKD

SEQ ID NO: 439596 - protein, 9 aa, Influenza virus
EWSYIVEKE

SEQ ID NO: 439597 - protein, 9 aa, Influenza virus
EWSYIVEKN

SEQ ID NO: 439598 - protein, 9 aa, Influenza virus
EWSYIVERE

SEQ ID NO: 439599 - protein, 9 aa, Influenza virus
EWSYIVERP

SEQ ID NO: 439600 - protein, 9 aa, Influenza virus
EWSYIVERT

SEQ ID NO: 439601 - protein, 9 aa, Influenza virus
EWSYLIEDP

SEQ ID NO: 439602 - protein, 9 aa, Influenza virus
EWTSNSLIA

SEQ ID NO: 439603 - protein, 9 aa, Influenza virus
EYAEESKLK

SEQ ID NO: 439604 - protein, 9 aa, Influenza virus
EYASKTRIS

SEQ ID NO: 439605 - protein, 9 aa, Influenza virus
EYDAVATTH

SEQ ID NO: 439606 - protein, 9 aa, Influenza virus
EYEEEAKLE

SEQ ID NO: 439607 - protein, 9 aa, Influenza virus
EYEEESKLK

SEQ ID NO: 439608 - protein, 9 aa, Influenza virus
EYGFKISKR

SEQ ID NO: 439609 - protein, 9 aa, Influenza virus
EYGFKISRR

SEQ ID NO: 439610 - protein, 9 aa, Influenza virus
EYGFRISKR

SEQ ID NO: 439611 - protein, 9 aa, Influenza virus
EYGHLITGK

SEQ ID NO: 439612 - protein, 9 aa, Influenza virus
EYGHLTTGK

SEQ ID NO: 439613 - protein, 9 aa, Influenza virus
EYGHLVTGK

SEQ ID NO: 439614 - protein, 9 aa, Influenza virus
EYGKGRIFQ

SEQ ID NO: 439615 - protein, 9 aa, Influenza virus
EYGRGRIFQ

SEQ ID NO: 439616 - protein, 9 aa, Influenza virus
EYGYLITGK

SEQ ID NO: 439617 - protein, 9 aa, Influenza virus
EYKDWILWI

SEQ ID NO: 439618 - protein, 9 aa, Influenza virus
EYKNTGDSD

SEQ ID NO: 439619 - protein, 9 aa, Influenza virus
EYKNTRDSD

SEQ ID NO: 439620 - protein, 9 aa, Influenza virus
EYKNTRDSN

SEQ ID NO: 439621 - protein, 9 aa, Influenza virus
EYNETIRIE

SEQ ID NO: 439622 - protein, 9 aa, Influenza virus
EYNETVKVE

SEQ ID NO: 439623 - protein, 9 aa, Influenza virus
EYNETVRIE

SEQ ID NO: 439624 - protein, 9 aa, Influenza virus
EYNETVRTE

SEQ ID NO: 439625 - protein, 9 aa, Influenza virus
EYNETVRVE

SEQ ID NO: 439626 - protein, 9 aa, Influenza virus
EYNGKSLGI

SEQ ID NO: 439627 - protein, 9 aa, Influenza virus
EYNNTTGRD

SEQ ID NO: 439628 - protein, 9 aa, Influenza virus
EYPLQNLTK

SEQ ID NO: 439629 - protein, 9 aa, Influenza virus
EYQIGNVIN

SEQ ID NO: 439630 - protein, 9 aa, Influenza virus
EYQSLRSIL

SEQ ID NO: 439631 - protein, 9 aa, Influenza virus
EYRQEALQN

SEQ ID NO: 439632 - protein, 9 aa, Influenza virus
EYSIDSSYV

SEQ ID NO: 439633 - protein, 9 aa, Influenza virus
EYTLDEESR

SEQ ID NO: 439634 - protein, 9 aa, Influenza virus
EYYFVKEGK

SEQ ID NO: 439635 - protein, 9 aa, Influenza virus
FAAAPPEQS

SEQ ID NO: 439636 - protein, 9 aa, Influenza virus
FAAAPPKQS

SEQ ID NO: 439637 - protein, 9 aa, Influenza virus
FAAAPPVQS

SEQ ID NO: 439638 - protein, 9 aa, Influenza virus
FAAICTHLE

SEQ ID NO: 439639 - protein, 9 aa, Influenza virus
FAAICTHME

SEQ ID NO: 439640 - protein, 9 aa, Influenza virus
FADQELGDA

SEQ ID NO: 439641 - protein, 9 aa, Influenza virus
FAFKQGNSV

SEQ ID NO: 439642 - protein, 9 aa, Influenza virus
FAGKNADLE

SEQ ID NO: 439643 - protein, 9 aa, Influenza virus
FAGKNSDLE

SEQ ID NO: 439644 - protein, 9 aa, Influenza virus
FAGKNTDLE

SEQ ID NO: 439645 - protein, 9 aa, Influenza virus
FAGWILGNP

SEQ ID NO: 439646 - protein, 9 aa, Influenza virus
FAGWLLGNP

SEQ ID NO: 439647 - protein, 9 aa, Influenza virus
FAIASKDNG

SEQ ID NO: 439648 - protein, 9 aa, Influenza virus
FAIFSKDNG

SEQ ID NO: 439649 - protein, 9 aa, Influenza virus
FAIISKDNG

SEQ ID NO: 439650 - protein, 9 aa, Influenza virus
FAISCFLIC

SEQ ID NO: 439651 - protein, 9 aa, Influenza virus
FAISCFLLC

SEQ ID NO: 439652 - protein, 9 aa, Influenza virus
FAISCLLLC

SEQ ID NO: 439653 - protein, 9 aa, Influenza virus
FAIVSKDNG

SEQ ID NO: 439654 - protein, 9 aa, Influenza virus
FAKDNSIRL

SEQ ID NO: 439655 - protein, 9 aa, Influenza virus
FALAQGALL

SEQ ID NO: 439656 - protein, 9 aa, Influenza virus
FALAQGALV

SEQ ID NO: 439657 - protein, 9 aa, Influenza virus
FALAQGTLL

SEQ ID NO: 439658 - protein, 9 aa, Influenza virus
FALAQGVLL

SEQ ID NO: 439659 - protein, 9 aa, Influenza virus
FALGHGTTL

SEQ ID NO: 439660 - protein, 9 aa, Influenza virus
FALGQGATL

SEQ ID NO: 439661 - protein, 9 aa, Influenza virus
FALGQGTTL

SEQ ID NO: 439662 - protein, 9 aa, Influenza virus
FALSGVAIA

SEQ ID NO: 439663 - protein, 9 aa, Influenza virus
FALSGVAIS

SEQ ID NO: 439664 - protein, 9 aa, Influenza virus
FALSGVAIT

SEQ ID NO: 439665 - protein, 9 aa, Influenza virus
FALSGVAVA

SEQ ID NO: 439666 - protein, 9 aa, Influenza virus
FALSQGALL

SEQ ID NO: 439667 - protein, 9 aa, Influenza virus
FALSQGTTL

SEQ ID NO: 439668 - protein, 9 aa, Influenza virus
FAMSCFLLC

SEQ ID NO: 439669 - protein, 9 aa, Influenza virus
FAPFAKDNS

SEQ ID NO: 439670 - protein, 9 aa, Influenza virus
FAPFSKDNG

SEQ ID NO: 439671 - protein, 9 aa, Influenza virus
FAPFSKDNS

SEQ ID NO: 439672 - protein, 9 aa, Influenza virus
FAPFTKDNS

SEQ ID NO: 439673 - protein, 9 aa, Influenza virus
FAPLSKDNS

SEQ ID NO: 439674 - protein, 9 aa, Influenza virus
FASAPPEQS

SEQ ID NO: 439675 - protein, 9 aa, Influenza virus
FASICTHLE

SEQ ID NO: 439676 - protein, 9 aa, Influenza virus
FASSGIAIA

SEQ ID NO: 439677 - protein, 9 aa, Influenza virus
FASSGIAIV

SEQ ID NO: 439678 - protein, 9 aa, Influenza virus
FATSCFLLC

SEQ ID NO: 439679 - protein, 9 aa, Influenza virus
FAYDKICIG

SEQ ID NO: 439680 - protein, 9 aa, Influenza virus
FAYGSSINS

SEQ ID NO: 439681 - protein, 9 aa, Influenza virus
FCFTVMTDG

SEQ ID NO: 439682 - protein, 9 aa, Influenza virus
FCGASGTYG

SEQ ID NO: 439683 - protein, 9 aa, Influenza virus
FCGLDNEPG

SEQ ID NO: 439684 - protein, 9 aa, Influenza virus
FCGLNNEPG

SEQ ID NO: 439685 - protein, 9 aa, Influenza virus
FCGTPGTYG

SEQ ID NO: 439686 - protein, 9 aa, Influenza virus
FCGTSGIYG

SEQ ID NO: 439687 - protein, 9 aa, Influenza virus
FCGTSGSYG

SEQ ID NO: 439688 - protein, 9 aa, Influenza virus
FCGTSGTCG

SEQ ID NO: 439689 - protein, 9 aa, Influenza virus
FCGTSGTYG

SEQ ID NO: 439690 - protein, 9 aa, Influenza virus
FCGTTGTYG

SEQ ID NO: 439691 - protein, 9 aa, Influenza virus
FCGVDSDTT

SEQ ID NO: 439692 - protein, 9 aa, Influenza virus
FCGVNSDTT

SEQ ID NO: 439693 - protein, 9 aa, Influenza virus
FCGVSGEVP

SEQ ID NO: 439694 - protein, 9 aa, Influenza virus
FCGVSSEVP

SEQ ID NO: 439695 - protein, 9 aa, Influenza virus
FCLKNGNMQ

SEQ ID NO: 439696 - protein, 9 aa, Influenza virus
FCLKNGNMR

SEQ ID NO: 439697 - protein, 9 aa, Influenza virus
FCLRNGNMR

SEQ ID NO: 439698 - protein, 9 aa, Influenza virus
FCSIDGKAP

SEQ ID NO: 439699 - protein, 9 aa, Influenza virus
FCSINGKAP

SEQ ID NO: 439700 - protein, 9 aa, Influenza virus
FCSINGKEP

SEQ ID NO: 439701 - protein, 9 aa, Influenza virus
FCSINGKQP

SEQ ID NO: 439702 - protein, 9 aa, Influenza virus
FCSLDGKAP

SEQ ID NO: 439703 - protein, 9 aa, Influenza virus
FCYPGELDN

SEQ ID NO: 439704 - protein, 9 aa, Influenza virus
FCYTLITDG

SEQ ID NO: 439705 - protein, 9 aa, Influenza virus
FCYTLMTDG

SEQ ID NO: 439706 - protein, 9 aa, Influenza virus
FCYTLVTDG

SEQ ID NO: 439707 - protein, 9 aa, Influenza virus
FDDRLRRDQ

SEQ ID NO: 439708 - protein, 9 aa, Influenza virus
FDERRNKYL

SEQ ID NO: 439709 - protein, 9 aa, Influenza virus
FDERRNRYL

SEQ ID NO: 439710 - protein, 9 aa, Influenza virus
FDEVKRRLS

SEQ ID NO: 439711 - protein, 9 aa, Influenza virus
FDEVRRRLS

SEQ ID NO: 439712 - protein, 9 aa, Influenza virus
FDFIKWNVT

SEQ ID NO: 439713 - protein, 9 aa, Influenza virus
FDFSKWNVT

SEQ ID NO: 439714 - protein, 9 aa, Influenza virus
FDFTKWNVT

SEQ ID NO: 439715 - protein, 9 aa, Influenza virus
FDGGHIEEC

SEQ ID NO: 439716 - protein, 9 aa, Influenza virus
FDGKEWLHV

SEQ ID NO: 439717 - protein, 9 aa, Influenza virus
FDGKEWMHI

SEQ ID NO: 439718 - protein, 9 aa, Influenza virus
FDGKEWMHV

SEQ ID NO: 439719 - protein, 9 aa, Influenza virus
FDGREWMHV

SEQ ID NO: 439720 - protein, 9 aa, Influenza virus
FDILHKCDN

SEQ ID NO: 439721 - protein, 9 aa, Influenza virus
FDILHKCNN

SEQ ID NO: 439722 - protein, 9 aa, Influenza virus
FDKLYIWGI

SEQ ID NO: 439723 - protein, 9 aa, Influenza virus
FDKLYIWGV

SEQ ID NO: 439724 - protein, 9 aa, Influenza virus
FDKLYVWGI

SEQ ID NO: 439725 - protein, 9 aa, Influenza virus
FDKLYVWGV

SEQ ID NO: 439726 - protein, 9 aa, Influenza virus
FDMNNEGSY

SEQ ID NO: 439727 - protein, 9 aa, Influenza virus
FDMSKEGSY

SEQ ID NO: 439728 - protein, 9 aa, Influenza virus
FDMSNDGSY

SEQ ID NO: 439729 - protein, 9 aa, Influenza virus
FDMSNEGSY

SEQ ID NO: 439730 - protein, 9 aa, Influenza virus
FDSLNITAA

SEQ ID NO: 439731 - protein, 9 aa, Influenza virus
FDSNGNFIA

SEQ ID NO: 439732 - protein, 9 aa, Influenza virus
FDVPDYQSL

SEQ ID NO: 439733 - protein, 9 aa, Influenza virus
FDVYQILAI

SEQ ID NO: 439734 - protein, 9 aa, Influenza virus
FDWTLNRNQ

SEQ ID NO: 439735 - protein, 9 aa, Influenza virus
FDYSGWNVT

SEQ ID NO: 439736 - protein, 9 aa, Influenza virus
FDYSKWNVS

SEQ ID NO: 439737 - protein, 9 aa, Influenza virus
FDYSKWNVT

SEQ ID NO: 439738 - protein, 9 aa, Influenza virus
FDYSRWNVT

SEQ ID NO: 439739 - protein, 9 aa, Influenza virus
FEAIGREFN

SEQ ID NO: 439740 - protein, 9 aa, Influenza virus
FEANGNLIA

SEQ ID NO: 439741 - protein, 9 aa, Influenza virus
FEATGNLIA

SEQ ID NO: 439742 - protein, 9 aa, Influenza virus
FEATGNLLV

SEQ ID NO: 439743 - protein, 9 aa, Influenza virus
FEATGNLVA

SEQ ID NO: 439744 - protein, 9 aa, Influenza virus
FEATGNLVV

SEQ ID NO: 439745 - protein, 9 aa, Influenza virus
FEAVAWSAT

SEQ ID NO: 439746 - protein, 9 aa, Influenza virus
FEAVGKEFN

SEQ ID NO: 439747 - protein, 9 aa, Influenza virus
FEAVGREFN

SEQ ID NO: 439748 - protein, 9 aa, Influenza virus
FEAVGREFS

SEQ ID NO: 439749 - protein, 9 aa, Influenza virus
FECITPNGS

SEQ ID NO: 439750 - protein, 9 aa, Influenza virus
FEECSCYPS

SEQ ID NO: 439751 - protein, 9 aa, Influenza virus
FEFSDERAA

SEQ ID NO: 439752 - protein, 9 aa, Influenza virus
FEFTSFFYR

SEQ ID NO: 439753 - protein, 9 aa, Influenza virus
FEFWHKCDD

SEQ ID NO: 439754 - protein, 9 aa, Influenza virus
FEFWHKCDN

SEQ ID NO: 439755 - protein, 9 aa, Influenza virus
FEFWHKCNN

SEQ ID NO: 439756 - protein, 9 aa, Influenza virus
FEFYHKCDD

SEQ ID NO: 439757 - protein, 9 aa, Influenza virus
FEFYHKCDN

SEQ ID NO: 439758 - protein, 9 aa, Influenza virus
FEFYHKCND

SEQ ID NO: 439759 - protein, 9 aa, Influenza virus
FEFYHKCNN

SEQ ID NO: 439760 - protein, 9 aa, Influenza virus
FEFYHRCDD

SEQ ID NO: 439761 - protein, 9 aa, Influenza virus
FEFYHRCDN

SEQ ID NO: 439762 - protein, 9 aa, Influenza virus
FEGWIGGNP

SEQ ID NO: 439763 - protein, 9 aa, Influenza virus
FEGWIVGNP

SEQ ID NO: 439764 - protein, 9 aa, Influenza virus
FEIFHKCDD

SEQ ID NO: 439765 - protein, 9 aa, Influenza virus
FEIFHKCDN

SEQ ID NO: 439766 - protein, 9 aa, Influenza virus
FEIFHQCDN

SEQ ID NO: 439767 - protein, 9 aa, Influenza virus
FEIFHQCNN

SEQ ID NO: 439768 - protein, 9 aa, Influenza virus
FEIFHRCDD

SEQ ID NO: 439769 - protein, 9 aa, Influenza virus
FEIFHRCDN

SEQ ID NO: 439770 - protein, 9 aa, Influenza virus
FEIIEGRDR

SEQ ID NO: 439771 - protein, 9 aa, Influenza virus
FEILHKCDD

SEQ ID NO: 439772 - protein, 9 aa, Influenza virus
FEILHKCDN

SEQ ID NO: 439773 - protein, 9 aa, Influenza virus
FEILHKCND

SEQ ID NO: 439774 - protein, 9 aa, Influenza virus
FEILHRCDD

SEQ ID NO: 439775 - protein, 9 aa, Influenza virus
FEILHRCND

SEQ ID NO: 439776 - protein, 9 aa, Influenza virus
FEILLIEDG

SEQ ID NO: 439777 - protein, 9 aa, Influenza virus
FEILLIEEG

SEQ ID NO: 439778 - protein, 9 aa, Influenza virus
FEKEGYSLV

SEQ ID NO: 439779 - protein, 9 aa, Influenza virus
FEKFEIFPK

SEQ ID NO: 439780 - protein, 9 aa, Influenza virus
FEKFFPSSS

SEQ ID NO: 439781 - protein, 9 aa, Influenza virus
FEKIKILPR

SEQ ID NO: 439782 - protein, 9 aa, Influenza virus
FEKVKILAR

SEQ ID NO: 439783 - protein, 9 aa, Influenza virus
FEKVKILPK

SEQ ID NO: 439784 - protein, 9 aa, Influenza virus
FEKVKILPR

SEQ ID NO: 439785 - protein, 9 aa, Influenza virus
FEKVRILPK

SEQ ID NO: 439786 - protein, 9 aa, Influenza virus
FELIDNEFN

SEQ ID NO: 439787 - protein, 9 aa, Influenza virus
FELIDNEFS

SEQ ID NO: 439788 - protein, 9 aa, Influenza virus
FELIDNEFT

SEQ ID NO: 439789 - protein, 9 aa, Influenza virus
FELIDNKFN

SEQ ID NO: 439790 - protein, 9 aa, Influenza virus
FELINNEFN

SEQ ID NO: 439791 - protein, 9 aa, Influenza virus
FELLHKCND

SEQ ID NO: 439792 - protein, 9 aa, Influenza virus
FELLHKCNN

SEQ ID NO: 439793 - protein, 9 aa, Influenza virus
FELSDEKAA

SEQ ID NO: 439794 - protein, 9 aa, Influenza virus
FELSDEKAT

SEQ ID NO: 439795 - protein, 9 aa, Influenza virus
FELSDERAA

SEQ ID NO: 439796 - protein, 9 aa, Influenza virus
FELSDERAT

SEQ ID NO: 439797 - protein, 9 aa, Influenza virus
FEMIDNEFN

SEQ ID NO: 439798 - protein, 9 aa, Influenza virus
FEMIWDANG

SEQ ID NO: 439799 - protein, 9 aa, Influenza virus
FEMIWDPDG

SEQ ID NO: 439800 - protein, 9 aa, Influenza virus
FEMIWDPNG

SEQ ID NO: 439801 - protein, 9 aa, Influenza virus
FEMLKIHNA

SEQ ID NO: 439802 - protein, 9 aa, Influenza virus
FEMLKIPNA

SEQ ID NO: 439803 - protein, 9 aa, Influenza virus
FEMLKVPNA

SEQ ID NO: 439804 - protein, 9 aa, Influenza virus
FEMLRIPNA

SEQ ID NO: 439805 - protein, 9 aa, Influenza virus
FEMSNEGSY

SEQ ID NO: 439806 - protein, 9 aa, Influenza virus
FEMVWDANG

SEQ ID NO: 439807 - protein, 9 aa, Influenza virus
FEMVWDPNG

SEQ ID NO: 439808 - protein, 9 aa, Influenza virus
FEPFQSLIP

SEQ ID NO: 439809 - protein, 9 aa, Influenza virus
FEPFQSLVP

SEQ ID NO: 439810 - protein, 9 aa, Influenza virus
FEPNGCIEG

SEQ ID NO: 439811 - protein, 9 aa, Influenza virus
FEPNGCIES

SEQ ID NO: 439812 - protein, 9 aa, Influenza virus
FEPNGSIEG

SEQ ID NO: 439813 - protein, 9 aa, Influenza virus
FEPNGYIEG

SEQ ID NO: 439814 - protein, 9 aa, Influenza virus
FEQITFIQA

SEQ ID NO: 439815 - protein, 9 aa, Influenza virus
FEQITFLQA

SEQ ID NO: 439816 - protein, 9 aa, Influenza virus
FEQITFMQA

SEQ ID NO: 439817 - protein, 9 aa, Influenza virus
FEQVEGRIQ

SEQ ID NO: 439818 - protein, 9 aa, Influenza virus
FEQVEGRTQ

SEQ ID NO: 439819 - protein, 9 aa, Influenza virus
FEREGYSLV

SEQ ID NO: 439820 - protein, 9 aa, Influenza virus
FERFEIFPK

SEQ ID NO: 439821 - protein, 9 aa, Influenza virus
FERFEIFPN

SEQ ID NO: 439822 - protein, 9 aa, Influenza virus
FERFEMFPK

SEQ ID NO: 439823 - protein, 9 aa, Influenza virus
FERVKRQLR

SEQ ID NO: 439824 - protein, 9 aa, Influenza virus
FERVRHQLR

SEQ ID NO: 439825 - protein, 9 aa, Influenza virus
FERVRRQLR

SEQ ID NO: 439826 - protein, 9 aa, Influenza virus
FESDGAFLA

SEQ ID NO: 439827 - protein, 9 aa, Influenza virus
FESIESEFN

SEQ ID NO: 439828 - protein, 9 aa, Influenza virus
FESIESEFS

SEQ ID NO: 439829 - protein, 9 aa, Influenza virus
FESNGAFIA

SEQ ID NO: 439830 - protein, 9 aa, Influenza virus
FESNGAFLA

SEQ ID NO: 439831 - protein, 9 aa, Influenza virus
FESNGALLA

SEQ ID NO: 439832 - protein, 9 aa, Influenza virus
FESNGGFLA

SEQ ID NO: 439833 - protein, 9 aa, Influenza virus
FESNGGLIA

SEQ ID NO: 439834 - protein, 9 aa, Influenza virus
FESNGGLLA

SEQ ID NO: 439835 - protein, 9 aa, Influenza virus
FESNGNFIA

SEQ ID NO: 439836 - protein, 9 aa, Influenza virus
FESNGNFIT

SEQ ID NO: 439837 - protein, 9 aa, Influenza virus
FESNGNLIA

SEQ ID NO: 439838 - protein, 9 aa, Influenza virus
FESSGGLLA

SEQ ID NO: 439839 - protein, 9 aa, Influenza virus
FESTGNFIA

SEQ ID NO: 439840 - protein, 9 aa, Influenza virus
FESTGNLIA

SEQ ID NO: 439841 - protein, 9 aa, Influenza virus
FESTGNLVA

SEQ ID NO: 439842 - protein, 9 aa, Influenza virus
FESVAWSAS

SEQ ID NO: 439843 - protein, 9 aa, Influenza virus
FESVAWSAT

SEQ ID NO: 439844 - protein, 9 aa, Influenza virus
FESVEWSAT

SEQ ID NO: 439845 - protein, 9 aa, Influenza virus
FESVGWSAT

SEQ ID NO: 439846 - protein, 9 aa, Influenza virus
FEVLFIEDG

SEQ ID NO: 439847 - protein, 9 aa, Influenza virus
FEVLLIEDG

SEQ ID NO: 439848 - protein, 9 aa, Influenza virus
FEVMNHEFS

SEQ ID NO: 439849 - protein, 9 aa, Influenza virus
FEVVDHEFS

SEQ ID NO: 439850 - protein, 9 aa, Influenza virus
FEVVNHEFS

SEQ ID NO: 439851 - protein, 9 aa, Influenza virus
FFARLNWLT

SEQ ID NO: 439852 - protein, 9 aa, Influenza virus
FFCLKDGNM

SEQ ID NO: 439853 - protein, 9 aa, Influenza virus
FFCLKNGNM

SEQ ID NO: 439854 - protein, 9 aa, Influenza virus
FFCLKNGNT

SEQ ID NO: 439855 - protein, 9 aa, Influenza virus
FFCLRNGNM

SEQ ID NO: 439856 - protein, 9 aa, Influenza virus
FFFCLKNGN

SEQ ID NO: 439857 - protein, 9 aa, Influenza virus
FFGAIAGFI

SEQ ID NO: 439858 - protein, 9 aa, Influenza virus
FFGDNAEEF

SEQ ID NO: 439859 - protein, 9 aa, Influenza virus
FFGDNAEEY

SEQ ID NO: 439860 - protein, 9 aa, Influenza virus
FFGDNAKEY

SEQ ID NO: 439861 - protein, 9 aa, Influenza virus
FFHKCNDSC

SEQ ID NO: 439862 - protein, 9 aa, Influenza virus
FFLTHGALL

SEQ ID NO: 439863 - protein, 9 aa, Influenza virus
FFLTHGSLL

SEQ ID NO: 439864 - protein, 9 aa, Influenza virus
FFLTQGALL

SEQ ID NO: 439865 - protein, 9 aa, Influenza virus
FFLTQGSLL

SEQ ID NO: 439866 - protein, 9 aa, Influenza virus
FFNNTEPLC

SEQ ID NO: 439867 - protein, 9 aa, Influenza virus
FFPDGPQIQ

SEQ ID NO: 439868 - protein, 9 aa, Influenza virus
FFPFHKDNA

SEQ ID NO: 439869 - protein, 9 aa, Influenza virus
FFPSSSYRR

SEQ ID NO: 439870 - protein, 9 aa, Influenza virus
FFRHMVWLI

SEQ ID NO: 439871 - protein, 9 aa, Influenza virus
FFRNIVWLI

SEQ ID NO: 439872 - protein, 9 aa, Influenza virus
FFRNMIWLI

SEQ ID NO: 439873 - protein, 9 aa, Influenza virus
FFRNMIWLT

SEQ ID NO: 439874 - protein, 9 aa, Influenza virus
FFRNMVWLI

SEQ ID NO: 439875 - protein, 9 aa, Influenza virus
FFRNMVWLT

SEQ ID NO: 439876 - protein, 9 aa, Influenza virus
FFRNMVWLV

SEQ ID NO: 439877 - protein, 9 aa, Influenza virus
FFRNVVWLI

SEQ ID NO: 439878 - protein, 9 aa, Influenza virus
FFRNVVWLT

SEQ ID NO: 439879 - protein, 9 aa, Influenza virus
FFRNVVWLV

SEQ ID NO: 439880 - protein, 9 aa, Influenza virus
FFRRLNWLT

SEQ ID NO: 439881 - protein, 9 aa, Influenza virus
FFSRLNWLH

SEQ ID NO: 439882 - protein, 9 aa, Influenza virus
FFSRLNWLT

SEQ ID NO: 439883 - protein, 9 aa, Influenza virus
FFSRLNWLY

SEQ ID NO: 439884 - protein, 9 aa, Influenza virus
FFWMCSNGS

SEQ ID NO: 439885 - protein, 9 aa, Influenza virus
FFYRYGFVA

SEQ ID NO: 439886 - protein, 9 aa, Influenza virus
FGAIAGFIE

SEQ ID NO: 439887 - protein, 9 aa, Influenza virus
FGAIAGFLE

SEQ ID NO: 439888 - protein, 9 aa, Influenza virus
FGAKAGFIE

SEQ ID NO: 439889 - protein, 9 aa, Influenza virus
FGASCFILL

SEQ ID NO: 439890 - protein, 9 aa, Influenza virus
FGASCFLFL

SEQ ID NO: 439891 - protein, 9 aa, Influenza virus
FGASCFLLI

SEQ ID NO: 439892 - protein, 9 aa, Influenza virus
FGASCFLLL

SEQ ID NO: 439893 - protein, 9 aa, Influenza virus
FGASCFVLL

SEQ ID NO: 439894 - protein, 9 aa, Influenza virus
FGASCLILL

SEQ ID NO: 439895 - protein, 9 aa, Influenza virus
FGASCVMLL

SEQ ID NO: 439896 - protein, 9 aa, Influenza virus
FGASSFVLL

SEQ ID NO: 439897 - protein, 9 aa, Influenza virus
FGCQNGNIR

SEQ ID NO: 439898 - protein, 9 aa, Influenza virus
FGCQNGNVR

SEQ ID NO: 439899 - protein, 9 aa, Influenza virus
FGDNPRPAD

SEQ ID NO: 439900 - protein, 9 aa, Influenza virus
FGDNPRPDD

SEQ ID NO: 439901 - protein, 9 aa, Influenza virus
FGDNPRPMD

SEQ ID NO: 439902 - protein, 9 aa, Influenza virus
FGDNPRPND

SEQ ID NO: 439903 - protein, 9 aa, Influenza virus
FGDNPRPSD

SEQ ID NO: 439904 - protein, 9 aa, Influenza virus
FGDNPRPVD

SEQ ID NO: 439905 - protein, 9 aa, Influenza virus
FGDNPRSVD

SEQ ID NO: 439906 - protein, 9 aa, Influenza virus
FGDSPRPND

SEQ ID NO: 439907 - protein, 9 aa, Influenza virus
FGDTPRPND

SEQ ID NO: 439908 - protein, 9 aa, Influenza virus
FGEGEQIIV

SEQ ID NO: 439909 - protein, 9 aa, Influenza virus
FGESEQIIV

SEQ ID NO: 439910 - protein, 9 aa, Influenza virus
FGESEQIVV

SEQ ID NO: 439911 - protein, 9 aa, Influenza virus
FGESEQVIV

SEQ ID NO: 439912 - protein, 9 aa, Influenza virus
FGFRQGDDV

SEQ ID NO: 439913 - protein, 9 aa, Influenza virus
FGFRQGNDV

SEQ ID NO: 439914 - protein, 9 aa, Influenza virus
FGFRQGNSV

SEQ ID NO: 439915 - protein, 9 aa, Influenza virus
FGFRQGSDV

SEQ ID NO: 439916 - protein, 9 aa, Influenza virus
FGFRQGTDV

SEQ ID NO: 439917 - protein, 9 aa, Influenza virus
FGFRQGTSV

SEQ ID NO: 439918 - protein, 9 aa, Influenza virus
FGGFTFKRT

SEQ ID NO: 439919 - protein, 9 aa, Influenza virus
FGKDNAIRI

SEQ ID NO: 439920 - protein, 9 aa, Influenza virus
FGKDNAVRI

SEQ ID NO: 439921 - protein, 9 aa, Influenza virus
FGLICATCE

SEQ ID NO: 439922 - protein, 9 aa, Influenza virus
FGLIDNEFN

SEQ ID NO: 439923 - protein, 9 aa, Influenza virus
FGLVCATCE

SEQ ID NO: 439924 - protein, 9 aa, Influenza virus
FGNLERRLE

SEQ ID NO: 439925 - protein, 9 aa, Influenza virus
FGPVHFQNQ

SEQ ID NO: 439926 - protein, 9 aa, Influenza virus
FGPVHFRNQ

SEQ ID NO: 439927 - protein, 9 aa, Influenza virus
FGPVHFRSQ

SEQ ID NO: 439928 - protein, 9 aa, Influenza virus
FGQVEGRIQ

SEQ ID NO: 439929 - protein, 9 aa, Influenza virus
FGRIDFHWL

SEQ ID NO: 439930 - protein, 9 aa, Influenza virus
FGRINFHWL

SEQ ID NO: 439931 - protein, 9 aa, Influenza virus
FGVSGINES

SEQ ID NO: 439932 - protein, 9 aa, Influenza virus
FGVSGVNES

SEQ ID NO: 439933 - protein, 9 aa, Influenza virus
FGVVNHEFS

SEQ ID NO: 439934 - protein, 9 aa, Influenza virus
FGVYQILAI

SEQ ID NO: 439935 - protein, 9 aa, Influenza virus
FGYFGIFFV

SEQ ID NO: 439936 - protein, 9 aa, Influenza virus
FGYLLKGES

SEQ ID NO: 439937 - protein, 9 aa, Influenza virus
FGYLLRGES

SEQ ID NO: 439938 - protein, 9 aa, Influenza virus
FHDSNVKNL

SEQ ID NO: 439939 - protein, 9 aa, Influenza virus
FHDSNVKSL

SEQ ID NO: 439940 - protein, 9 aa, Influenza virus
FHDSNVRNL

SEQ ID NO: 439941 - protein, 9 aa, Influenza virus
FHFEECSCY

SEQ ID NO: 439942 - protein, 9 aa, Influenza virus
FHGAKEIAL

SEQ ID NO: 439943 - protein, 9 aa, Influenza virus
FHGAKEISL

SEQ ID NO: 439944 - protein, 9 aa, Influenza virus
FHGAKEVAL

SEQ ID NO: 439945 - protein, 9 aa, Influenza virus
FHGAKEVSL

SEQ ID NO: 439946 - protein, 9 aa, Influenza virus
FHHSNAEGT

SEQ ID NO: 439947 - protein, 9 aa, Influenza virus
FHHSNSEGT

SEQ ID NO: 439948 - protein, 9 aa, Influenza virus
FHKCDDDCM

SEQ ID NO: 439949 - protein, 9 aa, Influenza virus
FHKCDDHCM

SEQ ID NO: 439950 - protein, 9 aa, Influenza virus
FHKCDDQCM

SEQ ID NO: 439951 - protein, 9 aa, Influenza virus
FHKCDDRCM

SEQ ID NO: 439952 - protein, 9 aa, Influenza virus
FHKCDNQCM

SEQ ID NO: 439953 - protein, 9 aa, Influenza virus
FHKCNDSCM

SEQ ID NO: 439954 - protein, 9 aa, Influenza virus
FHKDNAIRL

SEQ ID NO: 439955 - protein, 9 aa, Influenza virus
FHKDNAIRP

SEQ ID NO: 439956 - protein, 9 aa, Influenza virus
FHKDNALRL

SEQ ID NO: 439957 - protein, 9 aa, Influenza virus
FHKDNAVRL

SEQ ID NO: 439958 - protein, 9 aa, Influenza virus
FHKGIVIKE

SEQ ID NO: 439959 - protein, 9 aa, Influenza virus
FHKGLIIKE

SEQ ID NO: 439960 - protein, 9 aa, Influenza virus
FHKGLLIKE

SEQ ID NO: 439961 - protein, 9 aa, Influenza virus
FHKGLVIKE

SEQ ID NO: 439962 - protein, 9 aa, Influenza virus
FHKGLVVKE

SEQ ID NO: 439963 - protein, 9 aa, Influenza virus
FHLATKQVC

SEQ ID NO: 439964 - protein, 9 aa, Influenza virus
FHLGTKQVC

SEQ ID NO: 439965 - protein, 9 aa, Influenza virus
FHLGTRQVC

SEQ ID NO: 439966 - protein, 9 aa, Influenza virus
FHNIHPLAI

SEQ ID NO: 439967 - protein, 9 aa, Influenza virus
FHNIHPLTI

SEQ ID NO: 439968 - protein, 9 aa, Influenza virus
FHNISKYAF

SEQ ID NO: 439969 - protein, 9 aa, Influenza virus
FHNVHPFTI

SEQ ID NO: 439970 - protein, 9 aa, Influenza virus
FHNVHPLAI

SEQ ID NO: 439971 - protein, 9 aa, Influenza virus
FHNVHPLTI

SEQ ID NO: 439972 - protein, 9 aa, Influenza virus
FHNVSKYAF

SEQ ID NO: 439973 - protein, 9 aa, Influenza virus
FHQCDNDCM

SEQ ID NO: 439974 - protein, 9 aa, Influenza virus
FHQCDNNCI

SEQ ID NO: 439975 - protein, 9 aa, Influenza virus
FHQIEKEFS

SEQ ID NO: 439976 - protein, 9 aa, Influenza virus
FHRAKEVAL

SEQ ID NO: 439977 - protein, 9 aa, Influenza virus
FHRCDDQCM

SEQ ID NO: 439978 - protein, 9 aa, Influenza virus
FHRKRRVRD

SEQ ID NO: 439979 - protein, 9 aa, Influenza virus
FHSDTPRPA

SEQ ID NO: 439980 - protein, 9 aa, Influenza virus
FHSDTPRPD

SEQ ID NO: 439981 - protein, 9 aa, Influenza virus
FHSDTPRPS

SEQ ID NO: 439982 - protein, 9 aa, Influenza virus
FHSDTPRPT

SEQ ID NO: 439983 - protein, 9 aa, Influenza virus
FHSDTPRPV

SEQ ID NO: 439984 - protein, 9 aa, Influenza virus
FHWLILNPN

SEQ ID NO: 439985 - protein, 9 aa, Influenza virus
FHWLLLDPN

SEQ ID NO: 439986 - protein, 9 aa, Influenza virus
FHWLMLNPN

SEQ ID NO: 439987 - protein, 9 aa, Influenza virus
FHWLMLNSN

SEQ ID NO: 439988 - protein, 9 aa, Influenza virus
FHWMLLDPG

SEQ ID NO: 439989 - protein, 9 aa, Influenza virus
FHWMMLNPN

SEQ ID NO: 439990 - protein, 9 aa, Influenza virus
FHYEECSCY

SEQ ID NO: 439991 - protein, 9 aa, Influenza virus
FIAEQFTWN

SEQ ID NO: 439992 - protein, 9 aa, Influenza virus
FIAPDRASF

SEQ ID NO: 439993 - protein, 9 aa, Influenza virus
FIAPDRATF

SEQ ID NO: 439994 - protein, 9 aa, Influenza virus
FIAPDRVSF

SEQ ID NO: 439995 - protein, 9 aa, Influenza virus
FIAPENAYK

SEQ ID NO: 439996 - protein, 9 aa, Influenza virus
FIAPEYAFK

SEQ ID NO: 439997 - protein, 9 aa, Influenza virus
FIAPEYAYI

SEQ ID NO: 439998 - protein, 9 aa, Influenza virus
FIAPEYAYK

SEQ ID NO: 439999 - protein, 9 aa, Influenza virus
FIAPEYAYR

SEQ ID NO: 440000 - protein, 9 aa, Influenza virus
FIAPNRASF

SEQ ID NO: 440001 - protein, 9 aa, Influenza virus
FIAPRYAFE

SEQ ID NO: 440002 - protein, 9 aa, Influenza virus
FICIKNGNM

SEQ ID NO: 440003 - protein, 9 aa, Influenza virus
FICIKNGNV

SEQ ID NO: 440004 - protein, 9 aa, Influenza virus
FICVGWSST

SEQ ID NO: 440005 - protein, 9 aa, Influenza virus
FICVKNGNM

SEQ ID NO: 440006 - protein, 9 aa, Influenza virus
FICVRNGNM

SEQ ID NO: 440007 - protein, 9 aa, Influenza virus
FIDIWTYNA

SEQ ID NO: 440008 - protein, 9 aa, Influenza virus
FIDRLRRDQ

SEQ ID NO: 440009 - protein, 9 aa, Influenza virus
FIDVWTYNA

SEQ ID NO: 440010 - protein, 9 aa, Influenza virus
FIEGGWCGM

SEQ ID NO: 440011 - protein, 9 aa, Influenza virus
FIEGGWPGL

SEQ ID NO: 440012 - protein, 9 aa, Influenza virus
FIEGGWQGL

SEQ ID NO: 440013 - protein, 9 aa, Influenza virus
FIEGGWQGM

SEQ ID NO: 440014 - protein, 9 aa, Influenza virus
FIEGGWSGL

SEQ ID NO: 440015 - protein, 9 aa, Influenza virus
FIEGGWSGM

SEQ ID NO: 440016 - protein, 9 aa, Influenza virus
FIEGGWTGL

SEQ ID NO: 440017 - protein, 9 aa, Influenza virus
FIEGGWTGM

SEQ ID NO: 440018 - protein, 9 aa, Influenza virus
FIEGRWPGL

SEQ ID NO: 440019 - protein, 9 aa, Influenza virus
FIEIGVTRR

SEQ ID NO: 440020 - protein, 9 aa, Influenza virus
FIEKTNQQF

SEQ ID NO: 440021 - protein, 9 aa, Influenza virus
FIENGWEGL

SEQ ID NO: 440022 - protein, 9 aa, Influenza virus
FIENGWEGM

SEQ ID NO: 440023 - protein, 9 aa, Influenza virus
FIENGWQGL

SEQ ID NO: 440024 - protein, 9 aa, Influenza virus
FIERPTAVD

SEQ ID NO: 440025 - protein, 9 aa, Influenza virus
FIEVEKQIG

SEQ ID NO: 440026 - protein, 9 aa, Influenza virus
FIFGCQNGN

SEQ ID NO: 440027 - protein, 9 aa, Influenza virus
FIFILLTHW

SEQ ID NO: 440028 - protein, 9 aa, Influenza virus
FIFLLLTHW

SEQ ID NO: 440029 - protein, 9 aa, Influenza virus
FIFNGAFIA

SEQ ID NO: 440030 - protein, 9 aa, Influenza virus
FIGEEMATK

SEQ ID NO: 440031 - protein, 9 aa, Influenza virus
FIIKGRSHL

SEQ ID NO: 440032 - protein, 9 aa, Influenza virus
FIIREPFIS

SEQ ID NO: 440033 - protein, 9 aa, Influenza virus
FIIREPFVS

SEQ ID NO: 440034 - protein, 9 aa, Influenza virus
FIKDYRYTY

SEQ ID NO: 440035 - protein, 9 aa, Influenza virus
FIKWNVTYT

SEQ ID NO: 440036 - protein, 9 aa, Influenza virus
FILWACQNG

SEQ ID NO: 440037 - protein, 9 aa, Influenza virus
FILWACSSG

SEQ ID NO: 440038 - protein, 9 aa, Influenza virus
FIMWACNSG

SEQ ID NO: 440039 - protein, 9 aa, Influenza virus
FIMWACQKG

SEQ ID NO: 440040 - protein, 9 aa, Influenza virus
FIMWACQRG

SEQ ID NO: 440041 - protein, 9 aa, Influenza virus
FIMWACSNG

SEQ ID NO: 440042 - protein, 9 aa, Influenza virus
FIMWACSSG

SEQ ID NO: 440043 - protein, 9 aa, Influenza virus
FIMWTCNSG

SEQ ID NO: 440044 - protein, 9 aa, Influenza virus
FIMWTCQKG

SEQ ID NO: 440045 - protein, 9 aa, Influenza virus
FIQALQLLL

SEQ ID NO: 440046 - protein, 9 aa, Influenza virus
FIQHPELTG

SEQ ID NO: 440047 - protein, 9 aa, Influenza virus
FIQNALNGN

SEQ ID NO: 440048 - protein, 9 aa, Influenza virus
FISCSHFEC

SEQ ID NO: 440049 - protein, 9 aa, Influenza virus
FISCSHLEC

SEQ ID NO: 440050 - protein, 9 aa, Influenza virus
FISCSHMEC

SEQ ID NO: 440051 - protein, 9 aa, Influenza virus
FISCSHSEC

SEQ ID NO: 440052 - protein, 9 aa, Influenza virus
FISCSPLEC

SEQ ID NO: 440053 - protein, 9 aa, Influenza virus
FISCSQLEC

SEQ ID NO: 440054 - protein, 9 aa, Influenza virus
FISCSYLEC

SEQ ID NO: 440055 - protein, 9 aa, Influenza virus
FITPEYAYK

SEQ ID NO: 440056 - protein, 9 aa, Influenza virus
FITQGSLLN

SEQ ID NO: 440057 - protein, 9 aa, Influenza virus
FIVKGRSHL

SEQ ID NO: 440058 - protein, 9 aa, Influenza virus
FIVWACQRG

SEQ ID NO: 440059 - protein, 9 aa, Influenza virus
FIWAIHHPP

SEQ ID NO: 440060 - protein, 9 aa, Influenza virus
FIWGLSEWK

SEQ ID NO: 440061 - protein, 9 aa, Influenza virus
FIYGSSINS

SEQ ID NO: 440062 - protein, 9 aa, Influenza virus
FIYSGIRTN

SEQ ID NO: 440063 - protein, 9 aa, Influenza virus
FKADLIIER

SEQ ID NO: 440064 - protein, 9 aa, Influenza virus
FKFVSSDCS

SEQ ID NO: 440065 - protein, 9 aa, Influenza virus
FKFYHKCDN

SEQ ID NO: 440066 - protein, 9 aa, Influenza virus
FKGFFPFHK

SEQ ID NO: 440067 - protein, 9 aa, Influenza virus
FKHQNAQGE

SEQ ID NO: 440068 - protein, 9 aa, Influenza virus
FKISKRGGS

SEQ ID NO: 440069 - protein, 9 aa, Influenza virus
FKISKRGNS

SEQ ID NO: 440070 - protein, 9 aa, Influenza virus
FKISKRGSS

SEQ ID NO: 440071 - protein, 9 aa, Influenza virus
FKIYHKCDN

SEQ ID NO: 440072 - protein, 9 aa, Influenza virus
FKIYHKCNN

SEQ ID NO: 440073 - protein, 9 aa, Influenza virus
FKIYHRCDN

SEQ ID NO: 440074 - protein, 9 aa, Influenza virus
FKLLQNSQI

SEQ ID NO: 440075 - protein, 9 aa, Influenza virus
FKLLQNSQV

SEQ ID NO: 440076 - protein, 9 aa, Influenza virus
FKLLQTSQV

SEQ ID NO: 440077 - protein, 9 aa, Influenza virus
FKMNPNKKI

SEQ ID NO: 440078 - protein, 9 aa, Influenza virus
FKMNPNQKI

SEQ ID NO: 440079 - protein, 9 aa, Influenza virus
FKNTKGRDV

SEQ ID NO: 440080 - protein, 9 aa, Influenza virus
FKPNGCIEG

SEQ ID NO: 440081 - protein, 9 aa, Influenza virus
FKPNIGPRP

SEQ ID NO: 440082 - protein, 9 aa, Influenza virus
FKPPLPLCP

SEQ ID NO: 440083 - protein, 9 aa, Influenza virus
FKPSLPLCP

SEQ ID NO: 440084 - protein, 9 aa, Influenza virus
FKSPLPLCP

SEQ ID NO: 440085 - protein, 9 aa, Influenza virus
FKSSLPLCP

SEQ ID NO: 440086 - protein, 9 aa, Influenza virus
FKSTQAAIN

SEQ ID NO: 440087 - protein, 9 aa, Influenza virus
FKSWKGNIM

SEQ ID NO: 440088 - protein, 9 aa, Influenza virus
FKVIGGWST

SEQ ID NO: 440089 - protein, 9 aa, Influenza virus
FKVIGGWTT

SEQ ID NO: 440090 - protein, 9 aa, Influenza virus
FKYGDGVWI

SEQ ID NO: 440091 - protein, 9 aa, Influenza virus
FKYGNGAWI

SEQ ID NO: 440092 - protein, 9 aa, Influenza virus
FKYGNGVWI

SEQ ID NO: 440093 - protein, 9 aa, Influenza virus
FLAFILWAC

SEQ ID NO: 440094 - protein, 9 aa, Influenza virus
FLAHALKLV

SEQ ID NO: 440095 - protein, 9 aa, Influenza virus
FLAMITYIT

SEQ ID NO: 440096 - protein, 9 aa, Influenza virus
FLAPGYAFE

SEQ ID NO: 440097 - protein, 9 aa, Influenza virus
FLAPRYAFE

SEQ ID NO: 440098 - protein, 9 aa, Influenza virus
FLAPRYALE

SEQ ID NO: 440099 - protein, 9 aa, Influenza virus
FLAPRYGYI

SEQ ID NO: 440100 - protein, 9 aa, Influenza virus
FLAPRYSFE

SEQ ID NO: 440101 - protein, 9 aa, Influenza virus
FLARSALIL

SEQ ID NO: 440102 - protein, 9 aa, Influenza virus
FLCVGWSST

SEQ ID NO: 440103 - protein, 9 aa, Influenza virus
FLDIWTYNA

SEQ ID NO: 440104 - protein, 9 aa, Influenza virus
FLDRIRRDQ

SEQ ID NO: 440105 - protein, 9 aa, Influenza virus
FLDRLRRDQ

SEQ ID NO: 440106 - protein, 9 aa, Influenza virus
FLDVWTYNA

SEQ ID NO: 440107 - protein, 9 aa, Influenza virus
FLDVWTYNT

SEQ ID NO: 440108 - protein, 9 aa, Influenza virus
FLEIGVTRR

SEQ ID NO: 440109 - protein, 9 aa, Influenza virus
FLFSSIKKY

SEQ ID NO: 440110 - protein, 9 aa, Influenza virus
FLGQWDWPD

SEQ ID NO: 440111 - protein, 9 aa, Influenza virus
FLGQWNWPD

SEQ ID NO: 440112 - protein, 9 aa, Influenza virus
FLGVWTYNA

SEQ ID NO: 440113 - protein, 9 aa, Influenza virus
FLHNGGLIA

SEQ ID NO: 440114 - protein, 9 aa, Influenza virus
FLIIGKEDR

SEQ ID NO: 440115 - protein, 9 aa, Influenza virus
FLILGKEDK

SEQ ID NO: 440116 - protein, 9 aa, Influenza virus
FLILGKEDR

SEQ ID NO: 440117 - protein, 9 aa, Influenza virus
FLILGKENK

SEQ ID NO: 440118 - protein, 9 aa, Influenza virus
FLILGREDK

SEQ ID NO: 440119 - protein, 9 aa, Influenza virus
FLLMDALKL

SEQ ID NO: 440120 - protein, 9 aa, Influenza virus
FLLMDSLKL

SEQ ID NO: 440121 - protein, 9 aa, Influenza virus
FLNNTEPLC

SEQ ID NO: 440122 - protein, 9 aa, Influenza virus
FLNVWTYNA

SEQ ID NO: 440123 - protein, 9 aa, Influenza virus
FLPDLYDYK

SEQ ID NO: 440124 - protein, 9 aa, Influenza virus
FLPVAGGTG

SEQ ID NO: 440125 - protein, 9 aa, Influenza virus
FLPVAGGTS

SEQ ID NO: 440126 - protein, 9 aa, Influenza virus
FLPVSGGTS

SEQ ID NO: 440127 - protein, 9 aa, Influenza virus
FLPVTGGTS

SEQ ID NO: 440128 - protein, 9 aa, Influenza virus
FLQALQLLL

SEQ ID NO: 440129 - protein, 9 aa, Influenza virus
FLRSNAPSG

SEQ ID NO: 440130 - protein, 9 aa, Influenza virus
FLRVKDQQG

SEQ ID NO: 440131 - protein, 9 aa, Influenza virus
FLRVRDQLG

SEQ ID NO: 440132 - protein, 9 aa, Influenza virus
FLRVRDQMG

SEQ ID NO: 440133 - protein, 9 aa, Influenza virus
FLRVRDQQG

SEQ ID NO: 440134 - protein, 9 aa, Influenza virus
FLRVRDQRG

SEQ ID NO: 440135 - protein, 9 aa, Influenza virus
FLSMEFSLT

SEQ ID NO: 440136 - protein, 9 aa, Influenza virus
FLTHALRFL

SEQ ID NO: 440137 - protein, 9 aa, Influenza virus
FLTHGALLN

SEQ ID NO: 440138 - protein, 9 aa, Influenza virus
FLTHGSLLN

SEQ ID NO: 440139 - protein, 9 aa, Influenza virus
FLTMITYIT

SEQ ID NO: 440140 - protein, 9 aa, Influenza virus
FLTQGALLN

SEQ ID NO: 440141 - protein, 9 aa, Influenza virus
FLTQGSLLN

SEQ ID NO: 440142 - protein, 9 aa, Influenza virus
FLTSSIVCP

SEQ ID NO: 440143 - protein, 9 aa, Influenza virus
FLVALENQH

SEQ ID NO: 440144 - protein, 9 aa, Influenza virus
FLVAMENQH

SEQ ID NO: 440145 - protein, 9 aa, Influenza virus
FLVAVENQH

SEQ ID NO: 440146 - protein, 9 aa, Influenza virus
FLVCVSLLQ

SEQ ID NO: 440147 - protein, 9 aa, Influenza virus
FLWCKIVTT

SEQ ID NO: 440148 - protein, 9 aa, Influenza virus
FLWGIHHPP

SEQ ID NO: 440149 - protein, 9 aa, Influenza virus
FLWMCSNGS

SEQ ID NO: 440150 - protein, 9 aa, Influenza virus
FLYIRTNGT

SEQ ID NO: 440151 - protein, 9 aa, Influenza virus
FLYVRTNGT

SEQ ID NO: 440152 - protein, 9 aa, Influenza virus
FMARSALIL

SEQ ID NO: 440153 - protein, 9 aa, Influenza virus
FMCVGWSST

SEQ ID NO: 440154 - protein, 9 aa, Influenza virus
FMCVKNGNL

SEQ ID NO: 440155 - protein, 9 aa, Influenza virus
FMCVKNGNM

SEQ ID NO: 440156 - protein, 9 aa, Influenza virus
FMDVWTYNA

SEQ ID NO: 440157 - protein, 9 aa, Influenza virus
FMIIGGFIF

SEQ ID NO: 440158 - protein, 9 aa, Influenza virus
FMLWACQNG

SEQ ID NO: 440159 - protein, 9 aa, Influenza virus
FMQALQLLF

SEQ ID NO: 440160 - protein, 9 aa, Influenza virus
FMQALQLLL

SEQ ID NO: 440161 - protein, 9 aa, Influenza virus
FMWAIHHPP

SEQ ID NO: 440162 - protein, 9 aa, Influenza virus
FMYSDFHFI

SEQ ID NO: 440163 - protein, 9 aa, Influenza virus
FNCLYASPQ

SEQ ID NO: 440164 - protein, 9 aa, Influenza virus
FNDYEELKH

SEQ ID NO: 440165 - protein, 9 aa, Influenza virus
FNDYEELKL

SEQ ID NO: 440166 - protein, 9 aa, Influenza virus
FNDYEELKY

SEQ ID NO: 440167 - protein, 9 aa, Influenza virus
FNEGAYVNN

SEQ ID NO: 440168 - protein, 9 aa, Influenza virus
FNEGHIEEC

SEQ ID NO: 440169 - protein, 9 aa, Influenza virus
FNEGSYINN

SEQ ID NO: 440170 - protein, 9 aa, Influenza virus
FNEGSYVNN

SEQ ID NO: 440171 - protein, 9 aa, Influenza virus
FNEGTYINN

SEQ ID NO: 440172 - protein, 9 aa, Influenza virus
FNEGTYVNN

SEQ ID NO: 440173 - protein, 9 aa, Influenza virus
FNEIEHQIG

SEQ ID NO: 440174 - protein, 9 aa, Influenza virus
FNEIEQQIG

SEQ ID NO: 440175 - protein, 9 aa, Influenza virus
FNEIEYQIG

SEQ ID NO: 440176 - protein, 9 aa, Influenza virus
FNEVEKQIG

SEQ ID NO: 440177 - protein, 9 aa, Influenza virus
FNEVEQQIG

SEQ ID NO: 440178 - protein, 9 aa, Influenza virus
FNFFHKCND

SEQ ID NO: 440179 - protein, 9 aa, Influenza virus
FNFILLTHW

SEQ ID NO: 440180 - protein, 9 aa, Influenza virus
FNFNGAFVA

SEQ ID NO: 440181 - protein, 9 aa, Influenza virus
FNGAFIAPD

SEQ ID NO: 440182 - protein, 9 aa, Influenza virus
FNGAFIAPN

SEQ ID NO: 440183 - protein, 9 aa, Influenza virus
FNGAFVAPD

SEQ ID NO: 440184 - protein, 9 aa, Influenza virus
FNGEEMATK

SEQ ID NO: 440185 - protein, 9 aa, Influenza virus
FNGGHIEEC

SEQ ID NO: 440186 - protein, 9 aa, Influenza virus
FNKACELTD

SEQ ID NO: 440187 - protein, 9 aa, Influenza virus
FNLLHKCND

SEQ ID NO: 440188 - protein, 9 aa, Influenza virus
FNLLIGISN

SEQ ID NO: 440189 - protein, 9 aa, Influenza virus
FNMERIKEL

SEQ ID NO: 440190 - protein, 9 aa, Influenza virus
FNMLSTVLG

SEQ ID NO: 440191 - protein, 9 aa, Influenza virus
FNNIKGRDV

SEQ ID NO: 440192 - protein, 9 aa, Influenza virus
FNNLEKRLE

SEQ ID NO: 440193 - protein, 9 aa, Influenza virus
FNNLERRLE

SEQ ID NO: 440194 - protein, 9 aa, Influenza virus
FNNLTKGLC

SEQ ID NO: 440195 - protein, 9 aa, Influenza virus
FNNLTKRLC

SEQ ID NO: 440196 - protein, 9 aa, Influenza virus
FNNLTRELC

SEQ ID NO: 440197 - protein, 9 aa, Influenza virus
FNNLTRGLC

SEQ ID NO: 440198 - protein, 9 aa, Influenza virus
FNNTEPLCE

SEQ ID NO: 440199 - protein, 9 aa, Influenza virus
FNNTKERDV

SEQ ID NO: 440200 - protein, 9 aa, Influenza virus
FNNTKGRDV

SEQ ID NO: 440201 - protein, 9 aa, Influenza virus
FNNTKGRYV

SEQ ID NO: 440202 - protein, 9 aa, Influenza virus
FNNYEELKH

SEQ ID NO: 440203 - protein, 9 aa, Influenza virus
FNPCFYVEL

SEQ ID NO: 440204 - protein, 9 aa, Influenza virus
FNPITGSPG

SEQ ID NO: 440205 - protein, 9 aa, Influenza virus
FNPMIAELA

SEQ ID NO: 440206 - protein, 9 aa, Influenza virus
FNPMIIELA

SEQ ID NO: 440207 - protein, 9 aa, Influenza virus
FNPMIVELA

SEQ ID NO: 440208 - protein, 9 aa, Influenza virus
FNPMTVELA

SEQ ID NO: 440209 - protein, 9 aa, Influenza virus
FNPMVVELA

SEQ ID NO: 440210 - protein, 9 aa, Influenza virus
FNQVEKRIN

SEQ ID NO: 440211 - protein, 9 aa, Influenza virus
FNQVENRIN

SEQ ID NO: 440212 - protein, 9 aa, Influenza virus
FNQVEQRIN

SEQ ID NO: 440213 - protein, 9 aa, Influenza virus
FNSDLDYQI

SEQ ID NO: 440214 - protein, 9 aa, Influenza virus
FNSDLNYQI

SEQ ID NO: 440215 - protein, 9 aa, Influenza virus
FNSIGNLIA

SEQ ID NO: 440216 - protein, 9 aa, Influenza virus
FNSIYASPQ

SEQ ID NO: 440217 - protein, 9 aa, Influenza virus
FNSLYASPQ

SEQ ID NO: 440218 - protein, 9 aa, Influenza virus
FNSLYASSQ

SEQ ID NO: 440219 - protein, 9 aa, Influenza virus
FNSLYSSPQ

SEQ ID NO: 440220 - protein, 9 aa, Influenza virus
FNSNLDYQI

SEQ ID NO: 440221 - protein, 9 aa, Influenza virus
FNTIGNLIA

SEQ ID NO: 440222 - protein, 9 aa, Influenza virus
FNTIGNLVA

SEQ ID NO: 440223 - protein, 9 aa, Influenza virus
FPDGAKIQY

SEQ ID NO: 440224 - protein, 9 aa, Influenza virus
FPDGAQIKY

SEQ ID NO: 440225 - protein, 9 aa, Influenza virus
FPDGAQIQY

SEQ ID NO: 440226 - protein, 9 aa, Influenza virus
FPDGARIQY

SEQ ID NO: 440227 - protein, 9 aa, Influenza virus
FPDGPQIQY

SEQ ID NO: 440228 - protein, 9 aa, Influenza virus
FPFHKDNAI

SEQ ID NO: 440229 - protein, 9 aa, Influenza virus
FPFHKDNAL

SEQ ID NO: 440230 - protein, 9 aa, Influenza virus
FPFHKDNAV

SEQ ID NO: 440231 - protein, 9 aa, Influenza virus
FPGELDNNG

SEQ ID NO: 440232 - protein, 9 aa, Influenza virus
FPGEVDNNG

SEQ ID NO: 440233 - protein, 9 aa, Influenza virus
FPIGTAPIL

SEQ ID NO: 440234 - protein, 9 aa, Influenza virus
FPIGTAPVL

SEQ ID NO: 440235 - protein, 9 aa, Influenza virus
FPIGVAPVL

SEQ ID NO: 440236 - protein, 9 aa, Influenza virus
FPMGTAPVL

SEQ ID NO: 440237 - protein, 9 aa, Influenza virus
FPNEVGAKI

SEQ ID NO: 440238 - protein, 9 aa, Influenza virus
FPNEVGARI

SEQ ID NO: 440239 - protein, 9 aa, Influenza virus
FPQLNQTYR

SEQ ID NO: 440240 - protein, 9 aa, Influenza virus
FPQMTKSYK

SEQ ID NO: 440241 - protein, 9 aa, Influenza virus
FPQMTKSYR

SEQ ID NO: 440242 - protein, 9 aa, Influenza virus
FPQMTRSYK

SEQ ID NO: 440243 - protein, 9 aa, Influenza virus
FPQTANTYR

SEQ ID NO: 440244 - protein, 9 aa, Influenza virus
FPQTTKSYK

SEQ ID NO: 440245 - protein, 9 aa, Influenza virus
FPQTTNTYR

SEQ ID NO: 440246 - protein, 9 aa, Influenza virus
FPRTTNTYR

SEQ ID NO: 440247 - protein, 9 aa, Influenza virus
FPSSSYRRP

SEQ ID NO: 440248 - protein, 9 aa, Influenza virus
FPSTGNHGS

SEQ ID NO: 440249 - protein, 9 aa, Influenza virus
FPVGSGSFP

SEQ ID NO: 440250 - protein, 9 aa, Influenza virus
FPVGTAPVL

SEQ ID NO: 440251 - protein, 9 aa, Influenza virus
FPVQTDEYK

SEQ ID NO: 440252 - protein, 9 aa, Influenza virus
FPYTGDPPY

SEQ ID NO: 440253 - protein, 9 aa, Influenza virus
FQGFFPFHK

SEQ ID NO: 440254 - protein, 9 aa, Influenza virus
FQGGHIEEC

SEQ ID NO: 440255 - protein, 9 aa, Influenza virus
FQGRGVFEF

SEQ ID NO: 440256 - protein, 9 aa, Influenza virus
FQGRGVFEL

SEQ ID NO: 440257 - protein, 9 aa, Influenza virus
FQHQNAEGI

SEQ ID NO: 440258 - protein, 9 aa, Influenza virus
FQHQNAEGT

SEQ ID NO: 440259 - protein, 9 aa, Influenza virus
FQHQNEQGM

SEQ ID NO: 440260 - protein, 9 aa, Influenza virus
FQHQNEQGT

SEQ ID NO: 440261 - protein, 9 aa, Influenza virus
FQHQNEQGV

SEQ ID NO: 440262 - protein, 9 aa, Influenza virus
FQHQNSEGT

SEQ ID NO: 440263 - protein, 9 aa, Influenza virus
FQHRNDEGT

SEQ ID NO: 440264 - protein, 9 aa, Influenza virus
FQHRNEEGT

SEQ ID NO: 440265 - protein, 9 aa, Influenza virus
FQIQGIKLT

SEQ ID NO: 440266 - protein, 9 aa, Influenza virus
FQIQGVKLA

SEQ ID NO: 440267 - protein, 9 aa, Influenza virus
FQIQGVKLI

SEQ ID NO: 440268 - protein, 9 aa, Influenza virus
FQIQGVKLT

SEQ ID NO: 440269 - protein, 9 aa, Influenza virus
FQIQGVRLT

SEQ ID NO: 440270 - protein, 9 aa, Influenza virus
FQLFLVCVS

SEQ ID NO: 440271 - protein, 9 aa, Influenza virus
FQLINNKKP

SEQ ID NO: 440272 - protein, 9 aa, Influenza virus
FQLIPMISK

SEQ ID NO: 440273 - protein, 9 aa, Influenza virus
FQNASRHHM

SEQ ID NO: 440274 - protein, 9 aa, Influenza virus
FQNASRHYM

SEQ ID NO: 440275 - protein, 9 aa, Influenza virus
FQNASRYYM

SEQ ID NO: 440276 - protein, 9 aa, Influenza virus
FQNICKPYI

SEQ ID NO: 440277 - protein, 9 aa, Influenza virus
FQNIDKNAL

SEQ ID NO: 440278 - protein, 9 aa, Influenza virus
FQNIDRNAI

SEQ ID NO: 440279 - protein, 9 aa, Influenza virus
FQNIDRNAL

SEQ ID NO: 440280 - protein, 9 aa, Influenza virus
FQNIDSRAV

SEQ ID NO: 440281 - protein, 9 aa, Influenza virus
FQNIDSWAV

SEQ ID NO: 440282 - protein, 9 aa, Influenza virus
FQNIEKNAL

SEQ ID NO: 440283 - protein, 9 aa, Influenza virus
FQNIERNAL

SEQ ID NO: 440284 - protein, 9 aa, Influenza virus
FQNIHPATI

SEQ ID NO: 440285 - protein, 9 aa, Influenza virus
FQNIHPITI

SEQ ID NO: 440286 - protein, 9 aa, Influenza virus
FQNIHPVTI

SEQ ID NO: 440287 - protein, 9 aa, Influenza virus
FQNISKYAF

SEQ ID NO: 440288 - protein, 9 aa, Influenza virus
FQNISPVWI

SEQ ID NO: 440289 - protein, 9 aa, Influenza virus
FQNLSPRTV

SEQ ID NO: 440290 - protein, 9 aa, Influenza virus
FQNQVKIRR

SEQ ID NO: 440291 - protein, 9 aa, Influenza virus
FQNTSKHYI

SEQ ID NO: 440292 - protein, 9 aa, Influenza virus
FQNTSRHYI

SEQ ID NO: 440293 - protein, 9 aa, Influenza virus
FQNTSRHYM

SEQ ID NO: 440294 - protein, 9 aa, Influenza virus
FQNVHPITI

SEQ ID NO: 440295 - protein, 9 aa, Influenza virus
FQNVHPVTI

SEQ ID NO: 440296 - protein, 9 aa, Influenza virus
FQNVNKITY

SEQ ID NO: 440297 - protein, 9 aa, Influenza virus
FQNVNKVTY

SEQ ID NO: 440298 - protein, 9 aa, Influenza virus
FQNVNRITY

SEQ ID NO: 440299 - protein, 9 aa, Influenza virus
FQNVSKYAF

SEQ ID NO: 440300 - protein, 9 aa, Influenza virus
FQNVSPIWI

SEQ ID NO: 440301 - protein, 9 aa, Influenza virus
FQNVSPLWI

SEQ ID NO: 440302 - protein, 9 aa, Influenza virus
FQNVSPLWV

SEQ ID NO: 440303 - protein, 9 aa, Influenza virus
FQNVSPVWI

SEQ ID NO: 440304 - protein, 9 aa, Influenza virus
FQNVSRIAI

SEQ ID NO: 440305 - protein, 9 aa, Influenza virus
FQNVSRYAF

SEQ ID NO: 440306 - protein, 9 aa, Influenza virus
FQPCFYIEL

SEQ ID NO: 440307 - protein, 9 aa, Influenza virus
FQPCFYVEL

SEQ ID NO: 440308 - protein, 9 aa, Influenza virus
FQPNIGPRA

SEQ ID NO: 440309 - protein, 9 aa, Influenza virus
FQPNIGPRP

SEQ ID NO: 440310 - protein, 9 aa, Influenza virus
FQQMRDILG

SEQ ID NO: 440311 - protein, 9 aa, Influenza virus
FQQMRDVLG

SEQ ID NO: 440312 - protein, 9 aa, Influenza virus
FQRKRRIRD

SEQ ID NO: 440313 - protein, 9 aa, Influenza virus
FQRKRRVRD

SEQ ID NO: 440314 - protein, 9 aa, Influenza virus
FQRSKFLLM

SEQ ID NO: 440315 - protein, 9 aa, Influenza virus
FQTAAQKAM

SEQ ID NO: 440316 - protein, 9 aa, Influenza virus
FQTAAQRAM

SEQ ID NO: 440317 - protein, 9 aa, Influenza virus
FQVDCFIWH

SEQ ID NO: 440318 - protein, 9 aa, Influenza virus
FQVDCFLWH

SEQ ID NO: 440319 - protein, 9 aa, Influenza virus
FQVDCYLWH

SEQ ID NO: 440320 - protein, 9 aa, Influenza virus
FQYLLFQDI

SEQ ID NO: 440321 - protein, 9 aa, Influenza virus
FRALISWEM

SEQ ID NO: 440322 - protein, 9 aa, Influenza virus
FRALISWGM

SEQ ID NO: 440323 - protein, 9 aa, Influenza virus
FRALVSWEM

SEQ ID NO: 440324 - protein, 9 aa, Influenza virus
FRAYVDGFE

SEQ ID NO: 440325 - protein, 9 aa, Influenza virus
FRAYVDGFK

SEQ ID NO: 440326 - protein, 9 aa, Influenza virus
FRDMRKNTL

SEQ ID NO: 440327 - protein, 9 aa, Influenza virus
FRDNLEPGT

SEQ ID NO: 440328 - protein, 9 aa, Influenza virus
FRDYEELKH

SEQ ID NO: 440329 - protein, 9 aa, Influenza virus
FREQKQEFK

SEQ ID NO: 440330 - protein, 9 aa, Influenza virus
FRGFFPFHK

SEQ ID NO: 440331 - protein, 9 aa, Influenza virus
FRGGHIEEC

SEQ ID NO: 440332 - protein, 9 aa, Influenza virus
FRGLISTHL

SEQ ID NO: 440333 - protein, 9 aa, Influenza virus
FRGLISTPL

SEQ ID NO: 440334 - protein, 9 aa, Influenza virus
FRGLISTQL

SEQ ID NO: 440335 - protein, 9 aa, Influenza virus
FRGLLSTPL

SEQ ID NO: 440336 - protein, 9 aa, Influenza virus
FRGLMSTPL

SEQ ID NO: 440337 - protein, 9 aa, Influenza virus
FRGRGVFEL

SEQ ID NO: 440338 - protein, 9 aa, Influenza virus
FRHQNAEGT

SEQ ID NO: 440339 - protein, 9 aa, Influenza virus
FRHQNAQGE

SEQ ID NO: 440340 - protein, 9 aa, Influenza virus
FRHQNAQGI

SEQ ID NO: 440341 - protein, 9 aa, Influenza virus
FRHQNAQGQ

SEQ ID NO: 440342 - protein, 9 aa, Influenza virus
FRHQNAQGT

SEQ ID NO: 440343 - protein, 9 aa, Influenza virus
FRHQNSEGT

SEQ ID NO: 440344 - protein, 9 aa, Influenza virus
FRHQNSQGE

SEQ ID NO: 440345 - protein, 9 aa, Influenza virus
FRISKRGSS

SEQ ID NO: 440346 - protein, 9 aa, Influenza virus
FRIYHKCDN

SEQ ID NO: 440347 - protein, 9 aa, Influenza virus
FRLLQNSQV

SEQ ID NO: 440348 - protein, 9 aa, Influenza virus
FRLLQSSQV

SEQ ID NO: 440349 - protein, 9 aa, Influenza virus
FRNILSIAP

SEQ ID NO: 440350 - protein, 9 aa, Influenza virus
FRNILSMAP

SEQ ID NO: 440351 - protein, 9 aa, Influenza virus
FRNQIKIRR

SEQ ID NO: 440352 - protein, 9 aa, Influenza virus
FRNQVKIRR

SEQ ID NO: 440353 - protein, 9 aa, Influenza virus
FRNVLSIAP

SEQ ID NO: 440354 - protein, 9 aa, Influenza virus
FRNVLSVAP

SEQ ID NO: 440355 - protein, 9 aa, Influenza virus
FRNVVWLIK

SEQ ID NO: 440356 - protein, 9 aa, Influenza virus
FRNVVWLTK

SEQ ID NO: 440357 - protein, 9 aa, Influenza virus
FRNVVWLVK

SEQ ID NO: 440358 - protein, 9 aa, Influenza virus
FRPNIGPRP

SEQ ID NO: 440359 - protein, 9 aa, Influenza virus
FRQGNNVWA

SEQ ID NO: 440360 - protein, 9 aa, Influenza virus
FRQGNSVWA

SEQ ID NO: 440361 - protein, 9 aa, Influenza virus
FRQGTSVWA

SEQ ID NO: 440362 - protein, 9 aa, Influenza virus
FRQSERGED

SEQ ID NO: 440363 - protein, 9 aa, Influenza virus
FRQSERGEE

SEQ ID NO: 440364 - protein, 9 aa, Influenza virus
FRRPDSSWL

SEQ ID NO: 440365 - protein, 9 aa, Influenza virus
FRTLMSCPI

SEQ ID NO: 440366 - protein, 9 aa, Influenza virus
FRTLMSCPM

SEQ ID NO: 440367 - protein, 9 aa, Influenza virus
FRTLMSCPV

SEQ ID NO: 440368 - protein, 9 aa, Influenza virus
FRTYVDGFE

SEQ ID NO: 440369 - protein, 9 aa, Influenza virus
FRVIGGWAT

SEQ ID NO: 440370 - protein, 9 aa, Influenza virus
FRVIGGWTT

SEQ ID NO: 440371 - protein, 9 aa, Influenza virus
FRVIGGWVT

SEQ ID NO: 440372 - protein, 9 aa, Influenza virus
FRVYVDGFE

SEQ ID NO: 440373 - protein, 9 aa, Influenza virus
FRYGDGVWI

SEQ ID NO: 440374 - protein, 9 aa, Influenza virus
FRYGNGVWI

SEQ ID NO: 440375 - protein, 9 aa, Influenza virus
FRYSGIKTD

SEQ ID NO: 440376 - protein, 9 aa, Influenza virus
FRYSGIRTD

SEQ ID NO: 440377 - protein, 9 aa, Influenza virus
FSAESRKLL

SEQ ID NO: 440378 - protein, 9 aa, Influenza virus
FSAESRKML

SEQ ID NO: 440379 - protein, 9 aa, Influenza virus
FSARSALIL

SEQ ID NO: 440380 - protein, 9 aa, Influenza virus
FSDNGGLIA

SEQ ID NO: 440381 - protein, 9 aa, Influenza virus
FSDYEELKH

SEQ ID NO: 440382 - protein, 9 aa, Influenza virus
FSEIEGRIQ

SEQ ID NO: 440383 - protein, 9 aa, Influenza virus
FSEIEHQIG

SEQ ID NO: 440384 - protein, 9 aa, Influenza virus
FSEIEHQIS

SEQ ID NO: 440385 - protein, 9 aa, Influenza virus
FSEIEQQIG

SEQ ID NO: 440386 - protein, 9 aa, Influenza virus
FSETEHQIG

SEQ ID NO: 440387 - protein, 9 aa, Influenza virus
FSEVEGRIQ

SEQ ID NO: 440388 - protein, 9 aa, Influenza virus
FSEVEIRIN

SEQ ID NO: 440389 - protein, 9 aa, Influenza virus
FSEVESRIN

SEQ ID NO: 440390 - protein, 9 aa, Influenza virus
FSEVETRIN

SEQ ID NO: 440391 - protein, 9 aa, Influenza virus
FSEVGSRIN

SEQ ID NO: 440392 - protein, 9 aa, Influenza virus
FSFGASCFI

SEQ ID NO: 440393 - protein, 9 aa, Influenza virus
FSFGASCFL

SEQ ID NO: 440394 - protein, 9 aa, Influenza virus
FSFGASCFT

SEQ ID NO: 440395 - protein, 9 aa, Influenza virus
FSFGASCFV

SEQ ID NO: 440396 - protein, 9 aa, Influenza virus
FSFGASCLI

SEQ ID NO: 440397 - protein, 9 aa, Influenza virus
FSFGASCVM

SEQ ID NO: 440398 - protein, 9 aa, Influenza virus
FSFGASSFV

SEQ ID NO: 440399 - protein, 9 aa, Influenza virus
FSFGGFTFK

SEQ ID NO: 440400 - protein, 9 aa, Influenza virus
FSFKYGNGV

SEQ ID NO: 440401 - protein, 9 aa, Influenza virus
FSFNGAFIA

SEQ ID NO: 440402 - protein, 9 aa, Influenza virus
FSFNGAFVA

SEQ ID NO: 440403 - protein, 9 aa, Influenza virus
FSFNGEEMA

SEQ ID NO: 440404 - protein, 9 aa, Influenza virus
FSFQLINNK

SEQ ID NO: 440405 - protein, 9 aa, Influenza virus
FSFRYGDGV

SEQ ID NO: 440406 - protein, 9 aa, Influenza virus
FSFRYGNGV

SEQ ID NO: 440407 - protein, 9 aa, Influenza virus
FSFTGEEMA

SEQ ID NO: 440408 - protein, 9 aa, Influenza virus
FSGGHIEEC

SEQ ID NO: 440409 - protein, 9 aa, Influenza virus
FSGIKSFSR

SEQ ID NO: 440410 - protein, 9 aa, Influenza virus
FSGIRSFSR

SEQ ID NO: 440411 - protein, 9 aa, Influenza virus
FSGMSANGD

SEQ ID NO: 440412 - protein, 9 aa, Influenza virus
FSGSQKQEF

SEQ ID NO: 440413 - protein, 9 aa, Influenza virus
FSGVNSFSR

SEQ ID NO: 440414 - protein, 9 aa, Influenza virus
FSGYKDIIL

SEQ ID NO: 440415 - protein, 9 aa, Influenza virus
FSHNGGLIA

SEQ ID NO: 440416 - protein, 9 aa, Influenza virus
FSHNGGLVA

SEQ ID NO: 440417 - protein, 9 aa, Influenza virus
FSHNGGRIA

SEQ ID NO: 440418 - protein, 9 aa, Influenza virus
FSHYNQMKQ

SEQ ID NO: 440419 - protein, 9 aa, Influenza virus
FSHYNQMTQ

SEQ ID NO: 440420 - protein, 9 aa, Influenza virus
FSHYNQVAQ

SEQ ID NO: 440421 - protein, 9 aa, Influenza virus
FSHYNQVTQ

SEQ ID NO: 440422 - protein, 9 aa, Influenza virus
FSIAASYKR

SEQ ID NO: 440423 - protein, 9 aa, Influenza virus
FSILHKCND

SEQ ID NO: 440424 - protein, 9 aa, Influenza virus
FSIRGETTG

SEQ ID NO: 440425 - protein, 9 aa, Influenza virus
FSIRWETTG

SEQ ID NO: 440426 - protein, 9 aa, Influenza virus
FSISCFLLA

SEQ ID NO: 440427 - protein, 9 aa, Influenza virus
FSISCFLLI

SEQ ID NO: 440428 - protein, 9 aa, Influenza virus
FSISCFLLV

SEQ ID NO: 440429 - protein, 9 aa, Influenza virus
FSKDNAIRI

SEQ ID NO: 440430 - protein, 9 aa, Influenza virus
FSKDNGIRI

SEQ ID NO: 440431 - protein, 9 aa, Influenza virus
FSKDNSIQL

SEQ ID NO: 440432 - protein, 9 aa, Influenza virus
FSKDNSIRL

SEQ ID NO: 440433 - protein, 9 aa, Influenza virus
FSKDNSVRL

SEQ ID NO: 440434 - protein, 9 aa, Influenza virus
FSKVETRIN

SEQ ID NO: 440435 - protein, 9 aa, Influenza virus
FSKWNVTYT

SEQ ID NO: 440436 - protein, 9 aa, Influenza virus
FSLGASCFL

SEQ ID NO: 440437 - protein, 9 aa, Influenza virus
FSLLHKCND

SEQ ID NO: 440438 - protein, 9 aa, Influenza virus
FSLTDPKLE

SEQ ID NO: 440439 - protein, 9 aa, Influenza virus
FSLTDPRFE

SEQ ID NO: 440440 - protein, 9 aa, Influenza virus
FSLTDPRLE

SEQ ID NO: 440441 - protein, 9 aa, Influenza virus
FSLVDPRLE

SEQ ID NO: 440442 - protein, 9 aa, Influenza virus
FSMELPSFG

SEQ ID NO: 440443 - protein, 9 aa, Influenza virus
FSMSCFVFV

SEQ ID NO: 440444 - protein, 9 aa, Influenza virus
FSNAASYKR

SEQ ID NO: 440445 - protein, 9 aa, Influenza virus
FSNKMARLG

SEQ ID NO: 440446 - protein, 9 aa, Influenza virus
FSNKVARLG

SEQ ID NO: 440447 - protein, 9 aa, Influenza virus
FSNLEKRLE

SEQ ID NO: 440448 - protein, 9 aa, Influenza virus
FSNLERRLE

SEQ ID NO: 440449 - protein, 9 aa, Influenza virus
FSPRSRSGF

SEQ ID NO: 440450 - protein, 9 aa, Influenza virus
FSPSPGARP

SEQ ID NO: 440451 - protein, 9 aa, Influenza virus
FSPSPGDRP

SEQ ID NO: 440452 - protein, 9 aa, Influenza virus
FSQEDCMIK

SEQ ID NO: 440453 - protein, 9 aa, Influenza virus
FSQEDCMMK

SEQ ID NO: 440454 - protein, 9 aa, Influenza virus
FSQEDCMVK

SEQ ID NO: 440455 - protein, 9 aa, Influenza virus
FSQEDRMIK

SEQ ID NO: 440456 - protein, 9 aa, Influenza virus
FSQEECMIK

SEQ ID NO: 440457 - protein, 9 aa, Influenza virus
FSQVEQRIN

SEQ ID NO: 440458 - protein, 9 aa, Influenza virus
FSQVERRIN

SEQ ID NO: 440459 - protein, 9 aa, Influenza virus
FSRLNWLTK

SEQ ID NO: 440460 - protein, 9 aa, Influenza virus
FSRTELIAP

SEQ ID NO: 440461 - protein, 9 aa, Influenza virus
FSRTELINP

SEQ ID NO: 440462 - protein, 9 aa, Influenza virus
FSRTELIPP

SEQ ID NO: 440463 - protein, 9 aa, Influenza virus
FSRTELISP

SEQ ID NO: 440464 - protein, 9 aa, Influenza virus
FSRTQLIAP

SEQ ID NO: 440465 - protein, 9 aa, Influenza virus
FSSAASYKR

SEQ ID NO: 440466 - protein, 9 aa, Influenza virus
FSSIKKYER

SEQ ID NO: 440467 - protein, 9 aa, Influenza virus
FSSIKRYER

SEQ ID NO: 440468 - protein, 9 aa, Influenza virus
FSSLAVNVR

SEQ ID NO: 440469 - protein, 9 aa, Influenza virus
FSSLTVNVR

SEQ ID NO: 440470 - protein, 9 aa, Influenza virus
FSSLTVSVR

SEQ ID NO: 440471 - protein, 9 aa, Influenza virus
FSVQRNLPF

SEQ ID NO: 440472 - protein, 9 aa, Influenza virus
FSVQRSLPF

SEQ ID NO: 440473 - protein, 9 aa, Influenza virus
FSYKYDNGV

SEQ ID NO: 440474 - protein, 9 aa, Influenza virus
FSYKYGNGV

SEQ ID NO: 440475 - protein, 9 aa, Influenza virus
FSYRYGNGV

SEQ ID NO: 440476 - protein, 9 aa, Influenza virus
FTAEISHCR

SEQ ID NO: 440477 - protein, 9 aa, Influenza virus
FTAEVSHCR

SEQ ID NO: 440478 - protein, 9 aa, Influenza virus
FTAEVSYCR

SEQ ID NO: 440479 - protein, 9 aa, Influenza virus
FTAVGKEFN

SEQ ID NO: 440480 - protein, 9 aa, Influenza virus
FTAVGKEFS

SEQ ID NO: 440481 - protein, 9 aa, Influenza virus
FTDGSATGP

SEQ ID NO: 440482 - protein, 9 aa, Influenza virus
FTEGHIEEC

SEQ ID NO: 440483 - protein, 9 aa, Influenza virus
FTEIGVTRR

SEQ ID NO: 440484 - protein, 9 aa, Influenza virus
FTEVEGRIQ

SEQ ID NO: 440485 - protein, 9 aa, Influenza virus
FTEVEKQIG

SEQ ID NO: 440486 - protein, 9 aa, Influenza virus
FTEVEQQIG

SEQ ID NO: 440487 - protein, 9 aa, Influenza virus
FTFKRTKGF

SEQ ID NO: 440488 - protein, 9 aa, Influenza virus
FTFKRTKGS

SEQ ID NO: 440489 - protein, 9 aa, Influenza virus
FTFKRTSGS

SEQ ID NO: 440490 - protein, 9 aa, Influenza virus
FTFKRTSGT

SEQ ID NO: 440491 - protein, 9 aa, Influenza virus
FTFNGAFIA

SEQ ID NO: 440492 - protein, 9 aa, Influenza virus
FTFNGSFIA

SEQ ID NO: 440493 - protein, 9 aa, Influenza virus
FTFYHKCDD

SEQ ID NO: 440494 - protein, 9 aa, Influenza virus
FTFYHKCDN

SEQ ID NO: 440495 - protein, 9 aa, Influenza virus
FTFYHKCNN

SEQ ID NO: 440496 - protein, 9 aa, Influenza virus
FTFYHRCDN

SEQ ID NO: 440497 - protein, 9 aa, Influenza virus
FTGEEMASK

SEQ ID NO: 440498 - protein, 9 aa, Influenza virus
FTGEEMATK

SEQ ID NO: 440499 - protein, 9 aa, Influenza virus
FTGEEMATR

SEQ ID NO: 440500 - protein, 9 aa, Influenza virus
FTIGECPKY

SEQ ID NO: 440501 - protein, 9 aa, Influenza virus
FTIGECPRY

SEQ ID NO: 440502 - protein, 9 aa, Influenza virus
FTIMTDGPN

SEQ ID NO: 440503 - protein, 9 aa, Influenza virus
FTIMTDGPS

SEQ ID NO: 440504 - protein, 9 aa, Influenza virus
FTIRQELAS

SEQ ID NO: 440505 - protein, 9 aa, Influenza virus
FTIRQEMAG

SEQ ID NO: 440506 - protein, 9 aa, Influenza virus
FTIRQEMAI

SEQ ID NO: 440507 - protein, 9 aa, Influenza virus
FTIRQEMAN

SEQ ID NO: 440508 - protein, 9 aa, Influenza virus
FTIRQEMAS

SEQ ID NO: 440509 - protein, 9 aa, Influenza virus
FTITGDNTK

SEQ ID NO: 440510 - protein, 9 aa, Influenza virus
FTIYHKCDN

SEQ ID NO: 440511 - protein, 9 aa, Influenza virus
FTKDNSIRL

SEQ ID NO: 440512 - protein, 9 aa, Influenza virus
FTKWNVTHT

SEQ ID NO: 440513 - protein, 9 aa, Influenza virus
FTKWNVTYT

SEQ ID NO: 440514 - protein, 9 aa, Influenza virus
FTLSGVAIA

SEQ ID NO: 440515 - protein, 9 aa, Influenza virus
FTLTVPSER

SEQ ID NO: 440516 - protein, 9 aa, Influenza virus
FTNEEALRQ

SEQ ID NO: 440517 - protein, 9 aa, Influenza virus
FTNEEPLRQ

SEQ ID NO: 440518 - protein, 9 aa, Influenza virus
FTNEESLRQ

SEQ ID NO: 440519 - protein, 9 aa, Influenza virus
FTSFFYRYG

SEQ ID NO: 440520 - protein, 9 aa, Influenza virus
FTSVGKEFN

SEQ ID NO: 440521 - protein, 9 aa, Influenza virus
FTTEVSHCR

SEQ ID NO: 440522 - protein, 9 aa, Influenza virus
FTVLTDGPS

SEQ ID NO: 440523 - protein, 9 aa, Influenza virus
FTVMTDGPN

SEQ ID NO: 440524 - protein, 9 aa, Influenza virus
FTVMTDGPS

SEQ ID NO: 440525 - protein, 9 aa, Influenza virus
FTWAIHHPP

SEQ ID NO: 440526 - protein, 9 aa, Influenza virus
FTWNGVKVD

SEQ ID NO: 440527 - protein, 9 aa, Influenza virus
FTYESSINP

SEQ ID NO: 440528 - protein, 9 aa, Influenza virus
FTYGSSINS

SEQ ID NO: 440529 - protein, 9 aa, Influenza virus
FTYGSSITS

SEQ ID NO: 440530 - protein, 9 aa, Influenza virus
FTYNGIRTN

SEQ ID NO: 440531 - protein, 9 aa, Influenza virus
FTYSGIRTD

SEQ ID NO: 440532 - protein, 9 aa, Influenza virus
FTYSGIRTN

SEQ ID NO: 440533 - protein, 9 aa, Influenza virus
FTYTGVRTD

SEQ ID NO: 440534 - protein, 9 aa, Influenza virus
FTYTGVRTN

SEQ ID NO: 440535 - protein, 9 aa, Influenza virus
FVACGPAEC

SEQ ID NO: 440536 - protein, 9 aa, Influenza virus
FVACGPSEC

SEQ ID NO: 440537 - protein, 9 aa, Influenza virus
FVACGPTEC

SEQ ID NO: 440538 - protein, 9 aa, Influenza virus
FVACSPSEC

SEQ ID NO: 440539 - protein, 9 aa, Influenza virus
FVALILGFV

SEQ ID NO: 440540 - protein, 9 aa, Influenza virus
FVANFSMEL

SEQ ID NO: 440541 - protein, 9 aa, Influenza virus
FVAPDRASF

SEQ ID NO: 440542 - protein, 9 aa, Influenza virus
FVAPDRVSF

SEQ ID NO: 440543 - protein, 9 aa, Influenza virus
FVEIGVTRR

SEQ ID NO: 440544 - protein, 9 aa, Influenza virus
FVENLEELR

SEQ ID NO: 440545 - protein, 9 aa, Influenza virus
FVFSIAASY

SEQ ID NO: 440546 - protein, 9 aa, Influenza virus
FVFSNAASY

SEQ ID NO: 440547 - protein, 9 aa, Influenza virus
FVFSSAASY

SEQ ID NO: 440548 - protein, 9 aa, Influenza virus
FVFTLTVPS

SEQ ID NO: 440549 - protein, 9 aa, Influenza virus
FVFVALILG

SEQ ID NO: 440550 - protein, 9 aa, Influenza virus
FVHFVEALA

SEQ ID NO: 440551 - protein, 9 aa, Influenza virus
FVIEKMNTQ

SEQ ID NO: 440552 - protein, 9 aa, Influenza virus
FVIREPCIS

SEQ ID NO: 440553 - protein, 9 aa, Influenza virus
FVIREPFIS

SEQ ID NO: 440554 - protein, 9 aa, Influenza virus
FVIREPFVA

SEQ ID NO: 440555 - protein, 9 aa, Influenza virus
FVIREPFVS

SEQ ID NO: 440556 - protein, 9 aa, Influenza virus
FVIVSKDNG

SEQ ID NO: 440557 - protein, 9 aa, Influenza virus
FVLMENERT

SEQ ID NO: 440558 - protein, 9 aa, Influenza virus
FVLWACQNG

SEQ ID NO: 440559 - protein, 9 aa, Influenza virus
FVMREPFIS

SEQ ID NO: 440560 - protein, 9 aa, Influenza virus
FVMWACQKG

SEQ ID NO: 440561 - protein, 9 aa, Influenza virus
FVNEEALRQ

SEQ ID NO: 440562 - protein, 9 aa, Influenza virus
FVNGEALRQ

SEQ ID NO: 440563 - protein, 9 aa, Influenza virus
FVNMTNVQN

SEQ ID NO: 440564 - protein, 9 aa, Influenza virus
FVNRANQRL

SEQ ID NO: 440565 - protein, 9 aa, Influenza virus
FVNVTHVQN

SEQ ID NO: 440566 - protein, 9 aa, Influenza virus
FVNVTNVQN

SEQ ID NO: 440567 - protein, 9 aa, Influenza virus
FVPFSKDNS

SEQ ID NO: 440568 - protein, 9 aa, Influenza virus
FVPVIGARP

SEQ ID NO: 440569 - protein, 9 aa, Influenza virus
FVPVMGARP

SEQ ID NO: 440570 - protein, 9 aa, Influenza virus
FVPVVGARP

SEQ ID NO: 440571 - protein, 9 aa, Influenza virus
FVPVVRARP

SEQ ID NO: 440572 - protein, 9 aa, Influenza virus
FVQHPELTG

SEQ ID NO: 440573 - protein, 9 aa, Influenza virus
FVQHPEMTG

SEQ ID NO: 440574 - protein, 9 aa, Influenza virus
FVQNALNGN

SEQ ID NO: 440575 - protein, 9 aa, Influenza virus
FVQNALSGN

SEQ ID NO: 440576 - protein, 9 aa, Influenza virus
FVQSYFQLF

SEQ ID NO: 440577 - protein, 9 aa, Influenza virus
FVRGQQGRM

SEQ ID NO: 440578 - protein, 9 aa, Influenza virus
FVRQCFNPM

SEQ ID NO: 440579 - protein, 9 aa, Influenza virus
FVRTLFQQM

SEQ ID NO: 440580 - protein, 9 aa, Influenza virus
FVSCGPSEC

SEQ ID NO: 440581 - protein, 9 aa, Influenza virus
FVSCSHLEC

SEQ ID NO: 440582 - protein, 9 aa, Influenza virus
FVSMEFSLT

SEQ ID NO: 440583 - protein, 9 aa, Influenza virus
FVTREPFIS

SEQ ID NO: 440584 - protein, 9 aa, Influenza virus
FVVREPFIS

SEQ ID NO: 440585 - protein, 9 aa, Influenza virus
FVYFVEALA

SEQ ID NO: 440586 - protein, 9 aa, Influenza virus
FVYFVEILA

SEQ ID NO: 440587 - protein, 9 aa, Influenza virus
FVYFVETLA

SEQ ID NO: 440588 - protein, 9 aa, Influenza virus
FWHKCDDEC

SEQ ID NO: 440589 - protein, 9 aa, Influenza virus
FWHKCDNDC

SEQ ID NO: 440590 - protein, 9 aa, Influenza virus
FWHKCDNEC

SEQ ID NO: 440591 - protein, 9 aa, Influenza virus
FWHKCNNEC

SEQ ID NO: 440592 - protein, 9 aa, Influenza virus
FWIELIRGR

SEQ ID NO: 440593 - protein, 9 aa, Influenza virus
FWKGGSIKT

SEQ ID NO: 440594 - protein, 9 aa, Influenza virus
FWKGGSINT

SEQ ID NO: 440595 - protein, 9 aa, Influenza virus
FWKGGTINT

SEQ ID NO: 440596 - protein, 9 aa, Influenza virus
FWLEMIRGK

SEQ ID NO: 440597 - protein, 9 aa, Influenza virus
FWLEMIRGR

SEQ ID NO: 440598 - protein, 9 aa, Influenza virus
FWLKNGNMR

SEQ ID NO: 440599 - protein, 9 aa, Influenza virus
FWMCPNGSL

SEQ ID NO: 440600 - protein, 9 aa, Influenza virus
FWMCSGHSC

SEQ ID NO: 440601 - protein, 9 aa, Influenza virus
FWMCSNGSL

SEQ ID NO: 440602 - protein, 9 aa, Influenza virus
FWRGDNGRR

SEQ ID NO: 440603 - protein, 9 aa, Influenza virus
FWRGENGRK

SEQ ID NO: 440604 - protein, 9 aa, Influenza virus
FWRGENGRR

SEQ ID NO: 440605 - protein, 9 aa, Influenza virus
FWRGGSIIT

SEQ ID NO: 440606 - protein, 9 aa, Influenza virus
FWRGGSINT

SEQ ID NO: 440607 - protein, 9 aa, Influenza virus
FWTSNSIVA

SEQ ID NO: 440608 - protein, 9 aa, Influenza virus
FWTSNSIVT

SEQ ID NO: 440609 - protein, 9 aa, Influenza virus
FWVELIRGQ

SEQ ID NO: 440610 - protein, 9 aa, Influenza virus
FWVELIRGR

SEQ ID NO: 440611 - protein, 9 aa, Influenza virus
FWVELVRGL

SEQ ID NO: 440612 - protein, 9 aa, Influenza virus
FWVELVRGR

SEQ ID NO: 440613 - protein, 9 aa, Influenza virus
FWVEMIRGE

SEQ ID NO: 440614 - protein, 9 aa, Influenza virus
FWVEMIRGK

SEQ ID NO: 440615 - protein, 9 aa, Influenza virus
FWVEMIRGQ

SEQ ID NO: 440616 - protein, 9 aa, Influenza virus
FWVEMIRGR

SEQ ID NO: 440617 - protein, 9 aa, Influenza virus
FWVMTDGPA

SEQ ID NO: 440618 - protein, 9 aa, Influenza virus
FYAELKWLI

SEQ ID NO: 440619 - protein, 9 aa, Influenza virus
FYAELKWLV

SEQ ID NO: 440620 - protein, 9 aa, Influenza virus
FYAEMEWLL

SEQ ID NO: 440621 - protein, 9 aa, Influenza virus
FYAEMKWLL

SEQ ID NO: 440622 - protein, 9 aa, Influenza virus
FYALSQGTT

SEQ ID NO: 440623 - protein, 9 aa, Influenza virus
FYHKCDDEC

SEQ ID NO: 440624 - protein, 9 aa, Influenza virus
FYHKCDNEC

SEQ ID NO: 440625 - protein, 9 aa, Influenza virus
FYHKCDNKC

SEQ ID NO: 440626 - protein, 9 aa, Influenza virus
FYHKCNDEC

SEQ ID NO: 440627 - protein, 9 aa, Influenza virus
FYHKCNNEC

SEQ ID NO: 440628 - protein, 9 aa, Influenza virus
FYHRCDNEC

SEQ ID NO: 440629 - protein, 9 aa, Influenza virus
FYIELIRGK

SEQ ID NO: 440630 - protein, 9 aa, Influenza virus
FYIELIRGR

SEQ ID NO: 440631 - protein, 9 aa, Influenza virus
FYIQMCTEL

SEQ ID NO: 440632 - protein, 9 aa, Influenza virus
FYKILKIKK

SEQ ID NO: 440633 - protein, 9 aa, Influenza virus
FYKILKIRK

SEQ ID NO: 440634 - protein, 9 aa, Influenza virus
FYKSMRWLT

SEQ ID NO: 440635 - protein, 9 aa, Influenza virus
FYLGTKQVC

SEQ ID NO: 440636 - protein, 9 aa, Influenza virus
FYLGTRQVC

SEQ ID NO: 440637 - protein, 9 aa, Influenza virus
FYRGMRWLT

SEQ ID NO: 440638 - protein, 9 aa, Influenza virus
FYRICKLVG

SEQ ID NO: 440639 - protein, 9 aa, Influenza virus
FYRNLAWFV

SEQ ID NO: 440640 - protein, 9 aa, Influenza virus
FYRNLIWFV

SEQ ID NO: 440641 - protein, 9 aa, Influenza virus
FYRNLIWLV

SEQ ID NO: 440642 - protein, 9 aa, Influenza virus
FYRNLVWFI

SEQ ID NO: 440643 - protein, 9 aa, Influenza virus
FYRNLVWFV

SEQ ID NO: 440644 - protein, 9 aa, Influenza virus
FYRNLVWIV

SEQ ID NO: 440645 - protein, 9 aa, Influenza virus
FYRNLVWLV

SEQ ID NO: 440646 - protein, 9 aa, Influenza virus
FYRNMRWLT

SEQ ID NO: 440647 - protein, 9 aa, Influenza virus
FYRNVVWLI

SEQ ID NO: 440648 - protein, 9 aa, Influenza virus
FYRSINWLT

SEQ ID NO: 440649 - protein, 9 aa, Influenza virus
FYRSIRWLT

SEQ ID NO: 440650 - protein, 9 aa, Influenza virus
FYRSMKWLT

SEQ ID NO: 440651 - protein, 9 aa, Influenza virus
FYRSMRWLT

SEQ ID NO: 440652 - protein, 9 aa, Influenza virus
FYRSVRWLT

SEQ ID NO: 440653 - protein, 9 aa, Influenza virus
FYRTCKLLG

SEQ ID NO: 440654 - protein, 9 aa, Influenza virus
FYRTCKLVG

SEQ ID NO: 440655 - protein, 9 aa, Influenza virus
FYRYGFVAN

SEQ ID NO: 440656 - protein, 9 aa, Influenza virus
FYSEMKWLL

SEQ ID NO: 440657 - protein, 9 aa, Influenza virus
FYSEMKWLS

SEQ ID NO: 440658 - protein, 9 aa, Influenza virus
FYSGGTINS

SEQ ID NO: 440659 - protein, 9 aa, Influenza virus
FYVELIRGK

SEQ ID NO: 440660 - protein, 9 aa, Influenza virus
FYVELIRGM

SEQ ID NO: 440661 - protein, 9 aa, Influenza virus
FYVELIRGR

SEQ ID NO: 440662 - protein, 9 aa, Influenza virus
FYVELIRGS

SEQ ID NO: 440663 - protein, 9 aa, Influenza virus
FYVELTRGV

SEQ ID NO: 440664 - protein, 9 aa, Influenza virus
FYVELVRGR

SEQ ID NO: 440665 - protein, 9 aa, Influenza virus
FYVQMCTEL

SEQ ID NO: 440666 - protein, 9 aa, Influenza virus
FYWTIVDPG

SEQ ID NO: 440667 - protein, 9 aa, Influenza virus
FYWTIVEPE

SEQ ID NO: 440668 - protein, 9 aa, Influenza virus
FYWTIVEPG

SEQ ID NO: 440669 - protein, 9 aa, Influenza virus
FYYEECSCY

SEQ ID NO: 440670 - protein, 9 aa, Influenza virus
GAAGAAIKG

SEQ ID NO: 440671 - protein, 9 aa, Influenza virus
GAAGAAVKG

SEQ ID NO: 440672 - protein, 9 aa, Influenza virus
GAAIKGVGT

SEQ ID NO: 440673 - protein, 9 aa, Influenza virus
GAAPVLGNY

SEQ ID NO: 440674 - protein, 9 aa, Influenza virus
GAASLSPGM

SEQ ID NO: 440675 - protein, 9 aa, Influenza virus
GAAVKGIGT

SEQ ID NO: 440676 - protein, 9 aa, Influenza virus
GAAVKGVGT

SEQ ID NO: 440677 - protein, 9 aa, Influenza virus
GACWEQLYT

SEQ ID NO: 440678 - protein, 9 aa, Influenza virus
GADDDAYAV

SEQ ID NO: 440679 - protein, 9 aa, Influenza virus
GADDEAYAV

SEQ ID NO: 440680 - protein, 9 aa, Influenza virus
GADGVKGFS

SEQ ID NO: 440681 - protein, 9 aa, Influenza virus
GADINFMPI

SEQ ID NO: 440682 - protein, 9 aa, Influenza virus
GADNDAYAV

SEQ ID NO: 440683 - protein, 9 aa, Influenza virus
GADSFYRNL

SEQ ID NO: 440684 - protein, 9 aa, Influenza virus
GAFGPVHFR

SEQ ID NO: 440685 - protein, 9 aa, Influenza virus
GAFIAPDRA

SEQ ID NO: 440686 - protein, 9 aa, Influenza virus
GAFIAPDRV

SEQ ID NO: 440687 - protein, 9 aa, Influenza virus
GAFIAPNRA

SEQ ID NO: 440688 - protein, 9 aa, Influenza virus
GAFIAPRYA

SEQ ID NO: 440689 - protein, 9 aa, Influenza virus
GAFLAPRYA

SEQ ID NO: 440690 - protein, 9 aa, Influenza virus
GAFLAPRYS

SEQ ID NO: 440691 - protein, 9 aa, Influenza virus
GAFVAPDRV

SEQ ID NO: 440692 - protein, 9 aa, Influenza virus
GAGALAEDP

SEQ ID NO: 440693 - protein, 9 aa, Influenza virus
GAGNKLITV

SEQ ID NO: 440694 - protein, 9 aa, Influenza virus
GAGSWPDGA

SEQ ID NO: 440695 - protein, 9 aa, Influenza virus
GAGYAADKE

SEQ ID NO: 440696 - protein, 9 aa, Influenza virus
GAHILVTRE

SEQ ID NO: 440697 - protein, 9 aa, Influenza virus
GAIAGFIEG

SEQ ID NO: 440698 - protein, 9 aa, Influenza virus
GAIAGFIEN

SEQ ID NO: 440699 - protein, 9 aa, Influenza virus
GAIAGFLEN

SEQ ID NO: 440700 - protein, 9 aa, Influenza virus
GAIEECLIN

SEQ ID NO: 440701 - protein, 9 aa, Influenza virus
GAIGAIDSS

SEQ ID NO: 440702 - protein, 9 aa, Influenza virus
GAILPFDID

SEQ ID NO: 440703 - protein, 9 aa, Influenza virus
GAILPFGID

SEQ ID NO: 440704 - protein, 9 aa, Influenza virus
GAINSSKPF

SEQ ID NO: 440705 - protein, 9 aa, Influenza virus
GAINSSKPL

SEQ ID NO: 440706 - protein, 9 aa, Influenza virus
GAINSSMPF

SEQ ID NO: 440707 - protein, 9 aa, Influenza virus
GAINSSMPL

SEQ ID NO: 440708 - protein, 9 aa, Influenza virus
GAINSSRPF

SEQ ID NO: 440709 - protein, 9 aa, Influenza virus
GAINTTLPF

SEQ ID NO: 440710 - protein, 9 aa, Influenza virus
GAISFWMCS

SEQ ID NO: 440711 - protein, 9 aa, Influenza virus
GAIWVTREP

SEQ ID NO: 440712 - protein, 9 aa, Influenza virus
GAKAGFIEG

SEQ ID NO: 440713 - protein, 9 aa, Influenza virus
GAKAGFIEN

SEQ ID NO: 440714 - protein, 9 aa, Influenza virus
GAKEIALSY

SEQ ID NO: 440715 - protein, 9 aa, Influenza virus
GAKEISLSY

SEQ ID NO: 440716 - protein, 9 aa, Influenza virus
GAKEVALGY

SEQ ID NO: 440717 - protein, 9 aa, Influenza virus
GAKEVALSY

SEQ ID NO: 440718 - protein, 9 aa, Influenza virus
GAKEVSLSY

SEQ ID NO: 440719 - protein, 9 aa, Influenza virus
GAKILTSES

SEQ ID NO: 440720 - protein, 9 aa, Influenza virus
GAKSFYRNL

SEQ ID NO: 440721 - protein, 9 aa, Influenza virus
GAKVNTLTE

SEQ ID NO: 440722 - protein, 9 aa, Influenza virus
GALASCMGL

SEQ ID NO: 440723 - protein, 9 aa, Influenza virus
GALGSPGCD

SEQ ID NO: 440724 - protein, 9 aa, Influenza virus
GALLAPRYA

SEQ ID NO: 440725 - protein, 9 aa, Influenza virus
GALLGTKHS

SEQ ID NO: 440726 - protein, 9 aa, Influenza virus
GALLGTNHS

SEQ ID NO: 440727 - protein, 9 aa, Influenza virus
GALLGTRHS

SEQ ID NO: 440728 - protein, 9 aa, Influenza virus
GALLNDKHS

SEQ ID NO: 440729 - protein, 9 aa, Influenza virus
GALLNDRHS

SEQ ID NO: 440730 - protein, 9 aa, Influenza virus
GALLPFDID

SEQ ID NO: 440731 - protein, 9 aa, Influenza virus
GALNTTLPF

SEQ ID NO: 440732 - protein, 9 aa, Influenza virus
GALQLNPID

SEQ ID NO: 440733 - protein, 9 aa, Influenza virus
GALRQKIME

SEQ ID NO: 440734 - protein, 9 aa, Influenza virus
GALVGTKHS

SEQ ID NO: 440735 - protein, 9 aa, Influenza virus
GAMASQGTK

SEQ ID NO: 440736 - protein, 9 aa, Influenza virus
GANGVKGFS

SEQ ID NO: 440737 - protein, 9 aa, Influenza virus
GANIDFMPV

SEQ ID NO: 440738 - protein, 9 aa, Influenza virus
GANIGFMPK

SEQ ID NO: 440739 - protein, 9 aa, Influenza virus
GANINFMPI

SEQ ID NO: 440740 - protein, 9 aa, Influenza virus
GANINLMPI

SEQ ID NO: 440741 - protein, 9 aa, Influenza virus
GANISFMPI

SEQ ID NO: 440742 - protein, 9 aa, Influenza virus
GANRPIIEI

SEQ ID NO: 440743 - protein, 9 aa, Influenza virus
GANRPIITI

SEQ ID NO: 440744 - protein, 9 aa, Influenza virus
GANRPVIEI

SEQ ID NO: 440745 - protein, 9 aa, Influenza virus
GANRPVIII

SEQ ID NO: 440746 - protein, 9 aa, Influenza virus
GANRPVIKI

SEQ ID NO: 440747 - protein, 9 aa, Influenza virus
GANRPVITI

SEQ ID NO: 440748 - protein, 9 aa, Influenza virus
GANRPWVSF

SEQ ID NO: 440749 - protein, 9 aa, Influenza virus
GANSFYRNL

SEQ ID NO: 440750 - protein, 9 aa, Influenza virus
GAPACDLHL

SEQ ID NO: 440751 - protein, 9 aa, Influenza virus
GAPGVKGFG

SEQ ID NO: 440752 - protein, 9 aa, Influenza virus
GAPHGLCYP

SEQ ID NO: 440753 - protein, 9 aa, Influenza virus
GAPLELRDC

SEQ ID NO: 440754 - protein, 9 aa, Influenza virus
GAPLVLDDC

SEQ ID NO: 440755 - protein, 9 aa, Influenza virus
GAPQLNPID

SEQ ID NO: 440756 - protein, 9 aa, Influenza virus
GAPQLNPVD

SEQ ID NO: 440757 - protein, 9 aa, Influenza virus
GAPSCDLHL

SEQ ID NO: 440758 - protein, 9 aa, Influenza virus
GAQHIEECS

SEQ ID NO: 440759 - protein, 9 aa, Influenza virus
GAQHVEECS

SEQ ID NO: 440760 - protein, 9 aa, Influenza virus
GAQSFYRSI

SEQ ID NO: 440761 - protein, 9 aa, Influenza virus
GAQSLSISV

SEQ ID NO: 440762 - protein, 9 aa, Influenza virus
GARIGEGQR

SEQ ID NO: 440763 - protein, 9 aa, Influenza virus
GARIITSES

SEQ ID NO: 440764 - protein, 9 aa, Influenza virus
GARILASES

SEQ ID NO: 440765 - protein, 9 aa, Influenza virus
GARILTSES

SEQ ID NO: 440766 - protein, 9 aa, Influenza virus
GARPKVNGQ

SEQ ID NO: 440767 - protein, 9 aa, Influenza virus
GARPLVNGQ

SEQ ID NO: 440768 - protein, 9 aa, Influenza virus
GARPQVNGQ

SEQ ID NO: 440769 - protein, 9 aa, Influenza virus
GARRIDFHW

SEQ ID NO: 440770 - protein, 9 aa, Influenza virus
GARRIDFNW

SEQ ID NO: 440771 - protein, 9 aa, Influenza virus
GASCFILLA

SEQ ID NO: 440772 - protein, 9 aa, Influenza virus
GASCFLFLA

SEQ ID NO: 440773 - protein, 9 aa, Influenza virus
GASCFLLIA

SEQ ID NO: 440774 - protein, 9 aa, Influenza virus
GASCFLLLA

SEQ ID NO: 440775 - protein, 9 aa, Influenza virus
GASCFTLLA

SEQ ID NO: 440776 - protein, 9 aa, Influenza virus
GASCFVLLA

SEQ ID NO: 440777 - protein, 9 aa, Influenza virus
GASCLILLA

SEQ ID NO: 440778 - protein, 9 aa, Influenza virus
GASCVMLLA

SEQ ID NO: 440779 - protein, 9 aa, Influenza virus
GASSFVLLA

SEQ ID NO: 440780 - protein, 9 aa, Influenza virus
GASSFYRNL

SEQ ID NO: 440781 - protein, 9 aa, Influenza virus
GATINEEAL

SEQ ID NO: 440782 - protein, 9 aa, Influenza virus
GATSACKRT

SEQ ID NO: 440783 - protein, 9 aa, Influenza virus
GATVNEEAL

SEQ ID NO: 440784 - protein, 9 aa, Influenza virus
GATVNEGAL

SEQ ID NO: 440785 - protein, 9 aa, Influenza virus
GAVAVLKYD

SEQ ID NO: 440786 - protein, 9 aa, Influenza virus
GAVAVLKYK

SEQ ID NO: 440787 - protein, 9 aa, Influenza virus
GAVAVLKYN

SEQ ID NO: 440788 - protein, 9 aa, Influenza virus
GAVAVVKYN

SEQ ID NO: 440789 - protein, 9 aa, Influenza virus
GAVNSSKPF

SEQ ID NO: 440790 - protein, 9 aa, Influenza virus
GAVNSSMPF

SEQ ID NO: 440791 - protein, 9 aa, Influenza virus
GAVNTTLST

SEQ ID NO: 440792 - protein, 9 aa, Influenza virus
GAVWVTREP

SEQ ID NO: 440793 - protein, 9 aa, Influenza virus
GAYERMCNI

SEQ ID NO: 440794 - protein, 9 aa, Influenza virus
GAYGVKGFS

SEQ ID NO: 440795 - protein, 9 aa, Influenza virus
GAYKILTIY

SEQ ID NO: 440796 - protein, 9 aa, Influenza virus
GAYNNTTGR

SEQ ID NO: 440797 - protein, 9 aa, Influenza virus
GCDHSDNAD

SEQ ID NO: 440798 - protein, 9 aa, Influenza virus
GCDRLQDTT

SEQ ID NO: 440799 - protein, 9 aa, Influenza virus
GCFDILHKC

SEQ ID NO: 440800 - protein, 9 aa, Influenza virus
GCFDLYHKC

SEQ ID NO: 440801 - protein, 9 aa, Influenza virus
GCFEFWHKC

SEQ ID NO: 440802 - protein, 9 aa, Influenza virus
GCFEFYHKC

SEQ ID NO: 440803 - protein, 9 aa, Influenza virus
GCFEFYHRC

SEQ ID NO: 440804 - protein, 9 aa, Influenza virus
GCFEIFHKC

SEQ ID NO: 440805 - protein, 9 aa, Influenza virus
GCFEIFHQC

SEQ ID NO: 440806 - protein, 9 aa, Influenza virus
GCFEIFHRC

SEQ ID NO: 440807 - protein, 9 aa, Influenza virus
GCFEILHKC

SEQ ID NO: 440808 - protein, 9 aa, Influenza virus
GCFEILHRC

SEQ ID NO: 440809 - protein, 9 aa, Influenza virus
GCFEIYHAC

SEQ ID NO: 440810 - protein, 9 aa, Influenza virus
GCFEIYHKC

SEQ ID NO: 440811 - protein, 9 aa, Influenza virus
GCFEIYHNC

SEQ ID NO: 440812 - protein, 9 aa, Influenza virus
GCFEIYHTC

SEQ ID NO: 440813 - protein, 9 aa, Influenza virus
GCFEIYHVC

SEQ ID NO: 440814 - protein, 9 aa, Influenza virus
GCFELFHKC

SEQ ID NO: 440815 - protein, 9 aa, Influenza virus
GCFELLHKC

SEQ ID NO: 440816 - protein, 9 aa, Influenza virus
GCFELYHKC

SEQ ID NO: 440817 - protein, 9 aa, Influenza virus
GCFELYHRC

SEQ ID NO: 440818 - protein, 9 aa, Influenza virus
GCFKIYHKC

SEQ ID NO: 440819 - protein, 9 aa, Influenza virus
GCFKIYHRC

SEQ ID NO: 440820 - protein, 9 aa, Influenza virus
GCFNFFHKC

SEQ ID NO: 440821 - protein, 9 aa, Influenza virus
GCFNLLHKC

SEQ ID NO: 440822 - protein, 9 aa, Influenza virus
GCFQPCFYI

SEQ ID NO: 440823 - protein, 9 aa, Influenza virus
GCFQPCFYV

SEQ ID NO: 440824 - protein, 9 aa, Influenza virus
GCFSILHKC

SEQ ID NO: 440825 - protein, 9 aa, Influenza virus
GCFSLLHKC

SEQ ID NO: 440826 - protein, 9 aa, Influenza virus
GCFTFYHKC

SEQ ID NO: 440827 - protein, 9 aa, Influenza virus
GCFTFYHRC

SEQ ID NO: 440828 - protein, 9 aa, Influenza virus
GCFTIYHKC

SEQ ID NO: 440829 - protein, 9 aa, Influenza virus
GCIEGKLSQ

SEQ ID NO: 440830 - protein, 9 aa, Influenza virus
GCIESKLSQ

SEQ ID NO: 440831 - protein, 9 aa, Influenza virus
GCINRCFYV

SEQ ID NO: 440832 - protein, 9 aa, Influenza virus
GCITPNGSI

SEQ ID NO: 440833 - protein, 9 aa, Influenza virus
GCKMFALHQ

SEQ ID NO: 440834 - protein, 9 aa, Influenza virus
GCKMYALHQ

SEQ ID NO: 440835 - protein, 9 aa, Influenza virus
GCLKIYHKC

SEQ ID NO: 440836 - protein, 9 aa, Influenza virus
GCLVPCFWV

SEQ ID NO: 440837 - protein, 9 aa, Influenza virus
GCQLNEGVM

SEQ ID NO: 440838 - protein, 9 aa, Influenza virus
GCQNGNIRC

SEQ ID NO: 440839 - protein, 9 aa, Influenza virus
GCQNGNVRC

SEQ ID NO: 440840 - protein, 9 aa, Influenza virus
GCRDNWQGA

SEQ ID NO: 440841 - protein, 9 aa, Influenza virus
GCRFYALSQ

SEQ ID NO: 440842 - protein, 9 aa, Influenza virus
GCRMFALSQ

SEQ ID NO: 440843 - protein, 9 aa, Influenza virus
GCRMYALHQ

SEQ ID NO: 440844 - protein, 9 aa, Influenza virus
GCRTFFLTQ

SEQ ID NO: 440845 - protein, 9 aa, Influenza virus
GCSFAGWIL

SEQ ID NO: 440846 - protein, 9 aa, Influenza virus
GCVILLNPF

SEQ ID NO: 440847 - protein, 9 aa, Influenza virus
GCWSFALAQ

SEQ ID NO: 440848 - protein, 9 aa, Influenza virus
GDAPFIDRL

SEQ ID NO: 440849 - protein, 9 aa, Influenza virus
GDAPFLDRI

SEQ ID NO: 440850 - protein, 9 aa, Influenza virus
GDAPFLDRL

SEQ ID NO: 440851 - protein, 9 aa, Influenza virus
GDCNFEGWI

SEQ ID NO: 440852 - protein, 9 aa, Influenza virus
GDCNNPITG

SEQ ID NO: 440853 - protein, 9 aa, Influenza virus
GDCPKYIKQ

SEQ ID NO: 440854 - protein, 9 aa, Influenza virus
GDCPKYIKS

SEQ ID NO: 440855 - protein, 9 aa, Influenza virus
GDCPKYMNV

SEQ ID NO: 440856 - protein, 9 aa, Influenza virus
GDCPKYVKQ

SEQ ID NO: 440857 - protein, 9 aa, Influenza virus
GDCPKYVNI

SEQ ID NO: 440858 - protein, 9 aa, Influenza virus
GDCPKYVNV

SEQ ID NO: 440859 - protein, 9 aa, Influenza virus
GDCPRYVKQ

SEQ ID NO: 440860 - protein, 9 aa, Influenza virus
GDCRFEGWI

SEQ ID NO: 440861 - protein, 9 aa, Influenza virus
GDCSFAGWI

SEQ ID NO: 440862 - protein, 9 aa, Influenza virus
GDCSFAGWL

SEQ ID NO: 440863 - protein, 9 aa, Influenza virus
GDCSFEGWI

SEQ ID NO: 440864 - protein, 9 aa, Influenza virus
GDCSFTGWI

SEQ ID NO: 440865 - protein, 9 aa, Influenza virus
GDCSIAGWL

SEQ ID NO: 440866 - protein, 9 aa, Influenza virus
GDCSNPITG

SEQ ID NO: 440867 - protein, 9 aa, Influenza virus
GDCSVAGWL

SEQ ID NO: 440868 - protein, 9 aa, Influenza virus
GDCYRACFY

SEQ ID NO: 440869 - protein, 9 aa, Influenza virus
GDCYWVMTD

SEQ ID NO: 440870 - protein, 9 aa, Influenza virus
GDDGNATAS

SEQ ID NO: 440871 - protein, 9 aa, Influenza virus
GDDKNATAS

SEQ ID NO: 440872 - protein, 9 aa, Influenza virus
GDDRKATAS

SEQ ID NO: 440873 - protein, 9 aa, Influenza virus
GDDRNATAS

SEQ ID NO: 440874 - protein, 9 aa, Influenza virus
GDDVLMGRT

SEQ ID NO: 440875 - protein, 9 aa, Influenza virus
GDDVWLGRT

SEQ ID NO: 440876 - protein, 9 aa, Influenza virus
GDDVWMGRT

SEQ ID NO: 440877 - protein, 9 aa, Influenza virus
GDFVRQCFN

SEQ ID NO: 440878 - protein, 9 aa, Influenza virus
GDGCFEILH

SEQ ID NO: 440879 - protein, 9 aa, Influenza virus
GDGCFKIYH

SEQ ID NO: 440880 - protein, 9 aa, Influenza virus
GDGCFNFFH

SEQ ID NO: 440881 - protein, 9 aa, Influenza virus
GDGCFNLLH

SEQ ID NO: 440882 - protein, 9 aa, Influenza virus
GDGCFSILH

SEQ ID NO: 440883 - protein, 9 aa, Influenza virus
GDGCFSLLH

SEQ ID NO: 440884 - protein, 9 aa, Influenza virus
GDGQRSWMK

SEQ ID NO: 440885 - protein, 9 aa, Influenza virus
GDGVWIGRT

SEQ ID NO: 440886 - protein, 9 aa, Influenza virus
GDHGVKGWA

SEQ ID NO: 440887 - protein, 9 aa, Influenza virus
GDHITFSHN

SEQ ID NO: 440888 - protein, 9 aa, Influenza virus
GDIFVIREP

SEQ ID NO: 440889 - protein, 9 aa, Influenza virus
GDIFVMREP

SEQ ID NO: 440890 - protein, 9 aa, Influenza virus
GDIIFLWGI

SEQ ID NO: 440891 - protein, 9 aa, Influenza virus
GDIIVFNTI

SEQ ID NO: 440892 - protein, 9 aa, Influenza virus
GDILDGVTA

SEQ ID NO: 440893 - protein, 9 aa, Influenza virus
GDILEGTTA

SEQ ID NO: 440894 - protein, 9 aa, Influenza virus
GDILRTQES

SEQ ID NO: 440895 - protein, 9 aa, Influenza virus
GDIMRTQES

SEQ ID NO: 440896 - protein, 9 aa, Influenza virus
GDIVLVMKR

SEQ ID NO: 440897 - protein, 9 aa, Influenza virus
GDIWITREP

SEQ ID NO: 440898 - protein, 9 aa, Influenza virus
GDIWVTREL

SEQ ID NO: 440899 - protein, 9 aa, Influenza virus
GDIWVTREP

SEQ ID NO: 440900 - protein, 9 aa, Influenza virus
GDKICLGHH

SEQ ID NO: 440901 - protein, 9 aa, Influenza virus
GDLILFNTI

SEQ ID NO: 440902 - protein, 9 aa, Influenza virus
GDLIVFNTI

SEQ ID NO: 440903 - protein, 9 aa, Influenza virus
GDLNFVNRA

SEQ ID NO: 440904 - protein, 9 aa, Influenza virus
GDNENATAT

SEQ ID NO: 440905 - protein, 9 aa, Influenza virus
GDNIIFSHN

SEQ ID NO: 440906 - protein, 9 aa, Influenza virus
GDNITFLHN

SEQ ID NO: 440907 - protein, 9 aa, Influenza virus
GDNITFSDN

SEQ ID NO: 440908 - protein, 9 aa, Influenza virus
GDNITFSHN

SEQ ID NO: 440909 - protein, 9 aa, Influenza virus
GDNPRPADG

SEQ ID NO: 440910 - protein, 9 aa, Influenza virus
GDNPRPDDG

SEQ ID NO: 440911 - protein, 9 aa, Influenza virus
GDNPRPMDG

SEQ ID NO: 440912 - protein, 9 aa, Influenza virus
GDNPRPMDS

SEQ ID NO: 440913 - protein, 9 aa, Influenza virus
GDNPRPNDG

SEQ ID NO: 440914 - protein, 9 aa, Influenza virus
GDNPRPSDG

SEQ ID NO: 440915 - protein, 9 aa, Influenza virus
GDNPRPVDG

SEQ ID NO: 440916 - protein, 9 aa, Influenza virus
GDNPRSVDG

SEQ ID NO: 440917 - protein, 9 aa, Influenza virus
GDNTKWNEN

SEQ ID NO: 440918 - protein, 9 aa, Influenza virus
GDPNNMDKA

SEQ ID NO: 440919 - protein, 9 aa, Influenza virus
GDPNNMDRA

SEQ ID NO: 440920 - protein, 9 aa, Influenza virus
GDPPYSHGT

SEQ ID NO: 440921 - protein, 9 aa, Influenza virus
GDPSNMDRA

SEQ ID NO: 440922 - protein, 9 aa, Influenza virus
GDQICIGYH

SEQ ID NO: 440923 - protein, 9 aa, Influenza virus
GDQICVGYH

SEQ ID NO: 440924 - protein, 9 aa, Influenza virus
GDRICIGYH

SEQ ID NO: 440925 - protein, 9 aa, Influenza virus
GDRPKVNGQ

SEQ ID NO: 440926 - protein, 9 aa, Influenza virus
GDSFYAELK

SEQ ID NO: 440927 - protein, 9 aa, Influenza virus
GDSIIFNSI

SEQ ID NO: 440928 - protein, 9 aa, Influenza virus
GDSITFSHN

SEQ ID NO: 440929 - protein, 9 aa, Influenza virus
GDSPRPNDG

SEQ ID NO: 440930 - protein, 9 aa, Influenza virus
GDTPRNDDG

SEQ ID NO: 440931 - protein, 9 aa, Influenza virus
GDTPRNDDI

SEQ ID NO: 440932 - protein, 9 aa, Influenza virus
GDTPRNDDR

SEQ ID NO: 440933 - protein, 9 aa, Influenza virus
GDTPRNDDS

SEQ ID NO: 440934 - protein, 9 aa, Influenza virus
GDTPRNEDG

SEQ ID NO: 440935 - protein, 9 aa, Influenza virus
GDTPRNEDS

SEQ ID NO: 440936 - protein, 9 aa, Influenza virus
GDTPRNGDS

SEQ ID NO: 440937 - protein, 9 aa, Influenza virus
GDTPRNNDS

SEQ ID NO: 440938 - protein, 9 aa, Influenza virus
GDTPRPNDG

SEQ ID NO: 440939 - protein, 9 aa, Influenza virus
GDTPRSDDS

SEQ ID NO: 440940 - protein, 9 aa, Influenza virus
GDTVTFTFN

SEQ ID NO: 440941 - protein, 9 aa, Influenza virus
GDVFIIREP

SEQ ID NO: 440942 - protein, 9 aa, Influenza virus
GDVFVIREP

SEQ ID NO: 440943 - protein, 9 aa, Influenza virus
GDVFVMREP

SEQ ID NO: 440944 - protein, 9 aa, Influenza virus
GDVFVTREP

SEQ ID NO: 440945 - protein, 9 aa, Influenza virus
GDVFVVREP

SEQ ID NO: 440946 - protein, 9 aa, Influenza virus
GDVIVFNTI

SEQ ID NO: 440947 - protein, 9 aa, Influenza virus
GDVLDGVTA

SEQ ID NO: 440948 - protein, 9 aa, Influenza virus
GDVVLVMKR

SEQ ID NO: 440949 - protein, 9 aa, Influenza virus
GDVYKILSI

SEQ ID NO: 440950 - protein, 9 aa, Influenza virus
GDYARLYIW

SEQ ID NO: 440951 - protein, 9 aa, Influenza virus
GDYNNTTGR

SEQ ID NO: 440952 - protein, 9 aa, Influenza virus
GDYTRLYIW

SEQ ID NO: 440953 - protein, 9 aa, Influenza virus
GEALRQILR

SEQ ID NO: 440954 - protein, 9 aa, Influenza virus
GEAMVSRAR

SEQ ID NO: 440955 - protein, 9 aa, Influenza virus
GEAPSPYNS

SEQ ID NO: 440956 - protein, 9 aa, Influenza virus
GECFNPITG

SEQ ID NO: 440957 - protein, 9 aa, Influenza virus
GECFWVMTD

SEQ ID NO: 440958 - protein, 9 aa, Influenza virus
GECFYSGGT

SEQ ID NO: 440959 - protein, 9 aa, Influenza virus
GECPEYVKK

SEQ ID NO: 440960 - protein, 9 aa, Influenza virus
GECPKYAKK

SEQ ID NO: 440961 - protein, 9 aa, Influenza virus
GECPKYIKS

SEQ ID NO: 440962 - protein, 9 aa, Influenza virus
GECPKYVKK

SEQ ID NO: 440963 - protein, 9 aa, Influenza virus
GECPKYVKQ

SEQ ID NO: 440964 - protein, 9 aa, Influenza virus
GECPKYVKS

SEQ ID NO: 440965 - protein, 9 aa, Influenza virus
GECPKYVRK

SEQ ID NO: 440966 - protein, 9 aa, Influenza virus
GECPKYVRS

SEQ ID NO: 440967 - protein, 9 aa, Influenza virus
GECPNYVKK

SEQ ID NO: 440968 - protein, 9 aa, Influenza virus
GECPRYVKQ

SEQ ID NO: 440969 - protein, 9 aa, Influenza virus
GECPRYVKS

SEQ ID NO: 440970 - protein, 9 aa, Influenza virus
GECYRACFY

SEQ ID NO: 440971 - protein, 9 aa, Influenza virus
GECYWVMTD

SEQ ID NO: 440972 - protein, 9 aa, Influenza virus
GEDIAPIEH

SEQ ID NO: 440973 - protein, 9 aa, Influenza virus
GEDIAPIEY

SEQ ID NO: 440974 - protein, 9 aa, Influenza virus
GEDLAPIEY

SEQ ID NO: 440975 - protein, 9 aa, Influenza virus
GEDSDILVT

SEQ ID NO: 440976 - protein, 9 aa, Influenza virus
GEDSDVLVT

SEQ ID NO: 440977 - protein, 9 aa, Influenza virus
GEDTIEERF

SEQ ID NO: 440978 - protein, 9 aa, Influenza virus
GEDVAPIEH

SEQ ID NO: 440979 - protein, 9 aa, Influenza virus
GEDVAPIEY

SEQ ID NO: 440980 - protein, 9 aa, Influenza virus
GEETIEEKF

SEQ ID NO: 440981 - protein, 9 aa, Influenza virus
GEETIEERF

SEQ ID NO: 440982 - protein, 9 aa, Influenza virus
GEETVEERF

SEQ ID NO: 440983 - protein, 9 aa, Influenza virus
GEFNQVEKR

SEQ ID NO: 440984 - protein, 9 aa, Influenza virus
GEFNQVENR

SEQ ID NO: 440985 - protein, 9 aa, Influenza virus
GEFNQVEQR

SEQ ID NO: 440986 - protein, 9 aa, Influenza virus
GEFSQVEQR

SEQ ID NO: 440987 - protein, 9 aa, Influenza virus
GEFSQVERR

SEQ ID NO: 440988 - protein, 9 aa, Influenza virus
GEGEQIIVT

SEQ ID NO: 440989 - protein, 9 aa, Influenza virus
GEGIAADYK

SEQ ID NO: 440990 - protein, 9 aa, Influenza virus
GEGIPLHDA

SEQ ID NO: 440991 - protein, 9 aa, Influenza virus
GEGIPLYDA

SEQ ID NO: 440992 - protein, 9 aa, Influenza virus
GEGQRSWMK

SEQ ID NO: 440993 - protein, 9 aa, Influenza virus
GEGTAADYK

SEQ ID NO: 440994 - protein, 9 aa, Influenza virus
GEHAKAIGN

SEQ ID NO: 440995 - protein, 9 aa, Influenza virus
GEKANVLIG

SEQ ID NO: 440996 - protein, 9 aa, Influenza virus
GELDNNGEL

SEQ ID NO: 440997 - protein, 9 aa, Influenza virus
GELNNNGEL

SEQ ID NO: 440998 - protein, 9 aa, Influenza virus
GELRHLFSG

SEQ ID NO: 440999 - protein, 9 aa, Influenza virus
GENMAPEKI

SEQ ID NO: 441000 - protein, 9 aa, Influenza virus
GENMAPEKM

SEQ ID NO: 441001 - protein, 9 aa, Influenza virus
GENMAPEKV

SEQ ID NO: 441002 - protein, 9 aa, Influenza virus
GENSDVLVT

SEQ ID NO: 441003 - protein, 9 aa, Influenza virus
GENSGVLVT

SEQ ID NO: 441004 - protein, 9 aa, Influenza virus
GEPGVKGFG

SEQ ID NO: 441005 - protein, 9 aa, Influenza virus
GEQIIVTRE

SEQ ID NO: 441006 - protein, 9 aa, Influenza virus
GEQILIIWG

SEQ ID NO: 441007 - protein, 9 aa, Influenza virus
GEQMLIIWG

SEQ ID NO: 441008 - protein, 9 aa, Influenza virus
GEQMLVIWG

SEQ ID NO: 441009 - protein, 9 aa, Influenza virus
GEQVLVIWG

SEQ ID NO: 441010 - protein, 9 aa, Influenza virus
GERGLFGAI

SEQ ID NO: 441011 - protein, 9 aa, Influenza virus
GERIMFESN

SEQ ID NO: 441012 - protein, 9 aa, Influenza virus
GERITFESN

SEQ ID NO: 441013 - protein, 9 aa, Influenza virus
GERITFESS

SEQ ID NO: 441014 - protein, 9 aa, Influenza virus
GERTTFESN

SEQ ID NO: 441015 - protein, 9 aa, Influenza virus
GESEQIIVT

SEQ ID NO: 441016 - protein, 9 aa, Influenza virus
GESEQIVVT

SEQ ID NO: 441017 - protein, 9 aa, Influenza virus
GESEQVIVT

SEQ ID NO: 441018 - protein, 9 aa, Influenza virus
GESHCRIIQ

SEQ ID NO: 441019 - protein, 9 aa, Influenza virus
GESHGKIIQ

SEQ ID NO: 441020 - protein, 9 aa, Influenza virus
GESHGRIIQ

SEQ ID NO: 441021 - protein, 9 aa, Influenza virus
GESHGRTIQ

SEQ ID NO: 441022 - protein, 9 aa, Influenza virus
GESSDVLVT

SEQ ID NO: 441023 - protein, 9 aa, Influenza virus
GESYGRIIQ

SEQ ID NO: 441024 - protein, 9 aa, Influenza virus
GETLKIRTN

SEQ ID NO: 441025 - protein, 9 aa, Influenza virus
GETLKVESN

SEQ ID NO: 441026 - protein, 9 aa, Influenza virus
GETLNIESN

SEQ ID NO: 441027 - protein, 9 aa, Influenza virus
GETLNVESN

SEQ ID NO: 441028 - protein, 9 aa, Influenza virus
GETTGRNCT

SEQ ID NO: 441029 - protein, 9 aa, Influenza virus
GEVDNNGEL

SEQ ID NO: 441030 - protein, 9 aa, Influenza virus
GEVFVIREP

SEQ ID NO: 441031 - protein, 9 aa, Influenza virus
GEVPGWSWD

SEQ ID NO: 441032 - protein, 9 aa, Influenza virus
GEVPSPYNS

SEQ ID NO: 441033 - protein, 9 aa, Influenza virus
GEYNNTTGR

SEQ ID NO: 441034 - protein, 9 aa, Influenza virus
GFAFKQGNS

SEQ ID NO: 441035 - protein, 9 aa, Influenza virus
GFAFKYGNG

SEQ ID NO: 441036 - protein, 9 aa, Influenza virus
GFAIFSKDN

SEQ ID NO: 441037 - protein, 9 aa, Influenza virus
GFAIISKDN

SEQ ID NO: 441038 - protein, 9 aa, Influenza virus
GFAIVSKDN

SEQ ID NO: 441039 - protein, 9 aa, Influenza virus
GFAPFAKDN

SEQ ID NO: 441040 - protein, 9 aa, Influenza virus
GFAPFSKDN

SEQ ID NO: 441041 - protein, 9 aa, Influenza virus
GFAPFTKDN

SEQ ID NO: 441042 - protein, 9 aa, Influenza virus
GFAVVSKDN

SEQ ID NO: 441043 - protein, 9 aa, Influenza virus
GFCFTVMTD

SEQ ID NO: 441044 - protein, 9 aa, Influenza virus
GFEEFTMVG

SEQ ID NO: 441045 - protein, 9 aa, Influenza virus
GFEILLIED

SEQ ID NO: 441046 - protein, 9 aa, Influenza virus
GFEILLIEE

SEQ ID NO: 441047 - protein, 9 aa, Influenza virus
GFEMIWDAN

SEQ ID NO: 441048 - protein, 9 aa, Influenza virus
GFEMIWDPD

SEQ ID NO: 441049 - protein, 9 aa, Influenza virus
GFEMIWDPN

SEQ ID NO: 441050 - protein, 9 aa, Influenza virus
GFEMLKIHN

SEQ ID NO: 441051 - protein, 9 aa, Influenza virus
GFEMLKIPN

SEQ ID NO: 441052 - protein, 9 aa, Influenza virus
GFEMLKVPN

SEQ ID NO: 441053 - protein, 9 aa, Influenza virus
GFEMLRIPN

SEQ ID NO: 441054 - protein, 9 aa, Influenza virus
GFEMVWDAN

SEQ ID NO: 441055 - protein, 9 aa, Influenza virus
GFEMVWDPN

SEQ ID NO: 441056 - protein, 9 aa, Influenza virus
GFEPNGCIE

SEQ ID NO: 441057 - protein, 9 aa, Influenza virus
GFEPNGYIE

SEQ ID NO: 441058 - protein, 9 aa, Influenza virus
GFEVLFIED

SEQ ID NO: 441059 - protein, 9 aa, Influenza virus
GFEVLLIED

SEQ ID NO: 441060 - protein, 9 aa, Influenza virus
GFFGAIAGF

SEQ ID NO: 441061 - protein, 9 aa, Influenza virus
GFFGDNPRP

SEQ ID NO: 441062 - protein, 9 aa, Influenza virus
GFFPDGPQI

SEQ ID NO: 441063 - protein, 9 aa, Influenza virus
GFFPFHKDN

SEQ ID NO: 441064 - protein, 9 aa, Influenza virus
GFFRRLNWL

SEQ ID NO: 441065 - protein, 9 aa, Influenza virus
GFFSRLNWL

SEQ ID NO: 441066 - protein, 9 aa, Influenza virus
GFGFRQGDD

SEQ ID NO: 441067 - protein, 9 aa, Influenza virus
GFGFRQGND

SEQ ID NO: 441068 - protein, 9 aa, Influenza virus
GFGFRQGNS

SEQ ID NO: 441069 - protein, 9 aa, Influenza virus
GFGFRQGTD

SEQ ID NO: 441070 - protein, 9 aa, Influenza virus
GFGFRQGTS

SEQ ID NO: 441071 - protein, 9 aa, Influenza virus
GFHFEECSC

SEQ ID NO: 441072 - protein, 9 aa, Influenza virus
GFHHSNAEG

SEQ ID NO: 441073 - protein, 9 aa, Influenza virus
GFHHSNEQG

SEQ ID NO: 441074 - protein, 9 aa, Influenza virus
GFHHSNSEG

SEQ ID NO: 441075 - protein, 9 aa, Influenza virus
GFIDIWTYN

SEQ ID NO: 441076 - protein, 9 aa, Influenza virus
GFIDVWTYN

SEQ ID NO: 441077 - protein, 9 aa, Influenza virus
GFIEGGWCG

SEQ ID NO: 441078 - protein, 9 aa, Influenza virus
GFIEGGWPG

SEQ ID NO: 441079 - protein, 9 aa, Influenza virus
GFIEGGWQG

SEQ ID NO: 441080 - protein, 9 aa, Influenza virus
GFIEGGWSG

SEQ ID NO: 441081 - protein, 9 aa, Influenza virus
GFIEGGWTG

SEQ ID NO: 441082 - protein, 9 aa, Influenza virus
GFIEGRWPG

SEQ ID NO: 441083 - protein, 9 aa, Influenza virus
GFIENGWEG

SEQ ID NO: 441084 - protein, 9 aa, Influenza virus
GFIENGWQG

SEQ ID NO: 441085 - protein, 9 aa, Influenza virus
GFIFGCQNG

SEQ ID NO: 441086 - protein, 9 aa, Influenza virus
GFIIKGRSH

SEQ ID NO: 441087 - protein, 9 aa, Influenza virus
GFIMWACQK

SEQ ID NO: 441088 - protein, 9 aa, Influenza virus
GFIMWACQR

SEQ ID NO: 441089 - protein, 9 aa, Influenza virus
GFIMWTCQK

SEQ ID NO: 441090 - protein, 9 aa, Influenza virus
GFIVKGRSH

SEQ ID NO: 441091 - protein, 9 aa, Influenza virus
GFIVWACQR

SEQ ID NO: 441092 - protein, 9 aa, Influenza virus
GFIYSGIRT

SEQ ID NO: 441093 - protein, 9 aa, Influenza virus
GFKHQNAQG

SEQ ID NO: 441094 - protein, 9 aa, Influenza virus
GFKISKRGG

SEQ ID NO: 441095 - protein, 9 aa, Influenza virus
GFKISKRGN

SEQ ID NO: 441096 - protein, 9 aa, Influenza virus
GFKISKRGS

SEQ ID NO: 441097 - protein, 9 aa, Influenza virus
GFKPNGCIE

SEQ ID NO: 441098 - protein, 9 aa, Influenza virus
GFLAPRYGY

SEQ ID NO: 441099 - protein, 9 aa, Influenza virus
GFLDIWTYN

SEQ ID NO: 441100 - protein, 9 aa, Influenza virus
GFLDVWTYN

SEQ ID NO: 441101 - protein, 9 aa, Influenza virus
GFLGVWTYN

SEQ ID NO: 441102 - protein, 9 aa, Influenza virus
GFLIIGKED

SEQ ID NO: 441103 - protein, 9 aa, Influenza virus
GFLILGKED

SEQ ID NO: 441104 - protein, 9 aa, Influenza virus
GFLILGKEN

SEQ ID NO: 441105 - protein, 9 aa, Influenza virus
GFLILGRED

SEQ ID NO: 441106 - protein, 9 aa, Influenza virus
GFLNVWTYN

SEQ ID NO: 441107 - protein, 9 aa, Influenza virus
GFMDVWTYN

SEQ ID NO: 441108 - protein, 9 aa, Influenza virus
GFQHQNAEG

SEQ ID NO: 441109 - protein, 9 aa, Influenza virus
GFQHQNEQG

SEQ ID NO: 441110 - protein, 9 aa, Influenza virus
GFQHQNSEG

SEQ ID NO: 441111 - protein, 9 aa, Influenza virus
GFQHRDEEG

SEQ ID NO: 441112 - protein, 9 aa, Influenza virus
GFQHRNEEG

SEQ ID NO: 441113 - protein, 9 aa, Influenza virus
GFQHSNAQG

SEQ ID NO: 441114 - protein, 9 aa, Influenza virus
GFQHSNDQG

SEQ ID NO: 441115 - protein, 9 aa, Influenza virus
GFQHSNEQG

SEQ ID NO: 441116 - protein, 9 aa, Influenza virus
GFQHTNDQG

SEQ ID NO: 441117 - protein, 9 aa, Influenza virus
GFRDVWTYN

SEQ ID NO: 441118 - protein, 9 aa, Influenza virus
GFRHHNSEG

SEQ ID NO: 441119 - protein, 9 aa, Influenza virus
GFRHLNSEG

SEQ ID NO: 441120 - protein, 9 aa, Influenza virus
GFRHQNAEG

SEQ ID NO: 441121 - protein, 9 aa, Influenza virus
GFRHQNAQG

SEQ ID NO: 441122 - protein, 9 aa, Influenza virus
GFRHQNSEG

SEQ ID NO: 441123 - protein, 9 aa, Influenza virus
GFRHQNSQG

SEQ ID NO: 441124 - protein, 9 aa, Influenza virus
GFRHQNTQG

SEQ ID NO: 441125 - protein, 9 aa, Influenza virus
GFRISKRGS

SEQ ID NO: 441126 - protein, 9 aa, Influenza virus
GFRQGDDVW

SEQ ID NO: 441127 - protein, 9 aa, Influenza virus
GFRQGNDVW

SEQ ID NO: 441128 - protein, 9 aa, Influenza virus
GFRQGNSVW

SEQ ID NO: 441129 - protein, 9 aa, Influenza virus
GFRQGSDVW

SEQ ID NO: 441130 - protein, 9 aa, Influenza virus
GFRQGTDVW

SEQ ID NO: 441131 - protein, 9 aa, Influenza virus
GFRQGTSVW

SEQ ID NO: 441132 - protein, 9 aa, Influenza virus
GFRYQNSEG

SEQ ID NO: 441133 - protein, 9 aa, Influenza virus
GFRYSGIKT

SEQ ID NO: 441134 - protein, 9 aa, Influenza virus
GFRYSGIRT

SEQ ID NO: 441135 - protein, 9 aa, Influenza virus
GFSAESRKL

SEQ ID NO: 441136 - protein, 9 aa, Influenza virus
GFSAESRKM

SEQ ID NO: 441137 - protein, 9 aa, Influenza virus
GFSFKYGDG

SEQ ID NO: 441138 - protein, 9 aa, Influenza virus
GFSFKYGNG

SEQ ID NO: 441139 - protein, 9 aa, Influenza virus
GFSFRYGDG

SEQ ID NO: 441140 - protein, 9 aa, Influenza virus
GFSFRYGNG

SEQ ID NO: 441141 - protein, 9 aa, Influenza virus
GFSYKYDNG

SEQ ID NO: 441142 - protein, 9 aa, Influenza virus
GFSYKYGNG

SEQ ID NO: 441143 - protein, 9 aa, Influenza virus
GFSYRYGNG

SEQ ID NO: 441144 - protein, 9 aa, Influenza virus
GFTFKRTKG

SEQ ID NO: 441145 - protein, 9 aa, Influenza virus
GFTFKRTNG

SEQ ID NO: 441146 - protein, 9 aa, Influenza virus
GFTFKRTSG

SEQ ID NO: 441147 - protein, 9 aa, Influenza virus
GFTYNGIRT

SEQ ID NO: 441148 - protein, 9 aa, Influenza virus
GFTYSEIRT

SEQ ID NO: 441149 - protein, 9 aa, Influenza virus
GFTYSGIMT

SEQ ID NO: 441150 - protein, 9 aa, Influenza virus
GFTYSGIRT

SEQ ID NO: 441151 - protein, 9 aa, Influenza virus
GFTYSGMRT

SEQ ID NO: 441152 - protein, 9 aa, Influenza virus
GFTYSGVRT

SEQ ID NO: 441153 - protein, 9 aa, Influenza virus
GFTYTGVRT

SEQ ID NO: 441154 - protein, 9 aa, Influenza virus
GFVANFSME

SEQ ID NO: 441155 - protein, 9 aa, Influenza virus
GFVENLEEL

SEQ ID NO: 441156 - protein, 9 aa, Influenza virus
GFVFTLTVP

SEQ ID NO: 441157 - protein, 9 aa, Influenza virus
GFVHFVEAL

SEQ ID NO: 441158 - protein, 9 aa, Influenza virus
GFVIVSKDN

SEQ ID NO: 441159 - protein, 9 aa, Influenza virus
GFVLWACQN

SEQ ID NO: 441160 - protein, 9 aa, Influenza virus
GFVPFSKDN

SEQ ID NO: 441161 - protein, 9 aa, Influenza virus
GFVRQCFNP

SEQ ID NO: 441162 - protein, 9 aa, Influenza virus
GFVRTLFQQ

SEQ ID NO: 441163 - protein, 9 aa, Influenza virus
GFVYFVEAL

SEQ ID NO: 441164 - protein, 9 aa, Influenza virus
GFVYFVEIL

SEQ ID NO: 441165 - protein, 9 aa, Influenza virus
GFVYFVETL

SEQ ID NO: 441166 - protein, 9 aa, Influenza virus
GFWMCSNGS

SEQ ID NO: 441167 - protein, 9 aa, Influenza virus
GFYRNLVWF

SEQ ID NO: 441168 - protein, 9 aa, Influenza virus
GGAIWVTRE

SEQ ID NO: 441169 - protein, 9 aa, Influenza virus
GGAQHVEEC

SEQ ID NO: 441170 - protein, 9 aa, Influenza virus
GGCFQPCFY

SEQ ID NO: 441171 - protein, 9 aa, Influenza virus
GGCPKYVKS

SEQ ID NO: 441172 - protein, 9 aa, Influenza virus
GGDIWATRE

SEQ ID NO: 441173 - protein, 9 aa, Influenza virus
GGDIWITRE

SEQ ID NO: 441174 - protein, 9 aa, Influenza virus
GGDIWVMRE

SEQ ID NO: 441175 - protein, 9 aa, Influenza virus
GGDIWVTRE

SEQ ID NO: 441176 - protein, 9 aa, Influenza virus
GGDSFYAEL

SEQ ID NO: 441177 - protein, 9 aa, Influenza virus
GGFIFGCQN

SEQ ID NO: 441178 - protein, 9 aa, Influenza virus
GGFLAPRYG

SEQ ID NO: 441179 - protein, 9 aa, Influenza virus
GGFTFKRTK

SEQ ID NO: 441180 - protein, 9 aa, Influenza virus
GGFTFKRTN

SEQ ID NO: 441181 - protein, 9 aa, Influenza virus
GGFTFKRTS

SEQ ID NO: 441182 - protein, 9 aa, Influenza virus
GGGCFKIYH

SEQ ID NO: 441183 - protein, 9 aa, Influenza virus
GGGDIWVTR

SEQ ID NO: 441184 - protein, 9 aa, Influenza virus
GGGPDPGVK

SEQ ID NO: 441185 - protein, 9 aa, Influenza virus
GGGYAADKE

SEQ ID NO: 441186 - protein, 9 aa, Influenza virus
GGHGVKGWA

SEQ ID NO: 441187 - protein, 9 aa, Influenza virus
GGHIEECSC

SEQ ID NO: 441188 - protein, 9 aa, Influenza virus
GGHIWVTRE

SEQ ID NO: 441189 - protein, 9 aa, Influenza virus
GGIDKEPMG

SEQ ID NO: 441190 - protein, 9 aa, Influenza virus
GGIDKESMG

SEQ ID NO: 441191 - protein, 9 aa, Influenza virus
GGIDTNKTF

SEQ ID NO: 441192 - protein, 9 aa, Influenza virus
GGIGKFYIQ

SEQ ID NO: 441193 - protein, 9 aa, Influenza virus
GGIGRFYIQ

SEQ ID NO: 441194 - protein, 9 aa, Influenza virus
GGIGRFYVQ

SEQ ID NO: 441195 - protein, 9 aa, Influenza virus
GGINTNKTF

SEQ ID NO: 441196 - protein, 9 aa, Influenza virus
GGINTNRTF

SEQ ID NO: 441197 - protein, 9 aa, Influenza virus
GGIPTDVIR

SEQ ID NO: 441198 - protein, 9 aa, Influenza virus
GGIPTDVVR

SEQ ID NO: 441199 - protein, 9 aa, Influenza virus
GGLGVKGFG

SEQ ID NO: 441200 - protein, 9 aa, Influenza virus
GGLIAPDRV

SEQ ID NO: 441201 - protein, 9 aa, Influenza virus
GGLIAPNRV

SEQ ID NO: 441202 - protein, 9 aa, Influenza virus
GGLIAPRYG

SEQ ID NO: 441203 - protein, 9 aa, Influenza virus
GGLIAPSRV

SEQ ID NO: 441204 - protein, 9 aa, Influenza virus
GGLILGMQN

SEQ ID NO: 441205 - protein, 9 aa, Influenza virus
GGLLAPKYG

SEQ ID NO: 441206 - protein, 9 aa, Influenza virus
GGLLAPRYG

SEQ ID NO: 441207 - protein, 9 aa, Influenza virus
GGLVAPSRV

SEQ ID NO: 441208 - protein, 9 aa, Influenza virus
GGMPTDVVR

SEQ ID NO: 441209 - protein, 9 aa, Influenza virus
GGNEKKAKL

SEQ ID NO: 441210 - protein, 9 aa, Influenza virus
GGNIWITRE

SEQ ID NO: 441211 - protein, 9 aa, Influenza virus
GGNPDPGVK

SEQ ID NO: 441212 - protein, 9 aa, Influenza virus
GGNSFYAEL

SEQ ID NO: 441213 - protein, 9 aa, Influenza virus
GGPDPGVKG

SEQ ID NO: 441214 - protein, 9 aa, Influenza virus
GGPGVKGFG

SEQ ID NO: 441215 - protein, 9 aa, Influenza virus
GGPNLYNIR

SEQ ID NO: 441216 - protein, 9 aa, Influenza virus
GGQAFYRSI

SEQ ID NO: 441217 - protein, 9 aa, Influenza virus
GGQSFYRSI

SEQ ID NO: 441218 - protein, 9 aa, Influenza virus
GGRIAPSRV

SEQ ID NO: 441219 - protein, 9 aa, Influenza virus
GGRNSFFSR

SEQ ID NO: 441220 - protein, 9 aa, Influenza virus
GGSGIMKTE

SEQ ID NO: 441221 - protein, 9 aa, Influenza virus
GGSGTDNYG

SEQ ID NO: 441222 - protein, 9 aa, Influenza virus
GGSGTNNYG

SEQ ID NO: 441223 - protein, 9 aa, Influenza virus
GGSIITELP

SEQ ID NO: 441224 - protein, 9 aa, Influenza virus
GGSIKTKLP

SEQ ID NO: 441225 - protein, 9 aa, Influenza virus
GGSINTKLP

SEQ ID NO: 441226 - protein, 9 aa, Influenza virus
GGSINTRLP

SEQ ID NO: 441227 - protein, 9 aa, Influenza virus
GGSPDPGVK

SEQ ID NO: 441228 - protein, 9 aa, Influenza virus
GGTGSVYIE

SEQ ID NO: 441229 - protein, 9 aa, Influenza virus
GGTIASSLP

SEQ ID NO: 441230 - protein, 9 aa, Influenza virus
GGTIISNLP

SEQ ID NO: 441231 - protein, 9 aa, Influenza virus
GGTIISSLP

SEQ ID NO: 441232 - protein, 9 aa, Influenza virus
GGTINSPLP

SEQ ID NO: 441233 - protein, 9 aa, Influenza virus
GGTITSNLP

SEQ ID NO: 441234 - protein, 9 aa, Influenza virus
GGTITSPLP

SEQ ID NO: 441235 - protein, 9 aa, Influenza virus
GGTIVSSLP

SEQ ID NO: 441236 - protein, 9 aa, Influenza virus
GGTPDPGVK

SEQ ID NO: 441237 - protein, 9 aa, Influenza virus
GGTSSIYIE

SEQ ID NO: 441238 - protein, 9 aa, Influenza virus
GGTSSVYIE

SEQ ID NO: 441239 - protein, 9 aa, Influenza virus
GGTSSVYVE

SEQ ID NO: 441240 - protein, 9 aa, Influenza virus
GGVESAVLR

SEQ ID NO: 441241 - protein, 9 aa, Influenza virus
GGVNTNKTF

SEQ ID NO: 441242 - protein, 9 aa, Influenza virus
GGVPTDVIR

SEQ ID NO: 441243 - protein, 9 aa, Influenza virus
GGVPTDVVR

SEQ ID NO: 441244 - protein, 9 aa, Influenza virus
GGWATANSK

SEQ ID NO: 441245 - protein, 9 aa, Influenza virus
GGWCGMIDG

SEQ ID NO: 441246 - protein, 9 aa, Influenza virus
GGWPGLING

SEQ ID NO: 441247 - protein, 9 aa, Influenza virus
GGWPGLVAG

SEQ ID NO: 441248 - protein, 9 aa, Influenza virus
GGWQGLVDG

SEQ ID NO: 441249 - protein, 9 aa, Influenza virus
GGWQGMIDG

SEQ ID NO: 441250 - protein, 9 aa, Influenza virus
GGWQGMVDG

SEQ ID NO: 441251 - protein, 9 aa, Influenza virus
GGWSGLIAG

SEQ ID NO: 441252 - protein, 9 aa, Influenza virus
GGWSGLVAG

SEQ ID NO: 441253 - protein, 9 aa, Influenza virus
GGWSGMIDG

SEQ ID NO: 441254 - protein, 9 aa, Influenza virus
GGWTGLIDG

SEQ ID NO: 441255 - protein, 9 aa, Influenza virus
GGWTGMIDG

SEQ ID NO: 441256 - protein, 9 aa, Influenza virus
GGWTGMVDG

SEQ ID NO: 441257 - protein, 9 aa, Influenza virus
GGWTGMVNG

SEQ ID NO: 441258 - protein, 9 aa, Influenza virus
GGWTIANSK

SEQ ID NO: 441259 - protein, 9 aa, Influenza virus
GGWTTANSK

SEQ ID NO: 441260 - protein, 9 aa, Influenza virus
GGYAADKES

SEQ ID NO: 441261 - protein, 9 aa, Influenza virus
GGYDFEREG

SEQ ID NO: 441262 - protein, 9 aa, Influenza virus
GGYKDIILW

SEQ ID NO: 441263 - protein, 9 aa, Influenza virus
GGYKDVILW

SEQ ID NO: 441264 - protein, 9 aa, Influenza virus
GGYPVIKKT

SEQ ID NO: 441265 - protein, 9 aa, Influenza virus
GHDFEREGY

SEQ ID NO: 441266 - protein, 9 aa, Influenza virus
GHDKNATAS

SEQ ID NO: 441267 - protein, 9 aa, Influenza virus
GHGVKGWAF

SEQ ID NO: 441268 - protein, 9 aa, Influenza virus
GHHANNSTE

SEQ ID NO: 441269 - protein, 9 aa, Influenza virus
GHHAVANGT

SEQ ID NO: 441270 - protein, 9 aa, Influenza virus
GHHAVENGT

SEQ ID NO: 441271 - protein, 9 aa, Influenza virus
GHHAVPNGT

SEQ ID NO: 441272 - protein, 9 aa, Influenza virus
GHHAVQNGT

SEQ ID NO: 441273 - protein, 9 aa, Influenza virus
GHHAVSNGT

SEQ ID NO: 441274 - protein, 9 aa, Influenza virus
GHHAVTNGT

SEQ ID NO: 441275 - protein, 9 aa, Influenza virus
GHHSVPNGT

SEQ ID NO: 441276 - protein, 9 aa, Influenza virus
GHIEECSCY

SEQ ID NO: 441277 - protein, 9 aa, Influenza virus
GHIFVIREP

SEQ ID NO: 441278 - protein, 9 aa, Influenza virus
GHIWVTREP

SEQ ID NO: 441279 - protein, 9 aa, Influenza virus
GHLITGKSH

SEQ ID NO: 441280 - protein, 9 aa, Influenza virus
GHLTTGKSH

SEQ ID NO: 441281 - protein, 9 aa, Influenza virus
GHLVTGKSH

SEQ ID NO: 441282 - protein, 9 aa, Influenza virus
GHNGMLCAT

SEQ ID NO: 441283 - protein, 9 aa, Influenza virus
GHNITFSHN

SEQ ID NO: 441284 - protein, 9 aa, Influenza virus
GHNQEYTSG

SEQ ID NO: 441285 - protein, 9 aa, Influenza virus
GHPGVKGWA

SEQ ID NO: 441286 - protein, 9 aa, Influenza virus
GHQSTNSTD

SEQ ID NO: 441287 - protein, 9 aa, Influenza virus
GHQSTNSTE

SEQ ID NO: 441288 - protein, 9 aa, Influenza virus
GHVFVIREP

SEQ ID NO: 441289 - protein, 9 aa, Influenza virus
GHWPDGSNI

SEQ ID NO: 441290 - protein, 9 aa, Influenza virus
GHYKISKST

SEQ ID NO: 441291 - protein, 9 aa, Influenza virus
GIAADKAST

SEQ ID NO: 441292 - protein, 9 aa, Influenza virus
GIAADKEST

SEQ ID NO: 441293 - protein, 9 aa, Influenza virus
GIAADKTST

SEQ ID NO: 441294 - protein, 9 aa, Influenza virus
GIAADKVST

SEQ ID NO: 441295 - protein, 9 aa, Influenza virus
GIAADRDST

SEQ ID NO: 441296 - protein, 9 aa, Influenza virus
GIAADREST

SEQ ID NO: 441297 - protein, 9 aa, Influenza virus
GIAADRGST

SEQ ID NO: 441298 - protein, 9 aa, Influenza virus
GIAADYKST

SEQ ID NO: 441299 - protein, 9 aa, Influenza virus
GIAAEKEST

SEQ ID NO: 441300 - protein, 9 aa, Influenza virus
GIAIALGII

SEQ ID NO: 441301 - protein, 9 aa, Influenza virus
GIAIVLGII

SEQ ID NO: 441302 - protein, 9 aa, Influenza virus
GIANLGLNI

SEQ ID NO: 441303 - protein, 9 aa, Influenza virus
GICAVATTH

SEQ ID NO: 441304 - protein, 9 aa, Influenza virus
GICPVVFTD

SEQ ID NO: 441305 - protein, 9 aa, Influenza virus
GICPVVMTD

SEQ ID NO: 441306 - protein, 9 aa, Influenza virus
GICTVVMTD

SEQ ID NO: 441307 - protein, 9 aa, Influenza virus
GICVVAVTD

SEQ ID NO: 441308 - protein, 9 aa, Influenza virus
GICYPGILE

SEQ ID NO: 441309 - protein, 9 aa, Influenza virus
GICYPGSIE

SEQ ID NO: 441310 - protein, 9 aa, Influenza virus
GICYPGSLD

SEQ ID NO: 441311 - protein, 9 aa, Influenza virus
GICYPGSVE

SEQ ID NO: 441312 - protein, 9 aa, Influenza virus
GICYPGTLE

SEQ ID NO: 441313 - protein, 9 aa, Influenza virus
GICYPGTLG

SEQ ID NO: 441314 - protein, 9 aa, Influenza virus
GIDKEPMGF

SEQ ID NO: 441315 - protein, 9 aa, Influenza virus
GIDKESMGF

SEQ ID NO: 441316 - protein, 9 aa, Influenza virus
GIDKICLGH

SEQ ID NO: 441317 - protein, 9 aa, Influenza virus
GIDKVCTKG

SEQ ID NO: 441318 - protein, 9 aa, Influenza virus
GIDPFKLLQ

SEQ ID NO: 441319 - protein, 9 aa, Influenza virus
GIDPFRLLQ

SEQ ID NO: 441320 - protein, 9 aa, Influenza virus
GIDTNKTFQ

SEQ ID NO: 441321 - protein, 9 aa, Influenza virus
GIEVVNATE

SEQ ID NO: 441322 - protein, 9 aa, Influenza virus
GIEYNGKSL

SEQ ID NO: 441323 - protein, 9 aa, Influenza virus
GIFENSCIE

SEQ ID NO: 441324 - protein, 9 aa, Influenza virus
GIFENSCLE

SEQ ID NO: 441325 - protein, 9 aa, Influenza virus
GIFESSCLE

SEQ ID NO: 441326 - protein, 9 aa, Influenza virus
GIFFWMCSN

SEQ ID NO: 441327 - protein, 9 aa, Influenza virus
GIFGAIAGF

SEQ ID NO: 441328 - protein, 9 aa, Influenza virus
GIFGDNPRP

SEQ ID NO: 441329 - protein, 9 aa, Influenza virus
GIFGDSPRP

SEQ ID NO: 441330 - protein, 9 aa, Influenza virus
GIFGNSCLE

SEQ ID NO: 441331 - protein, 9 aa, Influenza virus
GIFGPVHFR

SEQ ID NO: 441332 - protein, 9 aa, Influenza virus
GIFLWMCSN

SEQ ID NO: 441333 - protein, 9 aa, Influenza virus
GIGIAADRD

SEQ ID NO: 441334 - protein, 9 aa, Influenza virus
GIGKFYIQM

SEQ ID NO: 441335 - protein, 9 aa, Influenza virus
GIGNLAFNA

SEQ ID NO: 441336 - protein, 9 aa, Influenza virus
GIGNLVFNT

SEQ ID NO: 441337 - protein, 9 aa, Influenza virus
GIGQAADLK

SEQ ID NO: 441338 - protein, 9 aa, Influenza virus
GIGQAADYK

SEQ ID NO: 441339 - protein, 9 aa, Influenza virus
GIGRFYIQM

SEQ ID NO: 441340 - protein, 9 aa, Influenza virus
GIGRFYVQM

SEQ ID NO: 441341 - protein, 9 aa, Influenza virus
GIGRMTICI

SEQ ID NO: 441342 - protein, 9 aa, Influenza virus
GIGRMTICV

SEQ ID NO: 441343 - protein, 9 aa, Influenza virus
GIHHPDSET

SEQ ID NO: 441344 - protein, 9 aa, Influenza virus
GIHHPDTEA

SEQ ID NO: 441345 - protein, 9 aa, Influenza virus
GIHHPDTEE

SEQ ID NO: 441346 - protein, 9 aa, Influenza virus
GIHHPDTET

SEQ ID NO: 441347 - protein, 9 aa, Influenza virus
GIHHPPDAK

SEQ ID NO: 441348 - protein, 9 aa, Influenza virus
GIHHPPDET

SEQ ID NO: 441349 - protein, 9 aa, Influenza virus
GIHHPPDTK

SEQ ID NO: 441350 - protein, 9 aa, Influenza virus
GIHHPPNTK

SEQ ID NO: 441351 - protein, 9 aa, Influenza virus
GIHHPSSAQ

SEQ ID NO: 441352 - protein, 9 aa, Influenza virus
GIHHPSSTK

SEQ ID NO: 441353 - protein, 9 aa, Influenza virus
GIHHPSSTQ

SEQ ID NO: 441354 - protein, 9 aa, Influenza virus
GIILGNPKC

SEQ ID NO: 441355 - protein, 9 aa, Influenza virus
GIINLLIGI

SEQ ID NO: 441356 - protein, 9 aa, Influenza virus
GIITDTFKS

SEQ ID NO: 441357 - protein, 9 aa, Influenza virus
GIITDTIKS

SEQ ID NO: 441358 - protein, 9 aa, Influenza virus
GIITDTIRS

SEQ ID NO: 441359 - protein, 9 aa, Influenza virus
GIITDTLKS

SEQ ID NO: 441360 - protein, 9 aa, Influenza virus
GIITETIKS

SEQ ID NO: 441361 - protein, 9 aa, Influenza virus
GIITGPPQC

SEQ ID NO: 441362 - protein, 9 aa, Influenza virus
GIITGTIKS

SEQ ID NO: 441363 - protein, 9 aa, Influenza virus
GIKGFAFLD

SEQ ID NO: 441364 - protein, 9 aa, Influenza virus
GIKGFGFLN

SEQ ID NO: 441365 - protein, 9 aa, Influenza virus
GIKGFSFKY

SEQ ID NO: 441366 - protein, 9 aa, Influenza virus
GIKGFSFRY

SEQ ID NO: 441367 - protein, 9 aa, Influenza virus
GIKLKSEDN

SEQ ID NO: 441368 - protein, 9 aa, Influenza virus
GIKLKTEDN

SEQ ID NO: 441369 - protein, 9 aa, Influenza virus
GIKSFSRTE

SEQ ID NO: 441370 - protein, 9 aa, Influenza virus
GIKSFSRTQ

SEQ ID NO: 441371 - protein, 9 aa, Influenza virus
GIKTDGATS

SEQ ID NO: 441372 - protein, 9 aa, Influenza virus
GIKVDTLTE

SEQ ID NO: 441373 - protein, 9 aa, Influenza virus
GILEDEQMY

SEQ ID NO: 441374 - protein, 9 aa, Influenza virus
GILGFVFTL

SEQ ID NO: 441375 - protein, 9 aa, Influenza virus
GILGILTGP

SEQ ID NO: 441376 - protein, 9 aa, Influenza virus
GILGTIIGP

SEQ ID NO: 441377 - protein, 9 aa, Influenza virus
GILHLILWI

SEQ ID NO: 441378 - protein, 9 aa, Influenza virus
GILHLVLWI

SEQ ID NO: 441379 - protein, 9 aa, Influenza virus
GILKRGETL

SEQ ID NO: 441380 - protein, 9 aa, Influenza virus
GILTDTSRP

SEQ ID NO: 441381 - protein, 9 aa, Influenza virus
GILTGPPQC

SEQ ID NO: 441382 - protein, 9 aa, Influenza virus
GIMKTEGTL

SEQ ID NO: 441383 - protein, 9 aa, Influenza virus
GIMKTEKTL

SEQ ID NO: 441384 - protein, 9 aa, Influenza virus
GIMKTERTL

SEQ ID NO: 441385 - protein, 9 aa, Influenza virus
GIMKTGGTL

SEQ ID NO: 441386 - protein, 9 aa, Influenza virus
GIMNTSKPF

SEQ ID NO: 441387 - protein, 9 aa, Influenza virus
GINDRNFWR

SEQ ID NO: 441388 - protein, 9 aa, Influenza virus
GINESADMS

SEQ ID NO: 441389 - protein, 9 aa, Influenza virus
GINKVCTKG

SEQ ID NO: 441390 - protein, 9 aa, Influenza virus
GINMSKKKS

SEQ ID NO: 441391 - protein, 9 aa, Influenza virus
GINTNKTFQ

SEQ ID NO: 441392 - protein, 9 aa, Influenza virus
GINTNRTFQ

SEQ ID NO: 441393 - protein, 9 aa, Influenza virus
GIPESMREE

SEQ ID NO: 441394 - protein, 9 aa, Influenza virus
GIPFHLGTK

SEQ ID NO: 441395 - protein, 9 aa, Influenza virus
GIPFHLGTR

SEQ ID NO: 441396 - protein, 9 aa, Influenza virus
GIPLHDAIK

SEQ ID NO: 441397 - protein, 9 aa, Influenza virus
GIPLYDAIK

SEQ ID NO: 441398 - protein, 9 aa, Influenza virus
GIPLYDAVK

SEQ ID NO: 441399 - protein, 9 aa, Influenza virus
GIPLYDAVR

SEQ ID NO: 441400 - protein, 9 aa, Influenza virus
GIPPLELGD

SEQ ID NO: 441401 - protein, 9 aa, Influenza virus
GIPPLELRD

SEQ ID NO: 441402 - protein, 9 aa, Influenza virus
GIPPLVLGD

SEQ ID NO: 441403 - protein, 9 aa, Influenza virus
GIPSDTPRG

SEQ ID NO: 441404 - protein, 9 aa, Influenza virus
GIPTDTPRG

SEQ ID NO: 441405 - protein, 9 aa, Influenza virus
GIPTDTPRI

SEQ ID NO: 441406 - protein, 9 aa, Influenza virus
GIPTDTPRV

SEQ ID NO: 441407 - protein, 9 aa, Influenza virus
GIPTDVVRS

SEQ ID NO: 441408 - protein, 9 aa, Influenza virus
GIQAGVDRF

SEQ ID NO: 441409 - protein, 9 aa, Influenza virus
GIQAGVNRF

SEQ ID NO: 441410 - protein, 9 aa, Influenza virus
GIQIASNEN

SEQ ID NO: 441411 - protein, 9 aa, Influenza virus
GIQSDAQID

SEQ ID NO: 441412 - protein, 9 aa, Influenza virus
GIREWSYLI

SEQ ID NO: 441413 - protein, 9 aa, Influenza virus
GIRIGSKGD

SEQ ID NO: 441414 - protein, 9 aa, Influenza virus
GIRIGSKGH

SEQ ID NO: 441415 - protein, 9 aa, Influenza virus
GIRIGSRGE

SEQ ID NO: 441416 - protein, 9 aa, Influenza virus
GIRIGSRGH

SEQ ID NO: 441417 - protein, 9 aa, Influenza virus
GIRPGYNGQ

SEQ ID NO: 441418 - protein, 9 aa, Influenza virus
GIRSFSRTE

SEQ ID NO: 441419 - protein, 9 aa, Influenza virus
GIRTDGATS

SEQ ID NO: 441420 - protein, 9 aa, Influenza virus
GIRVGSRGH

SEQ ID NO: 441421 - protein, 9 aa, Influenza virus
GISFWMCSN

SEQ ID NO: 441422 - protein, 9 aa, Influenza virus
GISGADDDA

SEQ ID NO: 441423 - protein, 9 aa, Influenza virus
GISGPDDGA

SEQ ID NO: 441424 - protein, 9 aa, Influenza virus
GISGPDNEA

SEQ ID NO: 441425 - protein, 9 aa, Influenza virus
GISGPDNGA

SEQ ID NO: 441426 - protein, 9 aa, Influenza virus
GISGPDSGA

SEQ ID NO: 441427 - protein, 9 aa, Influenza virus
GISIWMCSN

SEQ ID NO: 441428 - protein, 9 aa, Influenza virus
GISLWMCSN

SEQ ID NO: 441429 - protein, 9 aa, Influenza virus
GISNVGLKV

SEQ ID NO: 441430 - protein, 9 aa, Influenza virus
GISNVGLNV

SEQ ID NO: 441431 - protein, 9 aa, Influenza virus
GISPIHLGD

SEQ ID NO: 441432 - protein, 9 aa, Influenza virus
GISPLELGD

SEQ ID NO: 441433 - protein, 9 aa, Influenza virus
GISPVHLGD

SEQ ID NO: 441434 - protein, 9 aa, Influenza virus
GISSMGEAM

SEQ ID NO: 441435 - protein, 9 aa, Influenza virus
GISSMMEAM

SEQ ID NO: 441436 - protein, 9 aa, Influenza virus
GISSMVEAM

SEQ ID NO: 441437 - protein, 9 aa, Influenza virus
GITGPDATA

SEQ ID NO: 441438 - protein, 9 aa, Influenza virus
GITGPDSTA

SEQ ID NO: 441439 - protein, 9 aa, Influenza virus
GITGPDTTA

SEQ ID NO: 441440 - protein, 9 aa, Influenza virus
GITNKINSI

SEQ ID NO: 441441 - protein, 9 aa, Influenza virus
GITNKVNSI

SEQ ID NO: 441442 - protein, 9 aa, Influenza virus
GITTHFQRK

SEQ ID NO: 441443 - protein, 9 aa, Influenza virus
GITVIKNNM

SEQ ID NO: 441444 - protein, 9 aa, Influenza virus
GIVADRDST

SEQ ID NO: 441445 - protein, 9 aa, Influenza virus
GIVECVCRD

SEQ ID NO: 441446 - protein, 9 aa, Influenza virus
GIVHLILWI

SEQ ID NO: 441447 - protein, 9 aa, Influenza virus
GIVNTTLST

SEQ ID NO: 441448 - protein, 9 aa, Influenza virus
GIWDTLIER

SEQ ID NO: 441449 - protein, 9 aa, Influenza virus
GIYKILTIY

SEQ ID NO: 441450 - protein, 9 aa, Influenza virus
GIYQILAIY

SEQ ID NO: 441451 - protein, 9 aa, Influenza virus
GIYQILSIY

SEQ ID NO: 441452 - protein, 9 aa, Influenza virus
GKADTRILF

SEQ ID NO: 441453 - protein, 9 aa, Influenza virus
GKAPISLGD

SEQ ID NO: 441454 - protein, 9 aa, Influenza virus
GKAPISLGG

SEQ ID NO: 441455 - protein, 9 aa, Influenza virus
GKAQHIEEC

SEQ ID NO: 441456 - protein, 9 aa, Influenza virus
GKAWLHICV

SEQ ID NO: 441457 - protein, 9 aa, Influenza virus
GKAWLHVCI

SEQ ID NO: 441458 - protein, 9 aa, Influenza virus
GKAWLHVCV

SEQ ID NO: 441459 - protein, 9 aa, Influenza virus
GKCNDPYPG

SEQ ID NO: 441460 - protein, 9 aa, Influenza virus
GKCNEPYPG

SEQ ID NO: 441461 - protein, 9 aa, Influenza virus
GKCNTKCQT

SEQ ID NO: 441462 - protein, 9 aa, Influenza virus
GKCPKYIPS

SEQ ID NO: 441463 - protein, 9 aa, Influenza virus
GKCPKYISS

SEQ ID NO: 441464 - protein, 9 aa, Influenza virus
GKCPKYVKQ

SEQ ID NO: 441465 - protein, 9 aa, Influenza virus
GKCPKYVKS

SEQ ID NO: 441466 - protein, 9 aa, Influenza virus
GKCPRYIKQ

SEQ ID NO: 441467 - protein, 9 aa, Influenza virus
GKCPRYIPS

SEQ ID NO: 441468 - protein, 9 aa, Influenza virus
GKCPRYVKQ

SEQ ID NO: 441469 - protein, 9 aa, Influenza virus
GKCPRYVRQ

SEQ ID NO: 441470 - protein, 9 aa, Influenza virus
GKCYQFALG

SEQ ID NO: 441471 - protein, 9 aa, Influenza virus
GKDNAIRIG

SEQ ID NO: 441472 - protein, 9 aa, Influenza virus
GKDNAVRIG

SEQ ID NO: 441473 - protein, 9 aa, Influenza virus
GKDPKKTGG

SEQ ID NO: 441474 - protein, 9 aa, Influenza virus
GKEDKRYGP

SEQ ID NO: 441475 - protein, 9 aa, Influenza virus
GKEDRRYGP

SEQ ID NO: 441476 - protein, 9 aa, Influenza virus
GKENKKYGP

SEQ ID NO: 441477 - protein, 9 aa, Influenza virus
GKENKRYGP

SEQ ID NO: 441478 - protein, 9 aa, Influenza virus
GKEPISLGD

SEQ ID NO: 441479 - protein, 9 aa, Influenza virus
GKEWLHVCI

SEQ ID NO: 441480 - protein, 9 aa, Influenza virus
GKEWMHICM

SEQ ID NO: 441481 - protein, 9 aa, Influenza virus
GKEWMHVCI

SEQ ID NO: 441482 - protein, 9 aa, Influenza virus
GKEWMHVCM

SEQ ID NO: 441483 - protein, 9 aa, Influenza virus
GKFEFIAED

SEQ ID NO: 441484 - protein, 9 aa, Influenza virus
GKFEFIAEE

SEQ ID NO: 441485 - protein, 9 aa, Influenza virus
GKFEFIVEK

SEQ ID NO: 441486 - protein, 9 aa, Influenza virus
GKFQTAAQK

SEQ ID NO: 441487 - protein, 9 aa, Influenza virus
GKFQTAAQR

SEQ ID NO: 441488 - protein, 9 aa, Influenza virus
GKFTNEEAL

SEQ ID NO: 441489 - protein, 9 aa, Influenza virus
GKFYIQMCT

SEQ ID NO: 441490 - protein, 9 aa, Influenza virus
GKGCFDILH

SEQ ID NO: 441491 - protein, 9 aa, Influenza virus
GKGCFDLYH

SEQ ID NO: 441492 - protein, 9 aa, Influenza virus
GKGCFEIYH

SEQ ID NO: 441493 - protein, 9 aa, Influenza virus
GKGCFELYH

SEQ ID NO: 441494 - protein, 9 aa, Influenza virus
GKGLGIQSG

SEQ ID NO: 441495 - protein, 9 aa, Influenza virus
GKGRIFQSH

SEQ ID NO: 441496 - protein, 9 aa, Influenza virus
GKGRIFQSP

SEQ ID NO: 441497 - protein, 9 aa, Influenza virus
GKGRIFQSR

SEQ ID NO: 441498 - protein, 9 aa, Influenza virus
GKGRYGVKG

SEQ ID NO: 441499 - protein, 9 aa, Influenza virus
GKGSWPDGA

SEQ ID NO: 441500 - protein, 9 aa, Influenza virus
GKGYMFESK

SEQ ID NO: 441501 - protein, 9 aa, Influenza virus
GKHIVERIL

SEQ ID NO: 441502 - protein, 9 aa, Influenza virus
GKHSNGTIH

SEQ ID NO: 441503 - protein, 9 aa, Influenza virus
GKIAHISPL

SEQ ID NO: 441504 - protein, 9 aa, Influenza virus
GKIIHISPL

SEQ ID NO: 441505 - protein, 9 aa, Influenza virus
GKIIKWEPL

SEQ ID NO: 441506 - protein, 9 aa, Influenza virus
GKIIQNEDI

SEQ ID NO: 441507 - protein, 9 aa, Influenza virus
GKILKWEPL

SEQ ID NO: 441508 - protein, 9 aa, Influenza virus
GKILKWESL

SEQ ID NO: 441509 - protein, 9 aa, Influenza virus
GKILRTQES

SEQ ID NO: 441510 - protein, 9 aa, Influenza virus
GKISHISPL

SEQ ID NO: 441511 - protein, 9 aa, Influenza virus
GKITNKVNN

SEQ ID NO: 441512 - protein, 9 aa, Influenza virus
GKIVHIGPL

SEQ ID NO: 441513 - protein, 9 aa, Influenza virus
GKIVHISPL

SEQ ID NO: 441514 - protein, 9 aa, Influenza virus
GKIVHVSPL

SEQ ID NO: 441515 - protein, 9 aa, Influenza virus
GKKAVDLGS

SEQ ID NO: 441516 - protein, 9 aa, Influenza virus
GKKEEFSEI

SEQ ID NO: 441517 - protein, 9 aa, Influenza virus
GKKEFSEIM

SEQ ID NO: 441518 - protein, 9 aa, Influenza virus
GKKGKWLNQ

SEQ ID NO: 441519 - protein, 9 aa, Influenza virus
GKLCKLNGI

SEQ ID NO: 441520 - protein, 9 aa, Influenza virus
GKLCRLRGI

SEQ ID NO: 441521 - protein, 9 aa, Influenza virus
GKLCRLSGI

SEQ ID NO: 441522 - protein, 9 aa, Influenza virus
GKLEFIAEE

SEQ ID NO: 441523 - protein, 9 aa, Influenza virus
GKLKRRAIA

SEQ ID NO: 441524 - protein, 9 aa, Influenza virus
GKLNRFIEK

SEQ ID NO: 441525 - protein, 9 aa, Influenza virus
GKLNRIIEK

SEQ ID NO: 441526 - protein, 9 aa, Influenza virus
GKLNRLIDK

SEQ ID NO: 441527 - protein, 9 aa, Influenza virus
GKLNRLIDR

SEQ ID NO: 441528 - protein, 9 aa, Influenza virus
GKLNRLIEK

SEQ ID NO: 441529 - protein, 9 aa, Influenza virus
GKLNRLIER

SEQ ID NO: 441530 - protein, 9 aa, Influenza virus
GKLNRLIGK

SEQ ID NO: 441531 - protein, 9 aa, Influenza virus
GKLNRLISK

SEQ ID NO: 441532 - protein, 9 aa, Influenza virus
GKMNTQFEA

SEQ ID NO: 441533 - protein, 9 aa, Influenza virus
GKMRDSIKS

SEQ ID NO: 441534 - protein, 9 aa, Influenza virus
GKMTDSIKS

SEQ ID NO: 441535 - protein, 9 aa, Influenza virus
GKNADLEAL

SEQ ID NO: 441536 - protein, 9 aa, Influenza virus
GKNSDLEAL

SEQ ID NO: 441537 - protein, 9 aa, Influenza virus
GKNSFYAEL

SEQ ID NO: 441538 - protein, 9 aa, Influenza virus
GKNTDLEAL

SEQ ID NO: 441539 - protein, 9 aa, Influenza virus
GKNTDLEVL

SEQ ID NO: 441540 - protein, 9 aa, Influenza virus
GKPFQNVNR

SEQ ID NO: 441541 - protein, 9 aa, Influenza virus
GKQAKGLFG

SEQ ID NO: 441542 - protein, 9 aa, Influenza virus
GKQPISLGD

SEQ ID NO: 441543 - protein, 9 aa, Influenza virus
GKRGKWVKS

SEQ ID NO: 441544 - protein, 9 aa, Influenza virus
GKSDKICIG

SEQ ID NO: 441545 - protein, 9 aa, Influenza virus
GKSDRICIG

SEQ ID NO: 441546 - protein, 9 aa, Influenza virus
GKSGACKRA

SEQ ID NO: 441547 - protein, 9 aa, Influenza virus
GKSHGRILK

SEQ ID NO: 441548 - protein, 9 aa, Influenza virus
GKSHGRVLK

SEQ ID NO: 441549 - protein, 9 aa, Influenza virus
GKSLGIQSD

SEQ ID NO: 441550 - protein, 9 aa, Influenza virus
GKSSACKRA

SEQ ID NO: 441551 - protein, 9 aa, Influenza virus
GKTKATKME

SEQ ID NO: 441552 - protein, 9 aa, Influenza virus
GKTKATKMK

SEQ ID NO: 441553 - protein, 9 aa, Influenza virus
GKTLKWEPL

SEQ ID NO: 441554 - protein, 9 aa, Influenza virus
GKTNEKFHQ

SEQ ID NO: 441555 - protein, 9 aa, Influenza virus
GKTNQQFEL

SEQ ID NO: 441556 - protein, 9 aa, Influenza virus
GKTSWSYIV

SEQ ID NO: 441557 - protein, 9 aa, Influenza virus
GKVCRTLLA

SEQ ID NO: 441558 - protein, 9 aa, Influenza virus
GKVECICRD

SEQ ID NO: 441559 - protein, 9 aa, Influenza virus
GKVECVCRD

SEQ ID NO: 441560 - protein, 9 aa, Influenza virus
GKVVHISPL

SEQ ID NO: 441561 - protein, 9 aa, Influenza virus
GKWDTLIER

SEQ ID NO: 441562 - protein, 9 aa, Influenza virus
GKWREQLSQ

SEQ ID NO: 441563 - protein, 9 aa, Influenza virus
GLANLGLNI

SEQ ID NO: 441564 - protein, 9 aa, Influenza virus
GLANLGLNV

SEQ ID NO: 441565 - protein, 9 aa, Influenza virus
GLCTINSWH

SEQ ID NO: 441566 - protein, 9 aa, Influenza virus
GLCYPGELD

SEQ ID NO: 441567 - protein, 9 aa, Influenza virus
GLCYPGELN

SEQ ID NO: 441568 - protein, 9 aa, Influenza virus
GLCYPGSFN

SEQ ID NO: 441569 - protein, 9 aa, Influenza virus
GLDIRTATR

SEQ ID NO: 441570 - protein, 9 aa, Influenza virus
GLDKICLGH

SEQ ID NO: 441571 - protein, 9 aa, Influenza virus
GLDNEPGSE

SEQ ID NO: 441572 - protein, 9 aa, Influenza virus
GLDNEPGSG

SEQ ID NO: 441573 - protein, 9 aa, Influenza virus
GLDRICLGH

SEQ ID NO: 441574 - protein, 9 aa, Influenza virus
GLFENSCLE

SEQ ID NO: 441575 - protein, 9 aa, Influenza virus
GLFFFCLKN

SEQ ID NO: 441576 - protein, 9 aa, Influenza virus
GLFFWMCSN

SEQ ID NO: 441577 - protein, 9 aa, Influenza virus
GLFGAIAGF

SEQ ID NO: 441578 - protein, 9 aa, Influenza virus
GLFGAKAGF

SEQ ID NO: 441579 - protein, 9 aa, Influenza virus
GLFLWMCSN

SEQ ID NO: 441580 - protein, 9 aa, Influenza virus
GLGVKGFGF

SEQ ID NO: 441581 - protein, 9 aa, Influenza virus
GLHDANVRN

SEQ ID NO: 441582 - protein, 9 aa, Influenza virus
GLIAGWYGF

SEQ ID NO: 441583 - protein, 9 aa, Influenza virus
GLIAPDRVS

SEQ ID NO: 441584 - protein, 9 aa, Influenza virus
GLIAPRYGY

SEQ ID NO: 441585 - protein, 9 aa, Influenza virus
GLIAPSRVS

SEQ ID NO: 441586 - protein, 9 aa, Influenza virus
GLIAPSRVT

SEQ ID NO: 441587 - protein, 9 aa, Influenza virus
GLICATCEQ

SEQ ID NO: 441588 - protein, 9 aa, Influenza virus
GLIDGWYGF

SEQ ID NO: 441589 - protein, 9 aa, Influenza virus
GLIDGWYGY

SEQ ID NO: 441590 - protein, 9 aa, Influenza virus
GLIFMCVKN

SEQ ID NO: 441591 - protein, 9 aa, Influenza virus
GLILAFILW

SEQ ID NO: 441592 - protein, 9 aa, Influenza virus
GLILAFIMW

SEQ ID NO: 441593 - protein, 9 aa, Influenza virus
GLILGMQNG

SEQ ID NO: 441594 - protein, 9 aa, Influenza virus
GLILGNPKC

SEQ ID NO: 441595 - protein, 9 aa, Influenza virus
GLILSFIMW

SEQ ID NO: 441596 - protein, 9 aa, Influenza virus
GLILSNPKC

SEQ ID NO: 441597 - protein, 9 aa, Influenza virus
GLILTFIMW

SEQ ID NO: 441598 - protein, 9 aa, Influenza virus
GLINGWYGF

SEQ ID NO: 441599 - protein, 9 aa, Influenza virus
GLISTPLGS

SEQ ID NO: 441600 - protein, 9 aa, Influenza virus
GLISTPLGT

SEQ ID NO: 441601 - protein, 9 aa, Influenza virus
GLITDTIKS

SEQ ID NO: 441602 - protein, 9 aa, Influenza virus
GLIYGNPSC

SEQ ID NO: 441603 - protein, 9 aa, Influenza virus
GLIYNRMGA

SEQ ID NO: 441604 - protein, 9 aa, Influenza virus
GLIYNRMGT

SEQ ID NO: 441605 - protein, 9 aa, Influenza virus
GLKISSSFS

SEQ ID NO: 441606 - protein, 9 aa, Influenza virus
GLKVSLHLK

SEQ ID NO: 441607 - protein, 9 aa, Influenza virus
GLLAPKYGY

SEQ ID NO: 441608 - protein, 9 aa, Influenza virus
GLLAPRYGY

SEQ ID NO: 441609 - protein, 9 aa, Influenza virus
GLLDVWTYN

SEQ ID NO: 441610 - protein, 9 aa, Influenza virus
GLLEVGTRW

SEQ ID NO: 441611 - protein, 9 aa, Influenza virus
GLLGAIAGF

SEQ ID NO: 441612 - protein, 9 aa, Influenza virus
GLLGIITGP

SEQ ID NO: 441613 - protein, 9 aa, Influenza virus
GLLGILIGP

SEQ ID NO: 441614 - protein, 9 aa, Influenza virus
GLLGTITGP

SEQ ID NO: 441615 - protein, 9 aa, Influenza virus
GLLGTLIGP

SEQ ID NO: 441616 - protein, 9 aa, Influenza virus
GLLGTLTGP

SEQ ID NO: 441617 - protein, 9 aa, Influenza virus
GLLGTVTGP

SEQ ID NO: 441618 - protein, 9 aa, Influenza virus
GLLISDGGP

SEQ ID NO: 441619 - protein, 9 aa, Influenza virus
GLLLQIISL

SEQ ID NO: 441620 - protein, 9 aa, Influenza virus
GLLLQITSL

SEQ ID NO: 441621 - protein, 9 aa, Influenza virus
GLLLQVTSL

SEQ ID NO: 441622 - protein, 9 aa, Influenza virus
GLLLWMCSN

SEQ ID NO: 441623 - protein, 9 aa, Influenza virus
GLLVADGGP

SEQ ID NO: 441624 - protein, 9 aa, Influenza virus
GLLVALENQ

SEQ ID NO: 441625 - protein, 9 aa, Influenza virus
GLLVSDGGP

SEQ ID NO: 441626 - protein, 9 aa, Influenza virus
GLMGRTRIS

SEQ ID NO: 441627 - protein, 9 aa, Influenza virus
GLMSTPLGS

SEQ ID NO: 441628 - protein, 9 aa, Influenza virus
GLNIGLHLK

SEQ ID NO: 441629 - protein, 9 aa, Influenza virus
GLNIGLHLR

SEQ ID NO: 441630 - protein, 9 aa, Influenza virus
GLNISLHLK

SEQ ID NO: 441631 - protein, 9 aa, Influenza virus
GLNMSLHLK

SEQ ID NO: 441632 - protein, 9 aa, Influenza virus
GLNNEPGSG

SEQ ID NO: 441633 - protein, 9 aa, Influenza virus
GLNVGLHLK

SEQ ID NO: 441634 - protein, 9 aa, Influenza virus
GLNVSLHLK

SEQ ID NO: 441635 - protein, 9 aa, Influenza virus
GLNVSLHLR

SEQ ID NO: 441636 - protein, 9 aa, Influenza virus
GLPQSGRIV

SEQ ID NO: 441637 - protein, 9 aa, Influenza virus
GLPSDTPRG

SEQ ID NO: 441638 - protein, 9 aa, Influenza virus
GLPVGGNEK

SEQ ID NO: 441639 - protein, 9 aa, Influenza virus
GLQRRRFIQ

SEQ ID NO: 441640 - protein, 9 aa, Influenza virus
GLQRRRFVQ

SEQ ID NO: 441641 - protein, 9 aa, Influenza virus
GLQSSDDFA

SEQ ID NO: 441642 - protein, 9 aa, Influenza virus
GLREQKQEF

SEQ ID NO: 441643 - protein, 9 aa, Influenza virus
GLRILIRGN

SEQ ID NO: 441644 - protein, 9 aa, Influenza virus
GLRILVRGN

SEQ ID NO: 441645 - protein, 9 aa, Influenza virus
GLRISSSFS

SEQ ID NO: 441646 - protein, 9 aa, Influenza virus
GLRNIPAIA

SEQ ID NO: 441647 - protein, 9 aa, Influenza virus
GLRNIPQIE

SEQ ID NO: 441648 - protein, 9 aa, Influenza virus
GLRNIPSIQ

SEQ ID NO: 441649 - protein, 9 aa, Influenza virus
GLRNTPSID

SEQ ID NO: 441650 - protein, 9 aa, Influenza virus
GLRNTPSIE

SEQ ID NO: 441651 - protein, 9 aa, Influenza virus
GLRNTPSVE

SEQ ID NO: 441652 - protein, 9 aa, Influenza virus
GLRNVPAIA

SEQ ID NO: 441653 - protein, 9 aa, Influenza virus
GLRNVPAIS

SEQ ID NO: 441654 - protein, 9 aa, Influenza virus
GLRNVPAIT

SEQ ID NO: 441655 - protein, 9 aa, Influenza virus
GLRNVPQAQ

SEQ ID NO: 441656 - protein, 9 aa, Influenza virus
GLRNVPQIE

SEQ ID NO: 441657 - protein, 9 aa, Influenza virus
GLRNVPQIQ

SEQ ID NO: 441658 - protein, 9 aa, Influenza virus
GLRNVPQME

SEQ ID NO: 441659 - protein, 9 aa, Influenza virus
GLRNVPQVQ

SEQ ID NO: 441660 - protein, 9 aa, Influenza virus
GLRNVPSIQ

SEQ ID NO: 441661 - protein, 9 aa, Influenza virus
GLSFWMCSN

SEQ ID NO: 441662 - protein, 9 aa, Influenza virus
GLSLWMCFN

SEQ ID NO: 441663 - protein, 9 aa, Influenza virus
GLSLWMCSN

SEQ ID NO: 441664 - protein, 9 aa, Influenza virus
GLSMVKSDK

SEQ ID NO: 441665 - protein, 9 aa, Influenza virus
GLSMVRSDK

SEQ ID NO: 441666 - protein, 9 aa, Influenza virus
GLSPNVYQA

SEQ ID NO: 441667 - protein, 9 aa, Influenza virus
GLSSRISFY

SEQ ID NO: 441668 - protein, 9 aa, Influenza virus
GLTHIMIWH

SEQ ID NO: 441669 - protein, 9 aa, Influenza virus
GLTHLMIWH

SEQ ID NO: 441670 - protein, 9 aa, Influenza virus
GLTHMMIWH

SEQ ID NO: 441671 - protein, 9 aa, Influenza virus
GLVAGWYGF

SEQ ID NO: 441672 - protein, 9 aa, Influenza virus
GLVCATCEQ

SEQ ID NO: 441673 - protein, 9 aa, Influenza virus
GLVDGWYGF

SEQ ID NO: 441674 - protein, 9 aa, Influenza virus
GLVDGWYGY

SEQ ID NO: 441675 - protein, 9 aa, Influenza virus
GLVFFCLKN

SEQ ID NO: 441676 - protein, 9 aa, Influenza virus
GLVFFCLRN

SEQ ID NO: 441677 - protein, 9 aa, Influenza virus
GLVFICIKN

SEQ ID NO: 441678 - protein, 9 aa, Influenza virus
GLVFICVKN

SEQ ID NO: 441679 - protein, 9 aa, Influenza virus
GLVFMCVKN

SEQ ID NO: 441680 - protein, 9 aa, Influenza virus
GLVGDTPRD

SEQ ID NO: 441681 - protein, 9 aa, Influenza virus
GLVGDTPRE

SEQ ID NO: 441682 - protein, 9 aa, Influenza virus
GLVGDTPRK

SEQ ID NO: 441683 - protein, 9 aa, Influenza virus
GLVGDTPRN

SEQ ID NO: 441684 - protein, 9 aa, Influenza virus
GLVGDTPRS

SEQ ID NO: 441685 - protein, 9 aa, Influenza virus
GLVGDTPRT

SEQ ID NO: 441686 - protein, 9 aa, Influenza virus
GLVLGNPKC

SEQ ID NO: 441687 - protein, 9 aa, Influenza virus
GLVLGNPMC

SEQ ID NO: 441688 - protein, 9 aa, Influenza virus
GLVNLGLNI

SEQ ID NO: 441689 - protein, 9 aa, Influenza virus
GLVYGNPAC

SEQ ID NO: 441690 - protein, 9 aa, Influenza virus
GLVYGNPSC

SEQ ID NO: 441691 - protein, 9 aa, Influenza virus
GLWAYNAEL

SEQ ID NO: 441692 - protein, 9 aa, Influenza virus
GLWDPFRQS

SEQ ID NO: 441693 - protein, 9 aa, Influenza virus
GLWDSFRQS

SEQ ID NO: 441694 - protein, 9 aa, Influenza virus
GLYDAIEEC

SEQ ID NO: 441695 - protein, 9 aa, Influenza virus
GLYEAIEEC

SEQ ID NO: 441696 - protein, 9 aa, Influenza virus
GLYESIEEC

SEQ ID NO: 441697 - protein, 9 aa, Influenza virus
GLYGAIEEC

SEQ ID NO: 441698 - protein, 9 aa, Influenza virus
GMAADKEST

SEQ ID NO: 441699 - protein, 9 aa, Influenza virus
GMAADQKST

SEQ ID NO: 441700 - protein, 9 aa, Influenza virus
GMAADRDST

SEQ ID NO: 441701 - protein, 9 aa, Influenza virus
GMALSVVSL

SEQ ID NO: 441702 - protein, 9 aa, Influenza virus
GMCYPGFVE

SEQ ID NO: 441703 - protein, 9 aa, Influenza virus
GMCYPGSIE

SEQ ID NO: 441704 - protein, 9 aa, Influenza virus
GMCYPGSVE

SEQ ID NO: 441705 - protein, 9 aa, Influenza virus
GMDPRMCSL

SEQ ID NO: 441706 - protein, 9 aa, Influenza virus
GMEEGSIGK

SEQ ID NO: 441707 - protein, 9 aa, Influenza virus
GMELRRCLL

SEQ ID NO: 441708 - protein, 9 aa, Influenza virus
GMEMRRCLL

SEQ ID NO: 441709 - protein, 9 aa, Influenza virus
GMFNMLSTV

SEQ ID NO: 441710 - protein, 9 aa, Influenza virus
GMGMAADKE

SEQ ID NO: 441711 - protein, 9 aa, Influenza virus
GMGQAADLK

SEQ ID NO: 441712 - protein, 9 aa, Influenza virus
GMGQAPSPY

SEQ ID NO: 441713 - protein, 9 aa, Influenza virus
GMIDGWYGF

SEQ ID NO: 441714 - protein, 9 aa, Influenza virus
GMIDGWYGY

SEQ ID NO: 441715 - protein, 9 aa, Influenza virus
GMILSVVSL

SEQ ID NO: 441716 - protein, 9 aa, Influenza virus
GMITDTIKS

SEQ ID NO: 441717 - protein, 9 aa, Influenza virus
GMKNVPEIP

SEQ ID NO: 441718 - protein, 9 aa, Influenza virus
GMKNVPEKI

SEQ ID NO: 441719 - protein, 9 aa, Influenza virus
GMKNVPETP

SEQ ID NO: 441720 - protein, 9 aa, Influenza virus
GMLGFVFTL

SEQ ID NO: 441721 - protein, 9 aa, Influenza virus
GMMDGWYGF

SEQ ID NO: 441722 - protein, 9 aa, Influenza virus
GMMMGMFNM

SEQ ID NO: 441723 - protein, 9 aa, Influenza virus
GMPESMREE

SEQ ID NO: 441724 - protein, 9 aa, Influenza virus
GMPTDVVRS

SEQ ID NO: 441725 - protein, 9 aa, Influenza virus
GMQIRGFVH

SEQ ID NO: 441726 - protein, 9 aa, Influenza virus
GMQIRGFVY

SEQ ID NO: 441727 - protein, 9 aa, Influenza virus
GMQNGSCRC

SEQ ID NO: 441728 - protein, 9 aa, Influenza virus
GMQNGSYRC

SEQ ID NO: 441729 - protein, 9 aa, Influenza virus
GMRILIRGN

SEQ ID NO: 441730 - protein, 9 aa, Influenza virus
GMRILVRGN

SEQ ID NO: 441731 - protein, 9 aa, Influenza virus
GMRNIPEKP

SEQ ID NO: 441732 - protein, 9 aa, Influenza virus
GMRNIPEKQ

SEQ ID NO: 441733 - protein, 9 aa, Influenza virus
GMRNIPENP

SEQ ID NO: 441734 - protein, 9 aa, Influenza virus
GMRNIPERQ

SEQ ID NO: 441735 - protein, 9 aa, Influenza virus
GMRNIPGKQ

SEQ ID NO: 441736 - protein, 9 aa, Influenza virus
GMRNVPEKP

SEQ ID NO: 441737 - protein, 9 aa, Influenza virus
GMRNVPEKQ

SEQ ID NO: 441738 - protein, 9 aa, Influenza virus
GMRNVPENP

SEQ ID NO: 441739 - protein, 9 aa, Influenza virus
GMRNVPERQ

SEQ ID NO: 441740 - protein, 9 aa, Influenza virus
GMRNVPETQ

SEQ ID NO: 441741 - protein, 9 aa, Influenza virus
GMSANGDIL

SEQ ID NO: 441742 - protein, 9 aa, Influenza virus
GMTLSVVSL

SEQ ID NO: 441743 - protein, 9 aa, Influenza virus
GMVDGWYGF

SEQ ID NO: 441744 - protein, 9 aa, Influenza virus
GMVDGWYGY

SEQ ID NO: 441745 - protein, 9 aa, Influenza virus
GMVNGWYGF

SEQ ID NO: 441746 - protein, 9 aa, Influenza virus
GMVNGWYGY

SEQ ID NO: 441747 - protein, 9 aa, Influenza virus
GMWDTLIER

SEQ ID NO: 441748 - protein, 9 aa, Influenza virus
GNAEGRTSD

SEQ ID NO: 441749 - protein, 9 aa, Influenza virus
GNAEIEDLI

SEQ ID NO: 441750 - protein, 9 aa, Influenza virus
GNAEIEDLT

SEQ ID NO: 441751 - protein, 9 aa, Influenza virus
GNAKDEGNG

SEQ ID NO: 441752 - protein, 9 aa, Influenza virus
GNAQHIEEC

SEQ ID NO: 441753 - protein, 9 aa, Influenza virus
GNAQHVEEC

SEQ ID NO: 441754 - protein, 9 aa, Influenza virus
GNASGKADT

SEQ ID NO: 441755 - protein, 9 aa, Influenza virus
GNAWLHVCV

SEQ ID NO: 441756 - protein, 9 aa, Influenza virus
GNCDAKCQT

SEQ ID NO: 441757 - protein, 9 aa, Influenza virus
GNCDTKCQT

SEQ ID NO: 441758 - protein, 9 aa, Influenza virus
GNCNAKCQT

SEQ ID NO: 441759 - protein, 9 aa, Influenza virus
GNCNTKCQT

SEQ ID NO: 441760 - protein, 9 aa, Influenza virus
GNCPKYIKS

SEQ ID NO: 441761 - protein, 9 aa, Influenza virus
GNCPKYVKQ

SEQ ID NO: 441762 - protein, 9 aa, Influenza virus
GNCRFNVCI

SEQ ID NO: 441763 - protein, 9 aa, Influenza virus
GNCRFSVCI

SEQ ID NO: 441764 - protein, 9 aa, Influenza virus
GNCSIAGWL

SEQ ID NO: 441765 - protein, 9 aa, Influenza virus
GNCYWVMTD

SEQ ID NO: 441766 - protein, 9 aa, Influenza virus
GNDIWMGRT

SEQ ID NO: 441767 - protein, 9 aa, Influenza virus
GNDLWMGRT

SEQ ID NO: 441768 - protein, 9 aa, Influenza virus
GNDNWSGYS

SEQ ID NO: 441769 - protein, 9 aa, Influenza virus
GNDVWLGRT

SEQ ID NO: 441770 - protein, 9 aa, Influenza virus
GNDVWMGRT

SEQ ID NO: 441771 - protein, 9 aa, Influenza virus
GNEKKAKLA

SEQ ID NO: 441772 - protein, 9 aa, Influenza virus
GNFIAPENA

SEQ ID NO: 441773 - protein, 9 aa, Influenza virus
GNFIAPEYA

SEQ ID NO: 441774 - protein, 9 aa, Influenza virus
GNFNDYEEL

SEQ ID NO: 441775 - protein, 9 aa, Influenza virus
GNGAWIGRT

SEQ ID NO: 441776 - protein, 9 aa, Influenza virus
GNGCFDILH

SEQ ID NO: 441777 - protein, 9 aa, Influenza virus
GNGCFEFWH

SEQ ID NO: 441778 - protein, 9 aa, Influenza virus
GNGCFEFYH

SEQ ID NO: 441779 - protein, 9 aa, Influenza virus
GNGCFEIFH

SEQ ID NO: 441780 - protein, 9 aa, Influenza virus
GNGCFELLH

SEQ ID NO: 441781 - protein, 9 aa, Influenza virus
GNGCFELYH

SEQ ID NO: 441782 - protein, 9 aa, Influenza virus
GNGCFKIYH

SEQ ID NO: 441783 - protein, 9 aa, Influenza virus
GNGCFTFYH

SEQ ID NO: 441784 - protein, 9 aa, Influenza virus
GNGCFTIYH

SEQ ID NO: 441785 - protein, 9 aa, Influenza virus
GNGCLKIYH

SEQ ID NO: 441786 - protein, 9 aa, Influenza virus
GNGDPNNMD

SEQ ID NO: 441787 - protein, 9 aa, Influenza virus
GNGNKLITV

SEQ ID NO: 441788 - protein, 9 aa, Influenza virus
GNGSCRCTI

SEQ ID NO: 441789 - protein, 9 aa, Influenza virus
GNGVWIGRT

SEQ ID NO: 441790 - protein, 9 aa, Influenza virus
GNGVWMGRT

SEQ ID NO: 441791 - protein, 9 aa, Influenza virus
GNHGSLVLS

SEQ ID NO: 441792 - protein, 9 aa, Influenza virus
GNHGVKGWA

SEQ ID NO: 441793 - protein, 9 aa, Influenza virus
GNIIFLWGI

SEQ ID NO: 441794 - protein, 9 aa, Influenza virus
GNIKCNICI

SEQ ID NO: 441795 - protein, 9 aa, Influenza virus
GNILLSPEE

SEQ ID NO: 441796 - protein, 9 aa, Influenza virus
GNILRTQES

SEQ ID NO: 441797 - protein, 9 aa, Influenza virus
GNIMRTQES

SEQ ID NO: 441798 - protein, 9 aa, Influenza virus
GNIRCDICI

SEQ ID NO: 441799 - protein, 9 aa, Influenza virus
GNIRCNICI

SEQ ID NO: 441800 - protein, 9 aa, Influenza virus
GNIRCQICI

SEQ ID NO: 441801 - protein, 9 aa, Influenza virus
GNIRCTFCI

SEQ ID NO: 441802 - protein, 9 aa, Influenza virus
GNIWITREP

SEQ ID NO: 441803 - protein, 9 aa, Influenza virus
GNIYKILSI

SEQ ID NO: 441804 - protein, 9 aa, Influenza virus
GNKLITVGS

SEQ ID NO: 441805 - protein, 9 aa, Influenza virus
GNLAFNAVI

SEQ ID NO: 441806 - protein, 9 aa, Influenza virus
GNLAFNTVI

SEQ ID NO: 441807 - protein, 9 aa, Influenza virus
GNLERRLEN

SEQ ID NO: 441808 - protein, 9 aa, Influenza virus
GNLIAPEFG

SEQ ID NO: 441809 - protein, 9 aa, Influenza virus
GNLIAPEYG

SEQ ID NO: 441810 - protein, 9 aa, Influenza virus
GNLIAPLYG

SEQ ID NO: 441811 - protein, 9 aa, Influenza virus
GNLIAPRGH

SEQ ID NO: 441812 - protein, 9 aa, Influenza virus
GNLIAPRGY

SEQ ID NO: 441813 - protein, 9 aa, Influenza virus
GNLIAPWFG

SEQ ID NO: 441814 - protein, 9 aa, Influenza virus
GNLIAPWYA

SEQ ID NO: 441815 - protein, 9 aa, Influenza virus
GNLIAPWYG

SEQ ID NO: 441816 - protein, 9 aa, Influenza virus
GNLIFNAVI

SEQ ID NO: 441817 - protein, 9 aa, Influenza virus
GNLIFNTVI

SEQ ID NO: 441818 - protein, 9 aa, Influenza virus
GNLIVFNTI

SEQ ID NO: 441819 - protein, 9 aa, Influenza virus
GNLNKKMED

SEQ ID NO: 441820 - protein, 9 aa, Influenza virus
GNLRCQICI

SEQ ID NO: 441821 - protein, 9 aa, Influenza virus
GNLRCTICI

SEQ ID NO: 441822 - protein, 9 aa, Influenza virus
GNLVAPEYG

SEQ ID NO: 441823 - protein, 9 aa, Influenza virus
GNLVAPRGH

SEQ ID NO: 441824 - protein, 9 aa, Influenza virus
GNLVAPRGY

SEQ ID NO: 441825 - protein, 9 aa, Influenza virus
GNLVAPWYA

SEQ ID NO: 441826 - protein, 9 aa, Influenza virus
GNLVFNTVI

SEQ ID NO: 441827 - protein, 9 aa, Influenza virus
GNMQCTICI

SEQ ID NO: 441828 - protein, 9 aa, Influenza virus
GNMRCTICI

SEQ ID NO: 441829 - protein, 9 aa, Influenza virus
GNMRCTSCI

SEQ ID NO: 441830 - protein, 9 aa, Influenza virus
GNMRGTNWI

SEQ ID NO: 441831 - protein, 9 aa, Influenza virus
GNNBNGVKG

SEQ ID NO: 441832 - protein, 9 aa, Influenza virus
GNNCIESIR

SEQ ID NO: 441833 - protein, 9 aa, Influenza virus
GNNDNATAT

SEQ ID NO: 441834 - protein, 9 aa, Influenza virus
GNNEGRTSD

SEQ ID NO: 441835 - protein, 9 aa, Influenza virus
GNNENATAT

SEQ ID NO: 441836 - protein, 9 aa, Influenza virus
GNNKNATAT

SEQ ID NO: 441837 - protein, 9 aa, Influenza virus
GNNNGVKGF

SEQ ID NO: 441838 - protein, 9 aa, Influenza virus
GNNNNATAT

SEQ ID NO: 441839 - protein, 9 aa, Influenza virus
GNNNNGVKG

SEQ ID NO: 441840 - protein, 9 aa, Influenza virus
GNNQVFPQL

SEQ ID NO: 441841 - protein, 9 aa, Influenza virus
GNPDPGVKG

SEQ ID NO: 441842 - protein, 9 aa, Influenza virus
GNPECDILL

SEQ ID NO: 441843 - protein, 9 aa, Influenza virus
GNPECDLFL

SEQ ID NO: 441844 - protein, 9 aa, Influenza virus
GNPECDLLL

SEQ ID NO: 441845 - protein, 9 aa, Influenza virus
GNPECDRLL

SEQ ID NO: 441846 - protein, 9 aa, Influenza virus
GNPEGRTSD

SEQ ID NO: 441847 - protein, 9 aa, Influenza virus
GNPGVKGWA

SEQ ID NO: 441848 - protein, 9 aa, Influenza virus
GNPIICLGH

SEQ ID NO: 441849 - protein, 9 aa, Influenza virus
GNPKCDIHL

SEQ ID NO: 441850 - protein, 9 aa, Influenza virus
GNPKCDLYL

SEQ ID NO: 441851 - protein, 9 aa, Influenza virus
GNPKCDPYL

SEQ ID NO: 441852 - protein, 9 aa, Influenza virus
GNPKCDRLL

SEQ ID NO: 441853 - protein, 9 aa, Influenza virus
GNPKCDTHL

SEQ ID NO: 441854 - protein, 9 aa, Influenza virus
GNPKCDVHL

SEQ ID NO: 441855 - protein, 9 aa, Influenza virus
GNPMCDDLI

SEQ ID NO: 441856 - protein, 9 aa, Influenza virus
GNPMCDELI

SEQ ID NO: 441857 - protein, 9 aa, Influenza virus
GNPMCDNLI

SEQ ID NO: 441858 - protein, 9 aa, Influenza virus
GNPMCDYLI

SEQ ID NO: 441859 - protein, 9 aa, Influenza virus
GNPRCDDLI

SEQ ID NO: 441860 - protein, 9 aa, Influenza virus
GNPSCASNI

SEQ ID NO: 441861 - protein, 9 aa, Influenza virus
GNPSCATNI

SEQ ID NO: 441862 - protein, 9 aa, Influenza virus
GNPVICLGH

SEQ ID NO: 441863 - protein, 9 aa, Influenza virus
GNPVICMGH

SEQ ID NO: 441864 - protein, 9 aa, Influenza virus
GNQGVKGWA

SEQ ID NO: 441865 - protein, 9 aa, Influenza virus
GNQKTLDEH

SEQ ID NO: 441866 - protein, 9 aa, Influenza virus
GNSARLIHH

SEQ ID NO: 441867 - protein, 9 aa, Influenza virus
GNSDVLVTR

SEQ ID NO: 441868 - protein, 9 aa, Influenza virus
GNSEGRTSD

SEQ ID NO: 441869 - protein, 9 aa, Influenza virus
GNSFYAELK

SEQ ID NO: 441870 - protein, 9 aa, Influenza virus
GNSGVKGWA

SEQ ID NO: 441871 - protein, 9 aa, Influenza virus
GNSNNGVKG

SEQ ID NO: 441872 - protein, 9 aa, Influenza virus
GNSPAFNYN

SEQ ID NO: 441873 - protein, 9 aa, Influenza virus
GNSPIFNYN

SEQ ID NO: 441874 - protein, 9 aa, Influenza virus
GNSPVFNYN

SEQ ID NO: 441875 - protein, 9 aa, Influenza virus
GNSVWAGRT

SEQ ID NO: 441876 - protein, 9 aa, Influenza virus
GNTEGRTSD

SEQ ID NO: 441877 - protein, 9 aa, Influenza virus
GNTWLGRTI

SEQ ID NO: 441878 - protein, 9 aa, Influenza virus
GNTYVNNTT

SEQ ID NO: 441879 - protein, 9 aa, Influenza virus
GNVINWTKD

SEQ ID NO: 441880 - protein, 9 aa, Influenza virus
GNVINWTQD

SEQ ID NO: 441881 - protein, 9 aa, Influenza virus
GNVINWTRD

SEQ ID NO: 441882 - protein, 9 aa, Influenza virus
GNVLDGVTA

SEQ ID NO: 441883 - protein, 9 aa, Influenza virus
GNVLLSPEE

SEQ ID NO: 441884 - protein, 9 aa, Influenza virus
GNVRCQICI

SEQ ID NO: 441885 - protein, 9 aa, Influenza virus
GNVRCTFCI

SEQ ID NO: 441886 - protein, 9 aa, Influenza virus
GNVYKILSI

SEQ ID NO: 441887 - protein, 9 aa, Influenza virus
GNWPDGANI

SEQ ID NO: 441888 - protein, 9 aa, Influenza virus
GNWPDGSNI

SEQ ID NO: 441889 - protein, 9 aa, Influenza virus
GNYARLYIW

SEQ ID NO: 441890 - protein, 9 aa, Influenza virus
GNYDSIRGE

SEQ ID NO: 441891 - protein, 9 aa, Influenza virus
GNYGPINVT

SEQ ID NO: 441892 - protein, 9 aa, Influenza virus
GNYKEICIA

SEQ ID NO: 441893 - protein, 9 aa, Influenza virus
GNYKEICVA

SEQ ID NO: 441894 - protein, 9 aa, Influenza virus
GNYKEMCAA

SEQ ID NO: 441895 - protein, 9 aa, Influenza virus
GNYREICIA

SEQ ID NO: 441896 - protein, 9 aa, Influenza virus
GNYREVCIA

SEQ ID NO: 441897 - protein, 9 aa, Influenza virus
GPAANNADH

SEQ ID NO: 441898 - protein, 9 aa, Influenza virus
GPAANSADH

SEQ ID NO: 441899 - protein, 9 aa, Influenza virus
GPAANSAHH

SEQ ID NO: 441900 - protein, 9 aa, Influenza virus
GPADTRIYY

SEQ ID NO: 441901 - protein, 9 aa, Influenza virus
GPADTRVYY

SEQ ID NO: 441902 - protein, 9 aa, Influenza virus
GPAECRTFF

SEQ ID NO: 441903 - protein, 9 aa, Influenza virus
GPAETRIYY

SEQ ID NO: 441904 - protein, 9 aa, Influenza virus
GPAETRVYY

SEQ ID NO: 441905 - protein, 9 aa, Influenza virus
GPALSINEL

SEQ ID NO: 441906 - protein, 9 aa, Influenza virus
GPALSISEL

SEQ ID NO: 441907 - protein, 9 aa, Influenza virus
GPANKQASY

SEQ ID NO: 441908 - protein, 9 aa, Influenza virus
GPANNQASY

SEQ ID NO: 441909 - protein, 9 aa, Influenza virus
GPANSQASY

SEQ ID NO: 441910 - protein, 9 aa, Influenza virus
GPANSQAYT

SEQ ID NO: 441911 - protein, 9 aa, Influenza virus
GPASNQASY

SEQ ID NO: 441912 - protein, 9 aa, Influenza virus
GPATAQMAL

SEQ ID NO: 441913 - protein, 9 aa, Influenza virus
GPDATAVAV

SEQ ID NO: 441914 - protein, 9 aa, Influenza virus
GPDDGAVAV

SEQ ID NO: 441915 - protein, 9 aa, Influenza virus
GPDNEAVAV

SEQ ID NO: 441916 - protein, 9 aa, Influenza virus
GPDNGAVAV

SEQ ID NO: 441917 - protein, 9 aa, Influenza virus
GPDPGVKGF

SEQ ID NO: 441918 - protein, 9 aa, Influenza virus
GPDSGAVAV

SEQ ID NO: 441919 - protein, 9 aa, Influenza virus
GPDSTAVAV

SEQ ID NO: 441920 - protein, 9 aa, Influenza virus
GPDSVLVNT

SEQ ID NO: 441921 - protein, 9 aa, Influenza virus
GPDTTAVAV

SEQ ID NO: 441922 - protein, 9 aa, Influenza virus
GPESVLINT

SEQ ID NO: 441923 - protein, 9 aa, Influenza virus
GPESVLVNT

SEQ ID NO: 441924 - protein, 9 aa, Influenza virus
GPGSFPDGA

SEQ ID NO: 441925 - protein, 9 aa, Influenza virus
GPGVKGFGF

SEQ ID NO: 441926 - protein, 9 aa, Influenza virus
GPGWLTIGI

SEQ ID NO: 441927 - protein, 9 aa, Influenza virus
GPGWLTLGI

SEQ ID NO: 441928 - protein, 9 aa, Influenza virus
GPILSFIMW

SEQ ID NO: 441929 - protein, 9 aa, Influenza virus
GPINNGKGR

SEQ ID NO: 441930 - protein, 9 aa, Influenza virus
GPINVTKEN

SEQ ID NO: 441931 - protein, 9 aa, Influenza virus
GPLKAEIAQ

SEQ ID NO: 441932 - protein, 9 aa, Influenza virus
GPLSGSAQH

SEQ ID NO: 441933 - protein, 9 aa, Influenza virus
GPNDNASAV

SEQ ID NO: 441934 - protein, 9 aa, Influenza virus
GPNLYNIRN

SEQ ID NO: 441935 - protein, 9 aa, Influenza virus
GPNNNASAI

SEQ ID NO: 441936 - protein, 9 aa, Influenza virus
GPNNNASAV

SEQ ID NO: 441937 - protein, 9 aa, Influenza virus
GPPHCDQFL

SEQ ID NO: 441938 - protein, 9 aa, Influenza virus
GPPQCDKFL

SEQ ID NO: 441939 - protein, 9 aa, Influenza virus
GPPQCDLFL

SEQ ID NO: 441940 - protein, 9 aa, Influenza virus
GPPQCDLHL

SEQ ID NO: 441941 - protein, 9 aa, Influenza virus
GPPQCDQFL

SEQ ID NO: 441942 - protein, 9 aa, Influenza virus
GPPQCDRFL

SEQ ID NO: 441943 - protein, 9 aa, Influenza virus
GPPQCDSHL

SEQ ID NO: 441944 - protein, 9 aa, Influenza virus
GPRALVRGQ

SEQ ID NO: 441945 - protein, 9 aa, Influenza virus
GPRNVPAIA

SEQ ID NO: 441946 - protein, 9 aa, Influenza virus
GPRNVPQAQ

SEQ ID NO: 441947 - protein, 9 aa, Influenza virus
GPRNVPQIE

SEQ ID NO: 441948 - protein, 9 aa, Influenza virus
GPRNVPQVQ

SEQ ID NO: 441949 - protein, 9 aa, Influenza virus
GPRPFVRGQ

SEQ ID NO: 441950 - protein, 9 aa, Influenza virus
GPRPLIRGQ

SEQ ID NO: 441951 - protein, 9 aa, Influenza virus
GPRPLVMGQ

SEQ ID NO: 441952 - protein, 9 aa, Influenza virus
GPRPLVREQ

SEQ ID NO: 441953 - protein, 9 aa, Influenza virus
GPRPLVRGQ

SEQ ID NO: 441954 - protein, 9 aa, Influenza virus
GPSDAQAFY

SEQ ID NO: 441955 - protein, 9 aa, Influenza virus
GPSECRTFF

SEQ ID NO: 441956 - protein, 9 aa, Influenza virus
GPSFYAEMK

SEQ ID NO: 441957 - protein, 9 aa, Influenza virus
GPSHSIHTG

SEQ ID NO: 441958 - protein, 9 aa, Influenza virus
GPSNAQAFY

SEQ ID NO: 441959 - protein, 9 aa, Influenza virus
GPTECRTFF

SEQ ID NO: 441960 - protein, 9 aa, Influenza virus
GPVHFQNQV

SEQ ID NO: 441961 - protein, 9 aa, Influenza virus
GPVHFRNQI

SEQ ID NO: 441962 - protein, 9 aa, Influenza virus
GPVHFRNQV

SEQ ID NO: 441963 - protein, 9 aa, Influenza virus
GPVHFRSQV

SEQ ID NO: 441964 - protein, 9 aa, Influenza virus
GPWVRGQSG

SEQ ID NO: 441965 - protein, 9 aa, Influenza virus
GQAADLKST

SEQ ID NO: 441966 - protein, 9 aa, Influenza virus
GQAADYEST

SEQ ID NO: 441967 - protein, 9 aa, Influenza virus
GQAADYKST

SEQ ID NO: 441968 - protein, 9 aa, Influenza virus
GQAFYKILK

SEQ ID NO: 441969 - protein, 9 aa, Influenza virus
GQAFYRSIN

SEQ ID NO: 441970 - protein, 9 aa, Influenza virus
GQAGRIDFH

SEQ ID NO: 441971 - protein, 9 aa, Influenza virus
GQAGRMTFY

SEQ ID NO: 441972 - protein, 9 aa, Influenza virus
GQCGILGIL

SEQ ID NO: 441973 - protein, 9 aa, Influenza virus
GQCGLLGII

SEQ ID NO: 441974 - protein, 9 aa, Influenza virus
GQCGLLGTI

SEQ ID NO: 441975 - protein, 9 aa, Influenza virus
GQCGLLGTL

SEQ ID NO: 441976 - protein, 9 aa, Influenza virus
GQCGLLGTV

SEQ ID NO: 441977 - protein, 9 aa, Influenza virus
GQCPKYVKK

SEQ ID NO: 441978 - protein, 9 aa, Influenza virus
GQCPKYVNK

SEQ ID NO: 441979 - protein, 9 aa, Influenza virus
GQCPKYVNQ

SEQ ID NO: 441980 - protein, 9 aa, Influenza virus
GQCPKYVSK

SEQ ID NO: 441981 - protein, 9 aa, Influenza virus
GQCPKYVSQ

SEQ ID NO: 441982 - protein, 9 aa, Influenza virus
GQDCDLING

SEQ ID NO: 441983 - protein, 9 aa, Influenza virus
GQFGRIDFH

SEQ ID NO: 441984 - protein, 9 aa, Influenza virus
GQFGRINFH

SEQ ID NO: 441985 - protein, 9 aa, Influenza virus
GQFPVQTDE

SEQ ID NO: 441986 - protein, 9 aa, Influenza virus
GQGDIVLVM

SEQ ID NO: 441987 - protein, 9 aa, Influenza virus
GQGDVVLVM

SEQ ID NO: 441988 - protein, 9 aa, Influenza virus
GQGSGYAAD

SEQ ID NO: 441989 - protein, 9 aa, Influenza virus
GQGTAADYK

SEQ ID NO: 441990 - protein, 9 aa, Influenza virus
GQGTTLDNE

SEQ ID NO: 441991 - protein, 9 aa, Influenza virus
GQGTTLDNK

SEQ ID NO: 441992 - protein, 9 aa, Influenza virus
GQGTTLENK

SEQ ID NO: 441993 - protein, 9 aa, Influenza virus
GQGTTLNNK

SEQ ID NO: 441994 - protein, 9 aa, Influenza virus
GQGTTLYNK

SEQ ID NO: 441995 - protein, 9 aa, Influenza virus
GQHANGTIH

SEQ ID NO: 441996 - protein, 9 aa, Influenza virus
GQIIVLNTD

SEQ ID NO: 441997 - protein, 9 aa, Influenza virus
GQKSWMKIY

SEQ ID NO: 441998 - protein, 9 aa, Influenza virus
GQKSWTKIY

SEQ ID NO: 441999 - protein, 9 aa, Influenza virus
GQLKLATGL

SEQ ID NO: 442000 - protein, 9 aa, Influenza virus
GQNFPQTAN

SEQ ID NO: 442001 - protein, 9 aa, Influenza virus
GQNFPQTTN

SEQ ID NO: 442002 - protein, 9 aa, Influenza virus
GQNFPRTTN

SEQ ID NO: 442003 - protein, 9 aa, Influenza virus
GQNHGICAV

SEQ ID NO: 442004 - protein, 9 aa, Influenza virus
GQPKEKAIW

SEQ ID NO: 442005 - protein, 9 aa, Influenza virus
GQPKEKTIW

SEQ ID NO: 442006 - protein, 9 aa, Influenza virus
GQPNERTIW

SEQ ID NO: 442007 - protein, 9 aa, Influenza virus
GQQGRMDYY

SEQ ID NO: 442008 - protein, 9 aa, Influenza virus
GQQGTMDYY

SEQ ID NO: 442009 - protein, 9 aa, Influenza virus
GQQGWMDYY

SEQ ID NO: 442010 - protein, 9 aa, Influenza virus
GQRGRIDFH

SEQ ID NO: 442011 - protein, 9 aa, Influenza virus
GQRSWMKIY

SEQ ID NO: 442012 - protein, 9 aa, Influenza virus
GQRSWMKLY

SEQ ID NO: 442013 - protein, 9 aa, Influenza virus
GQSFPQTTN

SEQ ID NO: 442014 - protein, 9 aa, Influenza virus
GQSFYRSIN

SEQ ID NO: 442015 - protein, 9 aa, Influenza virus
GQSGRIDFH

SEQ ID NO: 442016 - protein, 9 aa, Influenza virus
GQSGRIDFY

SEQ ID NO: 442017 - protein, 9 aa, Influenza virus
GQSGRIEFH

SEQ ID NO: 442018 - protein, 9 aa, Influenza virus
GQSGRINFH

SEQ ID NO: 442019 - protein, 9 aa, Influenza virus
GQSGRISFY

SEQ ID NO: 442020 - protein, 9 aa, Influenza virus
GQSGRIVFH

SEQ ID NO: 442021 - protein, 9 aa, Influenza virus
GQSGRVSFY

SEQ ID NO: 442022 - protein, 9 aa, Influenza virus
GQSPNVYQA

SEQ ID NO: 442023 - protein, 9 aa, Influenza virus
GQSPNVYQS

SEQ ID NO: 442024 - protein, 9 aa, Influenza virus
GQTGRIDFH

SEQ ID NO: 442025 - protein, 9 aa, Influenza virus
GQTIVLNTD

SEQ ID NO: 442026 - protein, 9 aa, Influenza virus
GQTIVSNTD

SEQ ID NO: 442027 - protein, 9 aa, Influenza virus
GQTLRIISN

SEQ ID NO: 442028 - protein, 9 aa, Influenza virus
GQTLRIRSN

SEQ ID NO: 442029 - protein, 9 aa, Influenza virus
GQTLRVKSN

SEQ ID NO: 442030 - protein, 9 aa, Influenza virus
GQTLRVRSD

SEQ ID NO: 442031 - protein, 9 aa, Influenza virus
GQTLRVRSN

SEQ ID NO: 442032 - protein, 9 aa, Influenza virus
GQTVKIKTN

SEQ ID NO: 442033 - protein, 9 aa, Influenza virus
GQTVKIQTN

SEQ ID NO: 442034 - protein, 9 aa, Influenza virus
GQTVKIQTS

SEQ ID NO: 442035 - protein, 9 aa, Influenza virus
GQTVVLNTD

SEQ ID NO: 442036 - protein, 9 aa, Influenza virus
GQVECVCRD

SEQ ID NO: 442037 - protein, 9 aa, Influenza virus
GQVEGRIQD

SEQ ID NO: 442038 - protein, 9 aa, Influenza virus
GQWDWPDGA

SEQ ID NO: 442039 - protein, 9 aa, Influenza virus
GQWNWPDGA

SEQ ID NO: 442040 - protein, 9 aa, Influenza virus
GRADTKILF

SEQ ID NO: 442041 - protein, 9 aa, Influenza virus
GRADTRILF

SEQ ID NO: 442042 - protein, 9 aa, Influenza virus
GRAWLHVCV

SEQ ID NO: 442043 - protein, 9 aa, Influenza virus
GRCPRYVKQ

SEQ ID NO: 442044 - protein, 9 aa, Influenza virus
GRDLGIQSE

SEQ ID NO: 442045 - protein, 9 aa, Influenza virus
GRDVLVIWG

SEQ ID NO: 442046 - protein, 9 aa, Influenza virus
GRDVLVLWG

SEQ ID NO: 442047 - protein, 9 aa, Influenza virus
GRDVLVMWG

SEQ ID NO: 442048 - protein, 9 aa, Influenza virus
GREDKRYGP

SEQ ID NO: 442049 - protein, 9 aa, Influenza virus
GREWSYIVE

SEQ ID NO: 442050 - protein, 9 aa, Influenza virus
GRFEFIAEE

SEQ ID NO: 442051 - protein, 9 aa, Influenza virus
GRFTNEEAL

SEQ ID NO: 442052 - protein, 9 aa, Influenza virus
GRFYIQMCT

SEQ ID NO: 442053 - protein, 9 aa, Influenza virus
GRFYVQMCT

SEQ ID NO: 442054 - protein, 9 aa, Influenza virus
GRGCFEIYH

SEQ ID NO: 442055 - protein, 9 aa, Influenza virus
GRGIEVVNA

SEQ ID NO: 442056 - protein, 9 aa, Influenza virus
GRGLFGAIA

SEQ ID NO: 442057 - protein, 9 aa, Influenza virus
GRGLFGAKA

SEQ ID NO: 442058 - protein, 9 aa, Influenza virus
GRGLGIQSD

SEQ ID NO: 442059 - protein, 9 aa, Influenza virus
GRGLGIQSE

SEQ ID NO: 442060 - protein, 9 aa, Influenza virus
GRGLGIQSG

SEQ ID NO: 442061 - protein, 9 aa, Influenza virus
GRGQAADLK

SEQ ID NO: 442062 - protein, 9 aa, Influenza virus
GRGRIFQSR

SEQ ID NO: 442063 - protein, 9 aa, Influenza virus
GRGSTLGLD

SEQ ID NO: 442064 - protein, 9 aa, Influenza virus
GRGVFEFSD

SEQ ID NO: 442065 - protein, 9 aa, Influenza virus
GRGVFELSD

SEQ ID NO: 442066 - protein, 9 aa, Influenza virus
GRGYMFESK

SEQ ID NO: 442067 - protein, 9 aa, Influenza virus
GRHANGTIH

SEQ ID NO: 442068 - protein, 9 aa, Influenza virus
GRHANGTIN

SEQ ID NO: 442069 - protein, 9 aa, Influenza virus
GRHANGTMH

SEQ ID NO: 442070 - protein, 9 aa, Influenza virus
GRHSNGTIH

SEQ ID NO: 442071 - protein, 9 aa, Influenza virus
GRIDFHWLI

SEQ ID NO: 442072 - protein, 9 aa, Influenza virus
GRIDFHWLL

SEQ ID NO: 442073 - protein, 9 aa, Influenza virus
GRIDFHWLM

SEQ ID NO: 442074 - protein, 9 aa, Influenza virus
GRIDFHWLV

SEQ ID NO: 442075 - protein, 9 aa, Influenza virus
GRIDFHWML

SEQ ID NO: 442076 - protein, 9 aa, Influenza virus
GRIFQSGIR

SEQ ID NO: 442077 - protein, 9 aa, Influenza virus
GRIFQSGVR

SEQ ID NO: 442078 - protein, 9 aa, Influenza virus
GRIFQSHIR

SEQ ID NO: 442079 - protein, 9 aa, Influenza virus
GRIFQSPIR

SEQ ID NO: 442080 - protein, 9 aa, Influenza virus
GRIFQSRII

SEQ ID NO: 442081 - protein, 9 aa, Influenza virus
GRIFQSRIR

SEQ ID NO: 442082 - protein, 9 aa, Influenza virus
GRIIQNEDI

SEQ ID NO: 442083 - protein, 9 aa, Influenza virus
GRILKNDLP

SEQ ID NO: 442084 - protein, 9 aa, Influenza virus
GRILKNNLP

SEQ ID NO: 442085 - protein, 9 aa, Influenza virus
GRILKWEPL

SEQ ID NO: 442086 - protein, 9 aa, Influenza virus
GRINYYWTL

SEQ ID NO: 442087 - protein, 9 aa, Influenza virus
GRIQDLEKY

SEQ ID NO: 442088 - protein, 9 aa, Influenza virus
GRIQDLERY

SEQ ID NO: 442089 - protein, 9 aa, Influenza virus
GRISFYWTI

SEQ ID NO: 442090 - protein, 9 aa, Influenza virus
GRISIYWTL

SEQ ID NO: 442091 - protein, 9 aa, Influenza virus
GRLCNPLNP

SEQ ID NO: 442092 - protein, 9 aa, Influenza virus
GRLCNPMNP

SEQ ID NO: 442093 - protein, 9 aa, Influenza virus
GRLIDFLKD

SEQ ID NO: 442094 - protein, 9 aa, Influenza virus
GRLIQNSIT

SEQ ID NO: 442095 - protein, 9 aa, Influenza virus
GRLIQNSLT

SEQ ID NO: 442096 - protein, 9 aa, Influenza virus
GRLIQNSMT

SEQ ID NO: 442097 - protein, 9 aa, Influenza virus
GRLMDFLKD

SEQ ID NO: 442098 - protein, 9 aa, Influenza virus
GRLTTTIKT

SEQ ID NO: 442099 - protein, 9 aa, Influenza virus
GRLVRFRHQ

SEQ ID NO: 442100 - protein, 9 aa, Influenza virus
GRMDYYWAI

SEQ ID NO: 442101 - protein, 9 aa, Influenza virus
GRMDYYWAV

SEQ ID NO: 442102 - protein, 9 aa, Influenza virus
GRMDYYWGI

SEQ ID NO: 442103 - protein, 9 aa, Influenza virus
GRMDYYWTL

SEQ ID NO: 442104 - protein, 9 aa, Influenza virus
GRMNYHWTL

SEQ ID NO: 442105 - protein, 9 aa, Influenza virus
GRMNYYWTI

SEQ ID NO: 442106 - protein, 9 aa, Influenza virus
GRMNYYWTL

SEQ ID NO: 442107 - protein, 9 aa, Influenza virus
GRMSDSIKS

SEQ ID NO: 442108 - protein, 9 aa, Influenza virus
GRMTDSIKS

SEQ ID NO: 442109 - protein, 9 aa, Influenza virus
GRMTFYWAI

SEQ ID NO: 442110 - protein, 9 aa, Influenza virus
GRMTFYWKI

SEQ ID NO: 442111 - protein, 9 aa, Influenza virus
GRMTFYWTI

SEQ ID NO: 442112 - protein, 9 aa, Influenza virus
GRMTFYWTM

SEQ ID NO: 442113 - protein, 9 aa, Influenza virus
GRMTICIQG

SEQ ID NO: 442114 - protein, 9 aa, Influenza virus
GRMTICVQG

SEQ ID NO: 442115 - protein, 9 aa, Influenza virus
GRNCTIPCF

SEQ ID NO: 442116 - protein, 9 aa, Influenza virus
GRNCTVPCF

SEQ ID NO: 442117 - protein, 9 aa, Influenza virus
GRNPGNAEI

SEQ ID NO: 442118 - protein, 9 aa, Influenza virus
GRNSFFSRL

SEQ ID NO: 442119 - protein, 9 aa, Influenza virus
GRNSFYAEL

SEQ ID NO: 442120 - protein, 9 aa, Influenza virus
GRPEEAKYV

SEQ ID NO: 442121 - protein, 9 aa, Influenza virus
GRPEEVKYV

SEQ ID NO: 442122 - protein, 9 aa, Influenza virus
GRPITEINT

SEQ ID NO: 442123 - protein, 9 aa, Influenza virus
GRPKEDEVW

SEQ ID NO: 442124 - protein, 9 aa, Influenza virus
GRPKEDKVW

SEQ ID NO: 442125 - protein, 9 aa, Influenza virus
GRPKEDRVW

SEQ ID NO: 442126 - protein, 9 aa, Influenza virus
GRPKEEKVW

SEQ ID NO: 442127 - protein, 9 aa, Influenza virus
GRPTTEINT

SEQ ID NO: 442128 - protein, 9 aa, Influenza virus
GRQEIVDNN

SEQ ID NO: 442129 - protein, 9 aa, Influenza virus
GRQEKNPAL

SEQ ID NO: 442130 - protein, 9 aa, Influenza virus
GRQEKNPSL

SEQ ID NO: 442131 - protein, 9 aa, Influenza virus
GRQTFDWTL

SEQ ID NO: 442132 - protein, 9 aa, Influenza virus
GRQTYDWTL

SEQ ID NO: 442133 - protein, 9 aa, Influenza virus
GRRKTNLYG

SEQ ID NO: 442134 - protein, 9 aa, Influenza virus
GRSDKICIG

SEQ ID NO: 442135 - protein, 9 aa, Influenza virus
GRSHLRNDT

SEQ ID NO: 442136 - protein, 9 aa, Influenza virus
GRTFSPRSR

SEQ ID NO: 442137 - protein, 9 aa, Influenza virus
GRTINTASR

SEQ ID NO: 442138 - protein, 9 aa, Influenza virus
GRTIQNEDI

SEQ ID NO: 442139 - protein, 9 aa, Influenza virus
GRTISEDSR

SEQ ID NO: 442140 - protein, 9 aa, Influenza virus
GRTISIASR

SEQ ID NO: 442141 - protein, 9 aa, Influenza virus
GRTISKDLR

SEQ ID NO: 442142 - protein, 9 aa, Influenza virus
GRTISKDSR

SEQ ID NO: 442143 - protein, 9 aa, Influenza virus
GRTISKDTR

SEQ ID NO: 442144 - protein, 9 aa, Influenza virus
GRTISKNSR

SEQ ID NO: 442145 - protein, 9 aa, Influenza virus
GRTISMDSR

SEQ ID NO: 442146 - protein, 9 aa, Influenza virus
GRTISPHSR

SEQ ID NO: 442147 - protein, 9 aa, Influenza virus
GRTISPKLR

SEQ ID NO: 442148 - protein, 9 aa, Influenza virus
GRTISPRLR

SEQ ID NO: 442149 - protein, 9 aa, Influenza virus
GRTISPRSR

SEQ ID NO: 442150 - protein, 9 aa, Influenza virus
GRTISRDSR

SEQ ID NO: 442151 - protein, 9 aa, Influenza virus
GRTISTASR

SEQ ID NO: 442152 - protein, 9 aa, Influenza virus
GRTISTRSR

SEQ ID NO: 442153 - protein, 9 aa, Influenza virus
GRTKSLESR

SEQ ID NO: 442154 - protein, 9 aa, Influenza virus
GRTLDLHDA

SEQ ID NO: 442155 - protein, 9 aa, Influenza virus
GRTLDMHDA

SEQ ID NO: 442156 - protein, 9 aa, Influenza virus
GRTLGLHDA

SEQ ID NO: 442157 - protein, 9 aa, Influenza virus
GRTNQQFEL

SEQ ID NO: 442158 - protein, 9 aa, Influenza virus
GRTSDMRAE

SEQ ID NO: 442159 - protein, 9 aa, Influenza virus
GRTSDMRTE

SEQ ID NO: 442160 - protein, 9 aa, Influenza virus
GRTTSKDSR

SEQ ID NO: 442161 - protein, 9 aa, Influenza virus
GRTVSINGR

SEQ ID NO: 442162 - protein, 9 aa, Influenza virus
GRTVSISGR

SEQ ID NO: 442163 - protein, 9 aa, Influenza virus
GRTVSKDSR

SEQ ID NO: 442164 - protein, 9 aa, Influenza virus
GRTVSNSGR

SEQ ID NO: 442165 - protein, 9 aa, Influenza virus
GRTVSTSGR

SEQ ID NO: 442166 - protein, 9 aa, Influenza virus
GRVLKNNLP

SEQ ID NO: 442167 - protein, 9 aa, Influenza virus
GRVSFYWTI

SEQ ID NO: 442168 - protein, 9 aa, Influenza virus
GRVTDSIKS

SEQ ID NO: 442169 - protein, 9 aa, Influenza virus
GRVTVSTRS

SEQ ID NO: 442170 - protein, 9 aa, Influenza virus
GRWPGLVAG

SEQ ID NO: 442171 - protein, 9 aa, Influenza virus
GRYGVKGFS

SEQ ID NO: 442172 - protein, 9 aa, Influenza virus
GRYSIADKI

SEQ ID NO: 442173 - protein, 9 aa, Influenza virus
GRYSKADKI

SEQ ID NO: 442174 - protein, 9 aa, Influenza virus
GRYSRADKI

SEQ ID NO: 442175 - protein, 9 aa, Influenza virus
GSAEHIEEC

SEQ ID NO: 442176 - protein, 9 aa, Influenza virus
GSAKHIEEC

SEQ ID NO: 442177 - protein, 9 aa, Influenza virus
GSAKHVEEC

SEQ ID NO: 442178 - protein, 9 aa, Influenza virus
GSANSQAYT

SEQ ID NO: 442179 - protein, 9 aa, Influenza virus
GSAQATEEC

SEQ ID NO: 442180 - protein, 9 aa, Influenza virus
GSAQHIEEC

SEQ ID NO: 442181 - protein, 9 aa, Influenza virus
GSAQHVEEC

SEQ ID NO: 442182 - protein, 9 aa, Influenza virus
GSARHIEEC

SEQ ID NO: 442183 - protein, 9 aa, Influenza virus
GSARHIEEW

SEQ ID NO: 442184 - protein, 9 aa, Influenza virus
GSARHVEEC

SEQ ID NO: 442185 - protein, 9 aa, Influenza virus
GSASGKADT

SEQ ID NO: 442186 - protein, 9 aa, Influenza virus
GSASGKAET

SEQ ID NO: 442187 - protein, 9 aa, Influenza virus
GSASGQAYT

SEQ ID NO: 442188 - protein, 9 aa, Influenza virus
GSASGRADT

SEQ ID NO: 442189 - protein, 9 aa, Influenza virus
GSASRKADT

SEQ ID NO: 442190 - protein, 9 aa, Influenza virus
GSASSQAHT

SEQ ID NO: 442191 - protein, 9 aa, Influenza virus
GSASSQAYT

SEQ ID NO: 442192 - protein, 9 aa, Influenza virus
GSATGPADT

SEQ ID NO: 442193 - protein, 9 aa, Influenza virus
GSATGPAET

SEQ ID NO: 442194 - protein, 9 aa, Influenza virus
GSCASKCHT

SEQ ID NO: 442195 - protein, 9 aa, Influenza virus
GSCAVVMTD

SEQ ID NO: 442196 - protein, 9 aa, Influenza virus
GSCESKCHT

SEQ ID NO: 442197 - protein, 9 aa, Influenza virus
GSCFTIMTD

SEQ ID NO: 442198 - protein, 9 aa, Influenza virus
GSCFTLMTD

SEQ ID NO: 442199 - protein, 9 aa, Influenza virus
GSCFTVLTD

SEQ ID NO: 442200 - protein, 9 aa, Influenza virus
GSCFTVMTD

SEQ ID NO: 442201 - protein, 9 aa, Influenza virus
GSCGILGTI

SEQ ID NO: 442202 - protein, 9 aa, Influenza virus
GSCISKCHT

SEQ ID NO: 442203 - protein, 9 aa, Influenza virus
GSCRCMFCI

SEQ ID NO: 442204 - protein, 9 aa, Influenza virus
GSCRCTICI

SEQ ID NO: 442205 - protein, 9 aa, Influenza virus
GSCRFNVCI

SEQ ID NO: 442206 - protein, 9 aa, Influenza virus
GSCTSPCLT

SEQ ID NO: 442207 - protein, 9 aa, Influenza virus
GSCTVVMTD

SEQ ID NO: 442208 - protein, 9 aa, Influenza virus
GSCVSKCHT

SEQ ID NO: 442209 - protein, 9 aa, Influenza virus
GSCVSRCHT

SEQ ID NO: 442210 - protein, 9 aa, Influenza virus
GSDIGFMPK

SEQ ID NO: 442211 - protein, 9 aa, Influenza virus
GSDVWLGRT

SEQ ID NO: 442212 - protein, 9 aa, Influenza virus
GSDVWMGRT

SEQ ID NO: 442213 - protein, 9 aa, Influenza virus
GSECVCING

SEQ ID NO: 442214 - protein, 9 aa, Influenza virus
GSEHTAYSQ

SEQ ID NO: 442215 - protein, 9 aa, Influenza virus
GSFCSIDGK

SEQ ID NO: 442216 - protein, 9 aa, Influenza virus
GSFCSINGK

SEQ ID NO: 442217 - protein, 9 aa, Influenza virus
GSFCSINGR

SEQ ID NO: 442218 - protein, 9 aa, Influenza virus
GSFCSLDGK

SEQ ID NO: 442219 - protein, 9 aa, Influenza virus
GSFIDYWAE

SEQ ID NO: 442220 - protein, 9 aa, Influenza virus
GSFIDYWAK

SEQ ID NO: 442221 - protein, 9 aa, Influenza virus
GSFIDYWDD

SEQ ID NO: 442222 - protein, 9 aa, Influenza virus
GSFIDYWDE

SEQ ID NO: 442223 - protein, 9 aa, Influenza virus
GSFIDYWND

SEQ ID NO: 442224 - protein, 9 aa, Influenza virus
GSFIQHPEL

SEQ ID NO: 442225 - protein, 9 aa, Influenza virus
GSFMDYWAE

SEQ ID NO: 442226 - protein, 9 aa, Influenza virus
GSFNDYEEL

SEQ ID NO: 442227 - protein, 9 aa, Influenza virus
GSFNGAFIA

SEQ ID NO: 442228 - protein, 9 aa, Influenza virus
GSFNNYEEL

SEQ ID NO: 442229 - protein, 9 aa, Influenza virus
GSFPDGAKI

SEQ ID NO: 442230 - protein, 9 aa, Influenza virus
GSFPDGAQI

SEQ ID NO: 442231 - protein, 9 aa, Influenza virus
GSFPNGAQI

SEQ ID NO: 442232 - protein, 9 aa, Influenza virus
GSFSIRGET

SEQ ID NO: 442233 - protein, 9 aa, Influenza virus
GSFSIRWET

SEQ ID NO: 442234 - protein, 9 aa, Influenza virus
GSFTLPIEL

SEQ ID NO: 442235 - protein, 9 aa, Influenza virus
GSFTLPVEL

SEQ ID NO: 442236 - protein, 9 aa, Influenza virus
GSFTLPVEM

SEQ ID NO: 442237 - protein, 9 aa, Influenza virus
GSFTLPVGL

SEQ ID NO: 442238 - protein, 9 aa, Influenza virus
GSFVDYWAE

SEQ ID NO: 442239 - protein, 9 aa, Influenza virus
GSFVQHPEL

SEQ ID NO: 442240 - protein, 9 aa, Influenza virus
GSFVQHPEM

SEQ ID NO: 442241 - protein, 9 aa, Influenza virus
GSFYRNMRW

SEQ ID NO: 442242 - protein, 9 aa, Influenza virus
GSFYRSIRW

SEQ ID NO: 442243 - protein, 9 aa, Influenza virus
GSFYRSMRW

SEQ ID NO: 442244 - protein, 9 aa, Influenza virus
GSGAKLITV

SEQ ID NO: 442245 - protein, 9 aa, Influenza virus
GSGDWPDGS

SEQ ID NO: 442246 - protein, 9 aa, Influenza virus
GSGFFPDGP

SEQ ID NO: 442247 - protein, 9 aa, Influenza virus
GSGLRILIR

SEQ ID NO: 442248 - protein, 9 aa, Influenza virus
GSGLRILVR

SEQ ID NO: 442249 - protein, 9 aa, Influenza virus
GSGMRILIR

SEQ ID NO: 442250 - protein, 9 aa, Influenza virus
GSGMRILVR

SEQ ID NO: 442251 - protein, 9 aa, Influenza virus
GSGNKLITV

SEQ ID NO: 442252 - protein, 9 aa, Influenza virus
GSGNKLVTV

SEQ ID NO: 442253 - protein, 9 aa, Influenza virus
GSGNWPDGA

SEQ ID NO: 442254 - protein, 9 aa, Influenza virus
GSGNWPDGP

SEQ ID NO: 442255 - protein, 9 aa, Influenza virus
GSGNWPDGS

SEQ ID NO: 442256 - protein, 9 aa, Influenza virus
GSGRIFQSG

SEQ ID NO: 442257 - protein, 9 aa, Influenza virus
GSGSFPDGA

SEQ ID NO: 442258 - protein, 9 aa, Influenza virus
GSGSFPNGA

SEQ ID NO: 442259 - protein, 9 aa, Influenza virus
GSGSKLITV

SEQ ID NO: 442260 - protein, 9 aa, Influenza virus
GSGSWPDGA

SEQ ID NO: 442261 - protein, 9 aa, Influenza virus
GSGTDNYGV

SEQ ID NO: 442262 - protein, 9 aa, Influenza virus
GSGTNNYGV

SEQ ID NO: 442263 - protein, 9 aa, Influenza virus
GSGWLTLGI

SEQ ID NO: 442264 - protein, 9 aa, Influenza virus
GSGYAADKA

SEQ ID NO: 442265 - protein, 9 aa, Influenza virus
GSGYAADKE

SEQ ID NO: 442266 - protein, 9 aa, Influenza virus
GSGYAADKK

SEQ ID NO: 442267 - protein, 9 aa, Influenza virus
GSGYAADLK

SEQ ID NO: 442268 - protein, 9 aa, Influenza virus
GSGYAADQE

SEQ ID NO: 442269 - protein, 9 aa, Influenza virus
GSGYAADQK

SEQ ID NO: 442270 - protein, 9 aa, Influenza virus
GSGYAADRE

SEQ ID NO: 442271 - protein, 9 aa, Influenza virus
GSGYAADRK

SEQ ID NO: 442272 - protein, 9 aa, Influenza virus
GSGYAANKE

SEQ ID NO: 442273 - protein, 9 aa, Influenza virus
GSHGVKGWA

SEQ ID NO: 442274 - protein, 9 aa, Influenza virus
GSIAHKSCL

SEQ ID NO: 442275 - protein, 9 aa, Influenza virus
GSIENLEEL

SEQ ID NO: 442276 - protein, 9 aa, Influenza virus
GSIENQEEL

SEQ ID NO: 442277 - protein, 9 aa, Influenza virus
GSIGKVCRA

SEQ ID NO: 442278 - protein, 9 aa, Influenza virus
GSIGKVCRT

SEQ ID NO: 442279 - protein, 9 aa, Influenza virus
GSIISFCGV

SEQ ID NO: 442280 - protein, 9 aa, Influenza virus
GSIITELPF

SEQ ID NO: 442281 - protein, 9 aa, Influenza virus
GSIKNQEEL

SEQ ID NO: 442282 - protein, 9 aa, Influenza virus
GSIKTKLPF

SEQ ID NO: 442283 - protein, 9 aa, Influenza virus
GSINTKLPF

SEQ ID NO: 442284 - protein, 9 aa, Influenza virus
GSINTRLPF

SEQ ID NO: 442285 - protein, 9 aa, Influenza virus
GSIPNDKPF

SEQ ID NO: 442286 - protein, 9 aa, Influenza virus
GSIPNEKPF

SEQ ID NO: 442287 - protein, 9 aa, Influenza virus
GSIPNGKPF

SEQ ID NO: 442288 - protein, 9 aa, Influenza virus
GSIPNNKPF

SEQ ID NO: 442289 - protein, 9 aa, Influenza virus
GSIQSDKPF

SEQ ID NO: 442290 - protein, 9 aa, Influenza virus
GSIRNETYD

SEQ ID NO: 442291 - protein, 9 aa, Influenza virus
GSIRNGTYD

SEQ ID NO: 442292 - protein, 9 aa, Influenza virus
GSIRNGTYN

SEQ ID NO: 442293 - protein, 9 aa, Influenza virus
GSISLTIAA

SEQ ID NO: 442294 - protein, 9 aa, Influenza virus
GSISNDKPF

SEQ ID NO: 442295 - protein, 9 aa, Influenza virus
GSIYIEVLH

SEQ ID NO: 442296 - protein, 9 aa, Influenza virus
GSKEQLGSW

SEQ ID NO: 442297 - protein, 9 aa, Influenza virus
GSKERLGSW

SEQ ID NO: 442298 - protein, 9 aa, Influenza virus
GSKGDIFVI

SEQ ID NO: 442299 - protein, 9 aa, Influenza virus
GSKGDIFVM

SEQ ID NO: 442300 - protein, 9 aa, Influenza virus
GSKGDVFVI

SEQ ID NO: 442301 - protein, 9 aa, Influenza virus
GSKGDVFVM

SEQ ID NO: 442302 - protein, 9 aa, Influenza virus
GSKGHVFVI

SEQ ID NO: 442303 - protein, 9 aa, Influenza virus
GSKKRLGSW

SEQ ID NO: 442304 - protein, 9 aa, Influenza virus
GSLEFIAEQ

SEQ ID NO: 442305 - protein, 9 aa, Influenza virus
GSLHGRICI

SEQ ID NO: 442306 - protein, 9 aa, Influenza virus
GSLKLAIGL

SEQ ID NO: 442307 - protein, 9 aa, Influenza virus
GSLKLAIGP

SEQ ID NO: 442308 - protein, 9 aa, Influenza virus
GSLKLATGM

SEQ ID NO: 442309 - protein, 9 aa, Influenza virus
GSLLLATGM

SEQ ID NO: 442310 - protein, 9 aa, Influenza virus
GSLLNDKHF

SEQ ID NO: 442311 - protein, 9 aa, Influenza virus
GSLLNDKHS

SEQ ID NO: 442312 - protein, 9 aa, Influenza virus
GSLLNDRHS

SEQ ID NO: 442313 - protein, 9 aa, Influenza virus
GSLMLATGM

SEQ ID NO: 442314 - protein, 9 aa, Influenza virus
GSLNDYEEL

SEQ ID NO: 442315 - protein, 9 aa, Influenza virus
GSLNFVSME

SEQ ID NO: 442316 - protein, 9 aa, Influenza virus
GSLQCKICI

SEQ ID NO: 442317 - protein, 9 aa, Influenza virus
GSLQCRICI

SEQ ID NO: 442318 - protein, 9 aa, Influenza virus
GSLQCRICM

SEQ ID NO: 442319 - protein, 9 aa, Influenza virus
GSLQCRVCI

SEQ ID NO: 442320 - protein, 9 aa, Influenza virus
GSLQCTICI

SEQ ID NO: 442321 - protein, 9 aa, Influenza virus
GSLRCRICI

SEQ ID NO: 442322 - protein, 9 aa, Influenza virus
GSLRLATGM

SEQ ID NO: 442323 - protein, 9 aa, Influenza virus
GSLSLAIMI

SEQ ID NO: 442324 - protein, 9 aa, Influenza virus
GSLSLAIMM

SEQ ID NO: 442325 - protein, 9 aa, Influenza virus
GSLSLAIMV

SEQ ID NO: 442326 - protein, 9 aa, Influenza virus
GSMQCKICI

SEQ ID NO: 442327 - protein, 9 aa, Influenza virus
GSMQCNVCI

SEQ ID NO: 442328 - protein, 9 aa, Influenza virus
GSMQCRICI

SEQ ID NO: 442329 - protein, 9 aa, Influenza virus
GSMQCRVCI

SEQ ID NO: 442330 - protein, 9 aa, Influenza virus
GSNIGFMPK

SEQ ID NO: 442331 - protein, 9 aa, Influenza virus
GSNRPIIDI

SEQ ID NO: 442332 - protein, 9 aa, Influenza virus
GSNRPIVDI

SEQ ID NO: 442333 - protein, 9 aa, Influenza virus
GSNRPVIDI

SEQ ID NO: 442334 - protein, 9 aa, Influenza virus
GSNRPVIDV

SEQ ID NO: 442335 - protein, 9 aa, Influenza virus
GSNRPVIQI

SEQ ID NO: 442336 - protein, 9 aa, Influenza virus
GSNRPVIRI

SEQ ID NO: 442337 - protein, 9 aa, Influenza virus
GSNRPVLDI

SEQ ID NO: 442338 - protein, 9 aa, Influenza virus
GSNRPVVDI

SEQ ID NO: 442339 - protein, 9 aa, Influenza virus
GSNRPWIRF

SEQ ID NO: 442340 - protein, 9 aa, Influenza virus
GSNRPWIRI

SEQ ID NO: 442341 - protein, 9 aa, Influenza virus
GSNRPWISF

SEQ ID NO: 442342 - protein, 9 aa, Influenza virus
GSNRPWLSF

SEQ ID NO: 442343 - protein, 9 aa, Influenza virus
GSNRPWMRI

SEQ ID NO: 442344 - protein, 9 aa, Influenza virus
GSNRPWVRI

SEQ ID NO: 442345 - protein, 9 aa, Influenza virus
GSNRPWVRM

SEQ ID NO: 442346 - protein, 9 aa, Influenza virus
GSNRPWVSF

SEQ ID NO: 442347 - protein, 9 aa, Influenza virus
GSPDPGVKG

SEQ ID NO: 442348 - protein, 9 aa, Influenza virus
GSPFPVGSG

SEQ ID NO: 442349 - protein, 9 aa, Influenza virus
GSPGAPGVK

SEQ ID NO: 442350 - protein, 9 aa, Influenza virus
GSPGCDRLQ

SEQ ID NO: 442351 - protein, 9 aa, Influenza virus
GSPGVKGWA

SEQ ID NO: 442352 - protein, 9 aa, Influenza virus
GSPISVGSG

SEQ ID NO: 442353 - protein, 9 aa, Influenza virus
GSPLELRDC

SEQ ID NO: 442354 - protein, 9 aa, Influenza virus
GSPLVLDDC

SEQ ID NO: 442355 - protein, 9 aa, Influenza virus
GSPPIVSNS

SEQ ID NO: 442356 - protein, 9 aa, Influenza virus
GSPPMVSNS

SEQ ID NO: 442357 - protein, 9 aa, Influenza virus
GSPPVVSNS

SEQ ID NO: 442358 - protein, 9 aa, Influenza virus
GSPSAPGVK

SEQ ID NO: 442359 - protein, 9 aa, Influenza virus
GSPVPVGSG

SEQ ID NO: 442360 - protein, 9 aa, Influenza virus
GSPVSVGSG

SEQ ID NO: 442361 - protein, 9 aa, Influenza virus
GSQGVKGWA

SEQ ID NO: 442362 - protein, 9 aa, Influenza virus
GSQKQEFKM

SEQ ID NO: 442363 - protein, 9 aa, Influenza virus
GSRERLGSW

SEQ ID NO: 442364 - protein, 9 aa, Influenza virus
GSRGEVFVI

SEQ ID NO: 442365 - protein, 9 aa, Influenza virus
GSRGHIFVI

SEQ ID NO: 442366 - protein, 9 aa, Influenza virus
GSRGHVFVI

SEQ ID NO: 442367 - protein, 9 aa, Influenza virus
GSRINMINS

SEQ ID NO: 442368 - protein, 9 aa, Influenza virus
GSRPRVRNQ

SEQ ID NO: 442369 - protein, 9 aa, Influenza virus
GSSEQAAEA

SEQ ID NO: 442370 - protein, 9 aa, Influenza virus
GSSFYAELK

SEQ ID NO: 442371 - protein, 9 aa, Influenza virus
GSSFYAEMK

SEQ ID NO: 442372 - protein, 9 aa, Influenza virus
GSSGIMKTE

SEQ ID NO: 442373 - protein, 9 aa, Influenza virus
GSSGIMKTG

SEQ ID NO: 442374 - protein, 9 aa, Influenza virus
GSSGVMKTE

SEQ ID NO: 442375 - protein, 9 aa, Influenza virus
GSSIAFCGV

SEQ ID NO: 442376 - protein, 9 aa, Influenza virus
GSSISFCGV

SEQ ID NO: 442377 - protein, 9 aa, Influenza virus
GSSKYQQSF

SEQ ID NO: 442378 - protein, 9 aa, Influenza virus
GSSKYRQSF

SEQ ID NO: 442379 - protein, 9 aa, Influenza virus
GSSPNAYQA

SEQ ID NO: 442380 - protein, 9 aa, Influenza virus
GSSSACLRG

SEQ ID NO: 442381 - protein, 9 aa, Influenza virus
GSSSFYAEM

SEQ ID NO: 442382 - protein, 9 aa, Influenza virus
GSSTYHNSF

SEQ ID NO: 442383 - protein, 9 aa, Influenza virus
GSSTYQNNF

SEQ ID NO: 442384 - protein, 9 aa, Influenza virus
GSSTYQNSF

SEQ ID NO: 442385 - protein, 9 aa, Influenza virus
GSSTYQSNF

SEQ ID NO: 442386 - protein, 9 aa, Influenza virus
GSSYVCSGL

SEQ ID NO: 442387 - protein, 9 aa, Influenza virus
GSTLGLDIR

SEQ ID NO: 442388 - protein, 9 aa, Influenza virus
GSTLPRRSG

SEQ ID NO: 442389 - protein, 9 aa, Influenza virus
GSTQKAIDN

SEQ ID NO: 442390 - protein, 9 aa, Influenza virus
GSTVNEEAL

SEQ ID NO: 442391 - protein, 9 aa, Influenza virus
GSVAHKSCL

SEQ ID NO: 442392 - protein, 9 aa, Influenza virus
GSVENLEEL

SEQ ID NO: 442393 - protein, 9 aa, Influenza virus
GSVENQEEL

SEQ ID NO: 442394 - protein, 9 aa, Influenza virus
GSVNTVLSI

SEQ ID NO: 442395 - protein, 9 aa, Influenza virus
GSVSLIIAT

SEQ ID NO: 442396 - protein, 9 aa, Influenza virus
GSVSLTIAI

SEQ ID NO: 442397 - protein, 9 aa, Influenza virus
GSVSLTIAT

SEQ ID NO: 442398 - protein, 9 aa, Influenza virus
GSVSLTITT

SEQ ID NO: 442399 - protein, 9 aa, Influenza virus
GSVYIEVLH

SEQ ID NO: 442400 - protein, 9 aa, Influenza virus
GSWADGANI

SEQ ID NO: 442401 - protein, 9 aa, Influenza virus
GSWPDGADI

SEQ ID NO: 442402 - protein, 9 aa, Influenza virus
GSWPDGADL

SEQ ID NO: 442403 - protein, 9 aa, Influenza virus
GSWPDGAEI

SEQ ID NO: 442404 - protein, 9 aa, Influenza virus
GSWPDGANF

SEQ ID NO: 442405 - protein, 9 aa, Influenza virus
GSWPDGANI

SEQ ID NO: 442406 - protein, 9 aa, Influenza virus
GSWPDGANV

SEQ ID NO: 442407 - protein, 9 aa, Influenza virus
GSWPDGRTS

SEQ ID NO: 442408 - protein, 9 aa, Influenza virus
GSWSHNILR

SEQ ID NO: 442409 - protein, 9 aa, Influenza virus
GSWSQNILR

SEQ ID NO: 442410 - protein, 9 aa, Influenza virus
GSWSWHDGA

SEQ ID NO: 442411 - protein, 9 aa, Influenza virus
GSYFFGDNA

SEQ ID NO: 442412 - protein, 9 aa, Influenza virus
GSYGTGSWP

SEQ ID NO: 442413 - protein, 9 aa, Influenza virus
GSYNNTNGE

SEQ ID NO: 442414 - protein, 9 aa, Influenza virus
GSYNNTSGE

SEQ ID NO: 442415 - protein, 9 aa, Influenza virus
GSYRCMFCI

SEQ ID NO: 442416 - protein, 9 aa, Influenza virus
GSYVRLYLW

SEQ ID NO: 442417 - protein, 9 aa, Influenza virus
GTAADLKST

SEQ ID NO: 442418 - protein, 9 aa, Influenza virus
GTAADYKST

SEQ ID NO: 442419 - protein, 9 aa, Influenza virus
GTAALSPGM

SEQ ID NO: 442420 - protein, 9 aa, Influenza virus
GTACFEIFH

SEQ ID NO: 442421 - protein, 9 aa, Influenza virus
GTAKHIEEC

SEQ ID NO: 442422 - protein, 9 aa, Influenza virus
GTAPILGNY

SEQ ID NO: 442423 - protein, 9 aa, Influenza virus
GTAPVLGNY

SEQ ID NO: 442424 - protein, 9 aa, Influenza virus
GTASLSPGM

SEQ ID NO: 442425 - protein, 9 aa, Influenza virus
GTCAVVMTD

SEQ ID NO: 442426 - protein, 9 aa, Influenza virus
GTCGTGSWP

SEQ ID NO: 442427 - protein, 9 aa, Influenza virus
GTCIVAVTD

SEQ ID NO: 442428 - protein, 9 aa, Influenza virus
GTCTAVMTD

SEQ ID NO: 442429 - protein, 9 aa, Influenza virus
GTCTVVLTD

SEQ ID NO: 442430 - protein, 9 aa, Influenza virus
GTCTVVMTD

SEQ ID NO: 442431 - protein, 9 aa, Influenza virus
GTCVAVMTD

SEQ ID NO: 442432 - protein, 9 aa, Influenza virus
GTCVVAVTD

SEQ ID NO: 442433 - protein, 9 aa, Influenza virus
GTCVVIMTD

SEQ ID NO: 442434 - protein, 9 aa, Influenza virus
GTCVVTVTD

SEQ ID NO: 442435 - protein, 9 aa, Influenza virus
GTCVVVMTD

SEQ ID NO: 442436 - protein, 9 aa, Influenza virus
GTCWEQLYT

SEQ ID NO: 442437 - protein, 9 aa, Influenza virus
GTCWEQMYT

SEQ ID NO: 442438 - protein, 9 aa, Influenza virus
GTDNYGVKG

SEQ ID NO: 442439 - protein, 9 aa, Influenza virus
GTFDIEGLY

SEQ ID NO: 442440 - protein, 9 aa, Influenza virus
GTFDIGGLY

SEQ ID NO: 442441 - protein, 9 aa, Influenza virus
GTFDLEGLY

SEQ ID NO: 442442 - protein, 9 aa, Influenza virus
GTFDLGGLY

SEQ ID NO: 442443 - protein, 9 aa, Influenza virus
GTFDTAQII

SEQ ID NO: 442444 - protein, 9 aa, Influenza virus
GTFDTIQII

SEQ ID NO: 442445 - protein, 9 aa, Influenza virus
GTFDTTQII

SEQ ID NO: 442446 - protein, 9 aa, Influenza virus
GTFDTVQII

SEQ ID NO: 442447 - protein, 9 aa, Influenza virus
GTFDTVQVI

SEQ ID NO: 442448 - protein, 9 aa, Influenza virus
GTFEFTSFF

SEQ ID NO: 442449 - protein, 9 aa, Influenza virus
GTFGPVHFQ

SEQ ID NO: 442450 - protein, 9 aa, Influenza virus
GTFGPVHFR

SEQ ID NO: 442451 - protein, 9 aa, Influenza virus
GTGAWPDGA

SEQ ID NO: 442452 - protein, 9 aa, Influenza virus
GTGCFEIFH

SEQ ID NO: 442453 - protein, 9 aa, Influenza virus
GTGIAADKA

SEQ ID NO: 442454 - protein, 9 aa, Influenza virus
GTGIAADKE

SEQ ID NO: 442455 - protein, 9 aa, Influenza virus
GTGIAADKT

SEQ ID NO: 442456 - protein, 9 aa, Influenza virus
GTGIAADKV

SEQ ID NO: 442457 - protein, 9 aa, Influenza virus
GTGIAADRD

SEQ ID NO: 442458 - protein, 9 aa, Influenza virus
GTGIAADRE

SEQ ID NO: 442459 - protein, 9 aa, Influenza virus
GTGIAADRG

SEQ ID NO: 442460 - protein, 9 aa, Influenza virus
GTGIAAEKE

SEQ ID NO: 442461 - protein, 9 aa, Influenza virus
GTGIVADRD

SEQ ID NO: 442462 - protein, 9 aa, Influenza virus
GTGMAADQK

SEQ ID NO: 442463 - protein, 9 aa, Influenza virus
GTGMAADRD

SEQ ID NO: 442464 - protein, 9 aa, Influenza virus
GTGMRILVR

SEQ ID NO: 442465 - protein, 9 aa, Influenza virus
GTGNKLITV

SEQ ID NO: 442466 - protein, 9 aa, Influenza virus
GTGQAADLK

SEQ ID NO: 442467 - protein, 9 aa, Influenza virus
GTGQAADYE

SEQ ID NO: 442468 - protein, 9 aa, Influenza virus
GTGQAADYK

SEQ ID NO: 442469 - protein, 9 aa, Influenza virus
GTGRIFQSG

SEQ ID NO: 442470 - protein, 9 aa, Influenza virus
GTGRIFQSR

SEQ ID NO: 442471 - protein, 9 aa, Influenza virus
GTGSIYIEV

SEQ ID NO: 442472 - protein, 9 aa, Influenza virus
GTGSVYIEV

SEQ ID NO: 442473 - protein, 9 aa, Influenza virus
GTGSWPDGA

SEQ ID NO: 442474 - protein, 9 aa, Influenza virus
GTGTAADLK

SEQ ID NO: 442475 - protein, 9 aa, Influenza virus
GTGTGYTMD

SEQ ID NO: 442476 - protein, 9 aa, Influenza virus
GTGTWPDGA

SEQ ID NO: 442477 - protein, 9 aa, Influenza virus
GTGYTMDTV

SEQ ID NO: 442478 - protein, 9 aa, Influenza virus
GTHGTGSWP

SEQ ID NO: 442479 - protein, 9 aa, Influenza virus
GTIAGFIEG

SEQ ID NO: 442480 - protein, 9 aa, Influenza virus
GTIASSLPF

SEQ ID NO: 442481 - protein, 9 aa, Influenza virus
GTIHDRAAF

SEQ ID NO: 442482 - protein, 9 aa, Influenza virus
GTIHDRSPF

SEQ ID NO: 442483 - protein, 9 aa, Influenza virus
GTIHDRSPY

SEQ ID NO: 442484 - protein, 9 aa, Influenza virus
GTIHDRSQF

SEQ ID NO: 442485 - protein, 9 aa, Influenza virus
GTIHDRSQY

SEQ ID NO: 442486 - protein, 9 aa, Influenza virus
GTIHDRTAF

SEQ ID NO: 442487 - protein, 9 aa, Influenza virus
GTIHDRTTF

SEQ ID NO: 442488 - protein, 9 aa, Influenza virus
GTIIGPPQC

SEQ ID NO: 442489 - protein, 9 aa, Influenza virus
GTIIKTLTN

SEQ ID NO: 442490 - protein, 9 aa, Influenza virus
GTIISNLPF

SEQ ID NO: 442491 - protein, 9 aa, Influenza virus
GTIISSLPF

SEQ ID NO: 442492 - protein, 9 aa, Influenza virus
GTIKDRSPY

SEQ ID NO: 442493 - protein, 9 aa, Influenza virus
GTINDRSPF

SEQ ID NO: 442494 - protein, 9 aa, Influenza virus
GTINSPLPF

SEQ ID NO: 442495 - protein, 9 aa, Influenza virus
GTISPRSRS

SEQ ID NO: 442496 - protein, 9 aa, Influenza virus
GTITGPPQC

SEQ ID NO: 442497 - protein, 9 aa, Influenza virus
GTITSNLPF

SEQ ID NO: 442498 - protein, 9 aa, Influenza virus
GTITSPLPF

SEQ ID NO: 442499 - protein, 9 aa, Influenza virus
GTIVKTLTD

SEQ ID NO: 442500 - protein, 9 aa, Influenza virus
GTIVKTLTN

SEQ ID NO: 442501 - protein, 9 aa, Influenza virus
GTIVKTLTS

SEQ ID NO: 442502 - protein, 9 aa, Influenza virus
GTIVSSLPF

SEQ ID NO: 442503 - protein, 9 aa, Influenza virus
GTKGFGFLN

SEQ ID NO: 442504 - protein, 9 aa, Influenza virus
GTKINTLTE

SEQ ID NO: 442505 - protein, 9 aa, Influenza virus
GTKQVCAAW

SEQ ID NO: 442506 - protein, 9 aa, Influenza virus
GTKQVCIAW

SEQ ID NO: 442507 - protein, 9 aa, Influenza virus
GTKQVCMAW

SEQ ID NO: 442508 - protein, 9 aa, Influenza virus
GTKQVCVAW

SEQ ID NO: 442509 - protein, 9 aa, Influenza virus
GTKRSHEQM

SEQ ID NO: 442510 - protein, 9 aa, Influenza virus
GTKRSYEQM

SEQ ID NO: 442511 - protein, 9 aa, Influenza virus
GTKVDTLTE

SEQ ID NO: 442512 - protein, 9 aa, Influenza virus
GTKVNTLAE

SEQ ID NO: 442513 - protein, 9 aa, Influenza virus
GTKVNTLTE

SEQ ID NO: 442514 - protein, 9 aa, Influenza virus
GTLIGPPQC

SEQ ID NO: 442515 - protein, 9 aa, Influenza virus
GTLNRLIDK

SEQ ID NO: 442516 - protein, 9 aa, Influenza virus
GTMDYYWGI

SEQ ID NO: 442517 - protein, 9 aa, Influenza virus
GTMHDRSPF

SEQ ID NO: 442518 - protein, 9 aa, Influenza virus
GTMKDRSPY

SEQ ID NO: 442519 - protein, 9 aa, Influenza virus
GTMVKTLAD

SEQ ID NO: 442520 - protein, 9 aa, Influenza virus
GTMVKTLTD

SEQ ID NO: 442521 - protein, 9 aa, Influenza virus
GTMVKTLTG

SEQ ID NO: 442522 - protein, 9 aa, Influenza virus
GTNGVKGFS

SEQ ID NO: 442523 - protein, 9 aa, Influenza virus
GTNNYGVKG

SEQ ID NO: 442524 - protein, 9 aa, Influenza virus
GTNRPILVI

SEQ ID NO: 442525 - protein, 9 aa, Influenza virus
GTNRPVLII

SEQ ID NO: 442526 - protein, 9 aa, Influenza virus
GTNRPVLVI

SEQ ID NO: 442527 - protein, 9 aa, Influenza virus
GTNRPVLVV

SEQ ID NO: 442528 - protein, 9 aa, Influenza virus
GTPACDLHL

SEQ ID NO: 442529 - protein, 9 aa, Influenza virus
GTPACDLYL

SEQ ID NO: 442530 - protein, 9 aa, Influenza virus
GTPDPGVKG

SEQ ID NO: 442531 - protein, 9 aa, Influenza virus
GTPLELRDC

SEQ ID NO: 442532 - protein, 9 aa, Influenza virus
GTPPTVSNS

SEQ ID NO: 442533 - protein, 9 aa, Influenza virus
GTPTLNQRS

SEQ ID NO: 442534 - protein, 9 aa, Influenza virus
GTPVCDPHL

SEQ ID NO: 442535 - protein, 9 aa, Influenza virus
GTQGVKGWA

SEQ ID NO: 442536 - protein, 9 aa, Influenza virus
GTQPLSISV

SEQ ID NO: 442537 - protein, 9 aa, Influenza virus
GTQSLSISI

SEQ ID NO: 442538 - protein, 9 aa, Influenza virus
GTQSLSISV

SEQ ID NO: 442539 - protein, 9 aa, Influenza virus
GTREWSYLI

SEQ ID NO: 442540 - protein, 9 aa, Influenza virus
GTRIGDGQR

SEQ ID NO: 442541 - protein, 9 aa, Influenza virus
GTRPGYNGQ

SEQ ID NO: 442542 - protein, 9 aa, Influenza virus
GTRQVCIAW

SEQ ID NO: 442543 - protein, 9 aa, Influenza virus
GTRQVCMAW

SEQ ID NO: 442544 - protein, 9 aa, Influenza virus
GTRQVCVAW

SEQ ID NO: 442545 - protein, 9 aa, Influenza virus
GTRRIDFHW

SEQ ID NO: 442546 - protein, 9 aa, Influenza virus
GTRVNTLTE

SEQ ID NO: 442547 - protein, 9 aa, Influenza virus
GTRWMKIIR

SEQ ID NO: 442548 - protein, 9 aa, Influenza virus
GTSGTYGAG

SEQ ID NO: 442549 - protein, 9 aa, Influenza virus
GTSGTYGSG

SEQ ID NO: 442550 - protein, 9 aa, Influenza virus
GTSGTYGTG

SEQ ID NO: 442551 - protein, 9 aa, Influenza virus
GTSIWTSSS

SEQ ID NO: 442552 - protein, 9 aa, Influenza virus
GTSKACNAL

SEQ ID NO: 442553 - protein, 9 aa, Influenza virus
GTSKACNAS

SEQ ID NO: 442554 - protein, 9 aa, Influenza virus
GTSKACSAS

SEQ ID NO: 442555 - protein, 9 aa, Influenza virus
GTSKIKMKW

SEQ ID NO: 442556 - protein, 9 aa, Influenza virus
GTSKVKMKW

SEQ ID NO: 442557 - protein, 9 aa, Influenza virus
GTSSFYRNL

SEQ ID NO: 442558 - protein, 9 aa, Influenza virus
GTSSIYIEV

SEQ ID NO: 442559 - protein, 9 aa, Influenza virus
GTSSVYIEV

SEQ ID NO: 442560 - protein, 9 aa, Influenza virus
GTSSVYVEV

SEQ ID NO: 442561 - protein, 9 aa, Influenza virus
GTSTLNHRS

SEQ ID NO: 442562 - protein, 9 aa, Influenza virus
GTSTLNKRS

SEQ ID NO: 442563 - protein, 9 aa, Influenza virus
GTSTLNLRL

SEQ ID NO: 442564 - protein, 9 aa, Influenza virus
GTSTLNQKL

SEQ ID NO: 442565 - protein, 9 aa, Influenza virus
GTSTLNQRL

SEQ ID NO: 442566 - protein, 9 aa, Influenza virus
GTSTLNQRM

SEQ ID NO: 442567 - protein, 9 aa, Influenza virus
GTSTLNQRS

SEQ ID NO: 442568 - protein, 9 aa, Influenza virus
GTSVKTLTD

SEQ ID NO: 442569 - protein, 9 aa, Influenza virus
GTSVWAGRT

SEQ ID NO: 442570 - protein, 9 aa, Influenza virus
GTTASCQNR

SEQ ID NO: 442571 - protein, 9 aa, Influenza virus
GTTGNPIIC

SEQ ID NO: 442572 - protein, 9 aa, Influenza virus
GTTHDRTAF

SEQ ID NO: 442573 - protein, 9 aa, Influenza virus
GTTIRGKHS

SEQ ID NO: 442574 - protein, 9 aa, Influenza virus
GTTIRGRHS

SEQ ID NO: 442575 - protein, 9 aa, Influenza virus
GTTIRNKHS

SEQ ID NO: 442576 - protein, 9 aa, Influenza virus
GTTIRNRHS

SEQ ID NO: 442577 - protein, 9 aa, Influenza virus
GTTLDNEHS

SEQ ID NO: 442578 - protein, 9 aa, Influenza virus
GTTLDNKHS

SEQ ID NO: 442579 - protein, 9 aa, Influenza virus
GTTLENKHS

SEQ ID NO: 442580 - protein, 9 aa, Influenza virus
GTTLKGRHA

SEQ ID NO: 442581 - protein, 9 aa, Influenza virus
GTTLNNKHS

SEQ ID NO: 442582 - protein, 9 aa, Influenza virus
GTTLRGQHA

SEQ ID NO: 442583 - protein, 9 aa, Influenza virus
GTTLRGRHA

SEQ ID NO: 442584 - protein, 9 aa, Influenza virus
GTTLYNKHS

SEQ ID NO: 442585 - protein, 9 aa, Influenza virus
GTTVNEEAL

SEQ ID NO: 442586 - protein, 9 aa, Influenza virus
GTVKDRSPF

SEQ ID NO: 442587 - protein, 9 aa, Influenza virus
GTVKDRSPY

SEQ ID NO: 442588 - protein, 9 aa, Influenza virus
GTVSLSPGM

SEQ ID NO: 442589 - protein, 9 aa, Influenza virus
GTVTGPPQC

SEQ ID NO: 442590 - protein, 9 aa, Influenza virus
GTVVKTLTD

SEQ ID NO: 442591 - protein, 9 aa, Influenza virus
GTWAVVMTD

SEQ ID NO: 442592 - protein, 9 aa, Influenza virus
GTWDTIIER

SEQ ID NO: 442593 - protein, 9 aa, Influenza virus
GTWDTLIER

SEQ ID NO: 442594 - protein, 9 aa, Influenza virus
GTWNTLIER

SEQ ID NO: 442595 - protein, 9 aa, Influenza virus
GTWPDGADI

SEQ ID NO: 442596 - protein, 9 aa, Influenza virus
GTYCSLNGI

SEQ ID NO: 442597 - protein, 9 aa, Influenza virus
GTYCSLNGV

SEQ ID NO: 442598 - protein, 9 aa, Influenza virus
GTYDHKDYE

SEQ ID NO: 442599 - protein, 9 aa, Influenza virus
GTYDHKEFE

SEQ ID NO: 442600 - protein, 9 aa, Influenza virus
GTYDHKEFK

SEQ ID NO: 442601 - protein, 9 aa, Influenza virus
GTYDHKEYE

SEQ ID NO: 442602 - protein, 9 aa, Influenza virus
GTYDHNIYR

SEQ ID NO: 442603 - protein, 9 aa, Influenza virus
GTYDYPKYE

SEQ ID NO: 442604 - protein, 9 aa, Influenza virus
GTYDYPKYQ

SEQ ID NO: 442605 - protein, 9 aa, Influenza virus
GTYDYPKYS

SEQ ID NO: 442606 - protein, 9 aa, Influenza virus
GTYDYSKYE

SEQ ID NO: 442607 - protein, 9 aa, Influenza virus
GTYGAGSWP

SEQ ID NO: 442608 - protein, 9 aa, Influenza virus
GTYGSGSWP

SEQ ID NO: 442609 - protein, 9 aa, Influenza virus
GTYGTGAWP

SEQ ID NO: 442610 - protein, 9 aa, Influenza virus
GTYGTGSWP

SEQ ID NO: 442611 - protein, 9 aa, Influenza virus
GTYGTGTWP

SEQ ID NO: 442612 - protein, 9 aa, Influenza virus
GTYKILTIY

SEQ ID NO: 442613 - protein, 9 aa, Influenza virus
GTYNHEDYK

SEQ ID NO: 442614 - protein, 9 aa, Influenza virus
GTYNHEDYR

SEQ ID NO: 442615 - protein, 9 aa, Influenza virus
GTYNHKDYE

SEQ ID NO: 442616 - protein, 9 aa, Influenza virus
GTYNHKEYE

SEQ ID NO: 442617 - protein, 9 aa, Influenza virus
GTYNHQDYE

SEQ ID NO: 442618 - protein, 9 aa, Influenza virus
GTYNHQEYE

SEQ ID NO: 442619 - protein, 9 aa, Influenza virus
GTYNHREYE

SEQ ID NO: 442620 - protein, 9 aa, Influenza virus
GTYNNTTGR

SEQ ID NO: 442621 - protein, 9 aa, Influenza virus
GTYNRKEYE

SEQ ID NO: 442622 - protein, 9 aa, Influenza virus
GTYNYPKYE

SEQ ID NO: 442623 - protein, 9 aa, Influenza virus
GTYNYPKYH

SEQ ID NO: 442624 - protein, 9 aa, Influenza virus
GTYNYPKYQ

SEQ ID NO: 442625 - protein, 9 aa, Influenza virus
GTYNYPKYS

SEQ ID NO: 442626 - protein, 9 aa, Influenza virus
GTYQILSIY

SEQ ID NO: 442627 - protein, 9 aa, Influenza virus
GTYYYPKYE

SEQ ID NO: 442628 - protein, 9 aa, Influenza virus
GVAIALSIL

SEQ ID NO: 442629 - protein, 9 aa, Influenza virus
GVAIALSVL

SEQ ID NO: 442630 - protein, 9 aa, Influenza virus
GVANLGLNI

SEQ ID NO: 442631 - protein, 9 aa, Influenza virus
GVAPSPSNS

SEQ ID NO: 442632 - protein, 9 aa, Influenza virus
GVAPSPYNS

SEQ ID NO: 442633 - protein, 9 aa, Influenza virus
GVAPVLGNY

SEQ ID NO: 442634 - protein, 9 aa, Influenza virus
GVCPVVFTD

SEQ ID NO: 442635 - protein, 9 aa, Influenza virus
GVCPVVMTD

SEQ ID NO: 442636 - protein, 9 aa, Influenza virus
GVCYPGSIE

SEQ ID NO: 442637 - protein, 9 aa, Influenza virus
GVCYPGSIK

SEQ ID NO: 442638 - protein, 9 aa, Influenza virus
GVDEYSNAE

SEQ ID NO: 442639 - protein, 9 aa, Influenza virus
GVDEYSSAE

SEQ ID NO: 442640 - protein, 9 aa, Influenza virus
GVDEYSSTE

SEQ ID NO: 442641 - protein, 9 aa, Influenza virus
GVDPFKLLQ

SEQ ID NO: 442642 - protein, 9 aa, Influenza virus
GVDPFRLLQ

SEQ ID NO: 442643 - protein, 9 aa, Influenza virus
GVDRFYRIC

SEQ ID NO: 442644 - protein, 9 aa, Influenza virus
GVDRFYRTC

SEQ ID NO: 442645 - protein, 9 aa, Influenza virus
GVDSDTTGW

SEQ ID NO: 442646 - protein, 9 aa, Influenza virus
GVDSDTTSW

SEQ ID NO: 442647 - protein, 9 aa, Influenza virus
GVEDGSIGK

SEQ ID NO: 442648 - protein, 9 aa, Influenza virus
GVEEGSIGK

SEQ ID NO: 442649 - protein, 9 aa, Influenza virus
GVEESSIGK

SEQ ID NO: 442650 - protein, 9 aa, Influenza virus
GVELSSMGV

SEQ ID NO: 442651 - protein, 9 aa, Influenza virus
GVESAVLRG

SEQ ID NO: 442652 - protein, 9 aa, Influenza virus
GVETMVILS

SEQ ID NO: 442653 - protein, 9 aa, Influenza virus
GVEVVDATE

SEQ ID NO: 442654 - protein, 9 aa, Influenza virus
GVEVVNATE

SEQ ID NO: 442655 - protein, 9 aa, Influenza virus
GVEYNGKSL

SEQ ID NO: 442656 - protein, 9 aa, Influenza virus
GVFEFSDER

SEQ ID NO: 442657 - protein, 9 aa, Influenza virus
GVFELSDEK

SEQ ID NO: 442658 - protein, 9 aa, Influenza virus
GVFELSDER

SEQ ID NO: 442659 - protein, 9 aa, Influenza virus
GVFGDNPRP

SEQ ID NO: 442660 - protein, 9 aa, Influenza virus
GVFGDNPRS

SEQ ID NO: 442661 - protein, 9 aa, Influenza virus
GVFGDSPRP

SEQ ID NO: 442662 - protein, 9 aa, Influenza virus
GVFGDTPRP

SEQ ID NO: 442663 - protein, 9 aa, Influenza virus
GVFLAPRYA

SEQ ID NO: 442664 - protein, 9 aa, Influenza virus
GVGIAADKE

SEQ ID NO: 442665 - protein, 9 aa, Influenza virus
GVGMAADKE

SEQ ID NO: 442666 - protein, 9 aa, Influenza virus
GVGNLAFNT

SEQ ID NO: 442667 - protein, 9 aa, Influenza virus
GVGNLIFNT

SEQ ID NO: 442668 - protein, 9 aa, Influenza virus
GVGNLVFNT

SEQ ID NO: 442669 - protein, 9 aa, Influenza virus
GVGRMTICI

SEQ ID NO: 442670 - protein, 9 aa, Influenza virus
GVGRMTICV

SEQ ID NO: 442671 - protein, 9 aa, Influenza virus
GVHHPSSDN

SEQ ID NO: 442672 - protein, 9 aa, Influenza virus
GVHHPSTDA

SEQ ID NO: 442673 - protein, 9 aa, Influenza virus
GVHHPSTDK

SEQ ID NO: 442674 - protein, 9 aa, Influenza virus
GVHHPSTDT

SEQ ID NO: 442675 - protein, 9 aa, Influenza virus
GVHHSSSLD

SEQ ID NO: 442676 - protein, 9 aa, Influenza virus
GVILEENTT

SEQ ID NO: 442677 - protein, 9 aa, Influenza virus
GVINTSKPF

SEQ ID NO: 442678 - protein, 9 aa, Influenza virus
GVIPLTTTP

SEQ ID NO: 442679 - protein, 9 aa, Influenza virus
GVITDTIKS

SEQ ID NO: 442680 - protein, 9 aa, Influenza virus
GVITDTLKS

SEQ ID NO: 442681 - protein, 9 aa, Influenza virus
GVIVTREPY

SEQ ID NO: 442682 - protein, 9 aa, Influenza virus
GVKGFAFKY

SEQ ID NO: 442683 - protein, 9 aa, Influenza virus
GVKGFAFLD

SEQ ID NO: 442684 - protein, 9 aa, Influenza virus
GVKGFAFLN

SEQ ID NO: 442685 - protein, 9 aa, Influenza virus
GVKGFAYLD

SEQ ID NO: 442686 - protein, 9 aa, Influenza virus
GVKGFGFKA

SEQ ID NO: 442687 - protein, 9 aa, Influenza virus
GVKGFGFKK

SEQ ID NO: 442688 - protein, 9 aa, Influenza virus
GVKGFGFKS

SEQ ID NO: 442689 - protein, 9 aa, Influenza virus
GVKGFGFKT

SEQ ID NO: 442690 - protein, 9 aa, Influenza virus
GVKGFGFKV

SEQ ID NO: 442691 - protein, 9 aa, Influenza virus
GVKGFGFLD

SEQ ID NO: 442692 - protein, 9 aa, Influenza virus
GVKGFGFLN

SEQ ID NO: 442693 - protein, 9 aa, Influenza virus
GVKGFGFLS

SEQ ID NO: 442694 - protein, 9 aa, Influenza virus
GVKGFGFRQ

SEQ ID NO: 442695 - protein, 9 aa, Influenza virus
GVKGFSFKY

SEQ ID NO: 442696 - protein, 9 aa, Influenza virus
GVKGFSFRY

SEQ ID NO: 442697 - protein, 9 aa, Influenza virus
GVKGFSYKY

SEQ ID NO: 442698 - protein, 9 aa, Influenza virus
GVKGFSYLD

SEQ ID NO: 442699 - protein, 9 aa, Influenza virus
GVKGFSYLN

SEQ ID NO: 442700 - protein, 9 aa, Influenza virus
GVKGFSYRY

SEQ ID NO: 442701 - protein, 9 aa, Influenza virus
GVKGWAFDD

SEQ ID NO: 442702 - protein, 9 aa, Influenza virus
GVKGWAFDE

SEQ ID NO: 442703 - protein, 9 aa, Influenza virus
GVKGWAFDI

SEQ ID NO: 442704 - protein, 9 aa, Influenza virus
GVKGWAFDN

SEQ ID NO: 442705 - protein, 9 aa, Influenza virus
GVKGWAFDS

SEQ ID NO: 442706 - protein, 9 aa, Influenza virus
GVKGWAFDV

SEQ ID NO: 442707 - protein, 9 aa, Influenza virus
GVKGWAFDY

SEQ ID NO: 442708 - protein, 9 aa, Influenza virus
GVKLAQGYK

SEQ ID NO: 442709 - protein, 9 aa, Influenza virus
GVKLEENST

SEQ ID NO: 442710 - protein, 9 aa, Influenza virus
GVKLEENTS

SEQ ID NO: 442711 - protein, 9 aa, Influenza virus
GVKLEENTT

SEQ ID NO: 442712 - protein, 9 aa, Influenza virus
GVKLIQGYK

SEQ ID NO: 442713 - protein, 9 aa, Influenza virus
GVKLSNMGI

SEQ ID NO: 442714 - protein, 9 aa, Influenza virus
GVKLSNMGV

SEQ ID NO: 442715 - protein, 9 aa, Influenza virus
GVKLSSMGI

SEQ ID NO: 442716 - protein, 9 aa, Influenza virus
GVKLSSMGV

SEQ ID NO: 442717 - protein, 9 aa, Influenza virus
GVKLTQGYK

SEQ ID NO: 442718 - protein, 9 aa, Influenza virus
GVKMNPNQK

SEQ ID NO: 442719 - protein, 9 aa, Influenza virus
GVKPLILKD

SEQ ID NO: 442720 - protein, 9 aa, Influenza virus
GVKPLILRD

SEQ ID NO: 442721 - protein, 9 aa, Influenza virus
GVKPLILRN

SEQ ID NO: 442722 - protein, 9 aa, Influenza virus
GVKVDGSSS

SEQ ID NO: 442723 - protein, 9 aa, Influenza virus
GVLEDEQMY

SEQ ID NO: 442724 - protein, 9 aa, Influenza virus
GVLGDNPRP

SEQ ID NO: 442725 - protein, 9 aa, Influenza virus
GVLHLILWI

SEQ ID NO: 442726 - protein, 9 aa, Influenza virus
GVLLGTKHS

SEQ ID NO: 442727 - protein, 9 aa, Influenza virus
GVLTDTSRP

SEQ ID NO: 442728 - protein, 9 aa, Influenza virus
GVMKTEGTL

SEQ ID NO: 442729 - protein, 9 aa, Influenza virus
GVMNTSKPF

SEQ ID NO: 442730 - protein, 9 aa, Influenza virus
GVMNTSKPL

SEQ ID NO: 442731 - protein, 9 aa, Influenza virus
GVNDRNFWR

SEQ ID NO: 442732 - protein, 9 aa, Influenza virus
GVNESADMS

SEQ ID NO: 442733 - protein, 9 aa, Influenza virus
GVNRFYRTC

SEQ ID NO: 442734 - protein, 9 aa, Influenza virus
GVNSDTTGW

SEQ ID NO: 442735 - protein, 9 aa, Influenza virus
GVNSDTTSW

SEQ ID NO: 442736 - protein, 9 aa, Influenza virus
GVNSFSRTE

SEQ ID NO: 442737 - protein, 9 aa, Influenza virus
GVNSNTTGW

SEQ ID NO: 442738 - protein, 9 aa, Influenza virus
GVNTNKTFQ

SEQ ID NO: 442739 - protein, 9 aa, Influenza virus
GVPESMREE

SEQ ID NO: 442740 - protein, 9 aa, Influenza virus
GVPFHLATK

SEQ ID NO: 442741 - protein, 9 aa, Influenza virus
GVPFHLGTK

SEQ ID NO: 442742 - protein, 9 aa, Influenza virus
GVPFHLGTR

SEQ ID NO: 442743 - protein, 9 aa, Influenza virus
GVPFYLGTK

SEQ ID NO: 442744 - protein, 9 aa, Influenza virus
GVPFYLGTR

SEQ ID NO: 442745 - protein, 9 aa, Influenza virus
GVPKSMREE

SEQ ID NO: 442746 - protein, 9 aa, Influenza virus
GVPPLELGD

SEQ ID NO: 442747 - protein, 9 aa, Influenza virus
GVPTDVIRS

SEQ ID NO: 442748 - protein, 9 aa, Influenza virus
GVPTDVMRS

SEQ ID NO: 442749 - protein, 9 aa, Influenza virus
GVPTDVVRS

SEQ ID NO: 442750 - protein, 9 aa, Influenza virus
GVPVTSSID

SEQ ID NO: 442751 - protein, 9 aa, Influenza virus
GVPVTSSVD

SEQ ID NO: 442752 - protein, 9 aa, Influenza virus
GVQAGVDRF

SEQ ID NO: 442753 - protein, 9 aa, Influenza virus
GVQDIIDND

SEQ ID NO: 442754 - protein, 9 aa, Influenza virus
GVQDIIDNN

SEQ ID NO: 442755 - protein, 9 aa, Influenza virus
GVQIASNEN

SEQ ID NO: 442756 - protein, 9 aa, Influenza virus
GVQMQRFRR

SEQ ID NO: 442757 - protein, 9 aa, Influenza virus
GVQVASNEN

SEQ ID NO: 442758 - protein, 9 aa, Influenza virus
GVRCICRDN

SEQ ID NO: 442759 - protein, 9 aa, Influenza virus
GVREWSYLI

SEQ ID NO: 442760 - protein, 9 aa, Influenza virus
GVRLEENTT

SEQ ID NO: 442761 - protein, 9 aa, Influenza virus
GVRLTQGYK

SEQ ID NO: 442762 - protein, 9 aa, Influenza virus
GVRPGYNGQ

SEQ ID NO: 442763 - protein, 9 aa, Influenza virus
GVRPLILKD

SEQ ID NO: 442764 - protein, 9 aa, Influenza virus
GVRPLILRD

SEQ ID NO: 442765 - protein, 9 aa, Influenza virus
GVRPRYNGQ

SEQ ID NO: 442766 - protein, 9 aa, Influenza virus
GVSFHLGTK

SEQ ID NO: 442767 - protein, 9 aa, Influenza virus
GVSGADDDA

SEQ ID NO: 442768 - protein, 9 aa, Influenza virus
GVSGADNDA

SEQ ID NO: 442769 - protein, 9 aa, Influenza virus
GVSGEVPGW

SEQ ID NO: 442770 - protein, 9 aa, Influenza virus
GVSGINESA

SEQ ID NO: 442771 - protein, 9 aa, Influenza virus
GVSGPDNGA

SEQ ID NO: 442772 - protein, 9 aa, Influenza virus
GVSGTDDDA

SEQ ID NO: 442773 - protein, 9 aa, Influenza virus
GVSGVNESA

SEQ ID NO: 442774 - protein, 9 aa, Influenza virus
GVSILNLGQ

SEQ ID NO: 442775 - protein, 9 aa, Influenza virus
GVSPIHLGD

SEQ ID NO: 442776 - protein, 9 aa, Influenza virus
GVSPVHLGD

SEQ ID NO: 442777 - protein, 9 aa, Influenza virus
GVSSEVPEW

SEQ ID NO: 442778 - protein, 9 aa, Influenza virus
GVSSEVPGC

SEQ ID NO: 442779 - protein, 9 aa, Influenza virus
GVSSEVPGW

SEQ ID NO: 442780 - protein, 9 aa, Influenza virus
GVSVLNLGQ

SEQ ID NO: 442781 - protein, 9 aa, Influenza virus
GVTASCLDK

SEQ ID NO: 442782 - protein, 9 aa, Influenza virus
GVTASCLDR

SEQ ID NO: 442783 - protein, 9 aa, Influenza virus
GVTASCRDN

SEQ ID NO: 442784 - protein, 9 aa, Influenza virus
GVTLSVVSL

SEQ ID NO: 442785 - protein, 9 aa, Influenza virus
GVTNKVNSI

SEQ ID NO: 442786 - protein, 9 aa, Influenza virus
GVTRREIHI

SEQ ID NO: 442787 - protein, 9 aa, Influenza virus
GVTRREVHI

SEQ ID NO: 442788 - protein, 9 aa, Influenza virus
GVTRREVHM

SEQ ID NO: 442789 - protein, 9 aa, Influenza virus
GVTRREVHT

SEQ ID NO: 442790 - protein, 9 aa, Influenza virus
GVTRREVHV

SEQ ID NO: 442791 - protein, 9 aa, Influenza virus
GVTTHYVSQ

SEQ ID NO: 442792 - protein, 9 aa, Influenza virus
GVTVIKNNM

SEQ ID NO: 442793 - protein, 9 aa, Influenza virus
GVTVIRNNM

SEQ ID NO: 442794 - protein, 9 aa, Influenza virus
GVVNTALST

SEQ ID NO: 442795 - protein, 9 aa, Influenza virus
GVVNTTLST

SEQ ID NO: 442796 - protein, 9 aa, Influenza virus
GVWIGRTKN

SEQ ID NO: 442797 - protein, 9 aa, Influenza virus
GVWIGRTKS

SEQ ID NO: 442798 - protein, 9 aa, Influenza virus
GVWTYNAEL

SEQ ID NO: 442799 - protein, 9 aa, Influenza virus
GVWWTSNSI

SEQ ID NO: 442800 - protein, 9 aa, Influenza virus
GVYINTALL

SEQ ID NO: 442801 - protein, 9 aa, Influenza virus
GVYINTAML

SEQ ID NO: 442802 - protein, 9 aa, Influenza virus
GVYKALSIY

SEQ ID NO: 442803 - protein, 9 aa, Influenza virus
GVYMNTALL

SEQ ID NO: 442804 - protein, 9 aa, Influenza virus
GVYNNTTGR

SEQ ID NO: 442805 - protein, 9 aa, Influenza virus
GVYQILAIY

SEQ ID NO: 442806 - protein, 9 aa, Influenza virus
GVYQILSIY

SEQ ID NO: 442807 - protein, 9 aa, Influenza virus
GVYQVLAIY

SEQ ID NO: 442808 - protein, 9 aa, Influenza virus
GVYVNTALL

SEQ ID NO: 442809 - protein, 9 aa, Influenza virus
GWAFDNGDD

SEQ ID NO: 442810 - protein, 9 aa, Influenza virus
GWAFDNGND

SEQ ID NO: 442811 - protein, 9 aa, Influenza virus
GWAFDSGDD

SEQ ID NO: 442812 - protein, 9 aa, Influenza virus
GWAFDYGND

SEQ ID NO: 442813 - protein, 9 aa, Influenza virus
GWAFDYGSD

SEQ ID NO: 442814 - protein, 9 aa, Influenza virus
GWAIHSKDN

SEQ ID NO: 442815 - protein, 9 aa, Influenza virus
GWAIHTKDN

SEQ ID NO: 442816 - protein, 9 aa, Influenza virus
GWAIYSKDN

SEQ ID NO: 442817 - protein, 9 aa, Influenza virus
GWAIYTKDN

SEQ ID NO: 442818 - protein, 9 aa, Influenza virus
GWAPLSKDN

SEQ ID NO: 442819 - protein, 9 aa, Influenza virus
GWATANSKS

SEQ ID NO: 442820 - protein, 9 aa, Influenza virus
GWAVHSKDN

SEQ ID NO: 442821 - protein, 9 aa, Influenza virus
GWAVYSKDN

SEQ ID NO: 442822 - protein, 9 aa, Influenza virus
GWCGMIDGW

SEQ ID NO: 442823 - protein, 9 aa, Influenza virus
GWEGLIDGW

SEQ ID NO: 442824 - protein, 9 aa, Influenza virus
GWEGLINGW

SEQ ID NO: 442825 - protein, 9 aa, Influenza virus
GWEGLVDGW

SEQ ID NO: 442826 - protein, 9 aa, Influenza virus
GWEGMIDGW

SEQ ID NO: 442827 - protein, 9 aa, Influenza virus
GWEGMMDGW

SEQ ID NO: 442828 - protein, 9 aa, Influenza virus
GWEGMVDGW

SEQ ID NO: 442829 - protein, 9 aa, Influenza virus
GWEGMVNGW

SEQ ID NO: 442830 - protein, 9 aa, Influenza virus
GWIDSPNHA

SEQ ID NO: 442831 - protein, 9 aa, Influenza virus
GWIGGNPAC

SEQ ID NO: 442832 - protein, 9 aa, Influenza virus
GWILGNPEC

SEQ ID NO: 442833 - protein, 9 aa, Influenza virus
GWILGNPKC

SEQ ID NO: 442834 - protein, 9 aa, Influenza virus
GWILGNPMC

SEQ ID NO: 442835 - protein, 9 aa, Influenza virus
GWILGNPQC

SEQ ID NO: 442836 - protein, 9 aa, Influenza virus
GWILGNPRC

SEQ ID NO: 442837 - protein, 9 aa, Influenza virus
GWINSPNHA

SEQ ID NO: 442838 - protein, 9 aa, Influenza virus
GWINSPNHV

SEQ ID NO: 442839 - protein, 9 aa, Influenza virus
GWINSPSQA

SEQ ID NO: 442840 - protein, 9 aa, Influenza virus
GWITIGISG

SEQ ID NO: 442841 - protein, 9 aa, Influenza virus
GWIVGNPAC

SEQ ID NO: 442842 - protein, 9 aa, Influenza virus
GWIVGNPSC

SEQ ID NO: 442843 - protein, 9 aa, Influenza virus
GWLIGNPKC

SEQ ID NO: 442844 - protein, 9 aa, Influenza virus
GWLLGNPAC

SEQ ID NO: 442845 - protein, 9 aa, Influenza virus
GWLLGNPEC

SEQ ID NO: 442846 - protein, 9 aa, Influenza virus
GWLLGNPGC

SEQ ID NO: 442847 - protein, 9 aa, Influenza virus
GWLLGNPKC

SEQ ID NO: 442848 - protein, 9 aa, Influenza virus
GWLLGNPLC

SEQ ID NO: 442849 - protein, 9 aa, Influenza virus
GWLLGNPMC

SEQ ID NO: 442850 - protein, 9 aa, Influenza virus
GWLTIGISG

SEQ ID NO: 442851 - protein, 9 aa, Influenza virus
GWLTIGITG

SEQ ID NO: 442852 - protein, 9 aa, Influenza virus
GWLTLGITG

SEQ ID NO: 442853 - protein, 9 aa, Influenza virus
GWMDYYWGI

SEQ ID NO: 442854 - protein, 9 aa, Influenza virus
GWPGLINGW

SEQ ID NO: 442855 - protein, 9 aa, Influenza virus
GWPGLVAGW

SEQ ID NO: 442856 - protein, 9 aa, Influenza virus
GWPWPDGAL

SEQ ID NO: 442857 - protein, 9 aa, Influenza virus
GWQGLIDGW

SEQ ID NO: 442858 - protein, 9 aa, Influenza virus
GWQGLVDGW

SEQ ID NO: 442859 - protein, 9 aa, Influenza virus
GWQGMIDGW

SEQ ID NO: 442860 - protein, 9 aa, Influenza virus
GWQGMVDGW

SEQ ID NO: 442861 - protein, 9 aa, Influenza virus
GWSATACHD

SEQ ID NO: 442862 - protein, 9 aa, Influenza virus
GWSGLIAGW

SEQ ID NO: 442863 - protein, 9 aa, Influenza virus
GWSGLVAGW

SEQ ID NO: 442864 - protein, 9 aa, Influenza virus
GWSGMIDGW

SEQ ID NO: 442865 - protein, 9 aa, Influenza virus
GWSSTSCHD

SEQ ID NO: 442866 - protein, 9 aa, Influenza virus
GWSSTTCHD

SEQ ID NO: 442867 - protein, 9 aa, Influenza virus
GWSWDDGAI

SEQ ID NO: 442868 - protein, 9 aa, Influenza virus
GWSWPDDAE

SEQ ID NO: 442869 - protein, 9 aa, Influenza virus
GWSWPDGAE

SEQ ID NO: 442870 - protein, 9 aa, Influenza virus
GWSWPDGAK

SEQ ID NO: 442871 - protein, 9 aa, Influenza virus
GWSWPDGAL

SEQ ID NO: 442872 - protein, 9 aa, Influenza virus
GWSYIVERP

SEQ ID NO: 442873 - protein, 9 aa, Influenza virus
GWTGLIDGW

SEQ ID NO: 442874 - protein, 9 aa, Influenza virus
GWTGMIDGW

SEQ ID NO: 442875 - protein, 9 aa, Influenza virus
GWTGMVDGW

SEQ ID NO: 442876 - protein, 9 aa, Influenza virus
GWTGMVNGW

SEQ ID NO: 442877 - protein, 9 aa, Influenza virus
GWTIANSKS

SEQ ID NO: 442878 - protein, 9 aa, Influenza virus
GWTSNSIVV

SEQ ID NO: 442879 - protein, 9 aa, Influenza virus
GWTTANSKS

SEQ ID NO: 442880 - protein, 9 aa, Influenza virus
GWVAVAKDN

SEQ ID NO: 442881 - protein, 9 aa, Influenza virus
GWVSTDKDS

SEQ ID NO: 442882 - protein, 9 aa, Influenza virus
GWVSTDKNS

SEQ ID NO: 442883 - protein, 9 aa, Influenza virus
GWVTADKDS

SEQ ID NO: 442884 - protein, 9 aa, Influenza virus
GWVVIAKDN

SEQ ID NO: 442885 - protein, 9 aa, Influenza virus
GWVVIAQDN

SEQ ID NO: 442886 - protein, 9 aa, Influenza virus
GWVVIEKDN

SEQ ID NO: 442887 - protein, 9 aa, Influenza virus
GWVVVAKDN

SEQ ID NO: 442888 - protein, 9 aa, Influenza virus
GWYGFHHSN

SEQ ID NO: 442889 - protein, 9 aa, Influenza virus
GWYGFKHQN

SEQ ID NO: 442890 - protein, 9 aa, Influenza virus
GWYGFQHQN

SEQ ID NO: 442891 - protein, 9 aa, Influenza virus
GWYGFQHRN

SEQ ID NO: 442892 - protein, 9 aa, Influenza virus
GWYGFQHSN

SEQ ID NO: 442893 - protein, 9 aa, Influenza virus
GWYGFRHHN

SEQ ID NO: 442894 - protein, 9 aa, Influenza virus
GWYGFRHQK

SEQ ID NO: 442895 - protein, 9 aa, Influenza virus
GWYGFRHQN

SEQ ID NO: 442896 - protein, 9 aa, Influenza virus
GWYGFRYQN

SEQ ID NO: 442897 - protein, 9 aa, Influenza virus
GWYGYHHEN

SEQ ID NO: 442898 - protein, 9 aa, Influenza virus
GWYGYHHIN

SEQ ID NO: 442899 - protein, 9 aa, Influenza virus
GWYGYHHNN

SEQ ID NO: 442900 - protein, 9 aa, Influenza virus
GWYGYHHQN

SEQ ID NO: 442901 - protein, 9 aa, Influenza virus
GWYGYHHSN

SEQ ID NO: 442902 - protein, 9 aa, Influenza virus
GWYGYHHTN

SEQ ID NO: 442903 - protein, 9 aa, Influenza virus
GWYGYKHQN

SEQ ID NO: 442904 - protein, 9 aa, Influenza virus
GWYGYRHQN

SEQ ID NO: 442905 - protein, 9 aa, Influenza virus
GYAADKAST

SEQ ID NO: 442906 - protein, 9 aa, Influenza virus
GYAADKDST

SEQ ID NO: 442907 - protein, 9 aa, Influenza virus
GYAADKEST

SEQ ID NO: 442908 - protein, 9 aa, Influenza virus
GYAADKKST

SEQ ID NO: 442909 - protein, 9 aa, Influenza virus
GYAADLKST

SEQ ID NO: 442910 - protein, 9 aa, Influenza virus
GYAADQEST

SEQ ID NO: 442911 - protein, 9 aa, Influenza virus
GYAADQKST

SEQ ID NO: 442912 - protein, 9 aa, Influenza virus
GYAADREST

SEQ ID NO: 442913 - protein, 9 aa, Influenza virus
GYAADRKST

SEQ ID NO: 442914 - protein, 9 aa, Influenza virus
GYAQTDCVL

SEQ ID NO: 442915 - protein, 9 aa, Influenza virus
GYCFTVMTD

SEQ ID NO: 442916 - protein, 9 aa, Influenza virus
GYDFEKEGY

SEQ ID NO: 442917 - protein, 9 aa, Influenza virus
GYDFEREGY

SEQ ID NO: 442918 - protein, 9 aa, Influenza virus
GYEEFTIVG

SEQ ID NO: 442919 - protein, 9 aa, Influenza virus
GYEEFTLVG

SEQ ID NO: 442920 - protein, 9 aa, Influenza virus
GYEEFTMVG

SEQ ID NO: 442921 - protein, 9 aa, Influenza virus
GYEILKVPN

SEQ ID NO: 442922 - protein, 9 aa, Influenza virus
GYEKNATAS

SEQ ID NO: 442923 - protein, 9 aa, Influenza virus
GYEMLKVPD

SEQ ID NO: 442924 - protein, 9 aa, Influenza virus
GYEMLKVPN

SEQ ID NO: 442925 - protein, 9 aa, Influenza virus
GYETFKVIG

SEQ ID NO: 442926 - protein, 9 aa, Influenza virus
GYETFRVID

SEQ ID NO: 442927 - protein, 9 aa, Influenza virus
GYETFRVIG

SEQ ID NO: 442928 - protein, 9 aa, Influenza virus
GYETFRVIS

SEQ ID NO: 442929 - protein, 9 aa, Influenza virus
GYEVLKVPD

SEQ ID NO: 442930 - protein, 9 aa, Influenza virus
GYEVLKVPN

SEQ ID NO: 442931 - protein, 9 aa, Influenza virus
GYFGIFFVE

SEQ ID NO: 442932 - protein, 9 aa, Influenza virus
GYFGVFSVE

SEQ ID NO: 442933 - protein, 9 aa, Influenza virus
GYGVKGFGF

SEQ ID NO: 442934 - protein, 9 aa, Influenza virus
GYHANNSKK

SEQ ID NO: 442935 - protein, 9 aa, Influenza virus
GYHANNSTD

SEQ ID NO: 442936 - protein, 9 aa, Influenza virus
GYHANNSTE

SEQ ID NO: 442937 - protein, 9 aa, Influenza virus
GYHANNSTK

SEQ ID NO: 442938 - protein, 9 aa, Influenza virus
GYHANNSTT

SEQ ID NO: 442939 - protein, 9 aa, Influenza virus
GYHANNSTV

SEQ ID NO: 442940 - protein, 9 aa, Influenza virus
GYHFEECSC

SEQ ID NO: 442941 - protein, 9 aa, Influenza virus
GYHHENSQG

SEQ ID NO: 442942 - protein, 9 aa, Influenza virus
GYHHNNEQG

SEQ ID NO: 442943 - protein, 9 aa, Influenza virus
GYHHQNEQG

SEQ ID NO: 442944 - protein, 9 aa, Influenza virus
GYHHQNGQG

SEQ ID NO: 442945 - protein, 9 aa, Influenza virus
GYHHSKEQG

SEQ ID NO: 442946 - protein, 9 aa, Influenza virus
GYHHSNDQG

SEQ ID NO: 442947 - protein, 9 aa, Influenza virus
GYHHSNEQG

SEQ ID NO: 442948 - protein, 9 aa, Influenza virus
GYHHSNGQG

SEQ ID NO: 442949 - protein, 9 aa, Influenza virus
GYHSNNSTE

SEQ ID NO: 442950 - protein, 9 aa, Influenza virus
GYICSGFFG

SEQ ID NO: 442951 - protein, 9 aa, Influenza virus
GYICSGIFG

SEQ ID NO: 442952 - protein, 9 aa, Influenza virus
GYICSGVFG

SEQ ID NO: 442953 - protein, 9 aa, Influenza virus
GYICSKFHS

SEQ ID NO: 442954 - protein, 9 aa, Influenza virus
GYIEGKLSQ

SEQ ID NO: 442955 - protein, 9 aa, Influenza virus
GYIIEEYGK

SEQ ID NO: 442956 - protein, 9 aa, Influenza virus
GYIIEEYGR

SEQ ID NO: 442957 - protein, 9 aa, Influenza virus
GYIIEKYGS

SEQ ID NO: 442958 - protein, 9 aa, Influenza virus
GYIIEKYGT

SEQ ID NO: 442959 - protein, 9 aa, Influenza virus
GYKDIILWF

SEQ ID NO: 442960 - protein, 9 aa, Influenza virus
GYKDIILWI

SEQ ID NO: 442961 - protein, 9 aa, Influenza virus
GYKDIILWV

SEQ ID NO: 442962 - protein, 9 aa, Influenza virus
GYKDVILWF

SEQ ID NO: 442963 - protein, 9 aa, Influenza virus
GYKDWFLWI

SEQ ID NO: 442964 - protein, 9 aa, Influenza virus
GYKDWILWI

SEQ ID NO: 442965 - protein, 9 aa, Influenza virus
GYKDWVLWI

SEQ ID NO: 442966 - protein, 9 aa, Influenza virus
GYKEIILWF

SEQ ID NO: 442967 - protein, 9 aa, Influenza virus
GYKEVILWF

SEQ ID NO: 442968 - protein, 9 aa, Influenza virus
GYKHQNAQG

SEQ ID NO: 442969 - protein, 9 aa, Influenza virus
GYKMNIQIL

SEQ ID NO: 442970 - protein, 9 aa, Influenza virus
GYKMNNQIL

SEQ ID NO: 442971 - protein, 9 aa, Influenza virus
GYKMNTKIL

SEQ ID NO: 442972 - protein, 9 aa, Influenza virus
GYKMNTQIL

SEQ ID NO: 442973 - protein, 9 aa, Influenza virus
GYKMNTRIL

SEQ ID NO: 442974 - protein, 9 aa, Influenza virus
GYKNWILWI

SEQ ID NO: 442975 - protein, 9 aa, Influenza virus
GYLCAGIPS

SEQ ID NO: 442976 - protein, 9 aa, Influenza virus
GYLCAGIPT

SEQ ID NO: 442977 - protein, 9 aa, Influenza virus
GYLCAGLPS

SEQ ID NO: 442978 - protein, 9 aa, Influenza virus
GYLIRALTL

SEQ ID NO: 442979 - protein, 9 aa, Influenza virus
GYLITGKSH

SEQ ID NO: 442980 - protein, 9 aa, Influenza virus
GYLLKGESH

SEQ ID NO: 442981 - protein, 9 aa, Influenza virus
GYLLKGESY

SEQ ID NO: 442982 - protein, 9 aa, Influenza virus
GYLLLNKSL

SEQ ID NO: 442983 - protein, 9 aa, Influenza virus
GYLLRGESH

SEQ ID NO: 442984 - protein, 9 aa, Influenza virus
GYLSNNATD

SEQ ID NO: 442985 - protein, 9 aa, Influenza virus
GYLSNNSSD

SEQ ID NO: 442986 - protein, 9 aa, Influenza virus
GYLSNNSTD

SEQ ID NO: 442987 - protein, 9 aa, Influenza virus
GYLSNNSTE

SEQ ID NO: 442988 - protein, 9 aa, Influenza virus
GYLSTNSSD

SEQ ID NO: 442989 - protein, 9 aa, Influenza virus
GYLSTNSSE

SEQ ID NO: 442990 - protein, 9 aa, Influenza virus
GYLSTNSTE

SEQ ID NO: 442991 - protein, 9 aa, Influenza virus
GYMFESKKM

SEQ ID NO: 442992 - protein, 9 aa, Influenza virus
GYMFESKNM

SEQ ID NO: 442993 - protein, 9 aa, Influenza virus
GYMFESKRM

SEQ ID NO: 442994 - protein, 9 aa, Influenza virus
GYMFESKSM

SEQ ID NO: 442995 - protein, 9 aa, Influenza virus
GYMSNNSTE

SEQ ID NO: 442996 - protein, 9 aa, Influenza virus
GYNFEKEGY

SEQ ID NO: 442997 - protein, 9 aa, Influenza virus
GYNGQKSWM

SEQ ID NO: 442998 - protein, 9 aa, Influenza virus
GYNGQKSWT

SEQ ID NO: 442999 - protein, 9 aa, Influenza virus
GYNGQRSWM

SEQ ID NO: 443000 - protein, 9 aa, Influenza virus
GYPGVKGWA

SEQ ID NO: 443001 - protein, 9 aa, Influenza virus
GYQSLRSIL

SEQ ID NO: 443002 - protein, 9 aa, Influenza virus
GYQSNNSTD

SEQ ID NO: 443003 - protein, 9 aa, Influenza virus
GYQSNNSTN

SEQ ID NO: 443004 - protein, 9 aa, Influenza virus
GYQSTNSTE

SEQ ID NO: 443005 - protein, 9 aa, Influenza virus
GYQTNNSTD

SEQ ID NO: 443006 - protein, 9 aa, Influenza virus
GYQTNNSTE

SEQ ID NO: 443007 - protein, 9 aa, Influenza virus
GYRHQNAQG

SEQ ID NO: 443008 - protein, 9 aa, Influenza virus
GYSGAFIDY

SEQ ID NO: 443009 - protein, 9 aa, Influenza virus
GYSGAFMDY

SEQ ID NO: 443010 - protein, 9 aa, Influenza virus
GYSGAFTIP

SEQ ID NO: 443011 - protein, 9 aa, Influenza virus
GYSGAFTVP

SEQ ID NO: 443012 - protein, 9 aa, Influenza virus
GYSGAFVDY

SEQ ID NO: 443013 - protein, 9 aa, Influenza virus
GYSGIFSIE

SEQ ID NO: 443014 - protein, 9 aa, Influenza virus
GYSGIFSVE

SEQ ID NO: 443015 - protein, 9 aa, Influenza virus
GYSGSFIDY

SEQ ID NO: 443016 - protein, 9 aa, Influenza virus
GYSGSFIQH

SEQ ID NO: 443017 - protein, 9 aa, Influenza virus
GYSGSFMDY

SEQ ID NO: 443018 - protein, 9 aa, Influenza virus
GYSGSFSIR

SEQ ID NO: 443019 - protein, 9 aa, Influenza virus
GYSGSFTIP

SEQ ID NO: 443020 - protein, 9 aa, Influenza virus
GYSGSFTLP

SEQ ID NO: 443021 - protein, 9 aa, Influenza virus
GYSGSFVDY

SEQ ID NO: 443022 - protein, 9 aa, Influenza virus
GYSGSFVQH

SEQ ID NO: 443023 - protein, 9 aa, Influenza virus
GYSGVFSVE

SEQ ID NO: 443024 - protein, 9 aa, Influenza virus
GYSLVGIDP

SEQ ID NO: 443025 - protein, 9 aa, Influenza virus
GYSLVGVDP

SEQ ID NO: 443026 - protein, 9 aa, Influenza virus
GYSTGALAS

SEQ ID NO: 443027 - protein, 9 aa, Influenza virus
GYTMDTVNR

SEQ ID NO: 443028 - protein, 9 aa, Influenza virus
GYTMDTVSR

SEQ ID NO: 443029 - protein, 9 aa, Influenza virus
GYVCSGIFG

SEQ ID NO: 443030 - protein, 9 aa, Influenza virus
GYVCSGLVG

SEQ ID NO: 443031 - protein, 9 aa, Influenza virus
GYVCSGVFG

SEQ ID NO: 443032 - protein, 9 aa, Influenza virus
GYVCSKFHS

SEQ ID NO: 443033 - protein, 9 aa, Influenza virus
GYWAIRTRS

SEQ ID NO: 443034 - protein, 9 aa, Influenza virus
HAKDILEKA

SEQ ID NO: 443035 - protein, 9 aa, Influenza virus
HAKDILEKT

SEQ ID NO: 443036 - protein, 9 aa, Influenza virus
HAKNILEKT

SEQ ID NO: 443037 - protein, 9 aa, Influenza virus
HALKLVVAM

SEQ ID NO: 443038 - protein, 9 aa, Influenza virus
HALRELWQC

SEQ ID NO: 443039 - protein, 9 aa, Influenza virus
HANGTIHDR

SEQ ID NO: 443040 - protein, 9 aa, Influenza virus
HANGTINDR

SEQ ID NO: 443041 - protein, 9 aa, Influenza virus
HANGTMHDR

SEQ ID NO: 443042 - protein, 9 aa, Influenza virus
HANNSKKQI

SEQ ID NO: 443043 - protein, 9 aa, Influenza virus
HANNSTDTI

SEQ ID NO: 443044 - protein, 9 aa, Influenza virus
HANNSTDTV

SEQ ID NO: 443045 - protein, 9 aa, Influenza virus
HANNSTEHV

SEQ ID NO: 443046 - protein, 9 aa, Influenza virus
HANNSTEQV

SEQ ID NO: 443047 - protein, 9 aa, Influenza virus
HANNSTERV

SEQ ID NO: 443048 - protein, 9 aa, Influenza virus
HANNSTETV

SEQ ID NO: 443049 - protein, 9 aa, Influenza virus
HANNSTKQI

SEQ ID NO: 443050 - protein, 9 aa, Influenza virus
HANNSTKQV

SEQ ID NO: 443051 - protein, 9 aa, Influenza virus
HANNSTTKV

SEQ ID NO: 443052 - protein, 9 aa, Influenza virus
HANNSTTQI

SEQ ID NO: 443053 - protein, 9 aa, Influenza virus
HANNSTTQV

SEQ ID NO: 443054 - protein, 9 aa, Influenza virus
HANNSTVQV

SEQ ID NO: 443055 - protein, 9 aa, Influenza virus
HAQDILEKT

SEQ ID NO: 443056 - protein, 9 aa, Influenza virus
HAQNILEKT

SEQ ID NO: 443057 - protein, 9 aa, Influenza virus
HAQYREEAL

SEQ ID NO: 443058 - protein, 9 aa, Influenza virus
HASNRPWIS

SEQ ID NO: 443059 - protein, 9 aa, Influenza virus
HASNRPWVS

SEQ ID NO: 443060 - protein, 9 aa, Influenza virus
HAVANGTKV

SEQ ID NO: 443061 - protein, 9 aa, Influenza virus
HAVANGTRV

SEQ ID NO: 443062 - protein, 9 aa, Influenza virus
HAVENGTSV

SEQ ID NO: 443063 - protein, 9 aa, Influenza virus
HAVPNGTIV

SEQ ID NO: 443064 - protein, 9 aa, Influenza virus
HAVPNGTKV

SEQ ID NO: 443065 - protein, 9 aa, Influenza virus
HAVPNGTLV

SEQ ID NO: 443066 - protein, 9 aa, Influenza virus
HAVPNGTVV

SEQ ID NO: 443067 - protein, 9 aa, Influenza virus
HAVSNGTKV

SEQ ID NO: 443068 - protein, 9 aa, Influenza virus
HAVTNGTKV

SEQ ID NO: 443069 - protein, 9 aa, Influenza virus
HAYISFRNL

SEQ ID NO: 443070 - protein, 9 aa, Influenza virus
HCINRCFYV

SEQ ID NO: 443071 - protein, 9 aa, Influenza virus
HCMESIRNN

SEQ ID NO: 443072 - protein, 9 aa, Influenza virus
HCRATEYIM

SEQ ID NO: 443073 - protein, 9 aa, Influenza virus
HCRATEYMM

SEQ ID NO: 443074 - protein, 9 aa, Influenza virus
HCRIIQNED

SEQ ID NO: 443075 - protein, 9 aa, Influenza virus
HCSKYHWNL

SEQ ID NO: 443076 - protein, 9 aa, Influenza virus
HCWSFALAQ

SEQ ID NO: 443077 - protein, 9 aa, Influenza virus
HCYPGATIN

SEQ ID NO: 443078 - protein, 9 aa, Influenza virus
HDANVKNLH

SEQ ID NO: 443079 - protein, 9 aa, Influenza virus
HDANVRNLH

SEQ ID NO: 443080 - protein, 9 aa, Influenza virus
HDFEREGYS

SEQ ID NO: 443081 - protein, 9 aa, Influenza virus
HDGAEIIYF

SEQ ID NO: 443082 - protein, 9 aa, Influenza virus
HDGAEITYF

SEQ ID NO: 443083 - protein, 9 aa, Influenza virus
HDGASWLTI

SEQ ID NO: 443084 - protein, 9 aa, Influenza virus
HDGIARMTI

SEQ ID NO: 443085 - protein, 9 aa, Influenza virus
HDGIGRMTI

SEQ ID NO: 443086 - protein, 9 aa, Influenza virus
HDGISWLTI

SEQ ID NO: 443087 - protein, 9 aa, Influenza virus
HDGKAWLHI

SEQ ID NO: 443088 - protein, 9 aa, Influenza virus
HDGKAWLHV

SEQ ID NO: 443089 - protein, 9 aa, Influenza virus
HDGKSWLHV

SEQ ID NO: 443090 - protein, 9 aa, Influenza virus
HDGNAWLHV

SEQ ID NO: 443091 - protein, 9 aa, Influenza virus
HDGRAWLHI

SEQ ID NO: 443092 - protein, 9 aa, Influenza virus
HDGRAWLHV

SEQ ID NO: 443093 - protein, 9 aa, Influenza virus
HDGSSWLTI

SEQ ID NO: 443094 - protein, 9 aa, Influenza virus
HDGTNWLTI

SEQ ID NO: 443095 - protein, 9 aa, Influenza virus
HDGTSWLTI

SEQ ID NO: 443096 - protein, 9 aa, Influenza virus
HDGVGRMTI

SEQ ID NO: 443097 - protein, 9 aa, Influenza virus
HDGVNRMTI

SEQ ID NO: 443098 - protein, 9 aa, Influenza virus
HDGVSRMTI

SEQ ID NO: 443099 - protein, 9 aa, Influenza virus
HDIYRDEAI

SEQ ID NO: 443100 - protein, 9 aa, Influenza virus
HDIYRNEAI

SEQ ID NO: 443101 - protein, 9 aa, Influenza virus
HDRAAFRGL

SEQ ID NO: 443102 - protein, 9 aa, Influenza virus
HDRICIGYQ

SEQ ID NO: 443103 - protein, 9 aa, Influenza virus
HDRIPHRTL

SEQ ID NO: 443104 - protein, 9 aa, Influenza virus
HDRISHRTL

SEQ ID NO: 443105 - protein, 9 aa, Influenza virus
HDRNAFRGL

SEQ ID NO: 443106 - protein, 9 aa, Influenza virus
HDRSPFRAL

SEQ ID NO: 443107 - protein, 9 aa, Influenza virus
HDRSPHRTL

SEQ ID NO: 443108 - protein, 9 aa, Influenza virus
HDRSPYRAL

SEQ ID NO: 443109 - protein, 9 aa, Influenza virus
HDRSQFRAL

SEQ ID NO: 443110 - protein, 9 aa, Influenza virus
HDRSQYRAL

SEQ ID NO: 443111 - protein, 9 aa, Influenza virus
HDRSQYRSL

SEQ ID NO: 443112 - protein, 9 aa, Influenza virus
HDRTAFRGL

SEQ ID NO: 443113 - protein, 9 aa, Influenza virus
HDRTPHRTL

SEQ ID NO: 443114 - protein, 9 aa, Influenza virus
HDRTSHRTL

SEQ ID NO: 443115 - protein, 9 aa, Influenza virus
HDRTTFRGL

SEQ ID NO: 443116 - protein, 9 aa, Influenza virus
HDSNVENLF

SEQ ID NO: 443117 - protein, 9 aa, Influenza virus
HDSNVKNLF

SEQ ID NO: 443118 - protein, 9 aa, Influenza virus
HDSNVKNLH

SEQ ID NO: 443119 - protein, 9 aa, Influenza virus
HDSNVKNLY

SEQ ID NO: 443120 - protein, 9 aa, Influenza virus
HDSNVKSLY

SEQ ID NO: 443121 - protein, 9 aa, Influenza virus
HDSNVRNLH

SEQ ID NO: 443122 - protein, 9 aa, Influenza virus
HDSNVRNLY

SEQ ID NO: 443123 - protein, 9 aa, Influenza virus
HDSNVRSLH

SEQ ID NO: 443124 - protein, 9 aa, Influenza virus
HDVYRDEAI

SEQ ID NO: 443125 - protein, 9 aa, Influenza virus
HECRTFFLT

SEQ ID NO: 443126 - protein, 9 aa, Influenza virus
HEDYKEESQ

SEQ ID NO: 443127 - protein, 9 aa, Influenza virus
HEDYREESQ

SEQ ID NO: 443128 - protein, 9 aa, Influenza virus
HEEVTNATE

SEQ ID NO: 443129 - protein, 9 aa, Influenza virus
HEFSNLEKR

SEQ ID NO: 443130 - protein, 9 aa, Influenza virus
HEFSNLERR

SEQ ID NO: 443131 - protein, 9 aa, Influenza virus
HEFSSLERR

SEQ ID NO: 443132 - protein, 9 aa, Influenza virus
HEGEGIPLH

SEQ ID NO: 443133 - protein, 9 aa, Influenza virus
HEGEGIPLY

SEQ ID NO: 443134 - protein, 9 aa, Influenza virus
HEGRLIQNS

SEQ ID NO: 443135 - protein, 9 aa, Influenza virus
HENRMVIAS

SEQ ID NO: 443136 - protein, 9 aa, Influenza virus
HENRMVLAS

SEQ ID NO: 443137 - protein, 9 aa, Influenza virus
HENSQGSGY

SEQ ID NO: 443138 - protein, 9 aa, Influenza virus
HEQMETGGE

SEQ ID NO: 443139 - protein, 9 aa, Influenza virus
HERVRKQLR

SEQ ID NO: 443140 - protein, 9 aa, Influenza virus
HFEECSCYP

SEQ ID NO: 443141 - protein, 9 aa, Influenza virus
HFEKIKILP

SEQ ID NO: 443142 - protein, 9 aa, Influenza virus
HFEKVKILA

SEQ ID NO: 443143 - protein, 9 aa, Influenza virus
HFEKVKILP

SEQ ID NO: 443144 - protein, 9 aa, Influenza virus
HFEKVRILP

SEQ ID NO: 443145 - protein, 9 aa, Influenza virus
HFESNGNFI

SEQ ID NO: 443146 - protein, 9 aa, Influenza virus
HFQKDAKIL

SEQ ID NO: 443147 - protein, 9 aa, Influenza virus
HFQKDAKML

SEQ ID NO: 443148 - protein, 9 aa, Influenza virus
HFQKDAKVL

SEQ ID NO: 443149 - protein, 9 aa, Influenza virus
HFQKDARVL

SEQ ID NO: 443150 - protein, 9 aa, Influenza virus
HFQKNAKVL

SEQ ID NO: 443151 - protein, 9 aa, Influenza virus
HFQNQVKIR

SEQ ID NO: 443152 - protein, 9 aa, Influenza virus
HFQRKRRIR

SEQ ID NO: 443153 - protein, 9 aa, Influenza virus
HFQRKRRVR

SEQ ID NO: 443154 - protein, 9 aa, Influenza virus
HFRNQIKIR

SEQ ID NO: 443155 - protein, 9 aa, Influenza virus
HFRNQVKIR

SEQ ID NO: 443156 - protein, 9 aa, Influenza virus
HFRSQVKIR

SEQ ID NO: 443157 - protein, 9 aa, Influenza virus
HFVNIELED

SEQ ID NO: 443158 - protein, 9 aa, Influenza virus
HFVSIELEG

SEQ ID NO: 443159 - protein, 9 aa, Influenza virus
HGALLNDKH

SEQ ID NO: 443160 - protein, 9 aa, Influenza virus
HGANRPWVS

SEQ ID NO: 443161 - protein, 9 aa, Influenza virus
HGICAVATT

SEQ ID NO: 443162 - protein, 9 aa, Influenza virus
HGKIIQNED

SEQ ID NO: 443163 - protein, 9 aa, Influenza virus
HGLCYPGEL

SEQ ID NO: 443164 - protein, 9 aa, Influenza virus
HGRIIQNED

SEQ ID NO: 443165 - protein, 9 aa, Influenza virus
HGRILKNDL

SEQ ID NO: 443166 - protein, 9 aa, Influenza virus
HGRILKNNL

SEQ ID NO: 443167 - protein, 9 aa, Influenza virus
HGRTIQNED

SEQ ID NO: 443168 - protein, 9 aa, Influenza virus
HGRVLKNNL

SEQ ID NO: 443169 - protein, 9 aa, Influenza virus
HGSGYAADK

SEQ ID NO: 443170 - protein, 9 aa, Influenza virus
HGSLLNDKH

SEQ ID NO: 443171 - protein, 9 aa, Influenza virus
HGSLQCRIC

SEQ ID NO: 443172 - protein, 9 aa, Influenza virus
HGSLVLSLW

SEQ ID NO: 443173 - protein, 9 aa, Influenza virus
HGSNRPWIS

SEQ ID NO: 443174 - protein, 9 aa, Influenza virus
HGSNRPWLS

SEQ ID NO: 443175 - protein, 9 aa, Influenza virus
HGSNRPWVS

SEQ ID NO: 443176 - protein, 9 aa, Influenza virus
HGTGTGYTM

SEQ ID NO: 443177 - protein, 9 aa, Influenza virus
HGVKGWAFD

SEQ ID NO: 443178 - protein, 9 aa, Influenza virus
HHANNSTEQ

SEQ ID NO: 443179 - protein, 9 aa, Influenza virus
HHAVANGTI

SEQ ID NO: 443180 - protein, 9 aa, Influenza virus
HHAVANGTK

SEQ ID NO: 443181 - protein, 9 aa, Influenza virus
HHAVANGTR

SEQ ID NO: 443182 - protein, 9 aa, Influenza virus
HHAVANGTV

SEQ ID NO: 443183 - protein, 9 aa, Influenza virus
HHAVENGTS

SEQ ID NO: 443184 - protein, 9 aa, Influenza virus
HHAVPNGTI

SEQ ID NO: 443185 - protein, 9 aa, Influenza virus
HHAVPNGTK

SEQ ID NO: 443186 - protein, 9 aa, Influenza virus
HHAVPNGTL

SEQ ID NO: 443187 - protein, 9 aa, Influenza virus
HHAVPNGTV

SEQ ID NO: 443188 - protein, 9 aa, Influenza virus
HHAVSNGTI

SEQ ID NO: 443189 - protein, 9 aa, Influenza virus
HHAVSNGTK

SEQ ID NO: 443190 - protein, 9 aa, Influenza virus
HHAVTNGTI

SEQ ID NO: 443191 - protein, 9 aa, Influenza virus
HHAVTNGTK

SEQ ID NO: 443192 - protein, 9 aa, Influenza virus
HHENSQGSG

SEQ ID NO: 443193 - protein, 9 aa, Influenza virus
HHMGECPKY

SEQ ID NO: 443194 - protein, 9 aa, Influenza virus
HHMRKKRGL

SEQ ID NO: 443195 - protein, 9 aa, Influenza virus
HHNNEQGSG

SEQ ID NO: 443196 - protein, 9 aa, Influenza virus
HHNSEGTGQ

SEQ ID NO: 443197 - protein, 9 aa, Influenza virus
HHPDSETTA

SEQ ID NO: 443198 - protein, 9 aa, Influenza virus
HHPDTEATA

SEQ ID NO: 443199 - protein, 9 aa, Influenza virus
HHPDTEAVA

SEQ ID NO: 443200 - protein, 9 aa, Influenza virus
HHPDTEEVA

SEQ ID NO: 443201 - protein, 9 aa, Influenza virus
HHPDTETTA

SEQ ID NO: 443202 - protein, 9 aa, Influenza virus
HHPPDAKEQ

SEQ ID NO: 443203 - protein, 9 aa, Influenza virus
HHPPDETEQ

SEQ ID NO: 443204 - protein, 9 aa, Influenza virus
HHPPDTKEQ

SEQ ID NO: 443205 - protein, 9 aa, Influenza virus
HHPPNTKEQ

SEQ ID NO: 443206 - protein, 9 aa, Influenza virus
HHPPTSAEQ

SEQ ID NO: 443207 - protein, 9 aa, Influenza virus
HHPPTSDEQ

SEQ ID NO: 443208 - protein, 9 aa, Influenza virus
HHPPTSNEQ

SEQ ID NO: 443209 - protein, 9 aa, Influenza virus
HHPPTTDEQ

SEQ ID NO: 443210 - protein, 9 aa, Influenza virus
HHPSSAQEK

SEQ ID NO: 443211 - protein, 9 aa, Influenza virus
HHPSSDNEQ

SEQ ID NO: 443212 - protein, 9 aa, Influenza virus
HHPSSTKEK

SEQ ID NO: 443213 - protein, 9 aa, Influenza virus
HHPSSTQEK

SEQ ID NO: 443214 - protein, 9 aa, Influenza virus
HHPSTDAEQ

SEQ ID NO: 443215 - protein, 9 aa, Influenza virus
HHPSTDKEQ

SEQ ID NO: 443216 - protein, 9 aa, Influenza virus
HHPSTDTEQ

SEQ ID NO: 443217 - protein, 9 aa, Influenza virus
HHQNAQGSG

SEQ ID NO: 443218 - protein, 9 aa, Influenza virus
HHQNEQGSG

SEQ ID NO: 443219 - protein, 9 aa, Influenza virus
HHQNGQGSG

SEQ ID NO: 443220 - protein, 9 aa, Influenza virus
HHRSHRQMA

SEQ ID NO: 443221 - protein, 9 aa, Influenza virus
HHSKEQGSG

SEQ ID NO: 443222 - protein, 9 aa, Influenza virus
HHSNAEGTG

SEQ ID NO: 443223 - protein, 9 aa, Influenza virus
HHSNDQGAG

SEQ ID NO: 443224 - protein, 9 aa, Influenza virus
HHSNDQGSG

SEQ ID NO: 443225 - protein, 9 aa, Influenza virus
HHSNEQGSG

SEQ ID NO: 443226 - protein, 9 aa, Influenza virus
HHSNGQGSG

SEQ ID NO: 443227 - protein, 9 aa, Influenza virus
HHSNSEGTG

SEQ ID NO: 443228 - protein, 9 aa, Influenza virus
HHSSSLDEQ

SEQ ID NO: 443229 - protein, 9 aa, Influenza virus
HIAILVTTV

SEQ ID NO: 443230 - protein, 9 aa, Influenza virus
HICIGYHAN

SEQ ID NO: 443231 - protein, 9 aa, Influenza virus
HICVTGDDR

SEQ ID NO: 443232 - protein, 9 aa, Influenza virus
HIEECPCYG

SEQ ID NO: 443233 - protein, 9 aa, Influenza virus
HIEECSCYG

SEQ ID NO: 443234 - protein, 9 aa, Influenza virus
HIEECSCYP

SEQ ID NO: 443235 - protein, 9 aa, Influenza virus
HIEEWSCYG

SEQ ID NO: 443236 - protein, 9 aa, Influenza virus
HIEVTNATE

SEQ ID NO: 443237 - protein, 9 aa, Influenza virus
HIFGKDNAI

SEQ ID NO: 443238 - protein, 9 aa, Influenza virus
HIFGKDNAV

SEQ ID NO: 443239 - protein, 9 aa, Influenza virus
HIFSFNGEE

SEQ ID NO: 443240 - protein, 9 aa, Influenza virus
HIFSFTGEE

SEQ ID NO: 443241 - protein, 9 aa, Influenza virus
HIFSKDNAI

SEQ ID NO: 443242 - protein, 9 aa, Influenza virus
HIFVIREPF

SEQ ID NO: 443243 - protein, 9 aa, Influenza virus
HIGPLSGSA

SEQ ID NO: 443244 - protein, 9 aa, Influenza virus
HIHIFSFNG

SEQ ID NO: 443245 - protein, 9 aa, Influenza virus
HIHIFSFTG

SEQ ID NO: 443246 - protein, 9 aa, Influenza virus
HIIDLADSE

SEQ ID NO: 443247 - protein, 9 aa, Influenza virus
HIIDVTDSE

SEQ ID NO: 443248 - protein, 9 aa, Influenza virus
HIIMWGIHH

SEQ ID NO: 443249 - protein, 9 aa, Influenza virus
HILSKDNAI

SEQ ID NO: 443250 - protein, 9 aa, Influenza virus
HILSKDNAV

SEQ ID NO: 443251 - protein, 9 aa, Influenza virus
HILVTREPY

SEQ ID NO: 443252 - protein, 9 aa, Influenza virus
HIMIWHSNL

SEQ ID NO: 443253 - protein, 9 aa, Influenza virus
HIPEVCLKW

SEQ ID NO: 443254 - protein, 9 aa, Influenza virus
HIQTRRSFE

SEQ ID NO: 443255 - protein, 9 aa, Influenza virus
HISPLAGSA

SEQ ID NO: 443256 - protein, 9 aa, Influenza virus
HISPLSGSA

SEQ ID NO: 443257 - protein, 9 aa, Influenza virus
HISVGTSTL

SEQ ID NO: 443258 - protein, 9 aa, Influenza virus
HITFSHNGG

SEQ ID NO: 443259 - protein, 9 aa, Influenza virus
HITGFAPFS

SEQ ID NO: 443260 - protein, 9 aa, Influenza virus
HIVERILEE

SEQ ID NO: 443261 - protein, 9 aa, Influenza virus
HIWVTREPY

SEQ ID NO: 443262 - protein, 9 aa, Influenza virus
HIYGKDNAI

SEQ ID NO: 443263 - protein, 9 aa, Influenza virus
HIYGKDNAV

SEQ ID NO: 443264 - protein, 9 aa, Influenza virus
HKCDDDCMA

SEQ ID NO: 443265 - protein, 9 aa, Influenza virus
HKCDDECIE

SEQ ID NO: 443266 - protein, 9 aa, Influenza virus
HKCDDECMD

SEQ ID NO: 443267 - protein, 9 aa, Influenza virus
HKCDDECMN

SEQ ID NO: 443268 - protein, 9 aa, Influenza virus
HKCDDECMS

SEQ ID NO: 443269 - protein, 9 aa, Influenza virus
HKCDDHCME

SEQ ID NO: 443270 - protein, 9 aa, Influenza virus
HKCDDQCME

SEQ ID NO: 443271 - protein, 9 aa, Influenza virus
HKCDNECIE

SEQ ID NO: 443272 - protein, 9 aa, Influenza virus
HKCDNECMD

SEQ ID NO: 443273 - protein, 9 aa, Influenza virus
HKCDNECME

SEQ ID NO: 443274 - protein, 9 aa, Influenza virus
HKCDNKCIE

SEQ ID NO: 443275 - protein, 9 aa, Influenza virus
HKCDNKCME

SEQ ID NO: 443276 - protein, 9 aa, Influenza virus
HKCDNQCME

SEQ ID NO: 443277 - protein, 9 aa, Influenza virus
HKCNDECMN

SEQ ID NO: 443278 - protein, 9 aa, Influenza virus
HKCNDSCMD

SEQ ID NO: 443279 - protein, 9 aa, Influenza virus
HKCNDSCME

SEQ ID NO: 443280 - protein, 9 aa, Influenza virus
HKCNNECIE

SEQ ID NO: 443281 - protein, 9 aa, Influenza virus
HKCNNECME

SEQ ID NO: 443282 - protein, 9 aa, Influenza virus
HKCNNSCME

SEQ ID NO: 443283 - protein, 9 aa, Influenza virus
HKCNNTCME

SEQ ID NO: 443284 - protein, 9 aa, Influenza virus
HKDLGNCHP

SEQ ID NO: 443285 - protein, 9 aa, Influenza virus
HKDNAIRLG

SEQ ID NO: 443286 - protein, 9 aa, Influenza virus
HKDNAIRPG

SEQ ID NO: 443287 - protein, 9 aa, Influenza virus
HKDNALRLA

SEQ ID NO: 443288 - protein, 9 aa, Influenza virus
HKDNAVRLG

SEQ ID NO: 443289 - protein, 9 aa, Influenza virus
HKDYEEEAK

SEQ ID NO: 443290 - protein, 9 aa, Influenza virus
HKEFEEESK

SEQ ID NO: 443291 - protein, 9 aa, Influenza virus
HKEFEEESR

SEQ ID NO: 443292 - protein, 9 aa, Influenza virus
HKEFEKESK

SEQ ID NO: 443293 - protein, 9 aa, Influenza virus
HKEFEKESR

SEQ ID NO: 443294 - protein, 9 aa, Influenza virus
HKEFKEESK

SEQ ID NO: 443295 - protein, 9 aa, Influenza virus
HKEYEEEAK

SEQ ID NO: 443296 - protein, 9 aa, Influenza virus
HKGIVIKEE

SEQ ID NO: 443297 - protein, 9 aa, Influenza virus
HKGLIIKEE

SEQ ID NO: 443298 - protein, 9 aa, Influenza virus
HKGLLIKEE

SEQ ID NO: 443299 - protein, 9 aa, Influenza virus
HKGLVIKEE

SEQ ID NO: 443300 - protein, 9 aa, Influenza virus
HKGLVVKEE

SEQ ID NO: 443301 - protein, 9 aa, Influenza virus
HKGNSARLI

SEQ ID NO: 443302 - protein, 9 aa, Influenza virus
HKICIGYHA

SEQ ID NO: 443303 - protein, 9 aa, Influenza virus
HKMESRGLF

SEQ ID NO: 443304 - protein, 9 aa, Influenza virus
HKQLTHHMR

SEQ ID NO: 443305 - protein, 9 aa, Influenza virus
HKSCLPACA

SEQ ID NO: 443306 - protein, 9 aa, Influenza virus
HKSCLPACI

SEQ ID NO: 443307 - protein, 9 aa, Influenza virus
HKSCLPACV

SEQ ID NO: 443308 - protein, 9 aa, Influenza virus
HKSQLIWMA

SEQ ID NO: 443309 - protein, 9 aa, Influenza virus
HKSQLVWMA

SEQ ID NO: 443310 - protein, 9 aa, Influenza virus
HLAYCNTDL

SEQ ID NO: 443311 - protein, 9 aa, Influenza virus
HLECRTFFL

SEQ ID NO: 443312 - protein, 9 aa, Influenza virus
HLEECSCYM

SEQ ID NO: 443313 - protein, 9 aa, Influenza virus
HLEECSCYT

SEQ ID NO: 443314 - protein, 9 aa, Influenza virus
HLEECSCYV

SEQ ID NO: 443315 - protein, 9 aa, Influenza virus
HLEFKADLI

SEQ ID NO: 443316 - protein, 9 aa, Influenza virus
HLEICFMYS

SEQ ID NO: 443317 - protein, 9 aa, Influenza virus
HLEVCFMYS

SEQ ID NO: 443318 - protein, 9 aa, Influenza virus
HLFSGIKSF

SEQ ID NO: 443319 - protein, 9 aa, Influenza virus
HLFSGIRSF

SEQ ID NO: 443320 - protein, 9 aa, Influenza virus
HLFSGVNSF

SEQ ID NO: 443321 - protein, 9 aa, Influenza virus
HLGDCNFEG

SEQ ID NO: 443322 - protein, 9 aa, Influenza virus
HLGDCRFEG

SEQ ID NO: 443323 - protein, 9 aa, Influenza virus
HLGDCSFEG

SEQ ID NO: 443324 - protein, 9 aa, Influenza virus
HLGTKQVCA

SEQ ID NO: 443325 - protein, 9 aa, Influenza virus
HLGTKQVCI

SEQ ID NO: 443326 - protein, 9 aa, Influenza virus
HLGTKQVCM

SEQ ID NO: 443327 - protein, 9 aa, Influenza virus
HLGTKQVCV

SEQ ID NO: 443328 - protein, 9 aa, Influenza virus
HLGTRQVCI

SEQ ID NO: 443329 - protein, 9 aa, Influenza virus
HLGTRQVCM

SEQ ID NO: 443330 - protein, 9 aa, Influenza virus
HLGTRQVCV

SEQ ID NO: 443331 - protein, 9 aa, Influenza virus
HLIGKTNQQ

SEQ ID NO: 443332 - protein, 9 aa, Influenza virus
HLIIWGIHH

SEQ ID NO: 443333 - protein, 9 aa, Influenza virus
HLIMWGIHH

SEQ ID NO: 443334 - protein, 9 aa, Influenza virus
HLITGKSHG

SEQ ID NO: 443335 - protein, 9 aa, Influenza virus
HLITWGIHH

SEQ ID NO: 443336 - protein, 9 aa, Influenza virus
HLIVWGIHH

SEQ ID NO: 443337 - protein, 9 aa, Influenza virus
HLKDQAWSY

SEQ ID NO: 443338 - protein, 9 aa, Influenza virus
HLKDQDWSY

SEQ ID NO: 443339 - protein, 9 aa, Influenza virus
HLKDQGWSY

SEQ ID NO: 443340 - protein, 9 aa, Influenza virus
HLKDQSWSY

SEQ ID NO: 443341 - protein, 9 aa, Influenza virus
HLKFKADLI

SEQ ID NO: 443342 - protein, 9 aa, Influenza virus
HLMHPGERI

SEQ ID NO: 443343 - protein, 9 aa, Influenza virus
HLMIWHSNL

SEQ ID NO: 443344 - protein, 9 aa, Influenza virus
HLMRPGERI

SEQ ID NO: 443345 - protein, 9 aa, Influenza virus
HLMRPGERT

SEQ ID NO: 443346 - protein, 9 aa, Influenza virus
HLMSPGERI

SEQ ID NO: 443347 - protein, 9 aa, Influenza virus
HLRDQGWSY

SEQ ID NO: 443348 - protein, 9 aa, Influenza virus
HLRNDTDVV

SEQ ID NO: 443349 - protein, 9 aa, Influenza virus
HLSSVSSFE

SEQ ID NO: 443350 - protein, 9 aa, Influenza virus
HLTDSEMNK

SEQ ID NO: 443351 - protein, 9 aa, Influenza virus
HLTGIWDTL

SEQ ID NO: 443352 - protein, 9 aa, Influenza virus
HLTGKWDTL

SEQ ID NO: 443353 - protein, 9 aa, Influenza virus
HLTGTWDTL

SEQ ID NO: 443354 - protein, 9 aa, Influenza virus
HLTQGACWE

SEQ ID NO: 443355 - protein, 9 aa, Influenza virus
HLTQGTCWE

SEQ ID NO: 443356 - protein, 9 aa, Influenza virus
HLTTGKSHG

SEQ ID NO: 443357 - protein, 9 aa, Influenza virus
HLVTGKSHG

SEQ ID NO: 443358 - protein, 9 aa, Influenza virus
HMAIIKKYT

SEQ ID NO: 443359 - protein, 9 aa, Influenza virus
HMECRTFFL

SEQ ID NO: 443360 - protein, 9 aa, Influenza virus
HMEVCFMYS

SEQ ID NO: 443361 - protein, 9 aa, Influenza virus
HMGECPKYV

SEQ ID NO: 443362 - protein, 9 aa, Influenza virus
HMMIWHSNL

SEQ ID NO: 443363 - protein, 9 aa, Influenza virus
HMRKKRGLF

SEQ ID NO: 443364 - protein, 9 aa, Influenza virus
HNGGLIAPD

SEQ ID NO: 443365 - protein, 9 aa, Influenza virus
HNGGLIAPN

SEQ ID NO: 443366 - protein, 9 aa, Influenza virus
HNGGLIAPS

SEQ ID NO: 443367 - protein, 9 aa, Influenza virus
HNGGLVAPS

SEQ ID NO: 443368 - protein, 9 aa, Influenza virus
HNGGRIAPS

SEQ ID NO: 443369 - protein, 9 aa, Influenza virus
HNGICPVAF

SEQ ID NO: 443370 - protein, 9 aa, Influenza virus
HNGICPVVF

SEQ ID NO: 443371 - protein, 9 aa, Influenza virus
HNGKLCKLN

SEQ ID NO: 443372 - protein, 9 aa, Influenza virus
HNGKLCKLS

SEQ ID NO: 443373 - protein, 9 aa, Influenza virus
HNGKLCRLN

SEQ ID NO: 443374 - protein, 9 aa, Influenza virus
HNGKLCRLR

SEQ ID NO: 443375 - protein, 9 aa, Influenza virus
HNGKLCRLS

SEQ ID NO: 443376 - protein, 9 aa, Influenza virus
HNGTCAVVM

SEQ ID NO: 443377 - protein, 9 aa, Influenza virus
HNGTCVVIM

SEQ ID NO: 443378 - protein, 9 aa, Influenza virus
HNGTCVVVM

SEQ ID NO: 443379 - protein, 9 aa, Influenza virus
HNGTWAVVM

SEQ ID NO: 443380 - protein, 9 aa, Influenza virus
HNGVCPVVF

SEQ ID NO: 443381 - protein, 9 aa, Influenza virus
HNIHPLAIG

SEQ ID NO: 443382 - protein, 9 aa, Influenza virus
HNIHPLTIG

SEQ ID NO: 443383 - protein, 9 aa, Influenza virus
HNILRTQES

SEQ ID NO: 443384 - protein, 9 aa, Influenza virus
HNISKYAFG

SEQ ID NO: 443385 - protein, 9 aa, Influenza virus
HNIYRDEAI

SEQ ID NO: 443386 - protein, 9 aa, Influenza virus
HNNEQGSGY

SEQ ID NO: 443387 - protein, 9 aa, Influenza virus
HNQEYTSGR

SEQ ID NO: 443388 - protein, 9 aa, Influenza virus
HNSFVPVVG

SEQ ID NO: 443389 - protein, 9 aa, Influenza virus
HNSTCVVVM

SEQ ID NO: 443390 - protein, 9 aa, Influenza virus
HNVHPFTIG

SEQ ID NO: 443391 - protein, 9 aa, Influenza virus
HNVHPLAIG

SEQ ID NO: 443392 - protein, 9 aa, Influenza virus
HNVHPLTIG

SEQ ID NO: 443393 - protein, 9 aa, Influenza virus
HNVHRNAIG

SEQ ID NO: 443394 - protein, 9 aa, Influenza virus
HNVHRNTIG

SEQ ID NO: 443395 - protein, 9 aa, Influenza virus
HNVHRSTIG

SEQ ID NO: 443396 - protein, 9 aa, Influenza virus
HNVSKYAFG

SEQ ID NO: 443397 - protein, 9 aa, Influenza virus
HNVYRDEAI

SEQ ID NO: 443398 - protein, 9 aa, Influenza virus
HPATIGECP

SEQ ID NO: 443399 - protein, 9 aa, Influenza virus
HPAYCNTDL

SEQ ID NO: 443400 - protein, 9 aa, Influenza virus
HPELTGLDC

SEQ ID NO: 443401 - protein, 9 aa, Influenza virus
HPELTGLNC

SEQ ID NO: 443402 - protein, 9 aa, Influenza virus
HPELTGMDC

SEQ ID NO: 443403 - protein, 9 aa, Influenza virus
HPELTGMNC

SEQ ID NO: 443404 - protein, 9 aa, Influenza virus
HPELTGVDC

SEQ ID NO: 443405 - protein, 9 aa, Influenza virus
HPEMTGLDC

SEQ ID NO: 443406 - protein, 9 aa, Influenza virus
HPFTIGECP

SEQ ID NO: 443407 - protein, 9 aa, Influenza virus
HPGIFENSC

SEQ ID NO: 443408 - protein, 9 aa, Influenza virus
HPGIFGNSC

SEQ ID NO: 443409 - protein, 9 aa, Influenza virus
HPGLFENSC

SEQ ID NO: 443410 - protein, 9 aa, Influenza virus
HPITIGECP

SEQ ID NO: 443411 - protein, 9 aa, Influenza virus
HPLAIGECP

SEQ ID NO: 443412 - protein, 9 aa, Influenza virus
HPLTIGECP

SEQ ID NO: 443413 - protein, 9 aa, Influenza virus
HPLTIGKCP

SEQ ID NO: 443414 - protein, 9 aa, Influenza virus
HPLTMGECP

SEQ ID NO: 443415 - protein, 9 aa, Influenza virus
HPNAGKDPK

SEQ ID NO: 443416 - protein, 9 aa, Influenza virus
HPPDAKEQT

SEQ ID NO: 443417 - protein, 9 aa, Influenza virus
HPPDETEQT

SEQ ID NO: 443418 - protein, 9 aa, Influenza virus
HPPDTKEQT

SEQ ID NO: 443419 - protein, 9 aa, Influenza virus
HPPNTKEQT

SEQ ID NO: 443420 - protein, 9 aa, Influenza virus
HPPTSAEQV

SEQ ID NO: 443421 - protein, 9 aa, Influenza virus
HPPTSDEQI

SEQ ID NO: 443422 - protein, 9 aa, Influenza virus
HPPTSDEQV

SEQ ID NO: 443423 - protein, 9 aa, Influenza virus
HPPTSNEQV

SEQ ID NO: 443424 - protein, 9 aa, Influenza virus
HPPTTDEQM

SEQ ID NO: 443425 - protein, 9 aa, Influenza virus
HPRGLLEVG

SEQ ID NO: 443426 - protein, 9 aa, Influenza virus
HPSAGKDPK

SEQ ID NO: 443427 - protein, 9 aa, Influenza virus
HPSAGRDPK

SEQ ID NO: 443428 - protein, 9 aa, Influenza virus
HPSSAQEKN

SEQ ID NO: 443429 - protein, 9 aa, Influenza virus
HPSSDNEQT

SEQ ID NO: 443430 - protein, 9 aa, Influenza virus
HPSSTKEKN

SEQ ID NO: 443431 - protein, 9 aa, Influenza virus
HPSSTQEKN

SEQ ID NO: 443432 - protein, 9 aa, Influenza virus
HPSTGKDPK

SEQ ID NO: 443433 - protein, 9 aa, Influenza virus
HPTLLFLKV

SEQ ID NO: 443434 - protein, 9 aa, Influenza virus
HPVTIGECP

SEQ ID NO: 443435 - protein, 9 aa, Influenza virus
HPVTIGKCP

SEQ ID NO: 443436 - protein, 9 aa, Influenza virus
HQCDNNCIE

SEQ ID NO: 443437 - protein, 9 aa, Influenza virus
HQFELIDNE

SEQ ID NO: 443438 - protein, 9 aa, Influenza virus
HQGTTIRNK

SEQ ID NO: 443439 - protein, 9 aa, Influenza virus
HQGTTIRNR

SEQ ID NO: 443440 - protein, 9 aa, Influenza virus
HQIEKEFEQ

SEQ ID NO: 443441 - protein, 9 aa, Influenza virus
HQIEKEFGQ

SEQ ID NO: 443442 - protein, 9 aa, Influenza virus
HQIEKEFSE

SEQ ID NO: 443443 - protein, 9 aa, Influenza virus
HQIGNVINW

SEQ ID NO: 443444 - protein, 9 aa, Influenza virus
HQILAIYST

SEQ ID NO: 443445 - protein, 9 aa, Influenza virus
HQISNVINW

SEQ ID NO: 443446 - protein, 9 aa, Influenza virus
HQLLRHFQK

SEQ ID NO: 443447 - protein, 9 aa, Influenza virus
HQLRENAED

SEQ ID NO: 443448 - protein, 9 aa, Influenza virus
HQNAEGIGI

SEQ ID NO: 443449 - protein, 9 aa, Influenza virus
HQNAEGTGI

SEQ ID NO: 443450 - protein, 9 aa, Influenza virus
HQNAEGTGM

SEQ ID NO: 443451 - protein, 9 aa, Influenza virus
HQNAEGTGT

SEQ ID NO: 443452 - protein, 9 aa, Influenza virus
HQNAQGEGI

SEQ ID NO: 443453 - protein, 9 aa, Influenza virus
HQNAQGEGT

SEQ ID NO: 443454 - protein, 9 aa, Influenza virus
HQNAQGIGQ

SEQ ID NO: 443455 - protein, 9 aa, Influenza virus
HQNAQGQGT

SEQ ID NO: 443456 - protein, 9 aa, Influenza virus
HQNAQGSGY

SEQ ID NO: 443457 - protein, 9 aa, Influenza virus
HQNAQGTGQ

SEQ ID NO: 443458 - protein, 9 aa, Influenza virus
HQNEQGMGM

SEQ ID NO: 443459 - protein, 9 aa, Influenza virus
HQNEQGSGY

SEQ ID NO: 443460 - protein, 9 aa, Influenza virus
HQNEQGTGI

SEQ ID NO: 443461 - protein, 9 aa, Influenza virus
HQNEQGVGI

SEQ ID NO: 443462 - protein, 9 aa, Influenza virus
HQNEQGVGM

SEQ ID NO: 443463 - protein, 9 aa, Influenza virus
HQNGQGSGY

SEQ ID NO: 443464 - protein, 9 aa, Influenza virus
HQNSEGIGQ

SEQ ID NO: 443465 - protein, 9 aa, Influenza virus
HQNSEGMGQ

SEQ ID NO: 443466 - protein, 9 aa, Influenza virus
HQNSEGRGQ

SEQ ID NO: 443467 - protein, 9 aa, Influenza virus
HQNSEGTGI

SEQ ID NO: 443468 - protein, 9 aa, Influenza virus
HQNSEGTGQ

SEQ ID NO: 443469 - protein, 9 aa, Influenza virus
HQNSQGEGT

SEQ ID NO: 443470 - protein, 9 aa, Influenza virus
HQNTQGEGT

SEQ ID NO: 443471 - protein, 9 aa, Influenza virus
HQRSKFLLM

SEQ ID NO: 443472 - protein, 9 aa, Influenza virus
HQSETYPVI

SEQ ID NO: 443473 - protein, 9 aa, Influenza virus
HQSFVPSPG

SEQ ID NO: 443474 - protein, 9 aa, Influenza virus
HQSGTYPII

SEQ ID NO: 443475 - protein, 9 aa, Influenza virus
HQSGTYPVI

SEQ ID NO: 443476 - protein, 9 aa, Influenza virus
HQSGTYPVV

SEQ ID NO: 443477 - protein, 9 aa, Influenza virus
HQSTNSTET

SEQ ID NO: 443478 - protein, 9 aa, Influenza virus
HQYSEKGKW

SEQ ID NO: 443479 - protein, 9 aa, Influenza virus
HQYSEKGRW

SEQ ID NO: 443480 - protein, 9 aa, Influenza virus
HQYSERGKW

SEQ ID NO: 443481 - protein, 9 aa, Influenza virus
HQYSERGRW

SEQ ID NO: 443482 - protein, 9 aa, Influenza virus
HRCDDQCME

SEQ ID NO: 443483 - protein, 9 aa, Influenza virus
HRCDNECIE

SEQ ID NO: 443484 - protein, 9 aa, Influenza virus
HRDEEGTGI

SEQ ID NO: 443485 - protein, 9 aa, Influenza virus
HRFEIIEGR

SEQ ID NO: 443486 - protein, 9 aa, Influenza virus
HRIYWIREG

SEQ ID NO: 443487 - protein, 9 aa, Influenza virus
HRIYWIRKG

SEQ ID NO: 443488 - protein, 9 aa, Influenza virus
HRKRRVRDN

SEQ ID NO: 443489 - protein, 9 aa, Influenza virus
HRLCYPGEL

SEQ ID NO: 443490 - protein, 9 aa, Influenza virus
HRLKITENS

SEQ ID NO: 443491 - protein, 9 aa, Influenza virus
HRNDEGTGI

SEQ ID NO: 443492 - protein, 9 aa, Influenza virus
HRNEEGTGI

SEQ ID NO: 443493 - protein, 9 aa, Influenza virus
HRNTFGDCP

SEQ ID NO: 443494 - protein, 9 aa, Influenza virus
HRNTIGDCP

SEQ ID NO: 443495 - protein, 9 aa, Influenza virus
HRNTIGNCP

SEQ ID NO: 443496 - protein, 9 aa, Influenza virus
HRSTIGDCP

SEQ ID NO: 443497 - protein, 9 aa, Influenza virus
HRTLLMNEL

SEQ ID NO: 443498 - protein, 9 aa, Influenza virus
HRTLLMSEL

SEQ ID NO: 443499 - protein, 9 aa, Influenza virus
HRVYWIREG

SEQ ID NO: 443500 - protein, 9 aa, Influenza virus
HSAAFEDLR

SEQ ID NO: 443501 - protein, 9 aa, Influenza virus
HSAYCNTDL

SEQ ID NO: 443502 - protein, 9 aa, Influenza virus
HSDNADKIC

SEQ ID NO: 443503 - protein, 9 aa, Influenza virus
HSDTPRPAD

SEQ ID NO: 443504 - protein, 9 aa, Influenza virus
HSDTPRPDD

SEQ ID NO: 443505 - protein, 9 aa, Influenza virus
HSDTPRPSD

SEQ ID NO: 443506 - protein, 9 aa, Influenza virus
HSDTPRPTD

SEQ ID NO: 443507 - protein, 9 aa, Influenza virus
HSDTPRPVD

SEQ ID NO: 443508 - protein, 9 aa, Influenza virus
HSECRTFFL

SEQ ID NO: 443509 - protein, 9 aa, Influenza virus
HSGICPVVF

SEQ ID NO: 443510 - protein, 9 aa, Influenza virus
HSGVCPVVF

SEQ ID NO: 443511 - protein, 9 aa, Influenza virus
HSHYREEAL

SEQ ID NO: 443512 - protein, 9 aa, Influenza virus
HSKDNGIRI

SEQ ID NO: 443513 - protein, 9 aa, Influenza virus
HSKDNNIRI

SEQ ID NO: 443514 - protein, 9 aa, Influenza virus
HSKDNSIRI

SEQ ID NO: 443515 - protein, 9 aa, Influenza virus
HSKEQGSGY

SEQ ID NO: 443516 - protein, 9 aa, Influenza virus
HSKYREEAM

SEQ ID NO: 443517 - protein, 9 aa, Influenza virus
HSMSDIEAM

SEQ ID NO: 443518 - protein, 9 aa, Influenza virus
HSMSGFRSN

SEQ ID NO: 443519 - protein, 9 aa, Influenza virus
HSNAEGTGM

SEQ ID NO: 443520 - protein, 9 aa, Influenza virus
HSNDQGAGY

SEQ ID NO: 443521 - protein, 9 aa, Influenza virus
HSNDQGSGY

SEQ ID NO: 443522 - protein, 9 aa, Influenza virus
HSNDTIHDR

SEQ ID NO: 443523 - protein, 9 aa, Influenza virus
HSNDTVHDR

SEQ ID NO: 443524 - protein, 9 aa, Influenza virus
HSNEQGSGY

SEQ ID NO: 443525 - protein, 9 aa, Influenza virus
HSNETVKDR

SEQ ID NO: 443526 - protein, 9 aa, Influenza virus
HSNGQGSGY

SEQ ID NO: 443527 - protein, 9 aa, Influenza virus
HSNGTAKDR

SEQ ID NO: 443528 - protein, 9 aa, Influenza virus
HSNGTIEDR

SEQ ID NO: 443529 - protein, 9 aa, Influenza virus
HSNGTIHDR

SEQ ID NO: 443530 - protein, 9 aa, Influenza virus
HSNGTIKDK

SEQ ID NO: 443531 - protein, 9 aa, Influenza virus
HSNGTIKDR

SEQ ID NO: 443532 - protein, 9 aa, Influenza virus
HSNGTINDR

SEQ ID NO: 443533 - protein, 9 aa, Influenza virus
HSNGTKHDR

SEQ ID NO: 443534 - protein, 9 aa, Influenza virus
HSNGTMKDR

SEQ ID NO: 443535 - protein, 9 aa, Influenza virus
HSNGTNKDR

SEQ ID NO: 443536 - protein, 9 aa, Influenza virus
HSNGTTHDR

SEQ ID NO: 443537 - protein, 9 aa, Influenza virus
HSNGTVKBR

SEQ ID NO: 443538 - protein, 9 aa, Influenza virus
HSNGTVKDR

SEQ ID NO: 443539 - protein, 9 aa, Influenza virus
HSNGTVKNR

SEQ ID NO: 443540 - protein, 9 aa, Influenza virus
HSNGTVNDR

SEQ ID NO: 443541 - protein, 9 aa, Influenza virus
HSNLNDATY

SEQ ID NO: 443542 - protein, 9 aa, Influenza virus
HSNLNDTTY

SEQ ID NO: 443543 - protein, 9 aa, Influenza virus
HSNNTVKDR

SEQ ID NO: 443544 - protein, 9 aa, Influenza virus
HSNSEGTGM

SEQ ID NO: 443545 - protein, 9 aa, Influenza virus
HSNSTTHDR

SEQ ID NO: 443546 - protein, 9 aa, Influenza virus
HSQYREEAL

SEQ ID NO: 443547 - protein, 9 aa, Influenza virus
HSRGLFGAI

SEQ ID NO: 443548 - protein, 9 aa, Influenza virus
HSRYREEAM

SEQ ID NO: 443549 - protein, 9 aa, Influenza virus
HSSSLDEQN

SEQ ID NO: 443550 - protein, 9 aa, Influenza virus
HSVHRNTFG

SEQ ID NO: 443551 - protein, 9 aa, Influenza virus
HSVHRNTIG

SEQ ID NO: 443552 - protein, 9 aa, Influenza virus
HSWIPKRNR

SEQ ID NO: 443553 - protein, 9 aa, Influenza virus
HSWTPKRNR

SEQ ID NO: 443554 - protein, 9 aa, Influenza virus
HSWVPILNT

SEQ ID NO: 443555 - protein, 9 aa, Influenza virus
HSWVPKRNR

SEQ ID NO: 443556 - protein, 9 aa, Influenza virus
HTAYSQITN

SEQ ID NO: 443557 - protein, 9 aa, Influenza virus
HTDELCPSP

SEQ ID NO: 443558 - protein, 9 aa, Influenza virus
HTEYRQEAL

SEQ ID NO: 443559 - protein, 9 aa, Influenza virus
HTGNPVICL

SEQ ID NO: 443560 - protein, 9 aa, Influenza virus
HTGSFCSID

SEQ ID NO: 443561 - protein, 9 aa, Influenza virus
HTGSFCSIN

SEQ ID NO: 443562 - protein, 9 aa, Influenza virus
HTGTFCSIN

SEQ ID NO: 443563 - protein, 9 aa, Influenza virus
HTGTSKACN

SEQ ID NO: 443564 - protein, 9 aa, Influenza virus
HTGTYCSLD

SEQ ID NO: 443565 - protein, 9 aa, Influenza virus
HTGTYCSLG

SEQ ID NO: 443566 - protein, 9 aa, Influenza virus
HTGTYCSLN

SEQ ID NO: 443567 - protein, 9 aa, Influenza virus
HTGTYCSLS

SEQ ID NO: 443568 - protein, 9 aa, Influenza virus
HTIDLADSE

SEQ ID NO: 443569 - protein, 9 aa, Influenza virus
HTIDLAESE

SEQ ID NO: 443570 - protein, 9 aa, Influenza virus
HTIDLTDAE

SEQ ID NO: 443571 - protein, 9 aa, Influenza virus
HTIDLTDSE

SEQ ID NO: 443572 - protein, 9 aa, Influenza virus
HTIDLTNSE

SEQ ID NO: 443573 - protein, 9 aa, Influenza virus
HTIDMADSE

SEQ ID NO: 443574 - protein, 9 aa, Influenza virus
HTIDMGDSE

SEQ ID NO: 443575 - protein, 9 aa, Influenza virus
HTIDMTDSE

SEQ ID NO: 443576 - protein, 9 aa, Influenza virus
HTIDSTDSE

SEQ ID NO: 443577 - protein, 9 aa, Influenza virus
HTIDVTDSE

SEQ ID NO: 443578 - protein, 9 aa, Influenza virus
HTIHLTDSE

SEQ ID NO: 443579 - protein, 9 aa, Influenza virus
HTKCQTYAG

SEQ ID NO: 443580 - protein, 9 aa, Influenza virus
HTKCQTYTG

SEQ ID NO: 443581 - protein, 9 aa, Influenza virus
HTKDNSIRI

SEQ ID NO: 443582 - protein, 9 aa, Influenza virus
HTKILYFHK

SEQ ID NO: 443583 - protein, 9 aa, Influenza virus
HTKVLYFHK

SEQ ID NO: 443584 - protein, 9 aa, Influenza virus
HTKYRTESL

SEQ ID NO: 443585 - protein, 9 aa, Influenza virus
HTQYREEAL

SEQ ID NO: 443586 - protein, 9 aa, Influenza virus
HTQYREESL

SEQ ID NO: 443587 - protein, 9 aa, Influenza virus
HTQYRTESL

SEQ ID NO: 443588 - protein, 9 aa, Influenza virus
HTQYRTGSL

SEQ ID NO: 443589 - protein, 9 aa, Influenza virus
HTRGLFGAI

SEQ ID NO: 443590 - protein, 9 aa, Influenza virus
HTSKYVCTG

SEQ ID NO: 443591 - protein, 9 aa, Influenza virus
HTSQYICSP

SEQ ID NO: 443592 - protein, 9 aa, Influenza virus
HTSQYLCTG

SEQ ID NO: 443593 - protein, 9 aa, Influenza virus
HTSRYICTG

SEQ ID NO: 443594 - protein, 9 aa, Influenza virus
HTSRYMCTG

SEQ ID NO: 443595 - protein, 9 aa, Influenza virus
HTSRYVCTG

SEQ ID NO: 443596 - protein, 9 aa, Influenza virus
HVCITGDDR

SEQ ID NO: 443597 - protein, 9 aa, Influenza virus
HVCVTGDDG

SEQ ID NO: 443598 - protein, 9 aa, Influenza virus
HVCVTGDDK

SEQ ID NO: 443599 - protein, 9 aa, Influenza virus
HVCVTGDDR

SEQ ID NO: 443600 - protein, 9 aa, Influenza virus
HVDTIMEKN

SEQ ID NO: 443601 - protein, 9 aa, Influenza virus
HVEECSCYP

SEQ ID NO: 443602 - protein, 9 aa, Influenza virus
HVEVVSAKE

SEQ ID NO: 443603 - protein, 9 aa, Influenza virus
HVFVIREPF

SEQ ID NO: 443604 - protein, 9 aa, Influenza virus
HVLVTREPY

SEQ ID NO: 443605 - protein, 9 aa, Influenza virus
HVQNNYTTI

SEQ ID NO: 443606 - protein, 9 aa, Influenza virus
HVQNNYTTV

SEQ ID NO: 443607 - protein, 9 aa, Influenza virus
HVRKRFADQ

SEQ ID NO: 443608 - protein, 9 aa, Influenza virus
HVSPLSGSA

SEQ ID NO: 443609 - protein, 9 aa, Influenza virus
HWMLLDPGD

SEQ ID NO: 443610 - protein, 9 aa, Influenza virus
HWNLALDIV

SEQ ID NO: 443611 - protein, 9 aa, Influenza virus
HWPDGSNIG

SEQ ID NO: 443612 - protein, 9 aa, Influenza virus
HWTIVKPGD

SEQ ID NO: 443613 - protein, 9 aa, Influenza virus
HYEECSCYP

SEQ ID NO: 443614 - protein, 9 aa, Influenza virus
HYGGIPTDV

SEQ ID NO: 443615 - protein, 9 aa, Influenza virus
HYGGMPTDV

SEQ ID NO: 443616 - protein, 9 aa, Influenza virus
HYGGVPTDV

SEQ ID NO: 443617 - protein, 9 aa, Influenza virus
HYIGKCPKY

SEQ ID NO: 443618 - protein, 9 aa, Influenza virus
HYIGKCPRY

SEQ ID NO: 443619 - protein, 9 aa, Influenza virus
HYKISKSTK

SEQ ID NO: 443620 - protein, 9 aa, Influenza virus
HYMGECPEY

SEQ ID NO: 443621 - protein, 9 aa, Influenza virus
HYMGECPKY

SEQ ID NO: 443622 - protein, 9 aa, Influenza virus
HYMGECPNY

SEQ ID NO: 443623 - protein, 9 aa, Influenza virus
HYPKIYKTY

SEQ ID NO: 443624 - protein, 9 aa, Influenza virus
HYPKVYKPY

SEQ ID NO: 443625 - protein, 9 aa, Influenza virus
HYPKVYKTY

SEQ ID NO: 443626 - protein, 9 aa, Influenza virus
HYPKVYRTY

SEQ ID NO: 443627 - protein, 9 aa, Influenza virus
HYREEALLN

SEQ ID NO: 443628 - protein, 9 aa, Influenza virus
HYSKVYKTY

SEQ ID NO: 443629 - protein, 9 aa, Influenza virus
HYVCSGLVG

SEQ ID NO: 443630 - protein, 9 aa, Influenza virus
IAADKASTQ

SEQ ID NO: 443631 - protein, 9 aa, Influenza virus
IAADKESTQ

SEQ ID NO: 443632 - protein, 9 aa, Influenza virus
IAADKTSTQ

SEQ ID NO: 443633 - protein, 9 aa, Influenza virus
IAADKVSTQ

SEQ ID NO: 443634 - protein, 9 aa, Influenza virus
IAADRDSTQ

SEQ ID NO: 443635 - protein, 9 aa, Influenza virus
IAADRESTQ

SEQ ID NO: 443636 - protein, 9 aa, Influenza virus
IAADRGSTQ

SEQ ID NO: 443637 - protein, 9 aa, Influenza virus
IAADYKSTQ

SEQ ID NO: 443638 - protein, 9 aa, Influenza virus
IAAEKESTQ

SEQ ID NO: 443639 - protein, 9 aa, Influenza virus
IAARNIVRR

SEQ ID NO: 443640 - protein, 9 aa, Influenza virus
IAARSIVRR

SEQ ID NO: 443641 - protein, 9 aa, Influenza virus
IAASYKRIR

SEQ ID NO: 443642 - protein, 9 aa, Influenza virus
IADAQHRSH

SEQ ID NO: 443643 - protein, 9 aa, Influenza virus
IADKICIGY

SEQ ID NO: 443644 - protein, 9 aa, Influenza virus
IADRVDDAV

SEQ ID NO: 443645 - protein, 9 aa, Influenza virus
IADSHHRSH

SEQ ID NO: 443646 - protein, 9 aa, Influenza virus
IADSQHKSH

SEQ ID NO: 443647 - protein, 9 aa, Influenza virus
IADSQHRSH

SEQ ID NO: 443648 - protein, 9 aa, Influenza virus
IAEQFTWNG

SEQ ID NO: 443649 - protein, 9 aa, Influenza virus
IAFCGTSGT

SEQ ID NO: 443650 - protein, 9 aa, Influenza virus
IAFCGVDSD

SEQ ID NO: 443651 - protein, 9 aa, Influenza virus
IAFCGVNFD

SEQ ID NO: 443652 - protein, 9 aa, Influenza virus
IAFCGVNSD

SEQ ID NO: 443653 - protein, 9 aa, Influenza virus
IAFLTSSIV

SEQ ID NO: 443654 - protein, 9 aa, Influenza virus
IAFVLWACQ

SEQ ID NO: 443655 - protein, 9 aa, Influenza virus
IAGFAPFSK

SEQ ID NO: 443656 - protein, 9 aa, Influenza virus
IAGFIEGGW

SEQ ID NO: 443657 - protein, 9 aa, Influenza virus
IAGFIEGRW

SEQ ID NO: 443658 - protein, 9 aa, Influenza virus
IAGFIENGW

SEQ ID NO: 443659 - protein, 9 aa, Influenza virus
IAGGLILGM

SEQ ID NO: 443660 - protein, 9 aa, Influenza virus
IAGLFFWMC

SEQ ID NO: 443661 - protein, 9 aa, Influenza virus
IAGLSFWMC

SEQ ID NO: 443662 - protein, 9 aa, Influenza virus
IAGSSEQAA

SEQ ID NO: 443663 - protein, 9 aa, Influenza virus
IAGWILGNP

SEQ ID NO: 443664 - protein, 9 aa, Influenza virus
IAGWLLGNP

SEQ ID NO: 443665 - protein, 9 aa, Influenza virus
IAGWYGFQH

SEQ ID NO: 443666 - protein, 9 aa, Influenza virus
IAHCYPGAT

SEQ ID NO: 443667 - protein, 9 aa, Influenza virus
IAHISPLSG

SEQ ID NO: 443668 - protein, 9 aa, Influenza virus
IAHKSCLPA

SEQ ID NO: 443669 - protein, 9 aa, Influenza virus
IAIALGIIN

SEQ ID NO: 443670 - protein, 9 aa, Influenza virus
IAIGNCPKY

SEQ ID NO: 443671 - protein, 9 aa, Influenza virus
IAIGSVSRT

SEQ ID NO: 443672 - protein, 9 aa, Influenza virus
IAILAATVT

SEQ ID NO: 443673 - protein, 9 aa, Influenza virus
IAILATTIT

SEQ ID NO: 443674 - protein, 9 aa, Influenza virus
IAILATTVT

SEQ ID NO: 443675 - protein, 9 aa, Influenza virus
IAILVTTVT

SEQ ID NO: 443676 - protein, 9 aa, Influenza virus
IAIRPKVNG

SEQ ID NO: 443677 - protein, 9 aa, Influenza virus
IAIVLGIIN

SEQ ID NO: 443678 - protein, 9 aa, Influenza virus
IAKDNAIRF

SEQ ID NO: 443679 - protein, 9 aa, Influenza virus
IAKDNAVRF

SEQ ID NO: 443680 - protein, 9 aa, Influenza virus
IAKGEKANV

SEQ ID NO: 443681 - protein, 9 aa, Influenza virus
IAKRSYNNT

SEQ ID NO: 443682 - protein, 9 aa, Influenza virus
IALCGSPFP

SEQ ID NO: 443683 - protein, 9 aa, Influenza virus
IALCGSPFS

SEQ ID NO: 443684 - protein, 9 aa, Influenza virus
IALFIGVGN

SEQ ID NO: 443685 - protein, 9 aa, Influenza virus
IALGIINLL

SEQ ID NO: 443686 - protein, 9 aa, Influenza virus
IALIIGVGN

SEQ ID NO: 443687 - protein, 9 aa, Influenza virus
IALILVALA

SEQ ID NO: 443688 - protein, 9 aa, Influenza virus
IALLIGIGN

SEQ ID NO: 443689 - protein, 9 aa, Influenza virus
IALLIGVGN

SEQ ID NO: 443690 - protein, 9 aa, Influenza virus
IALSILNLL

SEQ ID NO: 443691 - protein, 9 aa, Influenza virus
IALSVLNLL

SEQ ID NO: 443692 - protein, 9 aa, Influenza virus
IALSYSAGA

SEQ ID NO: 443693 - protein, 9 aa, Influenza virus
IAMENQHTI

SEQ ID NO: 443694 - protein, 9 aa, Influenza virus
IAMGLIFMC

SEQ ID NO: 443695 - protein, 9 aa, Influenza virus
IAMGLVFIC

SEQ ID NO: 443696 - protein, 9 aa, Influenza virus
IAMGLVFMC

SEQ ID NO: 443697 - protein, 9 aa, Influenza virus
IANCYPGAT

SEQ ID NO: 443698 - protein, 9 aa, Influenza virus
IANLGLNIG

SEQ ID NO: 443699 - protein, 9 aa, Influenza virus
IAPDRASFF

SEQ ID NO: 443700 - protein, 9 aa, Influenza virus
IAPDRASFL

SEQ ID NO: 443701 - protein, 9 aa, Influenza virus
IAPDRATFL

SEQ ID NO: 443702 - protein, 9 aa, Influenza virus
IAPDRVSFL

SEQ ID NO: 443703 - protein, 9 aa, Influenza virus
IAPEFGYLL

SEQ ID NO: 443704 - protein, 9 aa, Influenza virus
IAPEKVDFE

SEQ ID NO: 443705 - protein, 9 aa, Influenza virus
IAPENAYKI

SEQ ID NO: 443706 - protein, 9 aa, Influenza virus
IAPEYAFKI

SEQ ID NO: 443707 - protein, 9 aa, Influenza virus
IAPEYAYIV

SEQ ID NO: 443708 - protein, 9 aa, Influenza virus
IAPEYAYKI

SEQ ID NO: 443709 - protein, 9 aa, Influenza virus
IAPEYAYKV

SEQ ID NO: 443710 - protein, 9 aa, Influenza virus
IAPEYAYRI

SEQ ID NO: 443711 - protein, 9 aa, Influenza virus
IAPEYGFKI

SEQ ID NO: 443712 - protein, 9 aa, Influenza virus
IAPEYGFRI

SEQ ID NO: 443713 - protein, 9 aa, Influenza virus
IAPEYGHLI

SEQ ID NO: 443714 - protein, 9 aa, Influenza virus
IAPEYGHLT

SEQ ID NO: 443715 - protein, 9 aa, Influenza virus
IAPEYGHLV

SEQ ID NO: 443716 - protein, 9 aa, Influenza virus
IAPEYGYLI

SEQ ID NO: 443717 - protein, 9 aa, Influenza virus
IAPIMFSNK

SEQ ID NO: 443718 - protein, 9 aa, Influenza virus
IAPLMMAYM

SEQ ID NO: 443719 - protein, 9 aa, Influenza virus
IAPLMVAYM

SEQ ID NO: 443720 - protein, 9 aa, Influenza virus
IAPNRASFF

SEQ ID NO: 443721 - protein, 9 aa, Influenza virus
IAPRGHYKI

SEQ ID NO: 443722 - protein, 9 aa, Influenza virus
IAPRGHYKL

SEQ ID NO: 443723 - protein, 9 aa, Influenza virus
IAPRGHYRL

SEQ ID NO: 443724 - protein, 9 aa, Influenza virus
IAPRGYFKI

SEQ ID NO: 443725 - protein, 9 aa, Influenza virus
IAPRGYFKM

SEQ ID NO: 443726 - protein, 9 aa, Influenza virus
IAPRGYFKV

SEQ ID NO: 443727 - protein, 9 aa, Influenza virus
IAPRGYYKM

SEQ ID NO: 443728 - protein, 9 aa, Influenza virus
IAPRYAFEL

SEQ ID NO: 443729 - protein, 9 aa, Influenza virus
IAPRYGYII

SEQ ID NO: 443730 - protein, 9 aa, Influenza virus
IAPSRVSKL

SEQ ID NO: 443731 - protein, 9 aa, Influenza virus
IAPSRVTKL

SEQ ID NO: 443732 - protein, 9 aa, Influenza virus
IAQDNAIRF

SEQ ID NO: 443733 - protein, 9 aa, Influenza virus
IAQKLEDVF

SEQ ID NO: 443734 - protein, 9 aa, Influenza virus
IAQRLEDVF

SEQ ID NO: 443735 - protein, 9 aa, Influenza virus
IAQRLEGVF

SEQ ID NO: 443736 - protein, 9 aa, Influenza virus
IAQRLENVF

SEQ ID NO: 443737 - protein, 9 aa, Influenza virus
IAQRLESVF

SEQ ID NO: 443738 - protein, 9 aa, Influenza virus
IASDILKRM

SEQ ID NO: 443739 - protein, 9 aa, Influenza virus
IASDILTRM

SEQ ID NO: 443740 - protein, 9 aa, Influenza virus
IASIRRNYF

SEQ ID NO: 443741 - protein, 9 aa, Influenza virus
IASKDNGIR

SEQ ID NO: 443742 - protein, 9 aa, Influenza virus
IASMRRDYF

SEQ ID NO: 443743 - protein, 9 aa, Influenza virus
IASMRRNYF

SEQ ID NO: 443744 - protein, 9 aa, Influenza virus
IASMRRSYF

SEQ ID NO: 443745 - protein, 9 aa, Influenza virus
IASRSGYEM

SEQ ID NO: 443746 - protein, 9 aa, Influenza virus
IASSGTLEF

SEQ ID NO: 443747 - protein, 9 aa, Influenza virus
IASSIVLVG

SEQ ID NO: 443748 - protein, 9 aa, Influenza virus
IASSIVMVG

SEQ ID NO: 443749 - protein, 9 aa, Influenza virus
IASSLILAA

SEQ ID NO: 443750 - protein, 9 aa, Influenza virus
IASSLPFQN

SEQ ID NO: 443751 - protein, 9 aa, Influenza virus
IASSLVLAA

SEQ ID NO: 443752 - protein, 9 aa, Influenza virus
IASSTVLVG

SEQ ID NO: 443753 - protein, 9 aa, Influenza virus
IASSTVMVG

SEQ ID NO: 443754 - protein, 9 aa, Influenza virus
IASSVVLVG

SEQ ID NO: 443755 - protein, 9 aa, Influenza virus
IASTTAKAM

SEQ ID NO: 443756 - protein, 9 aa, Influenza virus
IASVPASRY

SEQ ID NO: 443757 - protein, 9 aa, Influenza virus
IASWAGNIL

SEQ ID NO: 443758 - protein, 9 aa, Influenza virus
IATPGMQIR

SEQ ID NO: 443759 - protein, 9 aa, Influenza virus
IATREPYVS

SEQ ID NO: 443760 - protein, 9 aa, Influenza virus
IATRPKVNG

SEQ ID NO: 443761 - protein, 9 aa, Influenza virus
IATRPQVNG

SEQ ID NO: 443762 - protein, 9 aa, Influenza virus
IATRPRVNG

SEQ ID NO: 443763 - protein, 9 aa, Influenza virus
IATRSKVNG

SEQ ID NO: 443764 - protein, 9 aa, Influenza virus
IAVFCGTSG

SEQ ID NO: 443765 - protein, 9 aa, Influenza virus
IAWSATACH

SEQ ID NO: 443766 - protein, 9 aa, Influenza virus
IAWSRSSCH

SEQ ID NO: 443767 - protein, 9 aa, Influenza virus
IAWSSASCH

SEQ ID NO: 443768 - protein, 9 aa, Influenza virus
IAWSSSSCF

SEQ ID NO: 443769 - protein, 9 aa, Influenza virus
IAWSSSSCH

SEQ ID NO: 443770 - protein, 9 aa, Influenza virus
IAWSSSSCY

SEQ ID NO: 443771 - protein, 9 aa, Influenza virus
IAYCYPGAT

SEQ ID NO: 443772 - protein, 9 aa, Influenza virus
IAYCYPGST

SEQ ID NO: 443773 - protein, 9 aa, Influenza virus
IAYCYPGTT

SEQ ID NO: 443774 - protein, 9 aa, Influenza virus
IAYERMCNI

SEQ ID NO: 443775 - protein, 9 aa, Influenza virus
ICATCEQIA

SEQ ID NO: 443776 - protein, 9 aa, Influenza virus
ICAVATTHS

SEQ ID NO: 443777 - protein, 9 aa, Influenza virus
ICAVVMTDG

SEQ ID NO: 443778 - protein, 9 aa, Influenza virus
ICEKLEQSG

SEQ ID NO: 443779 - protein, 9 aa, Influenza virus
ICFMYSDFH

SEQ ID NO: 443780 - protein, 9 aa, Influenza virus
ICIAWSSSS

SEQ ID NO: 443781 - protein, 9 aa, Influenza virus
ICIDFRDMR

SEQ ID NO: 443782 - protein, 9 aa, Influenza virus
ICIGHHANN

SEQ ID NO: 443783 - protein, 9 aa, Influenza virus
ICIGYHANN

SEQ ID NO: 443784 - protein, 9 aa, Influenza virus
ICIGYHSNN

SEQ ID NO: 443785 - protein, 9 aa, Influenza virus
ICIGYLSNN

SEQ ID NO: 443786 - protein, 9 aa, Influenza virus
ICIGYLSTN

SEQ ID NO: 443787 - protein, 9 aa, Influenza virus
ICIGYMSNN

SEQ ID NO: 443788 - protein, 9 aa, Influenza virus
ICIGYQSNN

SEQ ID NO: 443789 - protein, 9 aa, Influenza virus
ICIGYQTNN

SEQ ID NO: 443790 - protein, 9 aa, Influenza virus
ICIKNGNMQ

SEQ ID NO: 443791 - protein, 9 aa, Influenza virus
ICIKNGNMR

SEQ ID NO: 443792 - protein, 9 aa, Influenza virus
ICILDQNFR

SEQ ID NO: 443793 - protein, 9 aa, Influenza virus
ICINGTCTV

SEQ ID NO: 443794 - protein, 9 aa, Influenza virus
ICIQGNNDN

SEQ ID NO: 443795 - protein, 9 aa, Influenza virus
ICISGPNNN

SEQ ID NO: 443796 - protein, 9 aa, Influenza virus
ICKAAIGLR

SEQ ID NO: 443797 - protein, 9 aa, Influenza virus
ICKAALGLR

SEQ ID NO: 443798 - protein, 9 aa, Influenza virus
ICKAAMGLK

SEQ ID NO: 443799 - protein, 9 aa, Influenza virus
ICKAAMGLR

SEQ ID NO: 443800 - protein, 9 aa, Influenza virus
ICKAAMGMR

SEQ ID NO: 443801 - protein, 9 aa, Influenza virus
ICKLVGINM

SEQ ID NO: 443802 - protein, 9 aa, Influenza virus
ICKPYIGKC

SEQ ID NO: 443803 - protein, 9 aa, Influenza virus
ICLGHHAIP

SEQ ID NO: 443804 - protein, 9 aa, Influenza virus
ICLGHHAVA

SEQ ID NO: 443805 - protein, 9 aa, Influenza virus
ICLGHHAVE

SEQ ID NO: 443806 - protein, 9 aa, Influenza virus
ICLGHHAVP

SEQ ID NO: 443807 - protein, 9 aa, Influenza virus
ICLGHHAVS

SEQ ID NO: 443808 - protein, 9 aa, Influenza virus
ICLGHHAVT

SEQ ID NO: 443809 - protein, 9 aa, Influenza virus
ICMKNGNMQ

SEQ ID NO: 443810 - protein, 9 aa, Influenza virus
ICMSGPNDN

SEQ ID NO: 443811 - protein, 9 aa, Influenza virus
ICMSGPNNN

SEQ ID NO: 443812 - protein, 9 aa, Influenza virus
ICNSNAITR

SEQ ID NO: 443813 - protein, 9 aa, Influenza virus
ICPVVFTDG

SEQ ID NO: 443814 - protein, 9 aa, Influenza virus
ICPVVMTDG

SEQ ID NO: 443815 - protein, 9 aa, Influenza virus
ICQMEKIVL

SEQ ID NO: 443816 - protein, 9 aa, Influenza virus
ICRDNWKGA

SEQ ID NO: 443817 - protein, 9 aa, Influenza virus
ICRDNWKGS

SEQ ID NO: 443818 - protein, 9 aa, Influenza virus
ICRDNWRGA

SEQ ID NO: 443819 - protein, 9 aa, Influenza virus
ICRDNWTGT

SEQ ID NO: 443820 - protein, 9 aa, Influenza virus
ICSCIASSL

SEQ ID NO: 443821 - protein, 9 aa, Influenza virus
ICSGFFGDN

SEQ ID NO: 443822 - protein, 9 aa, Influenza virus
ICSGIFGDN

SEQ ID NO: 443823 - protein, 9 aa, Influenza virus
ICSGLVGDT

SEQ ID NO: 443824 - protein, 9 aa, Influenza virus
ICSGVFGDN

SEQ ID NO: 443825 - protein, 9 aa, Influenza virus
ICSGVFGDS

SEQ ID NO: 443826 - protein, 9 aa, Influenza virus
ICSGVFGDT

SEQ ID NO: 443827 - protein, 9 aa, Influenza virus
ICSGVLGDN

SEQ ID NO: 443828 - protein, 9 aa, Influenza virus
ICSKFHSDT

SEQ ID NO: 443829 - protein, 9 aa, Influenza virus
ICSPVLTDN

SEQ ID NO: 443830 - protein, 9 aa, Influenza virus
ICTCRDNWQ

SEQ ID NO: 443831 - protein, 9 aa, Influenza virus
ICTGILTDT

SEQ ID NO: 443832 - protein, 9 aa, Influenza virus
ICTGVLTDT

SEQ ID NO: 443833 - protein, 9 aa, Influenza virus
ICTHLEICF

SEQ ID NO: 443834 - protein, 9 aa, Influenza virus
ICTHLEVCF

SEQ ID NO: 443835 - protein, 9 aa, Influenza virus
ICTHMEVCF

SEQ ID NO: 443836 - protein, 9 aa, Influenza virus
ICTVVMTDG

SEQ ID NO: 443837 - protein, 9 aa, Influenza virus
ICVAWSSSS

SEQ ID NO: 443838 - protein, 9 aa, Influenza virus
ICVAWSSTS

SEQ ID NO: 443839 - protein, 9 aa, Influenza virus
ICVCRDNWH

SEQ ID NO: 443840 - protein, 9 aa, Influenza virus
ICVGWSSTS

SEQ ID NO: 443841 - protein, 9 aa, Influenza virus
ICVGWSSTT

SEQ ID NO: 443842 - protein, 9 aa, Influenza virus
ICVGYHANN

SEQ ID NO: 443843 - protein, 9 aa, Influenza virus
ICVGYHSNN

SEQ ID NO: 443844 - protein, 9 aa, Influenza virus
ICVGYLSTN

SEQ ID NO: 443845 - protein, 9 aa, Influenza virus
ICVKNGNHA

SEQ ID NO: 443846 - protein, 9 aa, Influenza virus
ICVKNGNMQ

SEQ ID NO: 443847 - protein, 9 aa, Influenza virus
ICVKNGNMR

SEQ ID NO: 443848 - protein, 9 aa, Influenza virus
ICVQGNNDN

SEQ ID NO: 443849 - protein, 9 aa, Influenza virus
ICVQGNNKN

SEQ ID NO: 443850 - protein, 9 aa, Influenza virus
ICVQGNNNN

SEQ ID NO: 443851 - protein, 9 aa, Influenza virus
ICVSGPNNN

SEQ ID NO: 443852 - protein, 9 aa, Influenza virus
ICVTGDDRN

SEQ ID NO: 443853 - protein, 9 aa, Influenza virus
ICVVAVTDG

SEQ ID NO: 443854 - protein, 9 aa, Influenza virus
ICYPGKFTN

SEQ ID NO: 443855 - protein, 9 aa, Influenza virus
ICYPGRFTN

SEQ ID NO: 443856 - protein, 9 aa, Influenza virus
ICYPGSIEN

SEQ ID NO: 443857 - protein, 9 aa, Influenza virus
ICYPGSVEN

SEQ ID NO: 443858 - protein, 9 aa, Influenza virus
IDAGDGCFE

SEQ ID NO: 443859 - protein, 9 aa, Influenza virus
IDAGNGCFD

SEQ ID NO: 443860 - protein, 9 aa, Influenza virus
IDALLGDPH

SEQ ID NO: 443861 - protein, 9 aa, Influenza virus
IDALLGDPQ

SEQ ID NO: 443862 - protein, 9 aa, Influenza virus
IDARIDFES

SEQ ID NO: 443863 - protein, 9 aa, Influenza virus
IDARVDFES

SEQ ID NO: 443864 - protein, 9 aa, Influenza virus
IDAVKLSSG

SEQ ID NO: 443865 - protein, 9 aa, Influenza virus
IDDAVTDIW

SEQ ID NO: 443866 - protein, 9 aa, Influenza virus
IDDAVTDVW

SEQ ID NO: 443867 - protein, 9 aa, Influenza virus
IDDQIEDLW

SEQ ID NO: 443868 - protein, 9 aa, Influenza virus
IDDQIEELW

SEQ ID NO: 443869 - protein, 9 aa, Influenza virus
IDDQIEGLW

SEQ ID NO: 443870 - protein, 9 aa, Influenza virus
IDDQIENLW

SEQ ID NO: 443871 - protein, 9 aa, Influenza virus
IDDQIIDIW

SEQ ID NO: 443872 - protein, 9 aa, Influenza virus
IDDQITDIW

SEQ ID NO: 443873 - protein, 9 aa, Influenza virus
IDDQVTDIW

SEQ ID NO: 443874 - protein, 9 aa, Influenza virus
IDECRTFFL

SEQ ID NO: 443875 - protein, 9 aa, Influenza virus
IDEESRARI

SEQ ID NO: 443876 - protein, 9 aa, Influenza virus
IDEGDGCFN

SEQ ID NO: 443877 - protein, 9 aa, Influenza virus
IDEGDGCFS

SEQ ID NO: 443878 - protein, 9 aa, Influenza virus
IDEGNGCFE

SEQ ID NO: 443879 - protein, 9 aa, Influenza virus
IDEITTKIN

SEQ ID NO: 443880 - protein, 9 aa, Influenza virus
IDESCEGEC

SEQ ID NO: 443881 - protein, 9 aa, Influenza virus
IDFHWMLLD

SEQ ID NO: 443882 - protein, 9 aa, Influenza virus
IDFRDMRKN

SEQ ID NO: 443883 - protein, 9 aa, Influenza virus
IDGFEPNGC

SEQ ID NO: 443884 - protein, 9 aa, Influenza virus
IDGITNKIN

SEQ ID NO: 443885 - protein, 9 aa, Influenza virus
IDGITNKVN

SEQ ID NO: 443886 - protein, 9 aa, Influenza virus
IDGKAPISL

SEQ ID NO: 443887 - protein, 9 aa, Influenza virus
IDGTCTVVM

SEQ ID NO: 443888 - protein, 9 aa, Influenza virus
IDGVTNKVN

SEQ ID NO: 443889 - protein, 9 aa, Influenza virus
IDGWTTANS

SEQ ID NO: 443890 - protein, 9 aa, Influenza virus
IDGWYGFHH

SEQ ID NO: 443891 - protein, 9 aa, Influenza virus
IDGWYGFKH

SEQ ID NO: 443892 - protein, 9 aa, Influenza virus
IDGWYGFRH

SEQ ID NO: 443893 - protein, 9 aa, Influenza virus
IDGWYGYHH

SEQ ID NO: 443894 - protein, 9 aa, Influenza virus
IDGWYGYKH

SEQ ID NO: 443895 - protein, 9 aa, Influenza virus
IDGWYGYRH

SEQ ID NO: 443896 - protein, 9 aa, Influenza virus
IDIMQNKLN

SEQ ID NO: 443897 - protein, 9 aa, Influenza virus
IDIWAYNAE

SEQ ID NO: 443898 - protein, 9 aa, Influenza virus
IDIWTYNAE

SEQ ID NO: 443899 - protein, 9 aa, Influenza virus
IDIYCICRD

SEQ ID NO: 443900 - protein, 9 aa, Influenza virus
IDKEPMGFR

SEQ ID NO: 443901 - protein, 9 aa, Influenza virus
IDKESMGFR

SEQ ID NO: 443902 - protein, 9 aa, Influenza virus
IDKICLGHH

SEQ ID NO: 443903 - protein, 9 aa, Influenza virus
IDKINGKLN

SEQ ID NO: 443904 - protein, 9 aa, Influenza virus
IDKITNKIN

SEQ ID NO: 443905 - protein, 9 aa, Influenza virus
IDKITNKVN

SEQ ID NO: 443906 - protein, 9 aa, Influenza virus
IDKMNGNYD

SEQ ID NO: 443907 - protein, 9 aa, Influenza virus
IDKMNTQFE

SEQ ID NO: 443908 - protein, 9 aa, Influenza virus
IDKMNTRFE

SEQ ID NO: 443909 - protein, 9 aa, Influenza virus
IDKNALGDC

SEQ ID NO: 443910 - protein, 9 aa, Influenza virus
IDKNALGEC

SEQ ID NO: 443911 - protein, 9 aa, Influenza virus
IDKTNQQFE

SEQ ID NO: 443912 - protein, 9 aa, Influenza virus
IDKVCTKGK

SEQ ID NO: 443913 - protein, 9 aa, Influenza virus
IDLADSEMD

SEQ ID NO: 443914 - protein, 9 aa, Influenza virus
IDLADSEMK

SEQ ID NO: 443915 - protein, 9 aa, Influenza virus
IDLADSEML

SEQ ID NO: 443916 - protein, 9 aa, Influenza virus
IDLADSEMN

SEQ ID NO: 443917 - protein, 9 aa, Influenza virus
IDLADSEMS

SEQ ID NO: 443918 - protein, 9 aa, Influenza virus
IDLGQCGLL

SEQ ID NO: 443919 - protein, 9 aa, Influenza virus
IDLTDAEMN

SEQ ID NO: 443920 - protein, 9 aa, Influenza virus
IDLTDSEMN

SEQ ID NO: 443921 - protein, 9 aa, Influenza virus
IDLTDSEMS

SEQ ID NO: 443922 - protein, 9 aa, Influenza virus
IDLTNSEMN

SEQ ID NO: 443923 - protein, 9 aa, Influenza virus
IDLVETNHT

SEQ ID NO: 443924 - protein, 9 aa, Influenza virus
IDLWSYNAE

SEQ ID NO: 443925 - protein, 9 aa, Influenza virus
IDLWSYNAG

SEQ ID NO: 443926 - protein, 9 aa, Influenza virus
IDMADSEML

SEQ ID NO: 443927 - protein, 9 aa, Influenza virus
IDMADSTML

SEQ ID NO: 443928 - protein, 9 aa, Influenza virus
IDMTDSEMN

SEQ ID NO: 443929 - protein, 9 aa, Influenza virus
IDNDNWSGY

SEQ ID NO: 443930 - protein, 9 aa, Influenza virus
IDNEFIEVE

SEQ ID NO: 443931 - protein, 9 aa, Influenza virus
IDNEFNEIE

SEQ ID NO: 443932 - protein, 9 aa, Influenza virus
IDNEFNEVE

SEQ ID NO: 443933 - protein, 9 aa, Influenza virus
IDNEFSEIE

SEQ ID NO: 443934 - protein, 9 aa, Influenza virus
IDNEFSEVE

SEQ ID NO: 443935 - protein, 9 aa, Influenza virus
IDNEFTEIE

SEQ ID NO: 443936 - protein, 9 aa, Influenza virus
IDNEFTEVE

SEQ ID NO: 443937 - protein, 9 aa, Influenza virus
IDNGDGCFE

SEQ ID NO: 443938 - protein, 9 aa, Influenza virus
IDNMQNKLN

SEQ ID NO: 443939 - protein, 9 aa, Influenza virus
IDNMQNRLN

SEQ ID NO: 443940 - protein, 9 aa, Influenza virus
IDNNNWSGY

SEQ ID NO: 443941 - protein, 9 aa, Influenza virus
IDPKGLFGA

SEQ ID NO: 443942 - protein, 9 aa, Influenza virus
IDPVELSSG

SEQ ID NO: 443943 - protein, 9 aa, Influenza virus
IDPVKLSGG

SEQ ID NO: 443944 - protein, 9 aa, Influenza virus
IDPVKLSSG

SEQ ID NO: 443945 - protein, 9 aa, Influenza virus
IDQADSEMN

SEQ ID NO: 443946 - protein, 9 aa, Influenza virus
IDQINGKLN

SEQ ID NO: 443947 - protein, 9 aa, Influenza virus
IDQITGKLN

SEQ ID NO: 443948 - protein, 9 aa, Influenza virus
IDQITRKLN

SEQ ID NO: 443949 - protein, 9 aa, Influenza virus
IDQITTKIN

SEQ ID NO: 443950 - protein, 9 aa, Influenza virus
IDQSLIIAA

SEQ ID NO: 443951 - protein, 9 aa, Influenza virus
IDQVKLSSG

SEQ ID NO: 443952 - protein, 9 aa, Influenza virus
IDQVTGKLN

SEQ ID NO: 443953 - protein, 9 aa, Influenza virus
IDRFLRVKD

SEQ ID NO: 443954 - protein, 9 aa, Influenza virus
IDRFLRVRD

SEQ ID NO: 443955 - protein, 9 aa, Influenza virus
IDRITTKIN

SEQ ID NO: 443956 - protein, 9 aa, Influenza virus
IDRNAIGDC

SEQ ID NO: 443957 - protein, 9 aa, Influenza virus
IDRNALGDC

SEQ ID NO: 443958 - protein, 9 aa, Influenza virus
IDRSFRPNI

SEQ ID NO: 443959 - protein, 9 aa, Influenza virus
IDRTNHQFE

SEQ ID NO: 443960 - protein, 9 aa, Influenza virus
IDSGYVCSG

SEQ ID NO: 443961 - protein, 9 aa, Influenza virus
IDSIGSWSQ

SEQ ID NO: 443962 - protein, 9 aa, Influenza virus
IDSLLGDPH

SEQ ID NO: 443963 - protein, 9 aa, Influenza virus
IDSNYVCSG

SEQ ID NO: 443964 - protein, 9 aa, Influenza virus
IDSPNHAKS

SEQ ID NO: 443965 - protein, 9 aa, Influenza virus
IDSRAVGKC

SEQ ID NO: 443966 - protein, 9 aa, Influenza virus
IDSSYICSG

SEQ ID NO: 443967 - protein, 9 aa, Influenza virus
IDSSYLCSG

SEQ ID NO: 443968 - protein, 9 aa, Influenza virus
IDSSYMCSG

SEQ ID NO: 443969 - protein, 9 aa, Influenza virus
IDSSYVCSG

SEQ ID NO: 443970 - protein, 9 aa, Influenza virus
IDSTDSEMN

SEQ ID NO: 443971 - protein, 9 aa, Influenza virus
IDSVKLSSG

SEQ ID NO: 443972 - protein, 9 aa, Influenza virus
IDSWAVGRC

SEQ ID NO: 443973 - protein, 9 aa, Influenza virus
IDTGDGCFE

SEQ ID NO: 443974 - protein, 9 aa, Influenza virus
IDTGKGCFD

SEQ ID NO: 443975 - protein, 9 aa, Influenza virus
IDTGNGCFD

SEQ ID NO: 443976 - protein, 9 aa, Influenza virus
IDTILERNV

SEQ ID NO: 443977 - protein, 9 aa, Influenza virus
IDTIMEKNV

SEQ ID NO: 443978 - protein, 9 aa, Influenza virus
IDTLTETGV

SEQ ID NO: 443979 - protein, 9 aa, Influenza virus
IDTNKTFQN

SEQ ID NO: 443980 - protein, 9 aa, Influenza virus
IDVTDSEMD

SEQ ID NO: 443981 - protein, 9 aa, Influenza virus
IDVTDSEMN

SEQ ID NO: 443982 - protein, 9 aa, Influenza virus
IDVTDSEMS

SEQ ID NO: 443983 - protein, 9 aa, Influenza virus
IDVWTYNAE

SEQ ID NO: 443984 - protein, 9 aa, Influenza virus
IDVYCICRD

SEQ ID NO: 443985 - protein, 9 aa, Influenza virus
IDVYCVCRD

SEQ ID NO: 443986 - protein, 9 aa, Influenza virus
IEAESSIKE

SEQ ID NO: 443987 - protein, 9 aa, Influenza virus
IEAESSVKE

SEQ ID NO: 443988 - protein, 9 aa, Influenza virus
IEAESSVRE

SEQ ID NO: 443989 - protein, 9 aa, Influenza virus
IEAMASQGT

SEQ ID NO: 443990 - protein, 9 aa, Influenza virus
IEAMATQGT

SEQ ID NO: 443991 - protein, 9 aa, Influenza virus
IEARGLFGA

SEQ ID NO: 443992 - protein, 9 aa, Influenza virus
IEAVIYGNP

SEQ ID NO: 443993 - protein, 9 aa, Influenza virus
IECIGWSST

SEQ ID NO: 443994 - protein, 9 aa, Influenza virus
IECVCRDNW

SEQ ID NO: 443995 - protein, 9 aa, Influenza virus
IECVGWSST

SEQ ID NO: 443996 - protein, 9 aa, Influenza virus
IEDLIFLAR

SEQ ID NO: 443997 - protein, 9 aa, Influenza virus
IEDLIFLTR

SEQ ID NO: 443998 - protein, 9 aa, Influenza virus
IEDLIFMAR

SEQ ID NO: 443999 - protein, 9 aa, Influenza virus
IEDLIFSAR

SEQ ID NO: 444000 - protein, 9 aa, Influenza virus
IEDLTFLAR

SEQ ID NO: 444001 - protein, 9 aa, Influenza virus
IEDLWAYNA

SEQ ID NO: 444002 - protein, 9 aa, Influenza virus
IEDPAAPHG

SEQ ID NO: 444003 - protein, 9 aa, Influenza virus
IEDPDHEGE

SEQ ID NO: 444004 - protein, 9 aa, Influenza virus
IEDPGAPHG

SEQ ID NO: 444005 - protein, 9 aa, Influenza virus
IEDPNAPHK

SEQ ID NO: 444006 - protein, 9 aa, Influenza virus
IEDPNAPNK

SEQ ID NO: 444007 - protein, 9 aa, Influenza virus
IEDPNHEGE

SEQ ID NO: 444008 - protein, 9 aa, Influenza virus
IEDPSAPHG

SEQ ID NO: 444009 - protein, 9 aa, Influenza virus
IEDPSAPHR

SEQ ID NO: 444010 - protein, 9 aa, Influenza virus
IEDPSHEGE

SEQ ID NO: 444011 - protein, 9 aa, Influenza virus
IEDPTAPHG

SEQ ID NO: 444012 - protein, 9 aa, Influenza virus
IEDQITDIW

SEQ ID NO: 444013 - protein, 9 aa, Influenza virus
IEECLINDP

SEQ ID NO: 444014 - protein, 9 aa, Influenza virus
IEECPCYGH

SEQ ID NO: 444015 - protein, 9 aa, Influenza virus
IEECSCYGA

SEQ ID NO: 444016 - protein, 9 aa, Influenza virus
IEECSCYGE

SEQ ID NO: 444017 - protein, 9 aa, Influenza virus
IEECSCYGH

SEQ ID NO: 444018 - protein, 9 aa, Influenza virus
IEECSCYGK

SEQ ID NO: 444019 - protein, 9 aa, Influenza virus
IEECSCYGS

SEQ ID NO: 444020 - protein, 9 aa, Influenza virus
IEECSCYGV

SEQ ID NO: 444021 - protein, 9 aa, Influenza virus
IEECSCYPN

SEQ ID NO: 444022 - protein, 9 aa, Influenza virus
IEECSCYPQ

SEQ ID NO: 444023 - protein, 9 aa, Influenza virus
IEECSCYPR

SEQ ID NO: 444024 - protein, 9 aa, Influenza virus
IEEGINQLS

SEQ ID NO: 444025 - protein, 9 aa, Influenza virus
IEEGSIGKV

SEQ ID NO: 444026 - protein, 9 aa, Influenza virus
IEELWAYNA

SEQ ID NO: 444027 - protein, 9 aa, Influenza virus
IEERINHLS

SEQ ID NO: 444028 - protein, 9 aa, Influenza virus
IEERINQLS

SEQ ID NO: 444029 - protein, 9 aa, Influenza virus
IEEWSCYGH

SEQ ID NO: 444030 - protein, 9 aa, Influenza virus
IEEYGKGRI

SEQ ID NO: 444031 - protein, 9 aa, Influenza virus
IEEYGRGRI

SEQ ID NO: 444032 - protein, 9 aa, Influenza virus
IEFDEIGED

SEQ ID NO: 444033 - protein, 9 aa, Influenza virus
IEFEPFQSL

SEQ ID NO: 444034 - protein, 9 aa, Influenza virus
IEGGWCGMI

SEQ ID NO: 444035 - protein, 9 aa, Influenza virus
IEGGWPGLI

SEQ ID NO: 444036 - protein, 9 aa, Influenza virus
IEGGWPGLV

SEQ ID NO: 444037 - protein, 9 aa, Influenza virus
IEGGWQGLV

SEQ ID NO: 444038 - protein, 9 aa, Influenza virus
IEGGWQGMI

SEQ ID NO: 444039 - protein, 9 aa, Influenza virus
IEGGWQGMV

SEQ ID NO: 444040 - protein, 9 aa, Influenza virus
IEGGWSGLI

SEQ ID NO: 444041 - protein, 9 aa, Influenza virus
IEGGWSGLV

SEQ ID NO: 444042 - protein, 9 aa, Influenza virus
IEGGWSGMI

SEQ ID NO: 444043 - protein, 9 aa, Influenza virus
IEGGWTGLI

SEQ ID NO: 444044 - protein, 9 aa, Influenza virus
IEGGWTGMI

SEQ ID NO: 444045 - protein, 9 aa, Influenza virus
IEGGWTGMV

SEQ ID NO: 444046 - protein, 9 aa, Influenza virus
IEGICYPGS

SEQ ID NO: 444047 - protein, 9 aa, Influenza virus
IEGIKLKSE

SEQ ID NO: 444048 - protein, 9 aa, Influenza virus
IEGIKLKTE

SEQ ID NO: 444049 - protein, 9 aa, Influenza virus
IEGKLSQMS

SEQ ID NO: 444050 - protein, 9 aa, Influenza virus
IEGLIYGNP

SEQ ID NO: 444051 - protein, 9 aa, Influenza virus
IEGLVYGNP

SEQ ID NO: 444052 - protein, 9 aa, Influenza virus
IEGLWAYNA

SEQ ID NO: 444053 - protein, 9 aa, Influenza virus
IEGRIQDLE

SEQ ID NO: 444054 - protein, 9 aa, Influenza virus
IEGRVQDLE

SEQ ID NO: 444055 - protein, 9 aa, Influenza virus
IEGRWPGLV

SEQ ID NO: 444056 - protein, 9 aa, Influenza virus
IEGWVVVAK

SEQ ID NO: 444057 - protein, 9 aa, Influenza virus
IEHIASIRR

SEQ ID NO: 444058 - protein, 9 aa, Influenza virus
IEHIASMRR

SEQ ID NO: 444059 - protein, 9 aa, Influenza virus
IEHQIGNVI

SEQ ID NO: 444060 - protein, 9 aa, Influenza virus
IEHQISNVI

SEQ ID NO: 444061 - protein, 9 aa, Influenza virus
IEHVASMRR

SEQ ID NO: 444062 - protein, 9 aa, Influenza virus
IEIGVTRRE

SEQ ID NO: 444063 - protein, 9 aa, Influenza virus
IEIITIGSI

SEQ ID NO: 444064 - protein, 9 aa, Influenza virus
IEIMASQGT

SEQ ID NO: 444065 - protein, 9 aa, Influenza virus
IEIPSWAGN

SEQ ID NO: 444066 - protein, 9 aa, Influenza virus
IEIWSYNAE

SEQ ID NO: 444067 - protein, 9 aa, Influenza virus
IEKDNAVRF

SEQ ID NO: 444068 - protein, 9 aa, Influenza virus
IEKEFEQVE

SEQ ID NO: 444069 - protein, 9 aa, Influenza virus
IEKEFGQVE

SEQ ID NO: 444070 - protein, 9 aa, Influenza virus
IEKEFSEIE

SEQ ID NO: 444071 - protein, 9 aa, Influenza virus
IEKEFSEVE

SEQ ID NO: 444072 - protein, 9 aa, Influenza virus
IEKIEKIRP

SEQ ID NO: 444073 - protein, 9 aa, Influenza virus
IEKINTQFE

SEQ ID NO: 444074 - protein, 9 aa, Influenza virus
IEKIRNGTY

SEQ ID NO: 444075 - protein, 9 aa, Influenza virus
IEKITNKVN

SEQ ID NO: 444076 - protein, 9 aa, Influenza virus
IEKMNGNYD

SEQ ID NO: 444077 - protein, 9 aa, Influenza virus
IEKMNIQFE

SEQ ID NO: 444078 - protein, 9 aa, Influenza virus
IEKMNIQFT

SEQ ID NO: 444079 - protein, 9 aa, Influenza virus
IEKMNTQFE

SEQ ID NO: 444080 - protein, 9 aa, Influenza virus
IEKMNTQFG

SEQ ID NO: 444081 - protein, 9 aa, Influenza virus
IEKMNTQFT

SEQ ID NO: 444082 - protein, 9 aa, Influenza virus
IEKMNTQSE

SEQ ID NO: 444083 - protein, 9 aa, Influenza virus
IEKMVLSAF

SEQ ID NO: 444084 - protein, 9 aa, Influenza virus
IEKNALGDC

SEQ ID NO: 444085 - protein, 9 aa, Influenza virus
IEKQIGNVI

SEQ ID NO: 444086 - protein, 9 aa, Influenza virus
IEKRINQLS

SEQ ID NO: 444087 - protein, 9 aa, Influenza virus
IEKTNDKYH

SEQ ID NO: 444088 - protein, 9 aa, Influenza virus
IEKTNEKFH

SEQ ID NO: 444089 - protein, 9 aa, Influenza virus
IEKTNEKYH

SEQ ID NO: 444090 - protein, 9 aa, Influenza virus
IEKTNKQFE

SEQ ID NO: 444091 - protein, 9 aa, Influenza virus
IEKTNQQFE

SEQ ID NO: 444092 - protein, 9 aa, Influenza virus
IEKTNQQFK

SEQ ID NO: 444093 - protein, 9 aa, Influenza virus
IEKTNTEFE

SEQ ID NO: 444094 - protein, 9 aa, Influenza virus
IEKTNTQFE

SEQ ID NO: 444095 - protein, 9 aa, Influenza virus
IEKTSWSYI

SEQ ID NO: 444096 - protein, 9 aa, Influenza virus
IEKVRNGTY

SEQ ID NO: 444097 - protein, 9 aa, Influenza virus
IEKYGSGRI

SEQ ID NO: 444098 - protein, 9 aa, Influenza virus
IEKYGTGRI

SEQ ID NO: 444099 - protein, 9 aa, Influenza virus
IELAEKAMK

SEQ ID NO: 444100 - protein, 9 aa, Influenza virus
IELDEIGED

SEQ ID NO: 444101 - protein, 9 aa, Influenza virus
IELIRGKPN

SEQ ID NO: 444102 - protein, 9 aa, Influenza virus
IELIRGRPK

SEQ ID NO: 444103 - protein, 9 aa, Influenza virus
IELIRGRPN

SEQ ID NO: 444104 - protein, 9 aa, Influenza virus
IENDRTLDL

SEQ ID NO: 444105 - protein, 9 aa, Influenza virus
IENGWEGLI

SEQ ID NO: 444106 - protein, 9 aa, Influenza virus
IENGWEGLV

SEQ ID NO: 444107 - protein, 9 aa, Influenza virus
IENGWEGMI

SEQ ID NO: 444108 - protein, 9 aa, Influenza virus
IENGWEGMM

SEQ ID NO: 444109 - protein, 9 aa, Influenza virus
IENGWEGMV

SEQ ID NO: 444110 - protein, 9 aa, Influenza virus
IENGWQGLI

SEQ ID NO: 444111 - protein, 9 aa, Influenza virus
IENLEELRF

SEQ ID NO: 444112 - protein, 9 aa, Influenza virus
IENLNKKID

SEQ ID NO: 444113 - protein, 9 aa, Influenza virus
IENLNKKME

SEQ ID NO: 444114 - protein, 9 aa, Influenza virus
IENLNKKVD

SEQ ID NO: 444115 - protein, 9 aa, Influenza virus
IENLNRKME

SEQ ID NO: 444116 - protein, 9 aa, Influenza virus
IENLNRKVD

SEQ ID NO: 444117 - protein, 9 aa, Influenza virus
IENLQAYQK

SEQ ID NO: 444118 - protein, 9 aa, Influenza virus
IENLWAYNA

SEQ ID NO: 444119 - protein, 9 aa, Influenza virus
IENNVTVTS

SEQ ID NO: 444120 - protein, 9 aa, Influenza virus
IENPSHEGE

SEQ ID NO: 444121 - protein, 9 aa, Influenza virus
IENQEELKS

SEQ ID NO: 444122 - protein, 9 aa, Influenza virus
IENQEELRF

SEQ ID NO: 444123 - protein, 9 aa, Influenza virus
IENQEELRS

SEQ ID NO: 444124 - protein, 9 aa, Influenza virus
IENQHTIDL

SEQ ID NO: 444125 - protein, 9 aa, Influenza virus
IENQKTLDE

SEQ ID NO: 444126 - protein, 9 aa, Influenza virus
IENTYVNKT

SEQ ID NO: 444127 - protein, 9 aa, Influenza virus
IENTYVNNT

SEQ ID NO: 444128 - protein, 9 aa, Influenza virus
IEPKGLFGA

SEQ ID NO: 444129 - protein, 9 aa, Influenza virus
IEPRGLFGA

SEQ ID NO: 444130 - protein, 9 aa, Influenza virus
IEQKVPVTQ

SEQ ID NO: 444131 - protein, 9 aa, Influenza virus
IEQNIPVTQ

SEQ ID NO: 444132 - protein, 9 aa, Influenza virus
IEQNVPVTQ

SEQ ID NO: 444133 - protein, 9 aa, Influenza virus
IEQQIGNVI

SEQ ID NO: 444134 - protein, 9 aa, Influenza virus
IERMVLSAF

SEQ ID NO: 444135 - protein, 9 aa, Influenza virus
IERNALGDC

SEQ ID NO: 444136 - protein, 9 aa, Influenza virus
IERNALGNC

SEQ ID NO: 444137 - protein, 9 aa, Influenza virus
IERPTAVDT

SEQ ID NO: 444138 - protein, 9 aa, Influenza virus
IERQEIVDN

SEQ ID NO: 444139 - protein, 9 aa, Influenza virus
IERRNSSDI

SEQ ID NO: 444140 - protein, 9 aa, Influenza virus
IERTNEKFH

SEQ ID NO: 444141 - protein, 9 aa, Influenza virus
IERTNEKYH

SEQ ID NO: 444142 - protein, 9 aa, Influenza virus
IERTNQQFE

SEQ ID NO: 444143 - protein, 9 aa, Influenza virus
IERVRNGTY

SEQ ID NO: 444144 - protein, 9 aa, Influenza virus
IESEFNEIE

SEQ ID NO: 444145 - protein, 9 aa, Influenza virus
IESEFSEIE

SEQ ID NO: 444146 - protein, 9 aa, Influenza virus
IESEFSETE

SEQ ID NO: 444147 - protein, 9 aa, Influenza virus
IESIIEAES

SEQ ID NO: 444148 - protein, 9 aa, Influenza virus
IESIRNGTY

SEQ ID NO: 444149 - protein, 9 aa, Influenza virus
IESKLSQMS

SEQ ID NO: 444150 - protein, 9 aa, Influenza virus
IESLNKKME

SEQ ID NO: 444151 - protein, 9 aa, Influenza virus
IESMIEAES

SEQ ID NO: 444152 - protein, 9 aa, Influenza virus
IESMVEAES

SEQ ID NO: 444153 - protein, 9 aa, Influenza virus
IESNGNLIA

SEQ ID NO: 444154 - protein, 9 aa, Influenza virus
IESNITVTS

SEQ ID NO: 444155 - protein, 9 aa, Influenza virus
IESNVTVTS

SEQ ID NO: 444156 - protein, 9 aa, Influenza virus
IESRGLFGA

SEQ ID NO: 444157 - protein, 9 aa, Influenza virus
IESVRNGTY

SEQ ID NO: 444158 - protein, 9 aa, Influenza virus
IETGYVCSK

SEQ ID NO: 444159 - protein, 9 aa, Influenza virus
IETNHTGTY

SEQ ID NO: 444160 - protein, 9 aa, Influenza virus
IETTHTGTY

SEQ ID NO: 444161 - protein, 9 aa, Influenza virus
IEVEKQIGN

SEQ ID NO: 444162 - protein, 9 aa, Influenza virus
IEVLHLTQG

SEQ ID NO: 444163 - protein, 9 aa, Influenza virus
IEVTNATEL

SEQ ID NO: 444164 - protein, 9 aa, Influenza virus
IEVVAAQEL

SEQ ID NO: 444165 - protein, 9 aa, Influenza virus
IEVVNATET

SEQ ID NO: 444166 - protein, 9 aa, Influenza virus
IEVVTAQEL

SEQ ID NO: 444167 - protein, 9 aa, Influenza virus
IEVWSYNAE

SEQ ID NO: 444168 - protein, 9 aa, Influenza virus
IEYDAVATT

SEQ ID NO: 444169 - protein, 9 aa, Influenza virus
IEYIASMRR

SEQ ID NO: 444170 - protein, 9 aa, Influenza virus
IEYNGKSLG

SEQ ID NO: 444171 - protein, 9 aa, Influenza virus
IEYQIGNVI

SEQ ID NO: 444172 - protein, 9 aa, Influenza virus
IEYVASMRR

SEQ ID NO: 444173 - protein, 9 aa, Influenza virus
IFENSCIET

SEQ ID NO: 444174 - protein, 9 aa, Influenza virus
IFENSCLET

SEQ ID NO: 444175 - protein, 9 aa, Influenza virus
IFESSCLET

SEQ ID NO: 444176 - protein, 9 aa, Influenza virus
IFFWMCSNG

SEQ ID NO: 444177 - protein, 9 aa, Influenza virus
IFGAIAGFI

SEQ ID NO: 444178 - protein, 9 aa, Influenza virus
IFGCQNGNI

SEQ ID NO: 444179 - protein, 9 aa, Influenza virus
IFGCQNGNV

SEQ ID NO: 444180 - protein, 9 aa, Influenza virus
IFGKDNAIR

SEQ ID NO: 444181 - protein, 9 aa, Influenza virus
IFGKDNAVR

SEQ ID NO: 444182 - protein, 9 aa, Influenza virus
IFGNSCLET

SEQ ID NO: 444183 - protein, 9 aa, Influenza virus
IFGPVHFRN

SEQ ID NO: 444184 - protein, 9 aa, Influenza virus
IFHKCDDDC

SEQ ID NO: 444185 - protein, 9 aa, Influenza virus
IFHKCDDHC

SEQ ID NO: 444186 - protein, 9 aa, Influenza virus
IFHKCDDNC

SEQ ID NO: 444187 - protein, 9 aa, Influenza virus
IFHKCDDQC

SEQ ID NO: 444188 - protein, 9 aa, Influenza virus
IFHKCDNQC

SEQ ID NO: 444189 - protein, 9 aa, Influenza virus
IFHQCDNDC

SEQ ID NO: 444190 - protein, 9 aa, Influenza virus
IFHQCDNNC

SEQ ID NO: 444191 - protein, 9 aa, Influenza virus
IFHRCDDQC

SEQ ID NO: 444192 - protein, 9 aa, Influenza virus
IFIFILLTH

SEQ ID NO: 444193 - protein, 9 aa, Influenza virus
IFIFLLLTH

SEQ ID NO: 444194 - protein, 9 aa, Influenza virus
IFLAMITYI

SEQ ID NO: 444195 - protein, 9 aa, Influenza virus
IFLARSALI

SEQ ID NO: 444196 - protein, 9 aa, Influenza virus
IFLWCKIVT

SEQ ID NO: 444197 - protein, 9 aa, Influenza virus
IFLWGIHHP

SEQ ID NO: 444198 - protein, 9 aa, Influenza virus
IFLWMCSNG

SEQ ID NO: 444199 - protein, 9 aa, Influenza virus
IFLYVRTNG

SEQ ID NO: 444200 - protein, 9 aa, Influenza virus
IFMARSALI

SEQ ID NO: 444201 - protein, 9 aa, Influenza virus
IFMCVKNGN

SEQ ID NO: 444202 - protein, 9 aa, Influenza virus
IFNFILLTH

SEQ ID NO: 444203 - protein, 9 aa, Influenza virus
IFNGAFIAP

SEQ ID NO: 444204 - protein, 9 aa, Influenza virus
IFNMERIKE

SEQ ID NO: 444205 - protein, 9 aa, Influenza virus
IFNSIGNLI

SEQ ID NO: 444206 - protein, 9 aa, Influenza virus
IFQPNIGPR

SEQ ID NO: 444207 - protein, 9 aa, Influenza virus
IFQSGIRMA

SEQ ID NO: 444208 - protein, 9 aa, Influenza virus
IFQSGVRLA

SEQ ID NO: 444209 - protein, 9 aa, Influenza virus
IFQSGVRMA

SEQ ID NO: 444210 - protein, 9 aa, Influenza virus
IFQSGVRVA

SEQ ID NO: 444211 - protein, 9 aa, Influenza virus
IFQSRIRMG

SEQ ID NO: 444212 - protein, 9 aa, Influenza virus
IFRPNIGPR

SEQ ID NO: 444213 - protein, 9 aa, Influenza virus
IFSARSALI

SEQ ID NO: 444214 - protein, 9 aa, Influenza virus
IFSFNGEEM

SEQ ID NO: 444215 - protein, 9 aa, Influenza virus
IFSFTGEEM

SEQ ID NO: 444216 - protein, 9 aa, Influenza virus
IFSHNGGLI

SEQ ID NO: 444217 - protein, 9 aa, Influenza virus
IFSKDNAIR

SEQ ID NO: 444218 - protein, 9 aa, Influenza virus
IFSKDNGIR

SEQ ID NO: 444219 - protein, 9 aa, Influenza virus
IFVIREPFI

SEQ ID NO: 444220 - protein, 9 aa, Influenza virus
IFVIREPFV

SEQ ID NO: 444221 - protein, 9 aa, Influenza virus
IFVMREPFI

SEQ ID NO: 444222 - protein, 9 aa, Influenza virus
IGAIDSSMP

SEQ ID NO: 444223 - protein, 9 aa, Influenza virus
IGAINSSMP

SEQ ID NO: 444224 - protein, 9 aa, Influenza virus
IGAPQLNPI

SEQ ID NO: 444225 - protein, 9 aa, Influenza virus
IGARIGEGQ

SEQ ID NO: 444226 - protein, 9 aa, Influenza virus
IGARPQVNG

SEQ ID NO: 444227 - protein, 9 aa, Influenza virus
IGDCPKYIK

SEQ ID NO: 444228 - protein, 9 aa, Influenza virus
IGDCPKYMN

SEQ ID NO: 444229 - protein, 9 aa, Influenza virus
IGDCPKYVN

SEQ ID NO: 444230 - protein, 9 aa, Influenza virus
IGDGQRSWM

SEQ ID NO: 444231 - protein, 9 aa, Influenza virus
IGEAPSPYN

SEQ ID NO: 444232 - protein, 9 aa, Influenza virus
IGECPKYIK

SEQ ID NO: 444233 - protein, 9 aa, Influenza virus
IGECPKYVK

SEQ ID NO: 444234 - protein, 9 aa, Influenza virus
IGECPKYVR

SEQ ID NO: 444235 - protein, 9 aa, Influenza virus
IGECPRYVK

SEQ ID NO: 444236 - protein, 9 aa, Influenza virus
IGEDIAPIE

SEQ ID NO: 444237 - protein, 9 aa, Influenza virus
IGEDLAPIE

SEQ ID NO: 444238 - protein, 9 aa, Influenza virus
IGEDSDILV

SEQ ID NO: 444239 - protein, 9 aa, Influenza virus
IGEDSDVLV

SEQ ID NO: 444240 - protein, 9 aa, Influenza virus
IGEDVAPIE

SEQ ID NO: 444241 - protein, 9 aa, Influenza virus
IGEGQRSWM

SEQ ID NO: 444242 - protein, 9 aa, Influenza virus
IGENSDVLV

SEQ ID NO: 444243 - protein, 9 aa, Influenza virus
IGERINQLS

SEQ ID NO: 444244 - protein, 9 aa, Influenza virus
IGESSDVLV

SEQ ID NO: 444245 - protein, 9 aa, Influenza virus
IGEVPSPYN

SEQ ID NO: 444246 - protein, 9 aa, Influenza virus
IGEYPVVKG

SEQ ID NO: 444247 - protein, 9 aa, Influenza virus
IGFHFEECS

SEQ ID NO: 444248 - protein, 9 aa, Influenza virus
IGFWMCSNG

SEQ ID NO: 444249 - protein, 9 aa, Influenza virus
IGGFIFGCQ

SEQ ID NO: 444250 - protein, 9 aa, Influenza virus
IGGNSDVLV

SEQ ID NO: 444251 - protein, 9 aa, Influenza virus
IGGSGTNNY

SEQ ID NO: 444252 - protein, 9 aa, Influenza virus
IGGWATANS

SEQ ID NO: 444253 - protein, 9 aa, Influenza virus
IGGWTIANS

SEQ ID NO: 444254 - protein, 9 aa, Influenza virus
IGGWTTANS

SEQ ID NO: 444255 - protein, 9 aa, Influenza virus
IGHHANNST

SEQ ID NO: 444256 - protein, 9 aa, Influenza virus
IGIAADRDS

SEQ ID NO: 444257 - protein, 9 aa, Influenza virus
IGIGNLIFN

SEQ ID NO: 444258 - protein, 9 aa, Influenza virus
IGIGNLVFN

SEQ ID NO: 444259 - protein, 9 aa, Influenza virus
IGISGPDDG

SEQ ID NO: 444260 - protein, 9 aa, Influenza virus
IGISGPDNE

SEQ ID NO: 444261 - protein, 9 aa, Influenza virus
IGISGPDNG

SEQ ID NO: 444262 - protein, 9 aa, Influenza virus
IGISGPDSG

SEQ ID NO: 444263 - protein, 9 aa, Influenza virus
IGISNIGLN

SEQ ID NO: 444264 - protein, 9 aa, Influenza virus
IGISNMSLN

SEQ ID NO: 444265 - protein, 9 aa, Influenza virus
IGISNVGLN

SEQ ID NO: 444266 - protein, 9 aa, Influenza virus
IGISNVVLN

SEQ ID NO: 444267 - protein, 9 aa, Influenza virus
IGISSMVEA

SEQ ID NO: 444268 - protein, 9 aa, Influenza virus
IGITGPDAT

SEQ ID NO: 444269 - protein, 9 aa, Influenza virus
IGITVIKNN

SEQ ID NO: 444270 - protein, 9 aa, Influenza virus
IGKCNDPYP

SEQ ID NO: 444271 - protein, 9 aa, Influenza virus
IGKCPKYIP

SEQ ID NO: 444272 - protein, 9 aa, Influenza virus
IGKCPKYIS

SEQ ID NO: 444273 - protein, 9 aa, Influenza virus
IGKCPKYVK

SEQ ID NO: 444274 - protein, 9 aa, Influenza virus
IGKCPRYIP

SEQ ID NO: 444275 - protein, 9 aa, Influenza virus
IGKCPRYVK

SEQ ID NO: 444276 - protein, 9 aa, Influenza virus
IGKFYIQMC

SEQ ID NO: 444277 - protein, 9 aa, Influenza virus
IGKITNKVN

SEQ ID NO: 444278 - protein, 9 aa, Influenza virus
IGKMNTQFE

SEQ ID NO: 444279 - protein, 9 aa, Influenza virus
IGKTNEKFH

SEQ ID NO: 444280 - protein, 9 aa, Influenza virus
IGKTNQQFE

SEQ ID NO: 444281 - protein, 9 aa, Influenza virus
IGKTSWSYI

SEQ ID NO: 444282 - protein, 9 aa, Influenza virus
IGKVCRTLL

SEQ ID NO: 444283 - protein, 9 aa, Influenza virus
IGLLLQIIS

SEQ ID NO: 444284 - protein, 9 aa, Influenza virus
IGLLLQITS

SEQ ID NO: 444285 - protein, 9 aa, Influenza virus
IGLNVSLHL

SEQ ID NO: 444286 - protein, 9 aa, Influenza virus
IGLREQKQE

SEQ ID NO: 444287 - protein, 9 aa, Influenza virus
IGLRISSSF

SEQ ID NO: 444288 - protein, 9 aa, Influenza virus
IGLRNTPSI

SEQ ID NO: 444289 - protein, 9 aa, Influenza virus
IGLRNVPQA

SEQ ID NO: 444290 - protein, 9 aa, Influenza virus
IGLRNVPQI

SEQ ID NO: 444291 - protein, 9 aa, Influenza virus
IGLRNVPQV

SEQ ID NO: 444292 - protein, 9 aa, Influenza virus
IGLSPNVYQ

SEQ ID NO: 444293 - protein, 9 aa, Influenza virus
IGNCPKYVK

SEQ ID NO: 444294 - protein, 9 aa, Influenza virus
IGNCPKYVN

SEQ ID NO: 444295 - protein, 9 aa, Influenza virus
IGNGCFEFY

SEQ ID NO: 444296 - protein, 9 aa, Influenza virus
IGNLIAPRG

SEQ ID NO: 444297 - protein, 9 aa, Influenza virus
IGNLIFNTV

SEQ ID NO: 444298 - protein, 9 aa, Influenza virus
IGNLVAPRG

SEQ ID NO: 444299 - protein, 9 aa, Influenza virus
IGNLVFNTV

SEQ ID NO: 444300 - protein, 9 aa, Influenza virus
IGNVINWTK

SEQ ID NO: 444301 - protein, 9 aa, Influenza virus
IGNVINWTQ

SEQ ID NO: 444302 - protein, 9 aa, Influenza virus
IGNVINWTR

SEQ ID NO: 444303 - protein, 9 aa, Influenza virus
IGPLLQITS

SEQ ID NO: 444304 - protein, 9 aa, Influenza virus
IGPLSGSAQ

SEQ ID NO: 444305 - protein, 9 aa, Influenza virus
IGPPHCDQF

SEQ ID NO: 444306 - protein, 9 aa, Influenza virus
IGPPQCDKF

SEQ ID NO: 444307 - protein, 9 aa, Influenza virus
IGPPQCDLF

SEQ ID NO: 444308 - protein, 9 aa, Influenza virus
IGPPQCDLH

SEQ ID NO: 444309 - protein, 9 aa, Influenza virus
IGPPQCDQF

SEQ ID NO: 444310 - protein, 9 aa, Influenza virus
IGPPQCDRF

SEQ ID NO: 444311 - protein, 9 aa, Influenza virus
IGPPQCDSH

SEQ ID NO: 444312 - protein, 9 aa, Influenza virus
IGPRALVRG

SEQ ID NO: 444313 - protein, 9 aa, Influenza virus
IGPRNVPAI

SEQ ID NO: 444314 - protein, 9 aa, Influenza virus
IGPRNVPQA

SEQ ID NO: 444315 - protein, 9 aa, Influenza virus
IGPRNVPQV

SEQ ID NO: 444316 - protein, 9 aa, Influenza virus
IGPRPFVRG

SEQ ID NO: 444317 - protein, 9 aa, Influenza virus
IGPRPLIRG

SEQ ID NO: 444318 - protein, 9 aa, Influenza virus
IGPRPLVMG

SEQ ID NO: 444319 - protein, 9 aa, Influenza virus
IGPRPLVRE

SEQ ID NO: 444320 - protein, 9 aa, Influenza virus
IGPRPLVRG

SEQ ID NO: 444321 - protein, 9 aa, Influenza virus
IGQAADLKS

SEQ ID NO: 444322 - protein, 9 aa, Influenza virus
IGQAADYKS

SEQ ID NO: 444323 - protein, 9 aa, Influenza virus
IGQGDIVLV

SEQ ID NO: 444324 - protein, 9 aa, Influenza virus
IGQGDVVLV

SEQ ID NO: 444325 - protein, 9 aa, Influenza virus
IGQSANVYQ

SEQ ID NO: 444326 - protein, 9 aa, Influenza virus
IGQSPNVYQ

SEQ ID NO: 444327 - protein, 9 aa, Influenza virus
IGRFYIQMC

SEQ ID NO: 444328 - protein, 9 aa, Influenza virus
IGRFYVQMC

SEQ ID NO: 444329 - protein, 9 aa, Influenza virus
IGRMTICIQ

SEQ ID NO: 444330 - protein, 9 aa, Influenza virus
IGRMTICVQ

SEQ ID NO: 444331 - protein, 9 aa, Influenza virus
IGRTKSLES

SEQ ID NO: 444332 - protein, 9 aa, Influenza virus
IGRTNQQFE

SEQ ID NO: 444333 - protein, 9 aa, Influenza virus
IGSCASKCH

SEQ ID NO: 444334 - protein, 9 aa, Influenza virus
IGSCESKCH

SEQ ID NO: 444335 - protein, 9 aa, Influenza virus
IGSCISKCH

SEQ ID NO: 444336 - protein, 9 aa, Influenza virus
IGSCTSPCL

SEQ ID NO: 444337 - protein, 9 aa, Influenza virus
IGSCVSKCH

SEQ ID NO: 444338 - protein, 9 aa, Influenza virus
IGSCVSRCH

SEQ ID NO: 444339 - protein, 9 aa, Influenza virus
IGSGFFPDG

SEQ ID NO: 444340 - protein, 9 aa, Influenza virus
IGSIRNETY

SEQ ID NO: 444341 - protein, 9 aa, Influenza virus
IGSIRNGTY

SEQ ID NO: 444342 - protein, 9 aa, Influenza virus
IGSISLTIA

SEQ ID NO: 444343 - protein, 9 aa, Influenza virus
IGSKGDIFV

SEQ ID NO: 444344 - protein, 9 aa, Influenza virus
IGSKGDVFV

SEQ ID NO: 444345 - protein, 9 aa, Influenza virus
IGSKGHVFV

SEQ ID NO: 444346 - protein, 9 aa, Influenza virus
IGSRGDVFI

SEQ ID NO: 444347 - protein, 9 aa, Influenza virus
IGSRGDVFV

SEQ ID NO: 444348 - protein, 9 aa, Influenza virus
IGSRGEVFV

SEQ ID NO: 444349 - protein, 9 aa, Influenza virus
IGSRGHIFV

SEQ ID NO: 444350 - protein, 9 aa, Influenza virus
IGSRGHVFV

SEQ ID NO: 444351 - protein, 9 aa, Influenza virus
IGSRPRVRN

SEQ ID NO: 444352 - protein, 9 aa, Influenza virus
IGSSTYQNN

SEQ ID NO: 444353 - protein, 9 aa, Influenza virus
IGSVSLTIA

SEQ ID NO: 444354 - protein, 9 aa, Influenza virus
IGSVSLTIT

SEQ ID NO: 444355 - protein, 9 aa, Influenza virus
IGSWSHNIL

SEQ ID NO: 444356 - protein, 9 aa, Influenza virus
IGSWSQNIL

SEQ ID NO: 444357 - protein, 9 aa, Influenza virus
IGTAPILGN

SEQ ID NO: 444358 - protein, 9 aa, Influenza virus
IGTAPVLGN

SEQ ID NO: 444359 - protein, 9 aa, Influenza virus
IGTRIGDGQ

SEQ ID NO: 444360 - protein, 9 aa, Influenza virus
IGTSTLNQR

SEQ ID NO: 444361 - protein, 9 aa, Influenza virus
IGVAPSPSN

SEQ ID NO: 444362 - protein, 9 aa, Influenza virus
IGVAPVLGN

SEQ ID NO: 444363 - protein, 9 aa, Influenza virus
IGVAVIKNN

SEQ ID NO: 444364 - protein, 9 aa, Influenza virus
IGVGNLAFN

SEQ ID NO: 444365 - protein, 9 aa, Influenza virus
IGVGNLIFN

SEQ ID NO: 444366 - protein, 9 aa, Influenza virus
IGVGNLVFN

SEQ ID NO: 444367 - protein, 9 aa, Influenza virus
IGVSGPDNG

SEQ ID NO: 444368 - protein, 9 aa, Influenza virus
IGVSNVGLN

SEQ ID NO: 444369 - protein, 9 aa, Influenza virus
IGVTRREIH

SEQ ID NO: 444370 - protein, 9 aa, Influenza virus
IGVTRREVH

SEQ ID NO: 444371 - protein, 9 aa, Influenza virus
IGVTVIKNN

SEQ ID NO: 444372 - protein, 9 aa, Influenza virus
IGVTVIRNN

SEQ ID NO: 444373 - protein, 9 aa, Influenza virus
IGVYQILAI

SEQ ID NO: 444374 - protein, 9 aa, Influenza virus
IGWSSTSCH

SEQ ID NO: 444375 - protein, 9 aa, Influenza virus
IGYHANNSK

SEQ ID NO: 444376 - protein, 9 aa, Influenza virus
IGYHANNST

SEQ ID NO: 444377 - protein, 9 aa, Influenza virus
IGYHSNNST

SEQ ID NO: 444378 - protein, 9 aa, Influenza virus
IGYICSGFF

SEQ ID NO: 444379 - protein, 9 aa, Influenza virus
IGYICSGIF

SEQ ID NO: 444380 - protein, 9 aa, Influenza virus
IGYICSGVF

SEQ ID NO: 444381 - protein, 9 aa, Influenza virus
IGYICSGVL

SEQ ID NO: 444382 - protein, 9 aa, Influenza virus
IGYLSNNAT

SEQ ID NO: 444383 - protein, 9 aa, Influenza virus
IGYLSNNSS

SEQ ID NO: 444384 - protein, 9 aa, Influenza virus
IGYLSNNST

SEQ ID NO: 444385 - protein, 9 aa, Influenza virus
IGYLSTNSS

SEQ ID NO: 444386 - protein, 9 aa, Influenza virus
IGYMSNNST

SEQ ID NO: 444387 - protein, 9 aa, Influenza virus
IGYQSNNST

SEQ ID NO: 444388 - protein, 9 aa, Influenza virus
IGYQTNNST

SEQ ID NO: 444389 - protein, 9 aa, Influenza virus
IGYVCSGIF

SEQ ID NO: 444390 - protein, 9 aa, Influenza virus
IGYVCSGVF

SEQ ID NO: 444391 - protein, 9 aa, Influenza virus
IHDRAAFRG

SEQ ID NO: 444392 - protein, 9 aa, Influenza virus
IHDRIPHRT

SEQ ID NO: 444393 - protein, 9 aa, Influenza virus
IHDRSPFRA

SEQ ID NO: 444394 - protein, 9 aa, Influenza virus
IHDRSPHRT

SEQ ID NO: 444395 - protein, 9 aa, Influenza virus
IHDRSPYRA

SEQ ID NO: 444396 - protein, 9 aa, Influenza virus
IHDRSQFRA

SEQ ID NO: 444397 - protein, 9 aa, Influenza virus
IHDRSQYRA

SEQ ID NO: 444398 - protein, 9 aa, Influenza virus
IHDRSQYRS

SEQ ID NO: 444399 - protein, 9 aa, Influenza virus
IHDRTAFRG

SEQ ID NO: 444400 - protein, 9 aa, Influenza virus
IHDRTPHRT

SEQ ID NO: 444401 - protein, 9 aa, Influenza virus
IHDRTTFRG

SEQ ID NO: 444402 - protein, 9 aa, Influenza virus
IHECRTFFL

SEQ ID NO: 444403 - protein, 9 aa, Influenza virus
IHFESNGNF

SEQ ID NO: 444404 - protein, 9 aa, Influenza virus
IHHPDSETT

SEQ ID NO: 444405 - protein, 9 aa, Influenza virus
IHHPDTEAT

SEQ ID NO: 444406 - protein, 9 aa, Influenza virus
IHHPDTEAV

SEQ ID NO: 444407 - protein, 9 aa, Influenza virus
IHHPDTEEV

SEQ ID NO: 444408 - protein, 9 aa, Influenza virus
IHHPDTETT

SEQ ID NO: 444409 - protein, 9 aa, Influenza virus
IHHPPDAKE

SEQ ID NO: 444410 - protein, 9 aa, Influenza virus
IHHPPDETE

SEQ ID NO: 444411 - protein, 9 aa, Influenza virus
IHHPPDTKE

SEQ ID NO: 444412 - protein, 9 aa, Influenza virus
IHHPPNTKE

SEQ ID NO: 444413 - protein, 9 aa, Influenza virus
IHHPPTSAE

SEQ ID NO: 444414 - protein, 9 aa, Influenza virus
IHHPPTSDE

SEQ ID NO: 444415 - protein, 9 aa, Influenza virus
IHHPPTSNE

SEQ ID NO: 444416 - protein, 9 aa, Influenza virus
IHHPPTTDE

SEQ ID NO: 444417 - protein, 9 aa, Influenza virus
IHHPSSAQE

SEQ ID NO: 444418 - protein, 9 aa, Influenza virus
IHHPSSTKE

SEQ ID NO: 444419 - protein, 9 aa, Influenza virus
IHHPSSTQE

SEQ ID NO: 444420 - protein, 9 aa, Influenza virus
IHIFSFNGE

SEQ ID NO: 444421 - protein, 9 aa, Influenza virus
IHIFSFTGE

SEQ ID NO: 444422 - protein, 9 aa, Influenza virus
IHISPLSGS

SEQ ID NO: 444423 - protein, 9 aa, Influenza virus
IHIYYLEKA

SEQ ID NO: 444424 - protein, 9 aa, Influenza virus
IHKQLTHHM

SEQ ID NO: 444425 - protein, 9 aa, Influenza virus
IHLGDCSFE

SEQ ID NO: 444426 - protein, 9 aa, Influenza virus
IHLTDSEMN

SEQ ID NO: 444427 - protein, 9 aa, Influenza virus
IHPLAIGEC

SEQ ID NO: 444428 - protein, 9 aa, Influenza virus
IHPLTIGEC

SEQ ID NO: 444429 - protein, 9 aa, Influenza virus
IHPLTIGKC

SEQ ID NO: 444430 - protein, 9 aa, Influenza virus
IHQILAIYS

SEQ ID NO: 444431 - protein, 9 aa, Influenza virus
IHSRGLFGA

SEQ ID NO: 444432 - protein, 9 aa, Influenza virus
IHTRGLFGA

SEQ ID NO: 444433 - protein, 9 aa, Influenza virus
IHWTIVKPG

SEQ ID NO: 444434 - protein, 9 aa, Influenza virus
IHYGGIPTD

SEQ ID NO: 444435 - protein, 9 aa, Influenza virus
IHYGGMPTD

SEQ ID NO: 444436 - protein, 9 aa, Influenza virus
IHYGGVPTD

SEQ ID NO: 444437 - protein, 9 aa, Influenza virus
IIAARNIVR

SEQ ID NO: 444438 - protein, 9 aa, Influenza virus
IIAARSIVR

SEQ ID NO: 444439 - protein, 9 aa, Influenza virus
IIAFCGTSG

SEQ ID NO: 444440 - protein, 9 aa, Influenza virus
IIAIGSVSL

SEQ ID NO: 444441 - protein, 9 aa, Influenza virus
IIALLIGIG

SEQ ID NO: 444442 - protein, 9 aa, Influenza virus
IICIQGNND

SEQ ID NO: 444443 - protein, 9 aa, Influenza virus
IICLGHHAV

SEQ ID NO: 444444 - protein, 9 aa, Influenza virus
IICTCRDNW

SEQ ID NO: 444445 - protein, 9 aa, Influenza virus
IICVCRDNW

SEQ ID NO: 444446 - protein, 9 aa, Influenza virus
IIDIWAYNA

SEQ ID NO: 444447 - protein, 9 aa, Influenza virus
IIDKMNGNY

SEQ ID NO: 444448 - protein, 9 aa, Influenza virus
IIDKMNIQF

SEQ ID NO: 444449 - protein, 9 aa, Influenza virus
IIDKMNTQF

SEQ ID NO: 444450 - protein, 9 aa, Influenza virus
IIDKMNTRF

SEQ ID NO: 444451 - protein, 9 aa, Influenza virus
IIDKVNTQF

SEQ ID NO: 444452 - protein, 9 aa, Influenza virus
IIDLADSEM

SEQ ID NO: 444453 - protein, 9 aa, Influenza virus
IIDNDNWSG

SEQ ID NO: 444454 - protein, 9 aa, Influenza virus
IIDNNNWSG

SEQ ID NO: 444455 - protein, 9 aa, Influenza virus
IIDVTDSEM

SEQ ID NO: 444456 - protein, 9 aa, Influenza virus
IIEAESSVK

SEQ ID NO: 444457 - protein, 9 aa, Influenza virus
IIEEYGKGR

SEQ ID NO: 444458 - protein, 9 aa, Influenza virus
IIEEYGRGR

SEQ ID NO: 444459 - protein, 9 aa, Influenza virus
IIEKMNGNY

SEQ ID NO: 444460 - protein, 9 aa, Influenza virus
IIEKMNTQF

SEQ ID NO: 444461 - protein, 9 aa, Influenza virus
IIEKNVTVT

SEQ ID NO: 444462 - protein, 9 aa, Influenza virus
IIEKTNQQF

SEQ ID NO: 444463 - protein, 9 aa, Influenza virus
IIEKYGSGR

SEQ ID NO: 444464 - protein, 9 aa, Influenza virus
IIEKYGTGR

SEQ ID NO: 444465 - protein, 9 aa, Influenza virus
IIENNVTVT

SEQ ID NO: 444466 - protein, 9 aa, Influenza virus
IIERKEGTD

SEQ ID NO: 444467 - protein, 9 aa, Influenza virus
IIERREGAD

SEQ ID NO: 444468 - protein, 9 aa, Influenza virus
IIERREGND

SEQ ID NO: 444469 - protein, 9 aa, Influenza virus
IIERREGSD

SEQ ID NO: 444470 - protein, 9 aa, Influenza virus
IIERREGTD

SEQ ID NO: 444471 - protein, 9 aa, Influenza virus
IIERRNSSD

SEQ ID NO: 444472 - protein, 9 aa, Influenza virus
IIESNVTVT

SEQ ID NO: 444473 - protein, 9 aa, Influenza virus
IIETGYVCS

SEQ ID NO: 444474 - protein, 9 aa, Influenza virus
IIFEANGNL

SEQ ID NO: 444475 - protein, 9 aa, Influenza virus
IIFEATGNL

SEQ ID NO: 444476 - protein, 9 aa, Influenza virus
IIFLWGIHH

SEQ ID NO: 444477 - protein, 9 aa, Influenza virus
IIFNMERIK

SEQ ID NO: 444478 - protein, 9 aa, Influenza virus
IIFNSIGNL

SEQ ID NO: 444479 - protein, 9 aa, Influenza virus
IIFSHNGGL

SEQ ID NO: 444480 - protein, 9 aa, Influenza virus
IIGGFIFGC

SEQ ID NO: 444481 - protein, 9 aa, Influenza virus
IIGISGPDN

SEQ ID NO: 444482 - protein, 9 aa, Influenza virus
IIGISNVGL

SEQ ID NO: 444483 - protein, 9 aa, Influenza virus
IIGKMNTQF

SEQ ID NO: 444484 - protein, 9 aa, Influenza virus
IIGPPQCDL

SEQ ID NO: 444485 - protein, 9 aa, Influenza virus
IIGPPQCDS

SEQ ID NO: 444486 - protein, 9 aa, Influenza virus
IIHISPLSG

SEQ ID NO: 444487 - protein, 9 aa, Influenza virus
IIIAGLSFW

SEQ ID NO: 444488 - protein, 9 aa, Influenza virus
IIIAIGSVS

SEQ ID NO: 444489 - protein, 9 aa, Influenza virus
IIIRMMENA

SEQ ID NO: 444490 - protein, 9 aa, Influenza virus
IIIVVLLYT

SEQ ID NO: 444491 - protein, 9 aa, Influenza virus
IIKGRSHLR

SEQ ID NO: 444492 - protein, 9 aa, Influenza virus
IIKKYTSAR

SEQ ID NO: 444493 - protein, 9 aa, Influenza virus
IIKKYTSGR

SEQ ID NO: 444494 - protein, 9 aa, Influenza virus
IIKLLPFAA

SEQ ID NO: 444495 - protein, 9 aa, Influenza virus
IIKLLPFAS

SEQ ID NO: 444496 - protein, 9 aa, Influenza virus
IILGNPKCD

SEQ ID NO: 444497 - protein, 9 aa, Influenza virus
IILWFSFGA

SEQ ID NO: 444498 - protein, 9 aa, Influenza virus
IILWFSFSI

SEQ ID NO: 444499 - protein, 9 aa, Influenza virus
IILWISFSI

SEQ ID NO: 444500 - protein, 9 aa, Influenza virus
IILWISFSM

SEQ ID NO: 444501 - protein, 9 aa, Influenza virus
IILWVSFSI

SEQ ID NO: 444502 - protein, 9 aa, Influenza virus
IINGALGSP

SEQ ID NO: 444503 - protein, 9 aa, Influenza virus
IINKMNTQF

SEQ ID NO: 444504 - protein, 9 aa, Influenza virus
IINLLIGIS

SEQ ID NO: 444505 - protein, 9 aa, Influenza virus
IINNQNWSG

SEQ ID NO: 444506 - protein, 9 aa, Influenza virus
IINNYHNET

SEQ ID NO: 444507 - protein, 9 aa, Influenza virus
IINNYYNDT

SEQ ID NO: 444508 - protein, 9 aa, Influenza virus
IINNYYNET

SEQ ID NO: 444509 - protein, 9 aa, Influenza virus
IINNYYNKT

SEQ ID NO: 444510 - protein, 9 aa, Influenza virus
IIPSGPLKA

SEQ ID NO: 444511 - protein, 9 aa, Influenza virus
IIPVNNTIY

SEQ ID NO: 444512 - protein, 9 aa, Influenza virus
IIQNEDIPI

SEQ ID NO: 444513 - protein, 9 aa, Influenza virus
IIRALTLNT

SEQ ID NO: 444514 - protein, 9 aa, Influenza virus
IIREPFVSC

SEQ ID NO: 444515 - protein, 9 aa, Influenza virus
IIRESGGID

SEQ ID NO: 444516 - protein, 9 aa, Influenza virus
IIRVGCVIL

SEQ ID NO: 444517 - protein, 9 aa, Influenza virus
IISFCGVNS

SEQ ID NO: 444518 - protein, 9 aa, Influenza virus
IISKDNGIR

SEQ ID NO: 444519 - protein, 9 aa, Influenza virus
IISLCSIWF

SEQ ID NO: 444520 - protein, 9 aa, Influenza virus
IISMCSSTE

SEQ ID NO: 444521 - protein, 9 aa, Influenza virus
IISNLPFQN

SEQ ID NO: 444522 - protein, 9 aa, Influenza virus
IISSLPFQN

SEQ ID NO: 444523 - protein, 9 aa, Influenza virus
IITDTFKSW

SEQ ID NO: 444524 - protein, 9 aa, Influenza virus
IITDTIKSW

SEQ ID NO: 444525 - protein, 9 aa, Influenza virus
IITDTIRSW

SEQ ID NO: 444526 - protein, 9 aa, Influenza virus
IITDTLKSW

SEQ ID NO: 444527 - protein, 9 aa, Influenza virus
IITELPFQN

SEQ ID NO: 444528 - protein, 9 aa, Influenza virus
IITETIKSW

SEQ ID NO: 444529 - protein, 9 aa, Influenza virus
IITGPPQCD

SEQ ID NO: 444530 - protein, 9 aa, Influenza virus
IITGTIKSW

SEQ ID NO: 444531 - protein, 9 aa, Influenza virus
IITHFQRKR

SEQ ID NO: 444532 - protein, 9 aa, Influenza virus
IITIDSVSL

SEQ ID NO: 444533 - protein, 9 aa, Influenza virus
IITIGSASI

SEQ ID NO: 444534 - protein, 9 aa, Influenza virus
IITIGSASL

SEQ ID NO: 444535 - protein, 9 aa, Influenza virus
IITIGSICM

SEQ ID NO: 444536 - protein, 9 aa, Influenza virus
IITIGSISI

SEQ ID NO: 444537 - protein, 9 aa, Influenza virus
IITIGSISL

SEQ ID NO: 444538 - protein, 9 aa, Influenza virus
IITIGSISV

SEQ ID NO: 444539 - protein, 9 aa, Influenza virus
IITIGSVSI

SEQ ID NO: 444540 - protein, 9 aa, Influenza virus
IITIGSVSL

SEQ ID NO: 444541 - protein, 9 aa, Influenza virus
IITMGSVSL

SEQ ID NO: 444542 - protein, 9 aa, Influenza virus
IITREPYVS

SEQ ID NO: 444543 - protein, 9 aa, Influenza virus
IITVGSVSL

SEQ ID NO: 444544 - protein, 9 aa, Influenza virus
IIVFCGTSG

SEQ ID NO: 444545 - protein, 9 aa, Influenza virus
IIVFNTIGN

SEQ ID NO: 444546 - protein, 9 aa, Influenza virus
IIVILVLGL

SEQ ID NO: 444547 - protein, 9 aa, Influenza virus
IIVTREPYV

SEQ ID NO: 444548 - protein, 9 aa, Influenza virus
IIWGIHHPS

SEQ ID NO: 444549 - protein, 9 aa, Influenza virus
IIYSSSMMW

SEQ ID NO: 444550 - protein, 9 aa, Influenza virus
IKAVRGDLN

SEQ ID NO: 444551 - protein, 9 aa, Influenza virus
IKCICRDNW

SEQ ID NO: 444552 - protein, 9 aa, Influenza virus
IKCQTPLGA

SEQ ID NO: 444553 - protein, 9 aa, Influenza virus
IKCVCRDNW

SEQ ID NO: 444554 - protein, 9 aa, Influenza virus
IKDGNMRCT

SEQ ID NO: 444555 - protein, 9 aa, Influenza virus
IKDRSPYRT

SEQ ID NO: 444556 - protein, 9 aa, Influenza virus
IKDYRYTYR

SEQ ID NO: 444557 - protein, 9 aa, Influenza virus
IKEKDMTKE

SEQ ID NO: 444558 - protein, 9 aa, Influenza virus
IKFVSSDCS

SEQ ID NO: 444559 - protein, 9 aa, Influenza virus
IKGDYNNTT

SEQ ID NO: 444560 - protein, 9 aa, Influenza virus
IKGFAFLDG

SEQ ID NO: 444561 - protein, 9 aa, Influenza virus
IKGFAPFSK

SEQ ID NO: 444562 - protein, 9 aa, Influenza virus
IKGFGFLNE

SEQ ID NO: 444563 - protein, 9 aa, Influenza virus
IKGFSFKYG

SEQ ID NO: 444564 - protein, 9 aa, Influenza virus
IKGFSFRYG

SEQ ID NO: 444565 - protein, 9 aa, Influenza virus
IKGRSHLRN

SEQ ID NO: 444566 - protein, 9 aa, Influenza virus
IKGVELSSM

SEQ ID NO: 444567 - protein, 9 aa, Influenza virus
IKGVKLSNM

SEQ ID NO: 444568 - protein, 9 aa, Influenza virus
IKGVKLSSM

SEQ ID NO: 444569 - protein, 9 aa, Influenza virus
IKGVYINTA

SEQ ID NO: 444570 - protein, 9 aa, Influenza virus
IKGWAPLSK

SEQ ID NO: 444571 - protein, 9 aa, Influenza virus
IKHENRMVL

SEQ ID NO: 444572 - protein, 9 aa, Influenza virus
IKHLEECSC

SEQ ID NO: 444573 - protein, 9 aa, Influenza virus
IKICESRLR

SEQ ID NO: 444574 - protein, 9 aa, Influenza virus
IKINPVTLT

SEQ ID NO: 444575 - protein, 9 aa, Influenza virus
IKIRRRVDI

SEQ ID NO: 444576 - protein, 9 aa, Influenza virus
IKKTNEKFH

SEQ ID NO: 444577 - protein, 9 aa, Influenza virus
IKKYERVKM

SEQ ID NO: 444578 - protein, 9 aa, Influenza virus
IKKYTSARQ

SEQ ID NO: 444579 - protein, 9 aa, Influenza virus
IKKYTSGRQ

SEQ ID NO: 444580 - protein, 9 aa, Influenza virus
IKLKSEDNV

SEQ ID NO: 444581 - protein, 9 aa, Influenza virus
IKLKTEDNI

SEQ ID NO: 444582 - protein, 9 aa, Influenza virus
IKLKTEDNV

SEQ ID NO: 444583 - protein, 9 aa, Influenza virus
IKLLPFAAA

SEQ ID NO: 444584 - protein, 9 aa, Influenza virus
IKLLPFASA

SEQ ID NO: 444585 - protein, 9 aa, Influenza virus
IKMKWGMEL

SEQ ID NO: 444586 - protein, 9 aa, Influenza virus
IKMKWGMEM

SEQ ID NO: 444587 - protein, 9 aa, Influenza virus
IKMNPNQKI

SEQ ID NO: 444588 - protein, 9 aa, Influenza virus
IKNGNMQCT

SEQ ID NO: 444589 - protein, 9 aa, Influenza virus
IKNGNMRCT

SEQ ID NO: 444590 - protein, 9 aa, Influenza virus
IKNGTYDHK

SEQ ID NO: 444591 - protein, 9 aa, Influenza virus
IKNGTYNHK

SEQ ID NO: 444592 - protein, 9 aa, Influenza virus
IKNGTYNHQ

SEQ ID NO: 444593 - protein, 9 aa, Influenza virus
IKNGTYNRK

SEQ ID NO: 444594 - protein, 9 aa, Influenza virus
IKNNMINND

SEQ ID NO: 444595 - protein, 9 aa, Influenza virus
IKNQEELRS

SEQ ID NO: 444596 - protein, 9 aa, Influenza virus
IKPCFWVEL

SEQ ID NO: 444597 - protein, 9 aa, Influenza virus
IKPWARNIL

SEQ ID NO: 444598 - protein, 9 aa, Influenza virus
IKQGSLKLA

SEQ ID NO: 444599 - protein, 9 aa, Influenza virus
IKQNGKSGA

SEQ ID NO: 444600 - protein, 9 aa, Influenza virus
IKQNTLKLA

SEQ ID NO: 444601 - protein, 9 aa, Influenza virus
IKRGINDRN

SEQ ID NO: 444602 - protein, 9 aa, Influenza virus
IKRGVNDRN

SEQ ID NO: 444603 - protein, 9 aa, Influenza virus
IKRYERVKM

SEQ ID NO: 444604 - protein, 9 aa, Influenza virus
IKSDQLKLA

SEQ ID NO: 444605 - protein, 9 aa, Influenza virus
IKSFSRTEL

SEQ ID NO: 444606 - protein, 9 aa, Influenza virus
IKSFSRTQL

SEQ ID NO: 444607 - protein, 9 aa, Influenza virus
IKSGQLKLA

SEQ ID NO: 444608 - protein, 9 aa, Influenza virus
IKSHAYISF

SEQ ID NO: 444609 - protein, 9 aa, Influenza virus
IKSLKLATG

SEQ ID NO: 444610 - protein, 9 aa, Influenza virus
IKSWRKDIL

SEQ ID NO: 444611 - protein, 9 aa, Influenza virus
IKSWRRDIL

SEQ ID NO: 444612 - protein, 9 aa, Influenza virus
IKTDGATSA

SEQ ID NO: 444613 - protein, 9 aa, Influenza virus
IKTKLPFQN

SEQ ID NO: 444614 - protein, 9 aa, Influenza virus
IKTLTNEKE

SEQ ID NO: 444615 - protein, 9 aa, Influenza virus
IKTNGNLIA

SEQ ID NO: 444616 - protein, 9 aa, Influenza virus
IKTRLFTIR

SEQ ID NO: 444617 - protein, 9 aa, Influenza virus
IKTRPILSP

SEQ ID NO: 444618 - protein, 9 aa, Influenza virus
IKTWAGKIL

SEQ ID NO: 444619 - protein, 9 aa, Influenza virus
IKTWAGNIL

SEQ ID NO: 444620 - protein, 9 aa, Influenza virus
IKTWAKNIL

SEQ ID NO: 444621 - protein, 9 aa, Influenza virus
IKTWARNIL

SEQ ID NO: 444622 - protein, 9 aa, Influenza virus
IKVDTLTEK

SEQ ID NO: 444623 - protein, 9 aa, Influenza virus
IKWNVTYTG

SEQ ID NO: 444624 - protein, 9 aa, Influenza virus
IKYNGIITD

SEQ ID NO: 444625 - protein, 9 aa, Influenza virus
ILAATVTLH

SEQ ID NO: 444626 - protein, 9 aa, Influenza virus
ILAFILWAC

SEQ ID NO: 444627 - protein, 9 aa, Influenza virus
ILAFIMWAC

SEQ ID NO: 444628 - protein, 9 aa, Influenza virus
ILAFIMWTC

SEQ ID NO: 444629 - protein, 9 aa, Influenza virus
ILAIYATVA

SEQ ID NO: 444630 - protein, 9 aa, Influenza virus
ILAIYSTAA

SEQ ID NO: 444631 - protein, 9 aa, Influenza virus
ILAIYSTVA

SEQ ID NO: 444632 - protein, 9 aa, Influenza virus
ILAIYSTVS

SEQ ID NO: 444633 - protein, 9 aa, Influenza virus
ILANNGKFE

SEQ ID NO: 444634 - protein, 9 aa, Influenza virus
ILANNGRFE

SEQ ID NO: 444635 - protein, 9 aa, Influenza virus
ILASSGSLE

SEQ ID NO: 444636 - protein, 9 aa, Influenza virus
ILATTITLH

SEQ ID NO: 444637 - protein, 9 aa, Influenza virus
ILATTVTLH

SEQ ID NO: 444638 - protein, 9 aa, Influenza virus
ILCASATAI

SEQ ID NO: 444639 - protein, 9 aa, Influenza virus
ILCTSAIAI

SEQ ID NO: 444640 - protein, 9 aa, Influenza virus
ILCTSATAI

SEQ ID NO: 444641 - protein, 9 aa, Influenza virus
ILCTSATAL

SEQ ID NO: 444642 - protein, 9 aa, Influenza virus
ILDEHDSNV

SEQ ID NO: 444643 - protein, 9 aa, Influenza virus
ILDFHDSNV

SEQ ID NO: 444644 - protein, 9 aa, Influenza virus
ILDGVTASC

SEQ ID NO: 444645 - protein, 9 aa, Influenza virus
ILDQNFRNI

SEQ ID NO: 444646 - protein, 9 aa, Influenza virus
ILEDEQMYQ

SEQ ID NO: 444647 - protein, 9 aa, Influenza virus
ILEEESDEA

SEQ ID NO: 444648 - protein, 9 aa, Influenza virus
ILEENTTYK

SEQ ID NO: 444649 - protein, 9 aa, Influenza virus
ILEGTTASC

SEQ ID NO: 444650 - protein, 9 aa, Influenza virus
ILEKAHNGK

SEQ ID NO: 444651 - protein, 9 aa, Influenza virus
ILEKNITVT

SEQ ID NO: 444652 - protein, 9 aa, Influenza virus
ILEKNVTVT

SEQ ID NO: 444653 - protein, 9 aa, Influenza virus
ILEKTHNGK

SEQ ID NO: 444654 - protein, 9 aa, Influenza virus
ILEKTHNGR

SEQ ID NO: 444655 - protein, 9 aa, Influenza virus
ILEKVHNGK

SEQ ID NO: 444656 - protein, 9 aa, Influenza virus
ILEQNVTVT

SEQ ID NO: 444657 - protein, 9 aa, Influenza virus
ILERNVTVT

SEQ ID NO: 444658 - protein, 9 aa, Influenza virus
ILERTHNGK

SEQ ID NO: 444659 - protein, 9 aa, Influenza virus
ILETGYICS

SEQ ID NO: 444660 - protein, 9 aa, Influenza virus
ILETGYVCG

SEQ ID NO: 444661 - protein, 9 aa, Influenza virus
ILETGYVCS

SEQ ID NO: 444662 - protein, 9 aa, Influenza virus
ILETRYVCS

SEQ ID NO: 444663 - protein, 9 aa, Influenza virus
ILFASATAI

SEQ ID NO: 444664 - protein, 9 aa, Influenza virus
ILFIEEGKI

SEQ ID NO: 444665 - protein, 9 aa, Influenza virus
ILFIEEGKV

SEQ ID NO: 444666 - protein, 9 aa, Influenza virus
ILFIKEGKI

SEQ ID NO: 444667 - protein, 9 aa, Influenza virus
ILFIREGKI

SEQ ID NO: 444668 - protein, 9 aa, Influenza virus
ILFNTIGNL

SEQ ID NO: 444669 - protein, 9 aa, Influenza virus
ILFVKEGKI

SEQ ID NO: 444670 - protein, 9 aa, Influenza virus
ILGDCSVAG

SEQ ID NO: 444671 - protein, 9 aa, Influenza virus
ILGFVFTLT

SEQ ID NO: 444672 - protein, 9 aa, Influenza virus
ILGFVLWAC

SEQ ID NO: 444673 - protein, 9 aa, Influenza virus
ILGILTGPP

SEQ ID NO: 444674 - protein, 9 aa, Influenza virus
ILGMQNGSC

SEQ ID NO: 444675 - protein, 9 aa, Influenza virus
ILGMQNGSY

SEQ ID NO: 444676 - protein, 9 aa, Influenza virus
ILGNPKCDL

SEQ ID NO: 444677 - protein, 9 aa, Influenza virus
ILGNPKCDP

SEQ ID NO: 444678 - protein, 9 aa, Influenza virus
ILGNPMCDD

SEQ ID NO: 444679 - protein, 9 aa, Influenza virus
ILGNPMCDE

SEQ ID NO: 444680 - protein, 9 aa, Influenza virus
ILGNPMCDN

SEQ ID NO: 444681 - protein, 9 aa, Influenza virus
ILGNPMCDY

SEQ ID NO: 444682 - protein, 9 aa, Influenza virus
ILGNPRCDD

SEQ ID NO: 444683 - protein, 9 aa, Influenza virus
ILGNYKEIC

SEQ ID NO: 444684 - protein, 9 aa, Influenza virus
ILGTIIGPP

SEQ ID NO: 444685 - protein, 9 aa, Influenza virus
ILHKCDNEC

SEQ ID NO: 444686 - protein, 9 aa, Influenza virus
ILHKCDNKC

SEQ ID NO: 444687 - protein, 9 aa, Influenza virus
ILHKCNDSC

SEQ ID NO: 444688 - protein, 9 aa, Influenza virus
ILHKCNNEC

SEQ ID NO: 444689 - protein, 9 aa, Influenza virus
ILIAGGLIL

SEQ ID NO: 444690 - protein, 9 aa, Influenza virus
ILITQESEC

SEQ ID NO: 444691 - protein, 9 aa, Influenza virus
ILKDCSIAG

SEQ ID NO: 444692 - protein, 9 aa, Influenza virus
ILKDCSVAG

SEQ ID NO: 444693 - protein, 9 aa, Influenza virus
ILKDCSVSG

SEQ ID NO: 444694 - protein, 9 aa, Influenza virus
ILKGKFQTA

SEQ ID NO: 444695 - protein, 9 aa, Influenza virus
ILKHNPTEE

SEQ ID NO: 444696 - protein, 9 aa, Influenza virus
ILKIKKGKI

SEQ ID NO: 444697 - protein, 9 aa, Influenza virus
ILKIKKGKL

SEQ ID NO: 444698 - protein, 9 aa, Influenza virus
ILKIRKGKI

SEQ ID NO: 444699 - protein, 9 aa, Influenza virus
ILKPGETLN

SEQ ID NO: 444700 - protein, 9 aa, Influenza virus
ILKPGQTLR

SEQ ID NO: 444701 - protein, 9 aa, Influenza virus
ILKPGQTVK

SEQ ID NO: 444702 - protein, 9 aa, Influenza virus
ILKQNPTEE

SEQ ID NO: 444703 - protein, 9 aa, Influenza virus
ILKRGETLK

SEQ ID NO: 444704 - protein, 9 aa, Influenza virus
ILLENERTL

SEQ ID NO: 444705 - protein, 9 aa, Influenza virus
ILLNPFVSH

SEQ ID NO: 444706 - protein, 9 aa, Influenza virus
ILLSPEEVS

SEQ ID NO: 444707 - protein, 9 aa, Influenza virus
ILNLLIGIS

SEQ ID NO: 444708 - protein, 9 aa, Influenza virus
ILNNKNWSG

SEQ ID NO: 444709 - protein, 9 aa, Influenza virus
ILNPNDTVT

SEQ ID NO: 444710 - protein, 9 aa, Influenza virus
ILNTSQRGI

SEQ ID NO: 444711 - protein, 9 aa, Influenza virus
ILNTSQRGV

SEQ ID NO: 444712 - protein, 9 aa, Influenza virus
ILPFDIDKM

SEQ ID NO: 444713 - protein, 9 aa, Influenza virus
ILRDCSVAG

SEQ ID NO: 444714 - protein, 9 aa, Influenza virus
ILRGAVAHK

SEQ ID NO: 444715 - protein, 9 aa, Influenza virus
ILRGSIAHK

SEQ ID NO: 444716 - protein, 9 aa, Influenza virus
ILRGSVAHK

SEQ ID NO: 444717 - protein, 9 aa, Influenza virus
ILRQNPTEE

SEQ ID NO: 444718 - protein, 9 aa, Influenza virus
ILRTHESEC

SEQ ID NO: 444719 - protein, 9 aa, Influenza virus
ILRTQDSEC

SEQ ID NO: 444720 - protein, 9 aa, Influenza virus
ILRTQESEC

SEQ ID NO: 444721 - protein, 9 aa, Influenza virus
ILRTQESSC

SEQ ID NO: 444722 - protein, 9 aa, Influenza virus
ILSFIMWAC

SEQ ID NO: 444723 - protein, 9 aa, Influenza virus
ILSFIMWAG

SEQ ID NO: 444724 - protein, 9 aa, Influenza virus
ILSIAPIMF

SEQ ID NO: 444725 - protein, 9 aa, Influenza virus
ILSICSCIA

SEQ ID NO: 444726 - protein, 9 aa, Influenza virus
ILSIYSCIA

SEQ ID NO: 444727 - protein, 9 aa, Influenza virus
ILSIYSSVA

SEQ ID NO: 444728 - protein, 9 aa, Influenza virus
ILSIYSTAA

SEQ ID NO: 444729 - protein, 9 aa, Influenza virus
ILSIYSTVA

SEQ ID NO: 444730 - protein, 9 aa, Influenza virus
ILSIYSTVS

SEQ ID NO: 444731 - protein, 9 aa, Influenza virus
ILSIYSTVT

SEQ ID NO: 444732 - protein, 9 aa, Influenza virus
ILSIYSTVV

SEQ ID NO: 444733 - protein, 9 aa, Influenza virus
ILSKDNAIR

SEQ ID NO: 444734 - protein, 9 aa, Influenza virus
ILSMAPIMF

SEQ ID NO: 444735 - protein, 9 aa, Influenza virus
ILSNPKCDL

SEQ ID NO: 444736 - protein, 9 aa, Influenza virus
ILSPLTKGI

SEQ ID NO: 444737 - protein, 9 aa, Influenza virus
ILSPLTKGM

SEQ ID NO: 444738 - protein, 9 aa, Influenza virus
ILSTKALLI

SEQ ID NO: 444739 - protein, 9 aa, Influenza virus
ILSVYSTVA

SEQ ID NO: 444740 - protein, 9 aa, Influenza virus
ILTDSQTAT

SEQ ID NO: 444741 - protein, 9 aa, Influenza virus
ILTDTSRPG

SEQ ID NO: 444742 - protein, 9 aa, Influenza virus
ILTDTSRPS

SEQ ID NO: 444743 - protein, 9 aa, Influenza virus
ILTFIMWAC

SEQ ID NO: 444744 - protein, 9 aa, Influenza virus
ILTGPPQCD

SEQ ID NO: 444745 - protein, 9 aa, Influenza virus
ILTIYSTAA

SEQ ID NO: 444746 - protein, 9 aa, Influenza virus
ILTIYSTVA

SEQ ID NO: 444747 - protein, 9 aa, Influenza virus
ILTKITVDH

SEQ ID NO: 444748 - protein, 9 aa, Influenza virus
ILTKTTVDH

SEQ ID NO: 444749 - protein, 9 aa, Influenza virus
ILTRTTVDH

SEQ ID NO: 444750 - protein, 9 aa, Influenza virus
ILVAGGLIL

SEQ ID NO: 444751 - protein, 9 aa, Influenza virus
ILVALALSH

SEQ ID NO: 444752 - protein, 9 aa, Influenza virus
ILVALENQH

SEQ ID NO: 444753 - protein, 9 aa, Influenza virus
ILVIYATVA

SEQ ID NO: 444754 - protein, 9 aa, Influenza virus
ILVLGLSMV

SEQ ID NO: 444755 - protein, 9 aa, Influenza virus
ILVSTNAYD

SEQ ID NO: 444756 - protein, 9 aa, Influenza virus
ILVTREPYL

SEQ ID NO: 444757 - protein, 9 aa, Influenza virus
ILVTREPYV

SEQ ID NO: 444758 - protein, 9 aa, Influenza virus
ILVTTVTLH

SEQ ID NO: 444759 - protein, 9 aa, Influenza virus
ILWACQNGN

SEQ ID NO: 444760 - protein, 9 aa, Influenza virus
ILWACQTGN

SEQ ID NO: 444761 - protein, 9 aa, Influenza virus
ILWACSSGN

SEQ ID NO: 444762 - protein, 9 aa, Influenza virus
ILWFSFGAS

SEQ ID NO: 444763 - protein, 9 aa, Influenza virus
ILWFSLGAS

SEQ ID NO: 444764 - protein, 9 aa, Influenza virus
ILWISFAIS

SEQ ID NO: 444765 - protein, 9 aa, Influenza virus
ILWISFAMS

SEQ ID NO: 444766 - protein, 9 aa, Influenza virus
ILWISFATS

SEQ ID NO: 444767 - protein, 9 aa, Influenza virus
ILWISFSIS

SEQ ID NO: 444768 - protein, 9 aa, Influenza virus
ILWISFSMS

SEQ ID NO: 444769 - protein, 9 aa, Influenza virus
ILWVSFSIS

SEQ ID NO: 444770 - protein, 9 aa, Influenza virus
ILYFWGVHH

SEQ ID NO: 444771 - protein, 9 aa, Influenza virus
IMASQGTKR

SEQ ID NO: 444772 - protein, 9 aa, Influenza virus
IMEKIVTVT

SEQ ID NO: 444773 - protein, 9 aa, Influenza virus
IMEKNITVT

SEQ ID NO: 444774 - protein, 9 aa, Influenza virus
IMEKNVTVT

SEQ ID NO: 444775 - protein, 9 aa, Influenza virus
IMERNVTVT

SEQ ID NO: 444776 - protein, 9 aa, Influenza virus
IMESGGIDK

SEQ ID NO: 444777 - protein, 9 aa, Influenza virus
IMESGGISK

SEQ ID NO: 444778 - protein, 9 aa, Influenza virus
IMEVVFPNE

SEQ ID NO: 444779 - protein, 9 aa, Influenza virus
IMFESNGGL

SEQ ID NO: 444780 - protein, 9 aa, Influenza virus
IMFSNKMAR

SEQ ID NO: 444781 - protein, 9 aa, Influenza virus
IMFSNKVAR

SEQ ID NO: 444782 - protein, 9 aa, Influenza virus
IMGLFFFCL

SEQ ID NO: 444783 - protein, 9 aa, Influenza virus
IMGLVFFCL

SEQ ID NO: 444784 - protein, 9 aa, Influenza virus
IMHDRTKIR

SEQ ID NO: 444785 - protein, 9 aa, Influenza virus
IMIAGLFFW

SEQ ID NO: 444786 - protein, 9 aa, Influenza virus
IMIAGLSFW

SEQ ID NO: 444787 - protein, 9 aa, Influenza virus
IMIDGSASG

SEQ ID NO: 444788 - protein, 9 aa, Influenza virus
IMINPVKLS

SEQ ID NO: 444789 - protein, 9 aa, Influenza virus
IMIWHSNLN

SEQ ID NO: 444790 - protein, 9 aa, Influenza virus
IMMAGLSFW

SEQ ID NO: 444791 - protein, 9 aa, Influenza virus
IMNTSKPFQ

SEQ ID NO: 444792 - protein, 9 aa, Influenza virus
IMQNKLNNV

SEQ ID NO: 444793 - protein, 9 aa, Influenza virus
IMRIWRQAN

SEQ ID NO: 444794 - protein, 9 aa, Influenza virus
IMRTQESEC

SEQ ID NO: 444795 - protein, 9 aa, Influenza virus
IMRTQESSC

SEQ ID NO: 444796 - protein, 9 aa, Influenza virus
IMRTVIALS

SEQ ID NO: 444797 - protein, 9 aa, Influenza virus
IMSCDSPSN

SEQ ID NO: 444798 - protein, 9 aa, Influenza virus
IMTDGPASS

SEQ ID NO: 444799 - protein, 9 aa, Influenza virus
IMTDGSANS

SEQ ID NO: 444800 - protein, 9 aa, Influenza virus
IMTDGSASG

SEQ ID NO: 444801 - protein, 9 aa, Influenza virus
IMTDGSASS

SEQ ID NO: 444802 - protein, 9 aa, Influenza virus
IMTIGSVSL

SEQ ID NO: 444803 - protein, 9 aa, Influenza virus
IMVAGLSFW

SEQ ID NO: 444804 - protein, 9 aa, Influenza virus
IMWACNSGN

SEQ ID NO: 444805 - protein, 9 aa, Influenza virus
IMWACQKGN

SEQ ID NO: 444806 - protein, 9 aa, Influenza virus
IMWACQRGN

SEQ ID NO: 444807 - protein, 9 aa, Influenza virus
IMWACSNGN

SEQ ID NO: 444808 - protein, 9 aa, Influenza virus
IMWACSNGS

SEQ ID NO: 444809 - protein, 9 aa, Influenza virus
IMWACSSGN

SEQ ID NO: 444810 - protein, 9 aa, Influenza virus
IMWGIHHPS

SEQ ID NO: 444811 - protein, 9 aa, Influenza virus
IMWTCNSGN

SEQ ID NO: 444812 - protein, 9 aa, Influenza virus
IMWTCQKGN

SEQ ID NO: 444813 - protein, 9 aa, Influenza virus
INDKIDDQI

SEQ ID NO: 444814 - protein, 9 aa, Influenza virus
INDKINDQI

SEQ ID NO: 444815 - protein, 9 aa, Influenza virus
INDPWVLLN

SEQ ID NO: 444816 - protein, 9 aa, Influenza virus
INDQIEDLW

SEQ ID NO: 444817 - protein, 9 aa, Influenza virus
INDQITDIW

SEQ ID NO: 444818 - protein, 9 aa, Influenza virus
INDRNFWRG

SEQ ID NO: 444819 - protein, 9 aa, Influenza virus
INDRSPFRA

SEQ ID NO: 444820 - protein, 9 aa, Influenza virus
INDRTAFRG

SEQ ID NO: 444821 - protein, 9 aa, Influenza virus
INECRTFFL

SEQ ID NO: 444822 - protein, 9 aa, Influenza virus
INEEALRQK

SEQ ID NO: 444823 - protein, 9 aa, Influenza virus
INEGALRQK

SEQ ID NO: 444824 - protein, 9 aa, Influenza virus
INEGNGCFE

SEQ ID NO: 444825 - protein, 9 aa, Influenza virus
INEITTKIN

SEQ ID NO: 444826 - protein, 9 aa, Influenza virus
INESADMSI

SEQ ID NO: 444827 - protein, 9 aa, Influenza virus
INEVKLEEN

SEQ ID NO: 444828 - protein, 9 aa, Influenza virus
INFDSNGNF

SEQ ID NO: 444829 - protein, 9 aa, Influenza virus
INFESNGNF

SEQ ID NO: 444830 - protein, 9 aa, Influenza virus
INFESNGNL

SEQ ID NO: 444831 - protein, 9 aa, Influenza virus
INFESTGNL

SEQ ID NO: 444832 - protein, 9 aa, Influenza virus
INFMPYISF

SEQ ID NO: 444833 - protein, 9 aa, Influenza virus
INGALGSPG

SEQ ID NO: 444834 - protein, 9 aa, Influenza virus
INGFAPFSK

SEQ ID NO: 444835 - protein, 9 aa, Influenza virus
INGICTVVM

SEQ ID NO: 444836 - protein, 9 aa, Influenza virus
INGKAPISL

SEQ ID NO: 444837 - protein, 9 aa, Influenza virus
INGKEPISL

SEQ ID NO: 444838 - protein, 9 aa, Influenza virus
INGKLNRLI

SEQ ID NO: 444839 - protein, 9 aa, Influenza virus
INGKQPISL

SEQ ID NO: 444840 - protein, 9 aa, Influenza virus
INGPDSVLV

SEQ ID NO: 444841 - protein, 9 aa, Influenza virus
INGPESVLI

SEQ ID NO: 444842 - protein, 9 aa, Influenza virus
INGPESVLV

SEQ ID NO: 444843 - protein, 9 aa, Influenza virus
INGQAGRMT

SEQ ID NO: 444844 - protein, 9 aa, Influenza virus
INGQSGRID

SEQ ID NO: 444845 - protein, 9 aa, Influenza virus
INGRAPISL

SEQ ID NO: 444846 - protein, 9 aa, Influenza virus
INGSCAVVM

SEQ ID NO: 444847 - protein, 9 aa, Influenza virus
INGSCIVVM

SEQ ID NO: 444848 - protein, 9 aa, Influenza virus
INGSCTVVM

SEQ ID NO: 444849 - protein, 9 aa, Influenza virus
INGTCAVVM

SEQ ID NO: 444850 - protein, 9 aa, Influenza virus
INGTCTVIM

SEQ ID NO: 444851 - protein, 9 aa, Influenza virus
INGTCTVVM

SEQ ID NO: 444852 - protein, 9 aa, Influenza virus
INGVILEEN

SEQ ID NO: 444853 - protein, 9 aa, Influenza virus
INGVKLEEN

SEQ ID NO: 444854 - protein, 9 aa, Influenza virus
INGVRLEEN

SEQ ID NO: 444855 - protein, 9 aa, Influenza virus
INGVTNKVN

SEQ ID NO: 444856 - protein, 9 aa, Influenza virus
INGWYGFQH

SEQ ID NO: 444857 - protein, 9 aa, Influenza virus
INGWYGFRH

SEQ ID NO: 444858 - protein, 9 aa, Influenza virus
INIAEYSID

SEQ ID NO: 444859 - protein, 9 aa, Influenza virus
INIMASQGT

SEQ ID NO: 444860 - protein, 9 aa, Influenza virus
INIREWSYL

SEQ ID NO: 444861 - protein, 9 aa, Influenza virus
INKITNKVN

SEQ ID NO: 444862 - protein, 9 aa, Influenza virus
INKMNTQFE

SEQ ID NO: 444863 - protein, 9 aa, Influenza virus
INKTGTFEF

SEQ ID NO: 444864 - protein, 9 aa, Influenza virus
INKVCTKGK

SEQ ID NO: 444865 - protein, 9 aa, Influenza virus
INLHAYISF

SEQ ID NO: 444866 - protein, 9 aa, Influenza virus
INLLIGISN

SEQ ID NO: 444867 - protein, 9 aa, Influenza virus
INLYASKNP

SEQ ID NO: 444868 - protein, 9 aa, Influenza virus
INMADYSID

SEQ ID NO: 444869 - protein, 9 aa, Influenza virus
INMEDYSID

SEQ ID NO: 444870 - protein, 9 aa, Influenza virus
INMIADRVD

SEQ ID NO: 444871 - protein, 9 aa, Influenza virus
INMINDKID

SEQ ID NO: 444872 - protein, 9 aa, Influenza virus
INMINDKIN

SEQ ID NO: 444873 - protein, 9 aa, Influenza virus
INMINSKID

SEQ ID NO: 444874 - protein, 9 aa, Influenza virus
INMINSKIE

SEQ ID NO: 444875 - protein, 9 aa, Influenza virus
INMINSKIN

SEQ ID NO: 444876 - protein, 9 aa, Influenza virus
INMINSQID

SEQ ID NO: 444877 - protein, 9 aa, Influenza virus
INMISDKID

SEQ ID NO: 444878 - protein, 9 aa, Influenza virus
INMLADRID

SEQ ID NO: 444879 - protein, 9 aa, Influenza virus
INMLADRVD

SEQ ID NO: 444880 - protein, 9 aa, Influenza virus
INMLADWVD

SEQ ID NO: 444881 - protein, 9 aa, Influenza virus
INMSKKKSY

SEQ ID NO: 444882 - protein, 9 aa, Influenza virus
INNDLGPAT

SEQ ID NO: 444883 - protein, 9 aa, Influenza virus
INNETIIET

SEQ ID NO: 444884 - protein, 9 aa, Influenza virus
INNETILET

SEQ ID NO: 444885 - protein, 9 aa, Influenza virus
INNETIVET

SEQ ID NO: 444886 - protein, 9 aa, Influenza virus
INNGKGRYG

SEQ ID NO: 444887 - protein, 9 aa, Influenza virus
INNIIDKMN

SEQ ID NO: 444888 - protein, 9 aa, Influenza virus
INNIIEKMN

SEQ ID NO: 444889 - protein, 9 aa, Influenza virus
INNITNVVL

SEQ ID NO: 444890 - protein, 9 aa, Influenza virus
INNITTTII

SEQ ID NO: 444891 - protein, 9 aa, Influenza virus
INNITTTIT

SEQ ID NO: 444892 - protein, 9 aa, Influenza virus
INNIVDKMN

SEQ ID NO: 444893 - protein, 9 aa, Influenza virus
INNQNWSGY

SEQ ID NO: 444894 - protein, 9 aa, Influenza virus
INNRFQIQG

SEQ ID NO: 444895 - protein, 9 aa, Influenza virus
INNRIKINP

SEQ ID NO: 444896 - protein, 9 aa, Influenza virus
INNYHNETN

SEQ ID NO: 444897 - protein, 9 aa, Influenza virus
INNYYNDTN

SEQ ID NO: 444898 - protein, 9 aa, Influenza virus
INNYYNETN

SEQ ID NO: 444899 - protein, 9 aa, Influenza virus
INNYYNKTN

SEQ ID NO: 444900 - protein, 9 aa, Influenza virus
INPTLLFLK

SEQ ID NO: 444901 - protein, 9 aa, Influenza virus
INPVELSSG

SEQ ID NO: 444902 - protein, 9 aa, Influenza virus
INPVKLSGG

SEQ ID NO: 444903 - protein, 9 aa, Influenza virus
INPVKLSSG

SEQ ID NO: 444904 - protein, 9 aa, Influenza virus
INPVTLSSG

SEQ ID NO: 444905 - protein, 9 aa, Influenza virus
INPVTLTMG

SEQ ID NO: 444906 - protein, 9 aa, Influenza virus
INQINGKLN

SEQ ID NO: 444907 - protein, 9 aa, Influenza virus
INQITGKLN

SEQ ID NO: 444908 - protein, 9 aa, Influenza virus
INRCFYVEL

SEQ ID NO: 444909 - protein, 9 aa, Influenza virus
INRIFQPNI

SEQ ID NO: 444910 - protein, 9 aa, Influenza virus
INRIFRPNI

SEQ ID NO: 444911 - protein, 9 aa, Influenza virus
INRITYGAC

SEQ ID NO: 444912 - protein, 9 aa, Influenza virus
INRNFKPNI

SEQ ID NO: 444913 - protein, 9 aa, Influenza virus
INRNFQPNI

SEQ ID NO: 444914 - protein, 9 aa, Influenza virus
INRQEIEGV

SEQ ID NO: 444915 - protein, 9 aa, Influenza virus
INRQEVEGV

SEQ ID NO: 444916 - protein, 9 aa, Influenza virus
INRSFKPNI

SEQ ID NO: 444917 - protein, 9 aa, Influenza virus
INRSFQPNI

SEQ ID NO: 444918 - protein, 9 aa, Influenza virus
INRSFRPNI

SEQ ID NO: 444919 - protein, 9 aa, Influenza virus
INRTGTFEF

SEQ ID NO: 444920 - protein, 9 aa, Influenza virus
INSIIDKMN

SEQ ID NO: 444921 - protein, 9 aa, Influenza virus
INSKIDDQI

SEQ ID NO: 444922 - protein, 9 aa, Influenza virus
INSKIDDQV

SEQ ID NO: 444923 - protein, 9 aa, Influenza virus
INSKIEDQI

SEQ ID NO: 444924 - protein, 9 aa, Influenza virus
INSKINDQI

SEQ ID NO: 444925 - protein, 9 aa, Influenza virus
INSPLPFQN

SEQ ID NO: 444926 - protein, 9 aa, Influenza virus
INSPNHAKS

SEQ ID NO: 444927 - protein, 9 aa, Influenza virus
INSPNHVKS

SEQ ID NO: 444928 - protein, 9 aa, Influenza virus
INSPSQAKS

SEQ ID NO: 444929 - protein, 9 aa, Influenza virus
INSQIDDQI

SEQ ID NO: 444930 - protein, 9 aa, Influenza virus
INSRFQIQG

SEQ ID NO: 444931 - protein, 9 aa, Influenza virus
INSSKPFQN

SEQ ID NO: 444932 - protein, 9 aa, Influenza virus
INSSKPLQN

SEQ ID NO: 444933 - protein, 9 aa, Influenza virus
INSSMPFHN

SEQ ID NO: 444934 - protein, 9 aa, Influenza virus
INSSMPLHN

SEQ ID NO: 444935 - protein, 9 aa, Influenza virus
INSSRPFQN

SEQ ID NO: 444936 - protein, 9 aa, Influenza virus
INSSYVCSG

SEQ ID NO: 444937 - protein, 9 aa, Influenza virus
INSVKLFSG

SEQ ID NO: 444938 - protein, 9 aa, Influenza virus
INSVKLSSG

SEQ ID NO: 444939 - protein, 9 aa, Influenza virus
INSWHIFGK

SEQ ID NO: 444940 - protein, 9 aa, Influenza virus
INSWHIYGK

SEQ ID NO: 444941 - protein, 9 aa, Influenza virus
INTALLNAS

SEQ ID NO: 444942 - protein, 9 aa, Influenza virus
INTAMLNAS

SEQ ID NO: 444943 - protein, 9 aa, Influenza virus
INTINSKID

SEQ ID NO: 444944 - protein, 9 aa, Influenza virus
INTKLPFQN

SEQ ID NO: 444945 - protein, 9 aa, Influenza virus
INTLTERGV

SEQ ID NO: 444946 - protein, 9 aa, Influenza virus
INTNKTFQN

SEQ ID NO: 444947 - protein, 9 aa, Influenza virus
INTNRTFQN

SEQ ID NO: 444948 - protein, 9 aa, Influenza virus
INTRLPFQN

SEQ ID NO: 444949 - protein, 9 aa, Influenza virus
INTSKPFQN

SEQ ID NO: 444950 - protein, 9 aa, Influenza virus
INTTLPFHN

SEQ ID NO: 444951 - protein, 9 aa, Influenza virus
INTWARNIL

SEQ ID NO: 444952 - protein, 9 aa, Influenza virus
INTYQWIIR

SEQ ID NO: 444953 - protein, 9 aa, Influenza virus
INVINDKID

SEQ ID NO: 444954 - protein, 9 aa, Influenza virus
INVTKENTG

SEQ ID NO: 444955 - protein, 9 aa, Influenza virus
INWLTKKEP

SEQ ID NO: 444956 - protein, 9 aa, Influenza virus
INWLTKKKN

SEQ ID NO: 444957 - protein, 9 aa, Influenza virus
INWLTKKKP

SEQ ID NO: 444958 - protein, 9 aa, Influenza virus
INWTKDSIT

SEQ ID NO: 444959 - protein, 9 aa, Influenza virus
INWTQDAMT

SEQ ID NO: 444960 - protein, 9 aa, Influenza virus
INWTRDAMT

SEQ ID NO: 444961 - protein, 9 aa, Influenza virus
INWTRDSII

SEQ ID NO: 444962 - protein, 9 aa, Influenza virus
INWTRDSIT

SEQ ID NO: 444963 - protein, 9 aa, Influenza virus
INWTRDSLT

SEQ ID NO: 444964 - protein, 9 aa, Influenza virus
INWTRDSMT

SEQ ID NO: 444965 - protein, 9 aa, Influenza virus
INWTRDSVT

SEQ ID NO: 444966 - protein, 9 aa, Influenza virus
INYYNETFV

SEQ ID NO: 444967 - protein, 9 aa, Influenza virus
IPAQNAIST

SEQ ID NO: 444968 - protein, 9 aa, Influenza virus
IPCFWVEMI

SEQ ID NO: 444969 - protein, 9 aa, Influenza virus
IPEAGLKWE

SEQ ID NO: 444970 - protein, 9 aa, Influenza virus
IPERNEHGQ

SEQ ID NO: 444971 - protein, 9 aa, Influenza virus
IPERNEQGQ

SEQ ID NO: 444972 - protein, 9 aa, Influenza virus
IPESMREEY

SEQ ID NO: 444973 - protein, 9 aa, Influenza virus
IPEVCLKWD

SEQ ID NO: 444974 - protein, 9 aa, Influenza virus
IPEVCLKWE

SEQ ID NO: 444975 - protein, 9 aa, Influenza virus
IPFHLGTKQ

SEQ ID NO: 444976 - protein, 9 aa, Influenza virus
IPGKQAKGL

SEQ ID NO: 444977 - protein, 9 aa, Influenza virus
IPHRTLLMN

SEQ ID NO: 444978 - protein, 9 aa, Influenza virus
IPHRTLLMS

SEQ ID NO: 444979 - protein, 9 aa, Influenza virus
IPIGERGLF

SEQ ID NO: 444980 - protein, 9 aa, Influenza virus
IPKRNRSIL

SEQ ID NO: 444981 - protein, 9 aa, Influenza virus
IPLHDAIKC

SEQ ID NO: 444982 - protein, 9 aa, Influenza virus
IPLTTTPTK

SEQ ID NO: 444983 - protein, 9 aa, Influenza virus
IPLYDAIKC

SEQ ID NO: 444984 - protein, 9 aa, Influenza virus
IPLYDAVKC

SEQ ID NO: 444985 - protein, 9 aa, Influenza virus
IPLYDAVRC

SEQ ID NO: 444986 - protein, 9 aa, Influenza virus
IPMISKCKT

SEQ ID NO: 444987 - protein, 9 aa, Influenza virus
IPMISKCRT

SEQ ID NO: 444988 - protein, 9 aa, Influenza virus
IPMISKSRT

SEQ ID NO: 444989 - protein, 9 aa, Influenza virus
IPNAETDPN

SEQ ID NO: 444990 - protein, 9 aa, Influenza virus
IPNAETDPS

SEQ ID NO: 444991 - protein, 9 aa, Influenza virus
IPNAGIDPN

SEQ ID NO: 444992 - protein, 9 aa, Influenza virus
IPNAGTDPN

SEQ ID NO: 444993 - protein, 9 aa, Influenza virus
IPNDKPFQN

SEQ ID NO: 444994 - protein, 9 aa, Influenza virus
IPNEKPFQN

SEQ ID NO: 444995 - protein, 9 aa, Influenza virus
IPNGKPFQN

SEQ ID NO: 444996 - protein, 9 aa, Influenza virus
IPNNKPFQN

SEQ ID NO: 444997 - protein, 9 aa, Influenza virus
IPPLELGDC

SEQ ID NO: 444998 - protein, 9 aa, Influenza virus
IPPLELGNC

SEQ ID NO: 444999 - protein, 9 aa, Influenza virus
IPPLELRDC

SEQ ID NO: 445000 - protein, 9 aa, Influenza virus
IPPLVLGDC

SEQ ID NO: 445001 - protein, 9 aa, Influenza virus
IPQIESRGL

SEQ ID NO: 445002 - protein, 9 aa, Influenza virus
IPSDTPRGE

SEQ ID NO: 445003 - protein, 9 aa, Influenza virus
IPSGPLKAE

SEQ ID NO: 445004 - protein, 9 aa, Influenza virus
IPSGSLKLA

SEQ ID NO: 445005 - protein, 9 aa, Influenza virus
IPSIQSRGL

SEQ ID NO: 445006 - protein, 9 aa, Influenza virus
IPSNSLKLA

SEQ ID NO: 445007 - protein, 9 aa, Influenza virus
IPSRSLKLA

SEQ ID NO: 445008 - protein, 9 aa, Influenza virus
IPSVQSRGL

SEQ ID NO: 445009 - protein, 9 aa, Influenza virus
IPSWAGNIL

SEQ ID NO: 445010 - protein, 9 aa, Influenza virus
IPSWAGNVL

SEQ ID NO: 445011 - protein, 9 aa, Influenza virus
IPSWEGNIL

SEQ ID NO: 445012 - protein, 9 aa, Influenza virus
IPTDTPRGE

SEQ ID NO: 445013 - protein, 9 aa, Influenza virus
IPTDTPRIQ

SEQ ID NO: 445014 - protein, 9 aa, Influenza virus
IPTDTPRVQ

SEQ ID NO: 445015 - protein, 9 aa, Influenza virus
IPTDVVRSW

SEQ ID NO: 445016 - protein, 9 aa, Influenza virus
IPVQNAIST

SEQ ID NO: 445017 - protein, 9 aa, Influenza virus
IPVTQTMEL

SEQ ID NO: 445018 - protein, 9 aa, Influenza virus
IPVTQVEEL

SEQ ID NO: 445019 - protein, 9 aa, Influenza virus
IQAGVDRFY

SEQ ID NO: 445020 - protein, 9 aa, Influenza virus
IQAGVNRFY

SEQ ID NO: 445021 - protein, 9 aa, Influenza virus
IQALQLLLE

SEQ ID NO: 445022 - protein, 9 aa, Influenza virus
IQDIWAYNA

SEQ ID NO: 445023 - protein, 9 aa, Influenza virus
IQDLEKYVE

SEQ ID NO: 445024 - protein, 9 aa, Influenza virus
IQDLERYVE

SEQ ID NO: 445025 - protein, 9 aa, Influenza virus
IQDLWAYNA

SEQ ID NO: 445026 - protein, 9 aa, Influenza virus
IQDVWAYNA

SEQ ID NO: 445027 - protein, 9 aa, Influenza virus
IQFEAVGRE

SEQ ID NO: 445028 - protein, 9 aa, Influenza virus
IQFPIGTAP

SEQ ID NO: 445029 - protein, 9 aa, Influenza virus
IQFPMGTAP

SEQ ID NO: 445030 - protein, 9 aa, Influenza virus
IQFTAVGKE

SEQ ID NO: 445031 - protein, 9 aa, Influenza virus
IQFTSVGKE

SEQ ID NO: 445032 - protein, 9 aa, Influenza virus
IQGNNDNAT

SEQ ID NO: 445033 - protein, 9 aa, Influenza virus
IQGVKLAQG

SEQ ID NO: 445034 - protein, 9 aa, Influenza virus
IQGVKLIQG

SEQ ID NO: 445035 - protein, 9 aa, Influenza virus
IQGVKLTQG

SEQ ID NO: 445036 - protein, 9 aa, Influenza virus
IQGVRLTQG

SEQ ID NO: 445037 - protein, 9 aa, Influenza virus
IQGYKDIIL

SEQ ID NO: 445038 - protein, 9 aa, Influenza virus
IQHLEECSC

SEQ ID NO: 445039 - protein, 9 aa, Influenza virus
IQHPELTGL

SEQ ID NO: 445040 - protein, 9 aa, Influenza virus
IQIDAVKLS

SEQ ID NO: 445041 - protein, 9 aa, Influenza virus
IQIDPVKLS

SEQ ID NO: 445042 - protein, 9 aa, Influenza virus
IQIDQVKLS

SEQ ID NO: 445043 - protein, 9 aa, Influenza virus
IQIDSVKLS

SEQ ID NO: 445044 - protein, 9 aa, Influenza virus
IQIIKLLPF

SEQ ID NO: 445045 - protein, 9 aa, Influenza virus
IQINPVKLS

SEQ ID NO: 445046 - protein, 9 aa, Influenza virus
IQMCTELKL

SEQ ID NO: 445047 - protein, 9 aa, Influenza virus
IQMCTELQL

SEQ ID NO: 445048 - protein, 9 aa, Influenza virus
IQNALNGNG

SEQ ID NO: 445049 - protein, 9 aa, Influenza virus
IQNEDIPIE

SEQ ID NO: 445050 - protein, 9 aa, Influenza virus
IQNEDIPIG

SEQ ID NO: 445051 - protein, 9 aa, Influenza virus
IQNEFNKAC

SEQ ID NO: 445052 - protein, 9 aa, Influenza virus
IQNIWAYNA

SEQ ID NO: 445053 - protein, 9 aa, Influenza virus
IQNRGLFGA

SEQ ID NO: 445054 - protein, 9 aa, Influenza virus
IQPGDNITF

SEQ ID NO: 445055 - protein, 9 aa, Influenza virus
IQPTFSVQR

SEQ ID NO: 445056 - protein, 9 aa, Influenza virus
IQQTRVDKL

SEQ ID NO: 445057 - protein, 9 aa, Influenza virus
IQSDAQIDE

SEQ ID NO: 445058 - protein, 9 aa, Influenza virus
IQSDKPFQN

SEQ ID NO: 445059 - protein, 9 aa, Influenza virus
IQSEFNKAC

SEQ ID NO: 445060 - protein, 9 aa, Influenza virus
IQSKGLFGA

SEQ ID NO: 445061 - protein, 9 aa, Influenza virus
IQSRGLFGA

SEQ ID NO: 445062 - protein, 9 aa, Influenza virus
IQTKRSFEL

SEQ ID NO: 445063 - protein, 9 aa, Influenza virus
IQTLVSNND

SEQ ID NO: 445064 - protein, 9 aa, Influenza virus
IQTNGNLIA

SEQ ID NO: 445065 - protein, 9 aa, Influenza virus
IQTRGLFGA

SEQ ID NO: 445066 - protein, 9 aa, Influenza virus
IQTRRAFEL

SEQ ID NO: 445067 - protein, 9 aa, Influenza virus
IQTRRSFEI

SEQ ID NO: 445068 - protein, 9 aa, Influenza virus
IQTRRSFEL

SEQ ID NO: 445069 - protein, 9 aa, Influenza virus
IQTSGNLIA

SEQ ID NO: 445070 - protein, 9 aa, Influenza virus
IRAFSFQLI

SEQ ID NO: 445071 - protein, 9 aa, Influenza virus
IRALTLNTM

SEQ ID NO: 445072 - protein, 9 aa, Influenza virus
IRASVGKMI

SEQ ID NO: 445073 - protein, 9 aa, Influenza virus
IRASVGRMI

SEQ ID NO: 445074 - protein, 9 aa, Influenza virus
IRASVGRMV

SEQ ID NO: 445075 - protein, 9 aa, Influenza virus
IRCVCRDNW

SEQ ID NO: 445076 - protein, 9 aa, Influenza virus
IREGLILEY

SEQ ID NO: 445077 - protein, 9 aa, Influenza virus
IREKNVTVT

SEQ ID NO: 445078 - protein, 9 aa, Influenza virus
IREPFISCS

SEQ ID NO: 445079 - protein, 9 aa, Influenza virus
IREPFVACG

SEQ ID NO: 445080 - protein, 9 aa, Influenza virus
IREPFVACS

SEQ ID NO: 445081 - protein, 9 aa, Influenza virus
IREPFVSCG

SEQ ID NO: 445082 - protein, 9 aa, Influenza virus
IREPFVSCS

SEQ ID NO: 445083 - protein, 9 aa, Influenza virus
IRESGGIDK

SEQ ID NO: 445084 - protein, 9 aa, Influenza virus
IREWSYLIE

SEQ ID NO: 445085 - protein, 9 aa, Influenza virus
IRFGEGEQI

SEQ ID NO: 445086 - protein, 9 aa, Influenza virus
IRFGESEQI

SEQ ID NO: 445087 - protein, 9 aa, Influenza virus
IRFGESEQV

SEQ ID NO: 445088 - protein, 9 aa, Influenza virus
IRFNSDLDY

SEQ ID NO: 445089 - protein, 9 aa, Influenza virus
IRFNSDLNY

SEQ ID NO: 445090 - protein, 9 aa, Influenza virus
IRFNSNLDY

SEQ ID NO: 445091 - protein, 9 aa, Influenza virus
IRFPIGTAP

SEQ ID NO: 445092 - protein, 9 aa, Influenza virus
IRFPIGVAP

SEQ ID NO: 445093 - protein, 9 aa, Influenza virus
IRFPVGTAP

SEQ ID NO: 445094 - protein, 9 aa, Influenza virus
IRFVNSDCS

SEQ ID NO: 445095 - protein, 9 aa, Influenza virus
IRGEFNQVE

SEQ ID NO: 445096 - protein, 9 aa, Influenza virus
IRGEFSQVE

SEQ ID NO: 445097 - protein, 9 aa, Influenza virus
IRGETTGRN

SEQ ID NO: 445098 - protein, 9 aa, Influenza virus
IRGFVHFVE

SEQ ID NO: 445099 - protein, 9 aa, Influenza virus
IRGFVYFVE

SEQ ID NO: 445100 - protein, 9 aa, Influenza virus
IRGIFGAIA

SEQ ID NO: 445101 - protein, 9 aa, Influenza virus
IRGKHSNGT

SEQ ID NO: 445102 - protein, 9 aa, Influenza virus
IRGNSPIFN

SEQ ID NO: 445103 - protein, 9 aa, Influenza virus
IRGNSPVFN

SEQ ID NO: 445104 - protein, 9 aa, Influenza virus
IRGQPKEKA

SEQ ID NO: 445105 - protein, 9 aa, Influenza virus
IRGQPKEKT

SEQ ID NO: 445106 - protein, 9 aa, Influenza virus
IRGQPKERT

SEQ ID NO: 445107 - protein, 9 aa, Influenza virus
IRGQQGRMD

SEQ ID NO: 445108 - protein, 9 aa, Influenza virus
IRGRHSNGT

SEQ ID NO: 445109 - protein, 9 aa, Influenza virus
IRGRPEEAK

SEQ ID NO: 445110 - protein, 9 aa, Influenza virus
IRGRPEEVK

SEQ ID NO: 445111 - protein, 9 aa, Influenza virus
IRGRPKEDK

SEQ ID NO: 445112 - protein, 9 aa, Influenza virus
IRGRPKEDR

SEQ ID NO: 445113 - protein, 9 aa, Influenza virus
IRGRPKEEK

SEQ ID NO: 445114 - protein, 9 aa, Influenza virus
IRGWAPLSK

SEQ ID NO: 445115 - protein, 9 aa, Influenza virus
IRHENRMVI

SEQ ID NO: 445116 - protein, 9 aa, Influenza virus
IRHENRMVL

SEQ ID NO: 445117 - protein, 9 aa, Influenza virus
IRHLEECSC

SEQ ID NO: 445118 - protein, 9 aa, Influenza virus
IRIAWSSSS

SEQ ID NO: 445119 - protein, 9 aa, Influenza virus
IRIGSKGDI

SEQ ID NO: 445120 - protein, 9 aa, Influenza virus
IRIGSKGDV

SEQ ID NO: 445121 - protein, 9 aa, Influenza virus
IRIGSKGHV

SEQ ID NO: 445122 - protein, 9 aa, Influenza virus
IRIGSRGDV

SEQ ID NO: 445123 - protein, 9 aa, Influenza virus
IRIGSRGEV

SEQ ID NO: 445124 - protein, 9 aa, Influenza virus
IRIGSRGHI

SEQ ID NO: 445125 - protein, 9 aa, Influenza virus
IRIGSRGHV

SEQ ID NO: 445126 - protein, 9 aa, Influenza virus
IRINMINSK

SEQ ID NO: 445127 - protein, 9 aa, Influenza virus
IRINNETIL

SEQ ID NO: 445128 - protein, 9 aa, Influenza virus
IRKGLILEY

SEQ ID NO: 445129 - protein, 9 aa, Influenza virus
IRLAAGGDI

SEQ ID NO: 445130 - protein, 9 aa, Influenza virus
IRLFDYSGW

SEQ ID NO: 445131 - protein, 9 aa, Influenza virus
IRLFDYSKW

SEQ ID NO: 445132 - protein, 9 aa, Influenza virus
IRLFDYSRW

SEQ ID NO: 445133 - protein, 9 aa, Influenza virus
IRLSADGDI

SEQ ID NO: 445134 - protein, 9 aa, Influenza virus
IRLSAGGAI

SEQ ID NO: 445135 - protein, 9 aa, Influenza virus
IRLSAGGDI

SEQ ID NO: 445136 - protein, 9 aa, Influenza virus
IRLSAGGHI

SEQ ID NO: 445137 - protein, 9 aa, Influenza virus
IRLSAGGNI

SEQ ID NO: 445138 - protein, 9 aa, Influenza virus
IRLSASGDI

SEQ ID NO: 445139 - protein, 9 aa, Influenza virus
IRLSASGDV

SEQ ID NO: 445140 - protein, 9 aa, Influenza virus
IRMAINWGR

SEQ ID NO: 445141 - protein, 9 aa, Influenza virus
IRMATNECR

SEQ ID NO: 445142 - protein, 9 aa, Influenza virus
IRMIKRGIN

SEQ ID NO: 445143 - protein, 9 aa, Influenza virus
IRMIKRGVN

SEQ ID NO: 445144 - protein, 9 aa, Influenza virus
IRMVKRGIN

SEQ ID NO: 445145 - protein, 9 aa, Influenza virus
IRNETYDHD

SEQ ID NO: 445146 - protein, 9 aa, Influenza virus
IRNGTYDHD

SEQ ID NO: 445147 - protein, 9 aa, Influenza virus
IRNGTYDHK

SEQ ID NO: 445148 - protein, 9 aa, Influenza virus
IRNGTYDHN

SEQ ID NO: 445149 - protein, 9 aa, Influenza virus
IRNGTYDHT

SEQ ID NO: 445150 - protein, 9 aa, Influenza virus
IRNGTYNHA

SEQ ID NO: 445151 - protein, 9 aa, Influenza virus
IRNGTYNHD

SEQ ID NO: 445152 - protein, 9 aa, Influenza virus
IRNGTYNHE

SEQ ID NO: 445153 - protein, 9 aa, Influenza virus
IRNGTYNHI

SEQ ID NO: 445154 - protein, 9 aa, Influenza virus
IRNGTYNHK

SEQ ID NO: 445155 - protein, 9 aa, Influenza virus
IRNGTYNHN

SEQ ID NO: 445156 - protein, 9 aa, Influenza virus
IRNGTYNHQ

SEQ ID NO: 445157 - protein, 9 aa, Influenza virus
IRNGTYNHR

SEQ ID NO: 445158 - protein, 9 aa, Influenza virus
IRNGTYNHS

SEQ ID NO: 445159 - protein, 9 aa, Influenza virus
IRNGTYNHT

SEQ ID NO: 445160 - protein, 9 aa, Influenza virus
IRNKHSNGT

SEQ ID NO: 445161 - protein, 9 aa, Influenza virus
IRNKHSNST

SEQ ID NO: 445162 - protein, 9 aa, Influenza virus
IRNLHIPEA

SEQ ID NO: 445163 - protein, 9 aa, Influenza virus
IRNLHIPEV

SEQ ID NO: 445164 - protein, 9 aa, Influenza virus
IRNNMINND

SEQ ID NO: 445165 - protein, 9 aa, Influenza virus
IRNNSYDHS

SEQ ID NO: 445166 - protein, 9 aa, Influenza virus
IRNNTYDHA

SEQ ID NO: 445167 - protein, 9 aa, Influenza virus
IRNNTYDHK

SEQ ID NO: 445168 - protein, 9 aa, Influenza virus
IRNNTYDHN

SEQ ID NO: 445169 - protein, 9 aa, Influenza virus
IRNNTYDHS

SEQ ID NO: 445170 - protein, 9 aa, Influenza virus
IRNNTYDHT

SEQ ID NO: 445171 - protein, 9 aa, Influenza virus
IRNNTYNHT

SEQ ID NO: 445172 - protein, 9 aa, Influenza virus
IRNRHSNGT

SEQ ID NO: 445173 - protein, 9 aa, Influenza virus
IRNSTYDHS

SEQ ID NO: 445174 - protein, 9 aa, Influenza virus
IRPCFWVEL

SEQ ID NO: 445175 - protein, 9 aa, Influenza virus
IRPGYNGQK

SEQ ID NO: 445176 - protein, 9 aa, Influenza virus
IRRIWRQAN

SEQ ID NO: 445177 - protein, 9 aa, Influenza virus
IRRRVDINP

SEQ ID NO: 445178 - protein, 9 aa, Influenza virus
IRRRVDMNP

SEQ ID NO: 445179 - protein, 9 aa, Influenza virus
IRRRVDTNP

SEQ ID NO: 445180 - protein, 9 aa, Influenza virus
IRRRVDVNP

SEQ ID NO: 445181 - protein, 9 aa, Influenza virus
IRRVWRQAN

SEQ ID NO: 445182 - protein, 9 aa, Influenza virus
IRSFSRTEL

SEQ ID NO: 445183 - protein, 9 aa, Influenza virus
IRSNGNLIA

SEQ ID NO: 445184 - protein, 9 aa, Influenza virus
IRSNGNLVA

SEQ ID NO: 445185 - protein, 9 aa, Influenza virus
IRSSVGKMI

SEQ ID NO: 445186 - protein, 9 aa, Influenza virus
IRSWRKQIL

SEQ ID NO: 445187 - protein, 9 aa, Influenza virus
IRTATREGK

SEQ ID NO: 445188 - protein, 9 aa, Influenza virus
IRTDGATSA

SEQ ID NO: 445189 - protein, 9 aa, Influenza virus
IRTFSFQFI

SEQ ID NO: 445190 - protein, 9 aa, Influenza virus
IRTFSFQLI

SEQ ID NO: 445191 - protein, 9 aa, Influenza virus
IRTGTYNHR

SEQ ID NO: 445192 - protein, 9 aa, Influenza virus
IRTKSGGNT

SEQ ID NO: 445193 - protein, 9 aa, Influenza virus
IRTLTLNTM

SEQ ID NO: 445194 - protein, 9 aa, Influenza virus
IRTNGNLIA

SEQ ID NO: 445195 - protein, 9 aa, Influenza virus
IRTNGTSKI

SEQ ID NO: 445196 - protein, 9 aa, Influenza virus
IRTRGLFGA

SEQ ID NO: 445197 - protein, 9 aa, Influenza virus
IRTRSGGNT

SEQ ID NO: 445198 - protein, 9 aa, Influenza virus
IRTSVGRMV

SEQ ID NO: 445199 - protein, 9 aa, Influenza virus
IRTWAKNIL

SEQ ID NO: 445200 - protein, 9 aa, Influenza virus
IRVGCVILL

SEQ ID NO: 445201 - protein, 9 aa, Influenza virus
IRVGSRGHV

SEQ ID NO: 445202 - protein, 9 aa, Influenza virus
IRVKRRPVA

SEQ ID NO: 445203 - protein, 9 aa, Influenza virus
IRWETTGRN

SEQ ID NO: 445204 - protein, 9 aa, Influenza virus
IRWLTLKSG

SEQ ID NO: 445205 - protein, 9 aa, Influenza virus
ISATGMALS

SEQ ID NO: 445206 - protein, 9 aa, Influenza virus
ISATGMILS

SEQ ID NO: 445207 - protein, 9 aa, Influenza virus
ISATGMTLS

SEQ ID NO: 445208 - protein, 9 aa, Influenza virus
ISATGVTLS

SEQ ID NO: 445209 - protein, 9 aa, Influenza virus
ISCFLLAAL

SEQ ID NO: 445210 - protein, 9 aa, Influenza virus
ISCFLLIAL

SEQ ID NO: 445211 - protein, 9 aa, Influenza virus
ISCFLLVAL

SEQ ID NO: 445212 - protein, 9 aa, Influenza virus
ISCLYKLSQ

SEQ ID NO: 445213 - protein, 9 aa, Influenza virus
ISCSHFECR

SEQ ID NO: 445214 - protein, 9 aa, Influenza virus
ISCSHLECK

SEQ ID NO: 445215 - protein, 9 aa, Influenza virus
ISCSHLECR

SEQ ID NO: 445216 - protein, 9 aa, Influenza virus
ISCSHMECR

SEQ ID NO: 445217 - protein, 9 aa, Influenza virus
ISCSHSECR

SEQ ID NO: 445218 - protein, 9 aa, Influenza virus
ISCSIDECR

SEQ ID NO: 445219 - protein, 9 aa, Influenza virus
ISCSIHECR

SEQ ID NO: 445220 - protein, 9 aa, Influenza virus
ISCSINECR

SEQ ID NO: 445221 - protein, 9 aa, Influenza virus
ISCSISECR

SEQ ID NO: 445222 - protein, 9 aa, Influenza virus
ISCSPLECR

SEQ ID NO: 445223 - protein, 9 aa, Influenza virus
ISCSQLECR

SEQ ID NO: 445224 - protein, 9 aa, Influenza virus
ISCSVSECR

SEQ ID NO: 445225 - protein, 9 aa, Influenza virus
ISDGGPNLY

SEQ ID NO: 445226 - protein, 9 aa, Influenza virus
ISDKIDDQI

SEQ ID NO: 445227 - protein, 9 aa, Influenza virus
ISECRTFFL

SEQ ID NO: 445228 - protein, 9 aa, Influenza virus
ISFAISCFL

SEQ ID NO: 445229 - protein, 9 aa, Influenza virus
ISFAMSCFL

SEQ ID NO: 445230 - protein, 9 aa, Influenza virus
ISFATSCFL

SEQ ID NO: 445231 - protein, 9 aa, Influenza virus
ISFESNGGL

SEQ ID NO: 445232 - protein, 9 aa, Influenza virus
ISFESNGNF

SEQ ID NO: 445233 - protein, 9 aa, Influenza virus
ISFESTGNL

SEQ ID NO: 445234 - protein, 9 aa, Influenza virus
ISFQGGHIE

SEQ ID NO: 445235 - protein, 9 aa, Influenza virus
ISFQSGHIE

SEQ ID NO: 445236 - protein, 9 aa, Influenza virus
ISFSISCFL

SEQ ID NO: 445237 - protein, 9 aa, Influenza virus
ISFSMSCFV

SEQ ID NO: 445238 - protein, 9 aa, Influenza virus
ISFTITGDN

SEQ ID NO: 445239 - protein, 9 aa, Influenza virus
ISFWMCSGH

SEQ ID NO: 445240 - protein, 9 aa, Influenza virus
ISFWMCSNG

SEQ ID NO: 445241 - protein, 9 aa, Influenza virus
ISFYWTIVD

SEQ ID NO: 445242 - protein, 9 aa, Influenza virus
ISFYWTIVE

SEQ ID NO: 445243 - protein, 9 aa, Influenza virus
ISFYWTIVV

SEQ ID NO: 445244 - protein, 9 aa, Influenza virus
ISGADDDAY

SEQ ID NO: 445245 - protein, 9 aa, Influenza virus
ISGPDDGAV

SEQ ID NO: 445246 - protein, 9 aa, Influenza virus
ISGPDNEAV

SEQ ID NO: 445247 - protein, 9 aa, Influenza virus
ISGPDNGAV

SEQ ID NO: 445248 - protein, 9 aa, Influenza virus
ISGPDSGAV

SEQ ID NO: 445249 - protein, 9 aa, Influenza virus
ISGPNNNAS

SEQ ID NO: 445250 - protein, 9 aa, Influenza virus
ISGTCAVVM

SEQ ID NO: 445251 - protein, 9 aa, Influenza virus
ISGVKLEEN

SEQ ID NO: 445252 - protein, 9 aa, Influenza virus
ISGWTTANS

SEQ ID NO: 445253 - protein, 9 aa, Influenza virus
ISHCRATEY

SEQ ID NO: 445254 - protein, 9 aa, Influenza virus
ISHISPLSG

SEQ ID NO: 445255 - protein, 9 aa, Influenza virus
ISHRTLLMN

SEQ ID NO: 445256 - protein, 9 aa, Influenza virus
ISIASRSGY

SEQ ID NO: 445257 - protein, 9 aa, Influenza virus
ISIGSSTYQ

SEQ ID NO: 445258 - protein, 9 aa, Influenza virus
ISIGTSTLN

SEQ ID NO: 445259 - protein, 9 aa, Influenza virus
ISIVPNIGS

SEQ ID NO: 445260 - protein, 9 aa, Influenza virus
ISIWMCSNG

SEQ ID NO: 445261 - protein, 9 aa, Influenza virus
ISIYWTLVN

SEQ ID NO: 445262 - protein, 9 aa, Influenza virus
ISKCKTKEG

SEQ ID NO: 445263 - protein, 9 aa, Influenza virus
ISKCRTKEG

SEQ ID NO: 445264 - protein, 9 aa, Influenza virus
ISKCRTREG

SEQ ID NO: 445265 - protein, 9 aa, Influenza virus
ISKDLRSGY

SEQ ID NO: 445266 - protein, 9 aa, Influenza virus
ISKDNGIRI

SEQ ID NO: 445267 - protein, 9 aa, Influenza virus
ISKDSRSGY

SEQ ID NO: 445268 - protein, 9 aa, Influenza virus
ISKDTRSGY

SEQ ID NO: 445269 - protein, 9 aa, Influenza virus
ISKMGVDEY

SEQ ID NO: 445270 - protein, 9 aa, Influenza virus
ISKRGGSGI

SEQ ID NO: 445271 - protein, 9 aa, Influenza virus
ISKRGNSGI

SEQ ID NO: 445272 - protein, 9 aa, Influenza virus
ISKRGSSGI

SEQ ID NO: 445273 - protein, 9 aa, Influenza virus
ISKRGSSGV

SEQ ID NO: 445274 - protein, 9 aa, Influenza virus
ISKSRATEY

SEQ ID NO: 445275 - protein, 9 aa, Influenza virus
ISKSTKSTV

SEQ ID NO: 445276 - protein, 9 aa, Influenza virus
ISKTNQQFE

SEQ ID NO: 445277 - protein, 9 aa, Influenza virus
ISLCSIWFS

SEQ ID NO: 445278 - protein, 9 aa, Influenza virus
ISLGDCSFA

SEQ ID NO: 445279 - protein, 9 aa, Influenza virus
ISLGDCSFT

SEQ ID NO: 445280 - protein, 9 aa, Influenza virus
ISLVKTTLF

SEQ ID NO: 445281 - protein, 9 aa, Influenza virus
ISLWMCSNG

SEQ ID NO: 445282 - protein, 9 aa, Influenza virus
ISMCSSTEF

SEQ ID NO: 445283 - protein, 9 aa, Influenza virus
ISMDSRSGY

SEQ ID NO: 445284 - protein, 9 aa, Influenza virus
ISMEDYSID

SEQ ID NO: 445285 - protein, 9 aa, Influenza virus
ISMEDYSIG

SEQ ID NO: 445286 - protein, 9 aa, Influenza virus
ISNDKPFQN

SEQ ID NO: 445287 - protein, 9 aa, Influenza virus
ISNEGSYFF

SEQ ID NO: 445288 - protein, 9 aa, Influenza virus
ISNETILET

SEQ ID NO: 445289 - protein, 9 aa, Influenza virus
ISNKVNSVI

SEQ ID NO: 445290 - protein, 9 aa, Influenza virus
ISNLPFQNI

SEQ ID NO: 445291 - protein, 9 aa, Influenza virus
ISNQGSFYR

SEQ ID NO: 445292 - protein, 9 aa, Influenza virus
ISNRFQIQG

SEQ ID NO: 445293 - protein, 9 aa, Influenza virus
ISNVGLKVS

SEQ ID NO: 445294 - protein, 9 aa, Influenza virus
ISNVGLNVS

SEQ ID NO: 445295 - protein, 9 aa, Influenza virus
ISPIHLGDC

SEQ ID NO: 445296 - protein, 9 aa, Influenza virus
ISPKLRSGF

SEQ ID NO: 445297 - protein, 9 aa, Influenza virus
ISPLAGSAQ

SEQ ID NO: 445298 - protein, 9 aa, Influenza virus
ISPLAVTWW

SEQ ID NO: 445299 - protein, 9 aa, Influenza virus
ISPLMVAYM

SEQ ID NO: 445300 - protein, 9 aa, Influenza virus
ISPLSGSAQ

SEQ ID NO: 445301 - protein, 9 aa, Influenza virus
ISPRLRSGF

SEQ ID NO: 445302 - protein, 9 aa, Influenza virus
ISPRSRNGF

SEQ ID NO: 445303 - protein, 9 aa, Influenza virus
ISPRSRSGF

SEQ ID NO: 445304 - protein, 9 aa, Influenza virus
ISPVHLGDC

SEQ ID NO: 445305 - protein, 9 aa, Influenza virus
ISRARIDAR

SEQ ID NO: 445306 - protein, 9 aa, Influenza virus
ISRDSRSGY

SEQ ID NO: 445307 - protein, 9 aa, Influenza virus
ISSGSLKLA

SEQ ID NO: 445308 - protein, 9 aa, Influenza virus
ISSLPFQNI

SEQ ID NO: 445309 - protein, 9 aa, Influenza virus
ISSMGEAMV

SEQ ID NO: 445310 - protein, 9 aa, Influenza virus
ISSMMEAMV

SEQ ID NO: 445311 - protein, 9 aa, Influenza virus
ISSMVEAMI

SEQ ID NO: 445312 - protein, 9 aa, Influenza virus
ISSMVEAMM

SEQ ID NO: 445313 - protein, 9 aa, Influenza virus
ISSMVEAMV

SEQ ID NO: 445314 - protein, 9 aa, Influenza virus
ISSSFSFGG

SEQ ID NO: 445315 - protein, 9 aa, Influenza virus
ISTASRAGY

SEQ ID NO: 445316 - protein, 9 aa, Influenza virus
ISTASRSGY

SEQ ID NO: 445317 - protein, 9 aa, Influenza virus
ISTASRYGY

SEQ ID NO: 445318 - protein, 9 aa, Influenza virus
ISTPLGSPP

SEQ ID NO: 445319 - protein, 9 aa, Influenza virus
ISTPLGTPP

SEQ ID NO: 445320 - protein, 9 aa, Influenza virus
ISTRSRSGF

SEQ ID NO: 445321 - protein, 9 aa, Influenza virus
ISTTFPYTG

SEQ ID NO: 445322 - protein, 9 aa, Influenza virus
ISTTGMTLS

SEQ ID NO: 445323 - protein, 9 aa, Influenza virus
ISVESSTYQ

SEQ ID NO: 445324 - protein, 9 aa, Influenza virus
ISVGSGSFP

SEQ ID NO: 445325 - protein, 9 aa, Influenza virus
ISVGSSIYQ

SEQ ID NO: 445326 - protein, 9 aa, Influenza virus
ISVGSSTYQ

SEQ ID NO: 445327 - protein, 9 aa, Influenza virus
ISVGTSTLN

SEQ ID NO: 445328 - protein, 9 aa, Influenza virus
ISWEMGLAP

SEQ ID NO: 445329 - protein, 9 aa, Influenza virus
ISWEMGQAP

SEQ ID NO: 445330 - protein, 9 aa, Influenza virus
ISWGMGQAP

SEQ ID NO: 445331 - protein, 9 aa, Influenza virus
ISWPLSSPP

SEQ ID NO: 445332 - protein, 9 aa, Influenza virus
ISWPQSSPP

SEQ ID NO: 445333 - protein, 9 aa, Influenza virus
ITAASLNDD

SEQ ID NO: 445334 - protein, 9 aa, Influenza virus
ITAQELVES

SEQ ID NO: 445335 - protein, 9 aa, Influenza virus
ITCTCRDNW

SEQ ID NO: 445336 - protein, 9 aa, Influenza virus
ITCVCRDNW

SEQ ID NO: 445337 - protein, 9 aa, Influenza virus
ITDGPSDAQ

SEQ ID NO: 445338 - protein, 9 aa, Influenza virus
ITDGPSNAQ

SEQ ID NO: 445339 - protein, 9 aa, Influenza virus
ITDIWAYNA

SEQ ID NO: 445340 - protein, 9 aa, Influenza virus
ITDIWTYQA

SEQ ID NO: 445341 - protein, 9 aa, Influenza virus
ITDTFKSWK

SEQ ID NO: 445342 - protein, 9 aa, Influenza virus
ITDTIKSWG

SEQ ID NO: 445343 - protein, 9 aa, Influenza virus
ITDTIKSWK

SEQ ID NO: 445344 - protein, 9 aa, Influenza virus
ITDTIKSWR

SEQ ID NO: 445345 - protein, 9 aa, Influenza virus
ITDTIRSWR

SEQ ID NO: 445346 - protein, 9 aa, Influenza virus
ITDTLKSWK

SEQ ID NO: 445347 - protein, 9 aa, Influenza virus
ITDWSGYSG

SEQ ID NO: 445348 - protein, 9 aa, Influenza virus
ITEINTWAR

SEQ ID NO: 445349 - protein, 9 aa, Influenza virus
ITEIVYLNH

SEQ ID NO: 445350 - protein, 9 aa, Influenza virus
ITEIVYLNN

SEQ ID NO: 445351 - protein, 9 aa, Influenza virus
ITEIVYLNS

SEQ ID NO: 445352 - protein, 9 aa, Influenza virus
ITEIYNETV

SEQ ID NO: 445353 - protein, 9 aa, Influenza virus
ITELPFQNL

SEQ ID NO: 445354 - protein, 9 aa, Influenza virus
ITENSFEQI

SEQ ID NO: 445355 - protein, 9 aa, Influenza virus
ITEVWSYNA

SEQ ID NO: 445356 - protein, 9 aa, Influenza virus
ITEWSGYSG

SEQ ID NO: 445357 - protein, 9 aa, Influenza virus
ITFEATGNL

SEQ ID NO: 445358 - protein, 9 aa, Influenza virus
ITFESNGGF

SEQ ID NO: 445359 - protein, 9 aa, Influenza virus
ITFESNGGL

SEQ ID NO: 445360 - protein, 9 aa, Influenza virus
ITFESSGGL

SEQ ID NO: 445361 - protein, 9 aa, Influenza virus
ITFHGAKEI

SEQ ID NO: 445362 - protein, 9 aa, Influenza virus
ITFHGAKEV

SEQ ID NO: 445363 - protein, 9 aa, Influenza virus
ITFHRAKEV

SEQ ID NO: 445364 - protein, 9 aa, Influenza virus
ITFIQALQL

SEQ ID NO: 445365 - protein, 9 aa, Influenza virus
ITFLHNGGL

SEQ ID NO: 445366 - protein, 9 aa, Influenza virus
ITFLQALQL

SEQ ID NO: 445367 - protein, 9 aa, Influenza virus
ITFMQALQL

SEQ ID NO: 445368 - protein, 9 aa, Influenza virus
ITFSDNGGL

SEQ ID NO: 445369 - protein, 9 aa, Influenza virus
ITFSFNGAF

SEQ ID NO: 445370 - protein, 9 aa, Influenza virus
ITFSHNGGL

SEQ ID NO: 445371 - protein, 9 aa, Influenza virus
ITFSHNGGR

SEQ ID NO: 445372 - protein, 9 aa, Influenza virus
ITGDDKNAT

SEQ ID NO: 445373 - protein, 9 aa, Influenza virus
ITGDDRNAT

SEQ ID NO: 445374 - protein, 9 aa, Influenza virus
ITGDNTKWN

SEQ ID NO: 445375 - protein, 9 aa, Influenza virus
ITGFAPFSK

SEQ ID NO: 445376 - protein, 9 aa, Influenza virus
ITGFASFSK

SEQ ID NO: 445377 - protein, 9 aa, Influenza virus
ITGIDKVCT

SEQ ID NO: 445378 - protein, 9 aa, Influenza virus
ITGINKVCT

SEQ ID NO: 445379 - protein, 9 aa, Influenza virus
ITGKLNHLI

SEQ ID NO: 445380 - protein, 9 aa, Influenza virus
ITGKLNRII

SEQ ID NO: 445381 - protein, 9 aa, Influenza virus
ITGKLNRLI

SEQ ID NO: 445382 - protein, 9 aa, Influenza virus
ITGKSHGRI

SEQ ID NO: 445383 - protein, 9 aa, Influenza virus
ITGKSHGRV

SEQ ID NO: 445384 - protein, 9 aa, Influenza virus
ITGPDATAV

SEQ ID NO: 445385 - protein, 9 aa, Influenza virus
ITGPDSTAV

SEQ ID NO: 445386 - protein, 9 aa, Influenza virus
ITGPDTTAV

SEQ ID NO: 445387 - protein, 9 aa, Influenza virus
ITGSPCAPG

SEQ ID NO: 445388 - protein, 9 aa, Influenza virus
ITGSPEAPG

SEQ ID NO: 445389 - protein, 9 aa, Influenza virus
ITGSPGAPG

SEQ ID NO: 445390 - protein, 9 aa, Influenza virus
ITGSPGSPG

SEQ ID NO: 445391 - protein, 9 aa, Influenza virus
ITGSPGVPG

SEQ ID NO: 445392 - protein, 9 aa, Influenza virus
ITGSPSAPG

SEQ ID NO: 445393 - protein, 9 aa, Influenza virus
ITHFQRKRR

SEQ ID NO: 445394 - protein, 9 aa, Influenza virus
ITIDSVSLT

SEQ ID NO: 445395 - protein, 9 aa, Influenza virus
ITIGECPKY

SEQ ID NO: 445396 - protein, 9 aa, Influenza virus
ITIGFVSLI

SEQ ID NO: 445397 - protein, 9 aa, Influenza virus
ITIGISGPD

SEQ ID NO: 445398 - protein, 9 aa, Influenza virus
ITIGKCPKY

SEQ ID NO: 445399 - protein, 9 aa, Influenza virus
ITIGKCSKY

SEQ ID NO: 445400 - protein, 9 aa, Influenza virus
ITIGSASLT

SEQ ID NO: 445401 - protein, 9 aa, Influenza virus
ITIGSVSLI

SEQ ID NO: 445402 - protein, 9 aa, Influenza virus
ITIGSVSLT

SEQ ID NO: 445403 - protein, 9 aa, Influenza virus
ITKIVYLNS

SEQ ID NO: 445404 - protein, 9 aa, Influenza virus
ITLHFKQNE

SEQ ID NO: 445405 - protein, 9 aa, Influenza virus
ITLKFAFNM

SEQ ID NO: 445406 - protein, 9 aa, Influenza virus
ITNGTTGNP

SEQ ID NO: 445407 - protein, 9 aa, Influenza virus
ITNKANSII

SEQ ID NO: 445408 - protein, 9 aa, Influenza virus
ITNKINNIV

SEQ ID NO: 445409 - protein, 9 aa, Influenza virus
ITNKINSII

SEQ ID NO: 445410 - protein, 9 aa, Influenza virus
ITNKVNNIV

SEQ ID NO: 445411 - protein, 9 aa, Influenza virus
ITNKVNSII

SEQ ID NO: 445412 - protein, 9 aa, Influenza virus
ITNKVNSVI

SEQ ID NO: 445413 - protein, 9 aa, Influenza virus
ITNKVNSVV

SEQ ID NO: 445414 - protein, 9 aa, Influenza virus
ITNKVNTVI

SEQ ID NO: 445415 - protein, 9 aa, Influenza virus
ITNPLIRHE

SEQ ID NO: 445416 - protein, 9 aa, Influenza virus
ITNRVNSII

SEQ ID NO: 445417 - protein, 9 aa, Influenza virus
ITPEYAYKI

SEQ ID NO: 445418 - protein, 9 aa, Influenza virus
ITPNGSIPN

SEQ ID NO: 445419 - protein, 9 aa, Influenza virus
ITPNGSISN

SEQ ID NO: 445420 - protein, 9 aa, Influenza virus
ITQESECVC

SEQ ID NO: 445421 - protein, 9 aa, Influenza virus
ITQISNINI

SEQ ID NO: 445422 - protein, 9 aa, Influenza virus
ITQISNTNI

SEQ ID NO: 445423 - protein, 9 aa, Influenza virus
ITQRTIGKK

SEQ ID NO: 445424 - protein, 9 aa, Influenza virus
ITQTLVSNN

SEQ ID NO: 445425 - protein, 9 aa, Influenza virus
ITQTLVSNS

SEQ ID NO: 445426 - protein, 9 aa, Influenza virus
ITREPYVSC

SEQ ID NO: 445427 - protein, 9 aa, Influenza virus
ITRKLNRLI

SEQ ID NO: 445428 - protein, 9 aa, Influenza virus
ITRSGQNHG

SEQ ID NO: 445429 - protein, 9 aa, Influenza virus
ITSKVNSII

SEQ ID NO: 445430 - protein, 9 aa, Influenza virus
ITSLCSIWF

SEQ ID NO: 445431 - protein, 9 aa, Influenza virus
ITSNLPFQN

SEQ ID NO: 445432 - protein, 9 aa, Influenza virus
ITSPLPFQN

SEQ ID NO: 445433 - protein, 9 aa, Influenza virus
ITTHFQRKR

SEQ ID NO: 445434 - protein, 9 aa, Influenza virus
ITTKINNII

SEQ ID NO: 445435 - protein, 9 aa, Influenza virus
ITTKVNSII

SEQ ID NO: 445436 - protein, 9 aa, Influenza virus
ITVGSSKYQ

SEQ ID NO: 445437 - protein, 9 aa, Influenza virus
ITVGSSKYR

SEQ ID NO: 445438 - protein, 9 aa, Influenza virus
ITVIKNNMI

SEQ ID NO: 445439 - protein, 9 aa, Influenza virus
ITVTHAQDI

SEQ ID NO: 445440 - protein, 9 aa, Influenza virus
ITVTHSVEL

SEQ ID NO: 445441 - protein, 9 aa, Influenza virus
ITVTHSVNL

SEQ ID NO: 445442 - protein, 9 aa, Influenza virus
ITVTSSVEL

SEQ ID NO: 445443 - protein, 9 aa, Influenza virus
ITWGIHHPS

SEQ ID NO: 445444 - protein, 9 aa, Influenza virus
ITYGACPKY

SEQ ID NO: 445445 - protein, 9 aa, Influenza virus
ITYGACPRY

SEQ ID NO: 445446 - protein, 9 aa, Influenza virus
ITYGPCPRY

SEQ ID NO: 445447 - protein, 9 aa, Influenza virus
ITYGVCPRY

SEQ ID NO: 445448 - protein, 9 aa, Influenza virus
ITYIWTYQA

SEQ ID NO: 445449 - protein, 9 aa, Influenza virus
ITYNKTVIN

SEQ ID NO: 445450 - protein, 9 aa, Influenza virus
ITYNNTVIN

SEQ ID NO: 445451 - protein, 9 aa, Influenza virus
ITYNNTVVN

SEQ ID NO: 445452 - protein, 9 aa, Influenza virus
ITYNSTVVN

SEQ ID NO: 445453 - protein, 9 aa, Influenza virus
ITYSSPMMW

SEQ ID NO: 445454 - protein, 9 aa, Influenza virus
ITYSSSLMW

SEQ ID NO: 445455 - protein, 9 aa, Influenza virus
ITYSSSMMW

SEQ ID NO: 445456 - protein, 9 aa, Influenza virus
IVADRDSTQ

SEQ ID NO: 445457 - protein, 9 aa, Influenza virus
IVAFCGTSG

SEQ ID NO: 445458 - protein, 9 aa, Influenza virus
IVALCGSKE

SEQ ID NO: 445459 - protein, 9 aa, Influenza virus
IVALCGSKK

SEQ ID NO: 445460 - protein, 9 aa, Influenza virus
IVALCGSRE

SEQ ID NO: 445461 - protein, 9 aa, Influenza virus
IVAMVFSQE

SEQ ID NO: 445462 - protein, 9 aa, Influenza virus
IVASSGTLE

SEQ ID NO: 445463 - protein, 9 aa, Influenza virus
IVASSGTVE

SEQ ID NO: 445464 - protein, 9 aa, Influenza virus
IVAVTDGPA

SEQ ID NO: 445465 - protein, 9 aa, Influenza virus
IVDKMNREF

SEQ ID NO: 445466 - protein, 9 aa, Influenza virus
IVDNKNWSG

SEQ ID NO: 445467 - protein, 9 aa, Influenza virus
IVDNNNWFG

SEQ ID NO: 445468 - protein, 9 aa, Influenza virus
IVDNNNWSG

SEQ ID NO: 445469 - protein, 9 aa, Influenza virus
IVDNNSWSG

SEQ ID NO: 445470 - protein, 9 aa, Influenza virus
IVDNQNWSG

SEQ ID NO: 445471 - protein, 9 aa, Influenza virus
IVDNSNWSG

SEQ ID NO: 445472 - protein, 9 aa, Influenza virus
IVERILEEE

SEQ ID NO: 445473 - protein, 9 aa, Influenza virus
IVERPKEIE

SEQ ID NO: 445474 - protein, 9 aa, Influenza virus
IVERPKEME

SEQ ID NO: 445475 - protein, 9 aa, Influenza virus
IVERPSAPE

SEQ ID NO: 445476 - protein, 9 aa, Influenza virus
IVERTKEME

SEQ ID NO: 445477 - protein, 9 aa, Influenza virus
IVETGYVCS

SEQ ID NO: 445478 - protein, 9 aa, Influenza virus
IVFCGTSGT

SEQ ID NO: 445479 - protein, 9 aa, Influenza virus
IVFNTIGNL

SEQ ID NO: 445480 - protein, 9 aa, Influenza virus
IVGLVFFCL

SEQ ID NO: 445481 - protein, 9 aa, Influenza virus
IVGNDNWSG

SEQ ID NO: 445482 - protein, 9 aa, Influenza virus
IVGNNNWSG

SEQ ID NO: 445483 - protein, 9 aa, Influenza virus
IVGNPSCAS

SEQ ID NO: 445484 - protein, 9 aa, Influenza virus
IVGNPSCAT

SEQ ID NO: 445485 - protein, 9 aa, Influenza virus
IVHISPLSG

SEQ ID NO: 445486 - protein, 9 aa, Influenza virus
IVILVLGLS

SEQ ID NO: 445487 - protein, 9 aa, Influenza virus
IVKGRSHLR

SEQ ID NO: 445488 - protein, 9 aa, Influenza virus
IVKTLTNEK

SEQ ID NO: 445489 - protein, 9 aa, Influenza virus
IVKTLTNEQ

SEQ ID NO: 445490 - protein, 9 aa, Influenza virus
IVKTLTNER

SEQ ID NO: 445491 - protein, 9 aa, Influenza virus
IVKTLTSEK

SEQ ID NO: 445492 - protein, 9 aa, Influenza virus
IVLGIINLL

SEQ ID NO: 445493 - protein, 9 aa, Influenza virus
IVLLENQKT

SEQ ID NO: 445494 - protein, 9 aa, Influenza virus
IVLNTDWSG

SEQ ID NO: 445495 - protein, 9 aa, Influenza virus
IVLVGLILA

SEQ ID NO: 445496 - protein, 9 aa, Influenza virus
IVLVMKRKR

SEQ ID NO: 445497 - protein, 9 aa, Influenza virus
IVMGLVFIC

SEQ ID NO: 445498 - protein, 9 aa, Influenza virus
IVMVGLILA

SEQ ID NO: 445499 - protein, 9 aa, Influenza virus
IVNAALGSP

SEQ ID NO: 445500 - protein, 9 aa, Influenza virus
IVNGALGSP

SEQ ID NO: 445501 - protein, 9 aa, Influenza virus
IVNNQDWSG

SEQ ID NO: 445502 - protein, 9 aa, Influenza virus
IVNNQNWSG

SEQ ID NO: 445503 - protein, 9 aa, Influenza virus
IVNSALGSP

SEQ ID NO: 445504 - protein, 9 aa, Influenza virus
IVNTTLSTI

SEQ ID NO: 445505 - protein, 9 aa, Influenza virus
IVPCFWLEM

SEQ ID NO: 445506 - protein, 9 aa, Influenza virus
IVPNIGSRP

SEQ ID NO: 445507 - protein, 9 aa, Influenza virus
IVPSFDMNN

SEQ ID NO: 445508 - protein, 9 aa, Influenza virus
IVPSFDMSK

SEQ ID NO: 445509 - protein, 9 aa, Influenza virus
IVPSFDMSN

SEQ ID NO: 445510 - protein, 9 aa, Influenza virus
IVPSFEMSN

SEQ ID NO: 445511 - protein, 9 aa, Influenza virus
IVPSGPLKA

SEQ ID NO: 445512 - protein, 9 aa, Influenza virus
IVQITGKLN

SEQ ID NO: 445513 - protein, 9 aa, Influenza virus
IVRRAAVSA

SEQ ID NO: 445514 - protein, 9 aa, Influenza virus
IVRRAIVSA

SEQ ID NO: 445515 - protein, 9 aa, Influenza virus
IVRRATVSA

SEQ ID NO: 445516 - protein, 9 aa, Influenza virus
IVSADPLAS

SEQ ID NO: 445517 - protein, 9 aa, Influenza virus
IVSIDRFLR

SEQ ID NO: 445518 - protein, 9 aa, Influenza virus
IVSKDNGIR

SEQ ID NO: 445519 - protein, 9 aa, Influenza virus
IVSLGAISF

SEQ ID NO: 445520 - protein, 9 aa, Influenza virus
IVSMCSSTE

SEQ ID NO: 445521 - protein, 9 aa, Influenza virus
IVSNDNWSG

SEQ ID NO: 445522 - protein, 9 aa, Influenza virus
IVSNTDWSG

SEQ ID NO: 445523 - protein, 9 aa, Influenza virus
IVSPLAVTW

SEQ ID NO: 445524 - protein, 9 aa, Influenza virus
IVSSLPFQN

SEQ ID NO: 445525 - protein, 9 aa, Influenza virus
IVSSLPFQS

SEQ ID NO: 445526 - protein, 9 aa, Influenza virus
IVSWSQNIL

SEQ ID NO: 445527 - protein, 9 aa, Influenza virus
IVTFCGLDN

SEQ ID NO: 445528 - protein, 9 aa, Influenza virus
IVTFCGLNN

SEQ ID NO: 445529 - protein, 9 aa, Influenza virus
IVTHFQRKR

SEQ ID NO: 445530 - protein, 9 aa, Influenza virus
IVTIGSVSI

SEQ ID NO: 445531 - protein, 9 aa, Influenza virus
IVTREPYIS

SEQ ID NO: 445532 - protein, 9 aa, Influenza virus
IVTREPYVS

SEQ ID NO: 445533 - protein, 9 aa, Influenza virus
IVTTVGWSW

SEQ ID NO: 445534 - protein, 9 aa, Influenza virus
IVTVTHAQD

SEQ ID NO: 445535 - protein, 9 aa, Influenza virus
IVVFCGASG

SEQ ID NO: 445536 - protein, 9 aa, Influenza virus
IVVFCGTSA

SEQ ID NO: 445537 - protein, 9 aa, Influenza virus
IVVFCGTSG

SEQ ID NO: 445538 - protein, 9 aa, Influenza virus
IVVTREPYV

SEQ ID NO: 445539 - protein, 9 aa, Influenza virus
IVWACQRGN

SEQ ID NO: 445540 - protein, 9 aa, Influenza virus
IVWGIHHPS

SEQ ID NO: 445541 - protein, 9 aa, Influenza virus
IVWGVHHSS

SEQ ID NO: 445542 - protein, 9 aa, Influenza virus
IWAIHHPPT

SEQ ID NO: 445543 - protein, 9 aa, Influenza virus
IWASGSSIS

SEQ ID NO: 445544 - protein, 9 aa, Influenza virus
IWAYNAELI

SEQ ID NO: 445545 - protein, 9 aa, Influenza virus
IWAYNAELL

SEQ ID NO: 445546 - protein, 9 aa, Influenza virus
IWDANGWVS

SEQ ID NO: 445547 - protein, 9 aa, Influenza virus
IWDTLIERD

SEQ ID NO: 445548 - protein, 9 aa, Influenza virus
IWFSHYNQM

SEQ ID NO: 445549 - protein, 9 aa, Influenza virus
IWFSHYNQV

SEQ ID NO: 445550 - protein, 9 aa, Influenza virus
IWGIHHPND

SEQ ID NO: 445551 - protein, 9 aa, Influenza virus
IWGIHHPSS

SEQ ID NO: 445552 - protein, 9 aa, Influenza virus
IWGVHHPID

SEQ ID NO: 445553 - protein, 9 aa, Influenza virus
IWGVHHPKD

SEQ ID NO: 445554 - protein, 9 aa, Influenza virus
IWGVHHPND

SEQ ID NO: 445555 - protein, 9 aa, Influenza virus
IWGVHHPST

SEQ ID NO: 445556 - protein, 9 aa, Influenza virus
IWHSNLNDA

SEQ ID NO: 445557 - protein, 9 aa, Influenza virus
IWHSNLNDT

SEQ ID NO: 445558 - protein, 9 aa, Influenza virus
IWIGRTKST

SEQ ID NO: 445559 - protein, 9 aa, Influenza virus
IWITREPYV

SEQ ID NO: 445560 - protein, 9 aa, Influenza virus
IWLWLVLRE

SEQ ID NO: 445561 - protein, 9 aa, Influenza virus
IWMACHSAA

SEQ ID NO: 445562 - protein, 9 aa, Influenza virus
IWMCSNGSL

SEQ ID NO: 445563 - protein, 9 aa, Influenza virus
IWRQANNGD

SEQ ID NO: 445564 - protein, 9 aa, Influenza virus
IWRQANNGE

SEQ ID NO: 445565 - protein, 9 aa, Influenza virus
IWSKPQCQI

SEQ ID NO: 445566 - protein, 9 aa, Influenza virus
IWSYNAEFL

SEQ ID NO: 445567 - protein, 9 aa, Influenza virus
IWSYNAELL

SEQ ID NO: 445568 - protein, 9 aa, Influenza virus
IWSYNAKLL

SEQ ID NO: 445569 - protein, 9 aa, Influenza virus
IWSYNAQLL

SEQ ID NO: 445570 - protein, 9 aa, Influenza virus
IWSYNARLL

SEQ ID NO: 445571 - protein, 9 aa, Influenza virus
IWTSASSIS

SEQ ID NO: 445572 - protein, 9 aa, Influenza virus
IWTSGSIIS

SEQ ID NO: 445573 - protein, 9 aa, Influenza virus
IWTSGSSIA

SEQ ID NO: 445574 - protein, 9 aa, Influenza virus
IWTSGSSIS

SEQ ID NO: 445575 - protein, 9 aa, Influenza virus
IWTSSSSIV

SEQ ID NO: 445576 - protein, 9 aa, Influenza virus
IWTSSSSTV

SEQ ID NO: 445577 - protein, 9 aa, Influenza virus
IWTSSSSVV

SEQ ID NO: 445578 - protein, 9 aa, Influenza virus
IWTYNAELL

SEQ ID NO: 445579 - protein, 9 aa, Influenza virus
IWTYQAELL

SEQ ID NO: 445580 - protein, 9 aa, Influenza virus
IWVTRELYV

SEQ ID NO: 445581 - protein, 9 aa, Influenza virus
IWVTREPYV

SEQ ID NO: 445582 - protein, 9 aa, Influenza virus
IYATVAGSL

SEQ ID NO: 445583 - protein, 9 aa, Influenza virus
IYCICRDNW

SEQ ID NO: 445584 - protein, 9 aa, Influenza virus
IYCVCRDNW

SEQ ID NO: 445585 - protein, 9 aa, Influenza virus
IYDFNEGSY

SEQ ID NO: 445586 - protein, 9 aa, Influenza virus
IYGKDNAIR

SEQ ID NO: 445587 - protein, 9 aa, Influenza virus
IYGKDNAVR

SEQ ID NO: 445588 - protein, 9 aa, Influenza virus
IYGNPKCDI

SEQ ID NO: 445589 - protein, 9 aa, Influenza virus
IYGNPKCDT

SEQ ID NO: 445590 - protein, 9 aa, Influenza virus
IYGNPKCDV

SEQ ID NO: 445591 - protein, 9 aa, Influenza virus
IYHKCDNAC

SEQ ID NO: 445592 - protein, 9 aa, Influenza virus
IYHKCDNSC

SEQ ID NO: 445593 - protein, 9 aa, Influenza virus
IYHKCDNTC

SEQ ID NO: 445594 - protein, 9 aa, Influenza virus
IYHKCDNVC

SEQ ID NO: 445595 - protein, 9 aa, Influenza virus
IYHKCNNAC

SEQ ID NO: 445596 - protein, 9 aa, Influenza virus
IYIEVLHLT

SEQ ID NO: 445597 - protein, 9 aa, Influenza virus
IYKILSIYS

SEQ ID NO: 445598 - protein, 9 aa, Influenza virus
IYKILTIYS

SEQ ID NO: 445599 - protein, 9 aa, Influenza virus
IYNETVRLE

SEQ ID NO: 445600 - protein, 9 aa, Influenza virus
IYNRMGAVT

SEQ ID NO: 445601 - protein, 9 aa, Influenza virus
IYNRMGTIT

SEQ ID NO: 445602 - protein, 9 aa, Influenza virus
IYNRMGTVA

SEQ ID NO: 445603 - protein, 9 aa, Influenza virus
IYNRMGTVT

SEQ ID NO: 445604 - protein, 9 aa, Influenza virus
IYQILAIYA

SEQ ID NO: 445605 - protein, 9 aa, Influenza virus
IYQILAIYS

SEQ ID NO: 445606 - protein, 9 aa, Influenza virus
IYQILSIYS

SEQ ID NO: 445607 - protein, 9 aa, Influenza virus
IYRDEAINN

SEQ ID NO: 445608 - protein, 9 aa, Influenza virus
IYSCIASSI

SEQ ID NO: 445609 - protein, 9 aa, Influenza virus
IYSCIASSL

SEQ ID NO: 445610 - protein, 9 aa, Influenza virus
IYSCIASST

SEQ ID NO: 445611 - protein, 9 aa, Influenza virus
IYSCIASSV

SEQ ID NO: 445612 - protein, 9 aa, Influenza virus
IYSSSMMWE

SEQ ID NO: 445613 - protein, 9 aa, Influenza virus
IYSSVASSL

SEQ ID NO: 445614 - protein, 9 aa, Influenza virus
IYSTAASSL

SEQ ID NO: 445615 - protein, 9 aa, Influenza virus
IYSTISSSL

SEQ ID NO: 445616 - protein, 9 aa, Influenza virus
IYSTVAASL

SEQ ID NO: 445617 - protein, 9 aa, Influenza virus
IYSTVASSF

SEQ ID NO: 445618 - protein, 9 aa, Influenza virus
IYSTVASSI

SEQ ID NO: 445619 - protein, 9 aa, Influenza virus
IYSTVASSL

SEQ ID NO: 445620 - protein, 9 aa, Influenza virus
IYSTVASSS

SEQ ID NO: 445621 - protein, 9 aa, Influenza virus
IYSTVSSSL

SEQ ID NO: 445622 - protein, 9 aa, Influenza virus
IYSTVTSSL

SEQ ID NO: 445623 - protein, 9 aa, Influenza virus
IYSTVVSSL

SEQ ID NO: 445624 - protein, 9 aa, Influenza virus
IYWHLMHPG

SEQ ID NO: 445625 - protein, 9 aa, Influenza virus
IYWTIVKPG

SEQ ID NO: 445626 - protein, 9 aa, Influenza virus
IYWTLVNPG

SEQ ID NO: 445627 - protein, 9 aa, Influenza virus
IYWTVVKPG

SEQ ID NO: 445628 - protein, 9 aa, Influenza virus
IYWWDGLQS

SEQ ID NO: 445629 - protein, 9 aa, Influenza virus
KAAIGLRIS

SEQ ID NO: 445630 - protein, 9 aa, Influenza virus
KAALGLRIS

SEQ ID NO: 445631 - protein, 9 aa, Influenza virus
KAAMGLKIS

SEQ ID NO: 445632 - protein, 9 aa, Influenza virus
KAAMGLRIS

SEQ ID NO: 445633 - protein, 9 aa, Influenza virus
KAAMGMRIS

SEQ ID NO: 445634 - protein, 9 aa, Influenza virus
KACELTDSI

SEQ ID NO: 445635 - protein, 9 aa, Influenza virus
KACELTDSS

SEQ ID NO: 445636 - protein, 9 aa, Influenza virus
KACELTDST

SEQ ID NO: 445637 - protein, 9 aa, Influenza virus
KACELTDSV

SEQ ID NO: 445638 - protein, 9 aa, Influenza virus
KACELTGSS

SEQ ID NO: 445639 - protein, 9 aa, Influenza virus
KACNALTGG

SEQ ID NO: 445640 - protein, 9 aa, Influenza virus
KACNASTGA

SEQ ID NO: 445641 - protein, 9 aa, Influenza virus
KACNASTGG

SEQ ID NO: 445642 - protein, 9 aa, Influenza virus
KACSASTGG

SEQ ID NO: 445643 - protein, 9 aa, Influenza virus
KADEICIGY

SEQ ID NO: 445644 - protein, 9 aa, Influenza virus
KADHRIYWI

SEQ ID NO: 445645 - protein, 9 aa, Influenza virus
KADKICIGY

SEQ ID NO: 445646 - protein, 9 aa, Influenza virus
KADLIIERR

SEQ ID NO: 445647 - protein, 9 aa, Influenza virus
KADTILERN

SEQ ID NO: 445648 - protein, 9 aa, Influenza virus
KADTRILFI

SEQ ID NO: 445649 - protein, 9 aa, Influenza virus
KADTRILFV

SEQ ID NO: 445650 - protein, 9 aa, Influenza virus
KAEIAQKLE

SEQ ID NO: 445651 - protein, 9 aa, Influenza virus
KAEIAQRLE

SEQ ID NO: 445652 - protein, 9 aa, Influenza virus
KAGFIEGGW

SEQ ID NO: 445653 - protein, 9 aa, Influenza virus
KAGFIENGW

SEQ ID NO: 445654 - protein, 9 aa, Influenza virus
KAGVKMNPN

SEQ ID NO: 445655 - protein, 9 aa, Influenza virus
KAHNGKLCR

SEQ ID NO: 445656 - protein, 9 aa, Influenza virus
KAIDEITTK

SEQ ID NO: 445657 - protein, 9 aa, Influenza virus
KAIDGITNK

SEQ ID NO: 445658 - protein, 9 aa, Influenza virus
KAIDGVTNK

SEQ ID NO: 445659 - protein, 9 aa, Influenza virus
KAIDIMQNK

SEQ ID NO: 445660 - protein, 9 aa, Influenza virus
KAIDNMQNK

SEQ ID NO: 445661 - protein, 9 aa, Influenza virus
KAIDNMQNR

SEQ ID NO: 445662 - protein, 9 aa, Influenza virus
KAIDQITTK

SEQ ID NO: 445663 - protein, 9 aa, Influenza virus
KAIDRITTK

SEQ ID NO: 445664 - protein, 9 aa, Influenza virus
KAINEITTK

SEQ ID NO: 445665 - protein, 9 aa, Influenza virus
KAINGVTNK

SEQ ID NO: 445666 - protein, 9 aa, Influenza virus
KAIWTSGSS

SEQ ID NO: 445667 - protein, 9 aa, Influenza virus
KAKLANVVR

SEQ ID NO: 445668 - protein, 9 aa, Influenza virus
KALNEITTK

SEQ ID NO: 445669 - protein, 9 aa, Influenza virus
KALSIYSCI

SEQ ID NO: 445670 - protein, 9 aa, Influenza virus
KAMEQMAGS

SEQ ID NO: 445671 - protein, 9 aa, Influenza virus
KAMEQVAGS

SEQ ID NO: 445672 - protein, 9 aa, Influenza virus
KAMMDQVRE

SEQ ID NO: 445673 - protein, 9 aa, Influenza virus
KANQVFPQL

SEQ ID NO: 445674 - protein, 9 aa, Influenza virus
KANVLIGQG

SEQ ID NO: 445675 - protein, 9 aa, Influenza virus
KAPISLGDC

SEQ ID NO: 445676 - protein, 9 aa, Influenza virus
KAPQLNPID

SEQ ID NO: 445677 - protein, 9 aa, Influenza virus
KARIDYYWS

SEQ ID NO: 445678 - protein, 9 aa, Influenza virus
KASKEPEVH

SEQ ID NO: 445679 - protein, 9 aa, Influenza virus
KASLRLAVG

SEQ ID NO: 445680 - protein, 9 aa, Influenza virus
KASTQKAID

SEQ ID NO: 445681 - protein, 9 aa, Influenza virus
KASTQKAIN

SEQ ID NO: 445682 - protein, 9 aa, Influenza virus
KATAILRKA

SEQ ID NO: 445683 - protein, 9 aa, Influenza virus
KATCVCRDN

SEQ ID NO: 445684 - protein, 9 aa, Influenza virus
KATKMEAIL

SEQ ID NO: 445685 - protein, 9 aa, Influenza virus
KATKMKAII

SEQ ID NO: 445686 - protein, 9 aa, Influenza virus
KATKMKAIL

SEQ ID NO: 445687 - protein, 9 aa, Influenza virus
KATKRLIQL

SEQ ID NO: 445688 - protein, 9 aa, Influenza virus
KATNGNYGP

SEQ ID NO: 445689 - protein, 9 aa, Influenza virus
KATRKLIQL

SEQ ID NO: 445690 - protein, 9 aa, Influenza virus
KATRRLIQL

SEQ ID NO: 445691 - protein, 9 aa, Influenza virus
KATRRLVQL

SEQ ID NO: 445692 - protein, 9 aa, Influenza virus
KATRRMIQL

SEQ ID NO: 445693 - protein, 9 aa, Influenza virus
KAVDLGSCG

SEQ ID NO: 445694 - protein, 9 aa, Influenza virus
KAVKLYKKL

SEQ ID NO: 445695 - protein, 9 aa, Influenza virus
KAVKLYRKL

SEQ ID NO: 445696 - protein, 9 aa, Influenza virus
KAVRGDLNF

SEQ ID NO: 445697 - protein, 9 aa, Influenza virus
KAWLHICVT

SEQ ID NO: 445698 - protein, 9 aa, Influenza virus
KAWLHVCIT

SEQ ID NO: 445699 - protein, 9 aa, Influenza virus
KAWLHVCVT

SEQ ID NO: 445700 - protein, 9 aa, Influenza virus
KCCNLFEKF

SEQ ID NO: 445701 - protein, 9 aa, Influenza virus
KCCSLFEKF

SEQ ID NO: 445702 - protein, 9 aa, Influenza virus
KCCTLFEKF

SEQ ID NO: 445703 - protein, 9 aa, Influenza virus
KCDDDCMAS

SEQ ID NO: 445704 - protein, 9 aa, Influenza virus
KCDDECMDS

SEQ ID NO: 445705 - protein, 9 aa, Influenza virus
KCDDECMNS

SEQ ID NO: 445706 - protein, 9 aa, Influenza virus
KCDDECMSS

SEQ ID NO: 445707 - protein, 9 aa, Influenza virus
KCDDHCMES

SEQ ID NO: 445708 - protein, 9 aa, Influenza virus
KCDDQCMES

SEQ ID NO: 445709 - protein, 9 aa, Influenza virus
KCDIHLKDQ

SEQ ID NO: 445710 - protein, 9 aa, Influenza virus
KCDIHLRDQ

SEQ ID NO: 445711 - protein, 9 aa, Influenza virus
KCDLYLNGR

SEQ ID NO: 445712 - protein, 9 aa, Influenza virus
KCDLYLSGR

SEQ ID NO: 445713 - protein, 9 aa, Influenza virus
KCDNECMDS

SEQ ID NO: 445714 - protein, 9 aa, Influenza virus
KCDNECMET

SEQ ID NO: 445715 - protein, 9 aa, Influenza virus
KCDNKCMET

SEQ ID NO: 445716 - protein, 9 aa, Influenza virus
KCDNQCMES

SEQ ID NO: 445717 - protein, 9 aa, Influenza virus
KCDPYLNGR

SEQ ID NO: 445718 - protein, 9 aa, Influenza virus
KCDTHLKDQ

SEQ ID NO: 445719 - protein, 9 aa, Influenza virus
KCDVHLKDQ

SEQ ID NO: 445720 - protein, 9 aa, Influenza virus
KCFNPCFYV

SEQ ID NO: 445721 - protein, 9 aa, Influenza virus
KCFWKGGSI

SEQ ID NO: 445722 - protein, 9 aa, Influenza virus
KCFWKSGSI

SEQ ID NO: 445723 - protein, 9 aa, Influenza virus
KCFWRGGSI

SEQ ID NO: 445724 - protein, 9 aa, Influenza virus
KCICRDNWK

SEQ ID NO: 445725 - protein, 9 aa, Influenza virus
KCICRDNWR

SEQ ID NO: 445726 - protein, 9 aa, Influenza virus
KCIERVRNG

SEQ ID NO: 445727 - protein, 9 aa, Influenza virus
KCIESIRNG

SEQ ID NO: 445728 - protein, 9 aa, Influenza virus
KCIKTFFGW

SEQ ID NO: 445729 - protein, 9 aa, Influenza virus
KCIRTFFGW

SEQ ID NO: 445730 - protein, 9 aa, Influenza virus
KCKTKEGRR

SEQ ID NO: 445731 - protein, 9 aa, Influenza virus
KCMESVRNG

SEQ ID NO: 445732 - protein, 9 aa, Influenza virus
KCMETIKNG

SEQ ID NO: 445733 - protein, 9 aa, Influenza virus
KCMKTFFGW

SEQ ID NO: 445734 - protein, 9 aa, Influenza virus
KCMRTFFGW

SEQ ID NO: 445735 - protein, 9 aa, Influenza virus
KCNDECMNS

SEQ ID NO: 445736 - protein, 9 aa, Influenza virus
KCNDPYPGN

SEQ ID NO: 445737 - protein, 9 aa, Influenza virus
KCNDSCMDT

SEQ ID NO: 445738 - protein, 9 aa, Influenza virus
KCNDSCMEA

SEQ ID NO: 445739 - protein, 9 aa, Influenza virus
KCNDSCMET

SEQ ID NO: 445740 - protein, 9 aa, Influenza virus
KCNEPYPGN

SEQ ID NO: 445741 - protein, 9 aa, Influenza virus
KCNNECMET

SEQ ID NO: 445742 - protein, 9 aa, Influenza virus
KCNNSCMET

SEQ ID NO: 445743 - protein, 9 aa, Influenza virus
KCNNTCMET

SEQ ID NO: 445744 - protein, 9 aa, Influenza virus
KCNQFALGQ

SEQ ID NO: 445745 - protein, 9 aa, Influenza virus
KCNTKCQTS

SEQ ID NO: 445746 - protein, 9 aa, Influenza virus
KCPKYIPSG

SEQ ID NO: 445747 - protein, 9 aa, Influenza virus
KCPKYIPSN

SEQ ID NO: 445748 - protein, 9 aa, Influenza virus
KCPKYIPSR

SEQ ID NO: 445749 - protein, 9 aa, Influenza virus
KCPKYISSG

SEQ ID NO: 445750 - protein, 9 aa, Influenza virus
KCPKYVKST

SEQ ID NO: 445751 - protein, 9 aa, Influenza virus
KCPRYIPSG

SEQ ID NO: 445752 - protein, 9 aa, Influenza virus
KCPRYVKQS

SEQ ID NO: 445753 - protein, 9 aa, Influenza virus
KCQLNEGVM

SEQ ID NO: 445754 - protein, 9 aa, Influenza virus
KCQSEIGGI

SEQ ID NO: 445755 - protein, 9 aa, Influenza virus
KCQSEIGWI

SEQ ID NO: 445756 - protein, 9 aa, Influenza virus
KCQSPLGAI

SEQ ID NO: 445757 - protein, 9 aa, Influenza virus
KCQTEIGGI

SEQ ID NO: 445758 - protein, 9 aa, Influenza virus
KCQTEVGGI

SEQ ID NO: 445759 - protein, 9 aa, Influenza virus
KCQTPLGAI

SEQ ID NO: 445760 - protein, 9 aa, Influenza virus
KCQTPLGAL

SEQ ID NO: 445761 - protein, 9 aa, Influenza virus
KCQTSLGGI

SEQ ID NO: 445762 - protein, 9 aa, Influenza virus
KCQTSLGGV

SEQ ID NO: 445763 - protein, 9 aa, Influenza virus
KCQTSMGGI

SEQ ID NO: 445764 - protein, 9 aa, Influenza virus
KCQTSMGGV

SEQ ID NO: 445765 - protein, 9 aa, Influenza virus
KCQTSVGGI

SEQ ID NO: 445766 - protein, 9 aa, Influenza virus
KCQTYAGAI

SEQ ID NO: 445767 - protein, 9 aa, Influenza virus
KCQTYAGAV

SEQ ID NO: 445768 - protein, 9 aa, Influenza virus
KCQTYTGAI

SEQ ID NO: 445769 - protein, 9 aa, Influenza virus
KCRTKEGRR

SEQ ID NO: 445770 - protein, 9 aa, Influenza virus
KCRTREGRR

SEQ ID NO: 445771 - protein, 9 aa, Influenza virus
KCSKYVKST

SEQ ID NO: 445772 - protein, 9 aa, Influenza virus
KCVCRDNWK

SEQ ID NO: 445773 - protein, 9 aa, Influenza virus
KCYNPCFYV

SEQ ID NO: 445774 - protein, 9 aa, Influenza virus
KCYQFALGH

SEQ ID NO: 445775 - protein, 9 aa, Influenza virus
KCYQFALGQ

SEQ ID NO: 445776 - protein, 9 aa, Influenza virus
KDAERGKLK

SEQ ID NO: 445777 - protein, 9 aa, Influenza virus
KDCFQPCFY

SEQ ID NO: 445778 - protein, 9 aa, Influenza virus
KDCFQSCFY

SEQ ID NO: 445779 - protein, 9 aa, Influenza virus
KDCSIAGWL

SEQ ID NO: 445780 - protein, 9 aa, Influenza virus
KDCSVAGWL

SEQ ID NO: 445781 - protein, 9 aa, Influenza virus
KDCSVSGWL

SEQ ID NO: 445782 - protein, 9 aa, Influenza virus
KDEGNGCFT

SEQ ID NO: 445783 - protein, 9 aa, Influenza virus
KDGDIIFLW

SEQ ID NO: 445784 - protein, 9 aa, Influenza virus
KDIILWFSF

SEQ ID NO: 445785 - protein, 9 aa, Influenza virus
KDIILWISF

SEQ ID NO: 445786 - protein, 9 aa, Influenza virus
KDIILWVSF

SEQ ID NO: 445787 - protein, 9 aa, Influenza virus
KDILEKAHN

SEQ ID NO: 445788 - protein, 9 aa, Influenza virus
KDILEKTHN

SEQ ID NO: 445789 - protein, 9 aa, Influenza virus
KDILRTQES

SEQ ID NO: 445790 - protein, 9 aa, Influenza virus
KDLDNCHPI

SEQ ID NO: 445791 - protein, 9 aa, Influenza virus
KDLGNCHPI

SEQ ID NO: 445792 - protein, 9 aa, Influenza virus
KDLGNCHPV

SEQ ID NO: 445793 - protein, 9 aa, Influenza virus
KDLGNGCFE

SEQ ID NO: 445794 - protein, 9 aa, Influenza virus
KDLGSCHPI

SEQ ID NO: 445795 - protein, 9 aa, Influenza virus
KDLRSGYEM

SEQ ID NO: 445796 - protein, 9 aa, Influenza virus
KDLRSGYET

SEQ ID NO: 445797 - protein, 9 aa, Influenza virus
KDLTKEFFE

SEQ ID NO: 445798 - protein, 9 aa, Influenza virus
KDMTKDFFE

SEQ ID NO: 445799 - protein, 9 aa, Influenza virus
KDMTKEFFE

SEQ ID NO: 445800 - protein, 9 aa, Influenza virus
KDMTKEFFV

SEQ ID NO: 445801 - protein, 9 aa, Influenza virus
KDMTREFFE

SEQ ID NO: 445802 - protein, 9 aa, Influenza virus
KDNAIDEGD

SEQ ID NO: 445803 - protein, 9 aa, Influenza virus
KDNAIRFGE

SEQ ID NO: 445804 - protein, 9 aa, Influenza virus
KDNAIRIGE

SEQ ID NO: 445805 - protein, 9 aa, Influenza virus
KDNAIRLGE

SEQ ID NO: 445806 - protein, 9 aa, Influenza virus
KDNAIRPGE

SEQ ID NO: 445807 - protein, 9 aa, Influenza virus
KDNAKDEGN

SEQ ID NO: 445808 - protein, 9 aa, Influenza virus
KDNAKDLGN

SEQ ID NO: 445809 - protein, 9 aa, Influenza virus
KDNAKEIGN

SEQ ID NO: 445810 - protein, 9 aa, Influenza virus
KDNAKELGN

SEQ ID NO: 445811 - protein, 9 aa, Influenza virus
KDNALRLAE

SEQ ID NO: 445812 - protein, 9 aa, Influenza virus
KDNANDLGN

SEQ ID NO: 445813 - protein, 9 aa, Influenza virus
KDNARELGN

SEQ ID NO: 445814 - protein, 9 aa, Influenza virus
KDNAVRFGE

SEQ ID NO: 445815 - protein, 9 aa, Influenza virus
KDNAVRIGE

SEQ ID NO: 445816 - protein, 9 aa, Influenza virus
KDNAVRLGE

SEQ ID NO: 445817 - protein, 9 aa, Influenza virus
KDNGIRIGS

SEQ ID NO: 445818 - protein, 9 aa, Influenza virus
KDNGIRVGS

SEQ ID NO: 445819 - protein, 9 aa, Influenza virus
KDNLEPGTF

SEQ ID NO: 445820 - protein, 9 aa, Influenza virus
KDNNIRIGS

SEQ ID NO: 445821 - protein, 9 aa, Influenza virus
KDNQVFPQL

SEQ ID NO: 445822 - protein, 9 aa, Influenza virus
KDNSIQLSA

SEQ ID NO: 445823 - protein, 9 aa, Influenza virus
KDNSIRIGS

SEQ ID NO: 445824 - protein, 9 aa, Influenza virus
KDNSIRLAA

SEQ ID NO: 445825 - protein, 9 aa, Influenza virus
KDNSIRLSA

SEQ ID NO: 445826 - protein, 9 aa, Influenza virus
KDNSVRIGS

SEQ ID NO: 445827 - protein, 9 aa, Influenza virus
KDNSVRLSA

SEQ ID NO: 445828 - protein, 9 aa, Influenza virus
KDPKKTGGP

SEQ ID NO: 445829 - protein, 9 aa, Influenza virus
KDQAWSYIV

SEQ ID NO: 445830 - protein, 9 aa, Influenza virus
KDQDWSYIV

SEQ ID NO: 445831 - protein, 9 aa, Influenza virus
KDQGWSYIV

SEQ ID NO: 445832 - protein, 9 aa, Influenza virus
KDQSWSYIV

SEQ ID NO: 445833 - protein, 9 aa, Influenza virus
KDRAPYRSL

SEQ ID NO: 445834 - protein, 9 aa, Influenza virus
KDRSPFRAL

SEQ ID NO: 445835 - protein, 9 aa, Influenza virus
KDRSPFRTL

SEQ ID NO: 445836 - protein, 9 aa, Influenza virus
KDRSPHRAL

SEQ ID NO: 445837 - protein, 9 aa, Influenza virus
KDRSPHRTL

SEQ ID NO: 445838 - protein, 9 aa, Influenza virus
KDRSPQRTL

SEQ ID NO: 445839 - protein, 9 aa, Influenza virus
KDRSPYRAL

SEQ ID NO: 445840 - protein, 9 aa, Influenza virus
KDRSPYRTL

SEQ ID NO: 445841 - protein, 9 aa, Influenza virus
KDRTPYRSL

SEQ ID NO: 445842 - protein, 9 aa, Influenza virus
KDRTSYRSL

SEQ ID NO: 445843 - protein, 9 aa, Influenza virus
KDSITDIWT

SEQ ID NO: 445844 - protein, 9 aa, Influenza virus
KDSNGVQDI

SEQ ID NO: 445845 - protein, 9 aa, Influenza virus
KDSRSGYEI

SEQ ID NO: 445846 - protein, 9 aa, Influenza virus
KDSRSGYEM

SEQ ID NO: 445847 - protein, 9 aa, Influenza virus
KDSRSGYET

SEQ ID NO: 445848 - protein, 9 aa, Influenza virus
KDSRSGYEV

SEQ ID NO: 445849 - protein, 9 aa, Influenza virus
KDTRSGYEM

SEQ ID NO: 445850 - protein, 9 aa, Influenza virus
KDVIIWFSF

SEQ ID NO: 445851 - protein, 9 aa, Influenza virus
KDVILWFSF

SEQ ID NO: 445852 - protein, 9 aa, Influenza virus
KDVILWFSL

SEQ ID NO: 445853 - protein, 9 aa, Influenza virus
KDWILWISF

SEQ ID NO: 445854 - protein, 9 aa, Influenza virus
KDWVLWISF

SEQ ID NO: 445855 - protein, 9 aa, Influenza virus
KDYEEEAKL

SEQ ID NO: 445856 - protein, 9 aa, Influenza virus
KDYRYTYRC

SEQ ID NO: 445857 - protein, 9 aa, Influenza virus
KEAMQNRIQ

SEQ ID NO: 445858 - protein, 9 aa, Influenza virus
KEAQDVIME

SEQ ID NO: 445859 - protein, 9 aa, Influenza virus
KECFNPCFY

SEQ ID NO: 445860 - protein, 9 aa, Influenza virus
KEDEVWWTS

SEQ ID NO: 445861 - protein, 9 aa, Influenza virus
KEDKRYGPA

SEQ ID NO: 445862 - protein, 9 aa, Influenza virus
KEDKVWWTS

SEQ ID NO: 445863 - protein, 9 aa, Influenza virus
KEDRRYGPA

SEQ ID NO: 445864 - protein, 9 aa, Influenza virus
KEDRVWWTS

SEQ ID NO: 445865 - protein, 9 aa, Influenza virus
KEEALKGSA

SEQ ID NO: 445866 - protein, 9 aa, Influenza virus
KEEALQGSA

SEQ ID NO: 445867 - protein, 9 aa, Influenza virus
KEECYRACF

SEQ ID NO: 445868 - protein, 9 aa, Influenza virus
KEEKVWWTS

SEQ ID NO: 445869 - protein, 9 aa, Influenza virus
KEEPLKGSA

SEQ ID NO: 445870 - protein, 9 aa, Influenza virus
KEESQLKRQ

SEQ ID NO: 445871 - protein, 9 aa, Influenza virus
KEETLKGSA

SEQ ID NO: 445872 - protein, 9 aa, Influenza virus
KEEVINATE

SEQ ID NO: 445873 - protein, 9 aa, Influenza virus
KEEVLKGSA

SEQ ID NO: 445874 - protein, 9 aa, Influenza virus
KEEVTNATE

SEQ ID NO: 445875 - protein, 9 aa, Influenza virus
KEFEQVEGR

SEQ ID NO: 445876 - protein, 9 aa, Influenza virus
KEFGNLERR

SEQ ID NO: 445877 - protein, 9 aa, Influenza virus
KEFGQVEGR

SEQ ID NO: 445878 - protein, 9 aa, Influenza virus
KEFNNLEKR

SEQ ID NO: 445879 - protein, 9 aa, Influenza virus
KEFNNLERR

SEQ ID NO: 445880 - protein, 9 aa, Influenza virus
KEFSEIEGR

SEQ ID NO: 445881 - protein, 9 aa, Influenza virus
KEFSEVEGR

SEQ ID NO: 445882 - protein, 9 aa, Influenza virus
KEFSNLEKR

SEQ ID NO: 445883 - protein, 9 aa, Influenza virus
KEFSNLERR

SEQ ID NO: 445884 - protein, 9 aa, Influenza virus
KEFTEVEGR

SEQ ID NO: 445885 - protein, 9 aa, Influenza virus
KEGRRKTNL

SEQ ID NO: 445886 - protein, 9 aa, Influenza virus
KEGRRRTNL

SEQ ID NO: 445887 - protein, 9 aa, Influenza virus
KEGSYFFGD

SEQ ID NO: 445888 - protein, 9 aa, Influenza virus
KEGYSLVGI

SEQ ID NO: 445889 - protein, 9 aa, Influenza virus
KEGYSLVGV

SEQ ID NO: 445890 - protein, 9 aa, Influenza virus
KEICIAWSS

SEQ ID NO: 445891 - protein, 9 aa, Influenza virus
KEICVAWSS

SEQ ID NO: 445892 - protein, 9 aa, Influenza virus
KEIEGICYP

SEQ ID NO: 445893 - protein, 9 aa, Influenza virus
KEIGNGCFE

SEQ ID NO: 445894 - protein, 9 aa, Influenza virus
KEIVYLNNT

SEQ ID NO: 445895 - protein, 9 aa, Influenza virus
KEKAIWTSG

SEQ ID NO: 445896 - protein, 9 aa, Influenza virus
KEKDLTKEF

SEQ ID NO: 445897 - protein, 9 aa, Influenza virus
KEKDMTKEF

SEQ ID NO: 445898 - protein, 9 aa, Influenza virus
KEKDMTREF

SEQ ID NO: 445899 - protein, 9 aa, Influenza virus
KEKEICSVV

SEQ ID NO: 445900 - protein, 9 aa, Influenza virus
KEKENSYPK

SEQ ID NO: 445901 - protein, 9 aa, Influenza virus
KEKENSYPM

SEQ ID NO: 445902 - protein, 9 aa, Influenza virus
KEKNDLYGT

SEQ ID NO: 445903 - protein, 9 aa, Influenza virus
KEKNELYGT

SEQ ID NO: 445904 - protein, 9 aa, Influenza virus
KEKTIWTSG

SEQ ID NO: 445905 - protein, 9 aa, Influenza virus
KEKVTNATE

SEQ ID NO: 445906 - protein, 9 aa, Influenza virus
KELGNGCFE

SEQ ID NO: 445907 - protein, 9 aa, Influenza virus
KELVETNHT

SEQ ID NO: 445908 - protein, 9 aa, Influenza virus
KEMCAAWSS

SEQ ID NO: 445909 - protein, 9 aa, Influenza virus
KEMEGICYP

SEQ ID NO: 445910 - protein, 9 aa, Influenza virus
KEMEGVCYP

SEQ ID NO: 445911 - protein, 9 aa, Influenza virus
KEMGNGCFE

SEQ ID NO: 445912 - protein, 9 aa, Influenza virus
KENKKYGPA

SEQ ID NO: 445913 - protein, 9 aa, Influenza virus
KENKRYGPA

SEQ ID NO: 445914 - protein, 9 aa, Influenza virus
KENPAHKSQ

SEQ ID NO: 445915 - protein, 9 aa, Influenza virus
KENTGSYVR

SEQ ID NO: 445916 - protein, 9 aa, Influenza virus
KEPALIVWG

SEQ ID NO: 445917 - protein, 9 aa, Influenza virus
KEPDTYDFN

SEQ ID NO: 445918 - protein, 9 aa, Influenza virus
KEPISLGDC

SEQ ID NO: 445919 - protein, 9 aa, Influenza virus
KEPMGFRYS

SEQ ID NO: 445920 - protein, 9 aa, Influenza virus
KEQLGSWSW

SEQ ID NO: 445921 - protein, 9 aa, Influenza virus
KEQLSTVSS

SEQ ID NO: 445922 - protein, 9 aa, Influenza virus
KEQTALYKN

SEQ ID NO: 445923 - protein, 9 aa, Influenza virus
KEQTTLYKN

SEQ ID NO: 445924 - protein, 9 aa, Influenza virus
KERLGSWSW

SEQ ID NO: 445925 - protein, 9 aa, Influenza virus
KERTIWTSG

SEQ ID NO: 445926 - protein, 9 aa, Influenza virus
KERTSIWTS

SEQ ID NO: 445927 - protein, 9 aa, Influenza virus
KESLRLAIG

SEQ ID NO: 445928 - protein, 9 aa, Influenza virus
KESLRLALG

SEQ ID NO: 445929 - protein, 9 aa, Influenza virus
KESLRLAVG

SEQ ID NO: 445930 - protein, 9 aa, Influenza virus
KESMGFRYS

SEQ ID NO: 445931 - protein, 9 aa, Influenza virus
KESRLNRQE

SEQ ID NO: 445932 - protein, 9 aa, Influenza virus
KESRSGYET

SEQ ID NO: 445933 - protein, 9 aa, Influenza virus
KESTQKAID

SEQ ID NO: 445934 - protein, 9 aa, Influenza virus
KETGNGCFE

SEQ ID NO: 445935 - protein, 9 aa, Influenza virus
KETNGNYGP

SEQ ID NO: 445936 - protein, 9 aa, Influenza virus
KETRVWWTS

SEQ ID NO: 445937 - protein, 9 aa, Influenza virus
KEVGNGCFE

SEQ ID NO: 445938 - protein, 9 aa, Influenza virus
KEVILWFSF

SEQ ID NO: 445939 - protein, 9 aa, Influenza virus
KEWGNGCFE

SEQ ID NO: 445940 - protein, 9 aa, Influenza virus
KEWMHICMT

SEQ ID NO: 445941 - protein, 9 aa, Influenza virus
KEWMHVCIT

SEQ ID NO: 445942 - protein, 9 aa, Influenza virus
KEWMHVCMA

SEQ ID NO: 445943 - protein, 9 aa, Influenza virus
KEWMHVCMT

SEQ ID NO: 445944 - protein, 9 aa, Influenza virus
KEWMHVSMT

SEQ ID NO: 445945 - protein, 9 aa, Influenza virus
KEWSKRYEL

SEQ ID NO: 445946 - protein, 9 aa, Influenza virus
KEWSRRYEL

SEQ ID NO: 445947 - protein, 9 aa, Influenza virus
KEYEEEAKL

SEQ ID NO: 445948 - protein, 9 aa, Influenza virus
KFAAICTHL

SEQ ID NO: 445949 - protein, 9 aa, Influenza virus
KFAAICTHM

SEQ ID NO: 445950 - protein, 9 aa, Influenza virus
KFASICTHL

SEQ ID NO: 445951 - protein, 9 aa, Influenza virus
KFCYPGELD

SEQ ID NO: 445952 - protein, 9 aa, Influenza virus
KFEAVAWSA

SEQ ID NO: 445953 - protein, 9 aa, Influenza virus
KFEEIKWLI

SEQ ID NO: 445954 - protein, 9 aa, Influenza virus
KFEEIRWLI

SEQ ID NO: 445955 - protein, 9 aa, Influenza virus
KFEEIRWMI

SEQ ID NO: 445956 - protein, 9 aa, Influenza virus
KFEEMRWLI

SEQ ID NO: 445957 - protein, 9 aa, Influenza virus
KFEEVRWLI

SEQ ID NO: 445958 - protein, 9 aa, Influenza virus
KFEFIAEDF

SEQ ID NO: 445959 - protein, 9 aa, Influenza virus
KFEFIAEEF

SEQ ID NO: 445960 - protein, 9 aa, Influenza virus
KFEFIVEKF

SEQ ID NO: 445961 - protein, 9 aa, Influenza virus
KFESVAWSA

SEQ ID NO: 445962 - protein, 9 aa, Influenza virus
KFFPSSSYR

SEQ ID NO: 445963 - protein, 9 aa, Influenza virus
KFHQIEKEF

SEQ ID NO: 445964 - protein, 9 aa, Influenza virus
KFHSDTPRP

SEQ ID NO: 445965 - protein, 9 aa, Influenza virus
KFKADLIIE

SEQ ID NO: 445966 - protein, 9 aa, Influenza virus
KFLLMDALK

SEQ ID NO: 445967 - protein, 9 aa, Influenza virus
KFLLMDSLK

SEQ ID NO: 445968 - protein, 9 aa, Influenza virus
KFLNNTEPL

SEQ ID NO: 445969 - protein, 9 aa, Influenza virus
KFLPDLYDY

SEQ ID NO: 445970 - protein, 9 aa, Influenza virus
KFQTAAQKA

SEQ ID NO: 445971 - protein, 9 aa, Influenza virus
KFQTAAQRA

SEQ ID NO: 445972 - protein, 9 aa, Influenza virus
KFTNEEALR

SEQ ID NO: 445973 - protein, 9 aa, Influenza virus
KFYIQMCTE

SEQ ID NO: 445974 - protein, 9 aa, Influenza virus
KGANRPIIT

SEQ ID NO: 445975 - protein, 9 aa, Influenza virus
KGANRPVII

SEQ ID NO: 445976 - protein, 9 aa, Influenza virus
KGANRPVIT

SEQ ID NO: 445977 - protein, 9 aa, Influenza virus
KGCFDILHK

SEQ ID NO: 445978 - protein, 9 aa, Influenza virus
KGCFDLYHK

SEQ ID NO: 445979 - protein, 9 aa, Influenza virus
KGCFEIYHA

SEQ ID NO: 445980 - protein, 9 aa, Influenza virus
KGCFEIYHK

SEQ ID NO: 445981 - protein, 9 aa, Influenza virus
KGCFEIYHN

SEQ ID NO: 445982 - protein, 9 aa, Influenza virus
KGCFEIYHT

SEQ ID NO: 445983 - protein, 9 aa, Influenza virus
KGCFELYHK

SEQ ID NO: 445984 - protein, 9 aa, Influenza virus
KGCFELYHR

SEQ ID NO: 445985 - protein, 9 aa, Influenza virus
KGCFQPCFY

SEQ ID NO: 445986 - protein, 9 aa, Influenza virus
KGCINRCFY

SEQ ID NO: 445987 - protein, 9 aa, Influenza virus
KGDCYRACF

SEQ ID NO: 445988 - protein, 9 aa, Influenza virus
KGDIFVIRE

SEQ ID NO: 445989 - protein, 9 aa, Influenza virus
KGDIFVMRE

SEQ ID NO: 445990 - protein, 9 aa, Influenza virus
KGDKICLGH

SEQ ID NO: 445991 - protein, 9 aa, Influenza virus
KGDQICIGY

SEQ ID NO: 445992 - protein, 9 aa, Influenza virus
KGDRICIGY

SEQ ID NO: 445993 - protein, 9 aa, Influenza virus
KGDVFVIRE

SEQ ID NO: 445994 - protein, 9 aa, Influenza virus
KGDVFVMRE

SEQ ID NO: 445995 - protein, 9 aa, Influenza virus
KGDYNNTTG

SEQ ID NO: 445996 - protein, 9 aa, Influenza virus
KGECYRACF

SEQ ID NO: 445997 - protein, 9 aa, Influenza virus
KGEKANVLI

SEQ ID NO: 445998 - protein, 9 aa, Influenza virus
KGEYNNTTG

SEQ ID NO: 445999 - protein, 9 aa, Influenza virus
KGFAFKYGN

SEQ ID NO: 446000 - protein, 9 aa, Influenza virus
KGFAPFSKD

SEQ ID NO: 446001 - protein, 9 aa, Influenza virus
KGFFPFHKD

SEQ ID NO: 446002 - protein, 9 aa, Influenza virus
KGFGFRQGD

SEQ ID NO: 446003 - protein, 9 aa, Influenza virus
KGFGFRQGN

SEQ ID NO: 446004 - protein, 9 aa, Influenza virus
KGFGFRQGT

SEQ ID NO: 446005 - protein, 9 aa, Influenza virus
KGFNSFYRN

SEQ ID NO: 446006 - protein, 9 aa, Influenza virus
KGFSFKYGD

SEQ ID NO: 446007 - protein, 9 aa, Influenza virus
KGFSFKYGN

SEQ ID NO: 446008 - protein, 9 aa, Influenza virus
KGFSFRYGD

SEQ ID NO: 446009 - protein, 9 aa, Influenza virus
KGFSFRYGN

SEQ ID NO: 446010 - protein, 9 aa, Influenza virus
KGFSYKYDN

SEQ ID NO: 446011 - protein, 9 aa, Influenza virus
KGFSYKYGN

SEQ ID NO: 446012 - protein, 9 aa, Influenza virus
KGFSYRYGN

SEQ ID NO: 446013 - protein, 9 aa, Influenza virus
KGGPGVKGF

SEQ ID NO: 446014 - protein, 9 aa, Influenza virus
KGGSIKTKL

SEQ ID NO: 446015 - protein, 9 aa, Influenza virus
KGGSINTKL

SEQ ID NO: 446016 - protein, 9 aa, Influenza virus
KGHVFVIRE

SEQ ID NO: 446017 - protein, 9 aa, Influenza virus
KGIEVVNAT

SEQ ID NO: 446018 - protein, 9 aa, Influenza virus
KGILEDEQM

SEQ ID NO: 446019 - protein, 9 aa, Influenza virus
KGILGFVFT

SEQ ID NO: 446020 - protein, 9 aa, Influenza virus
KGKFQTAAQ

SEQ ID NO: 446021 - protein, 9 aa, Influenza virus
KGKKAVDLG

SEQ ID NO: 446022 - protein, 9 aa, Influenza virus
KGLCIINSW

SEQ ID NO: 446023 - protein, 9 aa, Influenza virus
KGLCTINSW

SEQ ID NO: 446024 - protein, 9 aa, Influenza virus
KGLFGAIAG

SEQ ID NO: 446025 - protein, 9 aa, Influenza virus
KGLILGNPK

SEQ ID NO: 446026 - protein, 9 aa, Influenza virus
KGLWDSFRQ

SEQ ID NO: 446027 - protein, 9 aa, Influenza virus
KGMLGFVFT

SEQ ID NO: 446028 - protein, 9 aa, Influenza virus
KGNAKDEGN

SEQ ID NO: 446029 - protein, 9 aa, Influenza virus
KGNGCFEIF

SEQ ID NO: 446030 - protein, 9 aa, Influenza virus
KGNIKCNIC

SEQ ID NO: 446031 - protein, 9 aa, Influenza virus
KGNIMRTQE

SEQ ID NO: 446032 - protein, 9 aa, Influenza virus
KGNIRCDIC

SEQ ID NO: 446033 - protein, 9 aa, Influenza virus
KGNIRCNIC

SEQ ID NO: 446034 - protein, 9 aa, Influenza virus
KGNPGVKGW

SEQ ID NO: 446035 - protein, 9 aa, Influenza virus
KGNQGVKGW

SEQ ID NO: 446036 - protein, 9 aa, Influenza virus
KGNSARLIH

SEQ ID NO: 446037 - protein, 9 aa, Influenza virus
KGRGLFGAI

SEQ ID NO: 446038 - protein, 9 aa, Influenza virus
KGRHANGTI

SEQ ID NO: 446039 - protein, 9 aa, Influenza virus
KGRIDYYWS

SEQ ID NO: 446040 - protein, 9 aa, Influenza virus
KGRIFQSHI

SEQ ID NO: 446041 - protein, 9 aa, Influenza virus
KGRIFQSPI

SEQ ID NO: 446042 - protein, 9 aa, Influenza virus
KGRIFQSRI

SEQ ID NO: 446043 - protein, 9 aa, Influenza virus
KGRLCNPLN

SEQ ID NO: 446044 - protein, 9 aa, Influenza virus
KGRSHLRND

SEQ ID NO: 446045 - protein, 9 aa, Influenza virus
KGRYGVKGF

SEQ ID NO: 446046 - protein, 9 aa, Influenza virus
KGSAKHIEE

SEQ ID NO: 446047 - protein, 9 aa, Influenza virus
KGSARHIEE

SEQ ID NO: 446048 - protein, 9 aa, Influenza virus
KGSIQSDKP

SEQ ID NO: 446049 - protein, 9 aa, Influenza virus
KGSNRPIID

SEQ ID NO: 446050 - protein, 9 aa, Influenza virus
KGSNRPIVD

SEQ ID NO: 446051 - protein, 9 aa, Influenza virus
KGSNRPVID

SEQ ID NO: 446052 - protein, 9 aa, Influenza virus
KGSNRPVVD

SEQ ID NO: 446053 - protein, 9 aa, Influenza virus
KGSNRPWIR

SEQ ID NO: 446054 - protein, 9 aa, Influenza virus
KGSNRPWMR

SEQ ID NO: 446055 - protein, 9 aa, Influenza virus
KGSNRPWVR

SEQ ID NO: 446056 - protein, 9 aa, Influenza virus
KGSYNNTNG

SEQ ID NO: 446057 - protein, 9 aa, Influenza virus
KGSYNNTSG

SEQ ID NO: 446058 - protein, 9 aa, Influenza virus
KGTNSFYRN

SEQ ID NO: 446059 - protein, 9 aa, Influenza virus
KGTYDYPKY

SEQ ID NO: 446060 - protein, 9 aa, Influenza virus
KGVELSSMG

SEQ ID NO: 446061 - protein, 9 aa, Influenza virus
KGVEVVNAT

SEQ ID NO: 446062 - protein, 9 aa, Influenza virus
KGVKLSNMG

SEQ ID NO: 446063 - protein, 9 aa, Influenza virus
KGVKLSSMG

SEQ ID NO: 446064 - protein, 9 aa, Influenza virus
KGVYINTAL

SEQ ID NO: 446065 - protein, 9 aa, Influenza virus
KGVYINTAM

SEQ ID NO: 446066 - protein, 9 aa, Influenza virus
KGVYMNTAL

SEQ ID NO: 446067 - protein, 9 aa, Influenza virus
KGVYVNTAL

SEQ ID NO: 446068 - protein, 9 aa, Influenza virus
KGWAFDNGD

SEQ ID NO: 446069 - protein, 9 aa, Influenza virus
KGWAFDNGN

SEQ ID NO: 446070 - protein, 9 aa, Influenza virus
KGWAFDSGD

SEQ ID NO: 446071 - protein, 9 aa, Influenza virus
KGWAFDYGN

SEQ ID NO: 446072 - protein, 9 aa, Influenza virus
KGWAFDYGS

SEQ ID NO: 446073 - protein, 9 aa, Influenza virus
KGWAPLSKD

SEQ ID NO: 446074 - protein, 9 aa, Influenza virus
KGWILGNPR

SEQ ID NO: 446075 - protein, 9 aa, Influenza virus
KGYGVKGFG

SEQ ID NO: 446076 - protein, 9 aa, Influenza virus
KHDRIPHRT

SEQ ID NO: 446077 - protein, 9 aa, Influenza virus
KHDSNVKNL

SEQ ID NO: 446078 - protein, 9 aa, Influenza virus
KHENRMVLA

SEQ ID NO: 446079 - protein, 9 aa, Influenza virus
KHFEKVKIL

SEQ ID NO: 446080 - protein, 9 aa, Influenza virus
KHFEKVRIL

SEQ ID NO: 446081 - protein, 9 aa, Influenza virus
KHIEECSCY

SEQ ID NO: 446082 - protein, 9 aa, Influenza virus
KHIVERILE

SEQ ID NO: 446083 - protein, 9 aa, Influenza virus
KHLAYCNTD

SEQ ID NO: 446084 - protein, 9 aa, Influenza virus
KHLEECSCY

SEQ ID NO: 446085 - protein, 9 aa, Influenza virus
KHPAYCNTD

SEQ ID NO: 446086 - protein, 9 aa, Influenza virus
KHQNAQGEG

SEQ ID NO: 446087 - protein, 9 aa, Influenza virus
KHRFEIIEG

SEQ ID NO: 446088 - protein, 9 aa, Influenza virus
KHSAYCNTD

SEQ ID NO: 446089 - protein, 9 aa, Influenza virus
KHSNDTIHD

SEQ ID NO: 446090 - protein, 9 aa, Influenza virus
KHSNDTVHD

SEQ ID NO: 446091 - protein, 9 aa, Influenza virus
KHSNETVKD

SEQ ID NO: 446092 - protein, 9 aa, Influenza virus
KHSNGTAKD

SEQ ID NO: 446093 - protein, 9 aa, Influenza virus
KHSNGTIHD

SEQ ID NO: 446094 - protein, 9 aa, Influenza virus
KHSNGTIKD

SEQ ID NO: 446095 - protein, 9 aa, Influenza virus
KHSNGTKHD

SEQ ID NO: 446096 - protein, 9 aa, Influenza virus
KHSNGTMKD

SEQ ID NO: 446097 - protein, 9 aa, Influenza virus
KHSNGTTHD

SEQ ID NO: 446098 - protein, 9 aa, Influenza virus
KHSNGTVKD

SEQ ID NO: 446099 - protein, 9 aa, Influenza virus
KHSNGTVND

SEQ ID NO: 446100 - protein, 9 aa, Influenza virus
KHSNNTVKD

SEQ ID NO: 446101 - protein, 9 aa, Influenza virus
KHSNNTVRD

SEQ ID NO: 446102 - protein, 9 aa, Influenza virus
KHSNSTTHD

SEQ ID NO: 446103 - protein, 9 aa, Influenza virus
KHTSQYICS

SEQ ID NO: 446104 - protein, 9 aa, Influenza virus
KHTSQYLCT

SEQ ID NO: 446105 - protein, 9 aa, Influenza virus
KHYIGKCPK

SEQ ID NO: 446106 - protein, 9 aa, Influenza virus
KHYIGKCPR

SEQ ID NO: 446107 - protein, 9 aa, Influenza virus
KIAHISPLS

SEQ ID NO: 446108 - protein, 9 aa, Influenza virus
KICIGYHAN

SEQ ID NO: 446109 - protein, 9 aa, Influenza virus
KICIGYLSN

SEQ ID NO: 446110 - protein, 9 aa, Influenza virus
KICIGYQTN

SEQ ID NO: 446111 - protein, 9 aa, Influenza virus
KICLGHHAE

SEQ ID NO: 446112 - protein, 9 aa, Influenza virus
KICLGHHAV

SEQ ID NO: 446113 - protein, 9 aa, Influenza virus
KICLGRHAV

SEQ ID NO: 446114 - protein, 9 aa, Influenza virus
KICVGYLST

SEQ ID NO: 446115 - protein, 9 aa, Influenza virus
KIDDQIEDL

SEQ ID NO: 446116 - protein, 9 aa, Influenza virus
KIDDQIEEL

SEQ ID NO: 446117 - protein, 9 aa, Influenza virus
KIDDQIEGL

SEQ ID NO: 446118 - protein, 9 aa, Influenza virus
KIDDQIENL

SEQ ID NO: 446119 - protein, 9 aa, Influenza virus
KIDLWSYNA

SEQ ID NO: 446120 - protein, 9 aa, Influenza virus
KIDTILERN

SEQ ID NO: 446121 - protein, 9 aa, Influenza virus
KIDTLTETG

SEQ ID NO: 446122 - protein, 9 aa, Influenza virus
KIEAVIYGN

SEQ ID NO: 446123 - protein, 9 aa, Influenza virus
KIEFEPFQS

SEQ ID NO: 446124 - protein, 9 aa, Influenza virus
KIEGRVQDL

SEQ ID NO: 446125 - protein, 9 aa, Influenza virus
KIEKIEKIR

SEQ ID NO: 446126 - protein, 9 aa, Influenza virus
KIHNAGTDP

SEQ ID NO: 446127 - protein, 9 aa, Influenza virus
KIHTRGLFG

SEQ ID NO: 446128 - protein, 9 aa, Influenza virus
KIIHISPLS

SEQ ID NO: 446129 - protein, 9 aa, Influenza virus
KIIQNEDIP

SEQ ID NO: 446130 - protein, 9 aa, Influenza virus
KIIRVGCVI

SEQ ID NO: 446131 - protein, 9 aa, Influenza virus
KIITIDSVS

SEQ ID NO: 446132 - protein, 9 aa, Influenza virus
KIITIGSAS

SEQ ID NO: 446133 - protein, 9 aa, Influenza virus
KIITIGSIS

SEQ ID NO: 446134 - protein, 9 aa, Influenza virus
KIITIGSVS

SEQ ID NO: 446135 - protein, 9 aa, Influenza virus
KIITMGSVS

SEQ ID NO: 446136 - protein, 9 aa, Influenza virus
KIKHLEECS

SEQ ID NO: 446137 - protein, 9 aa, Influenza virus
KIKMKWGME

SEQ ID NO: 446138 - protein, 9 aa, Influenza virus
KIKTNGNLI

SEQ ID NO: 446139 - protein, 9 aa, Influenza virus
KILCASATA

SEQ ID NO: 446140 - protein, 9 aa, Influenza virus
KILCTSAIA

SEQ ID NO: 446141 - protein, 9 aa, Influenza virus
KILCTSATA

SEQ ID NO: 446142 - protein, 9 aa, Influenza virus
KILDEHDSN

SEQ ID NO: 446143 - protein, 9 aa, Influenza virus
KILFASATA

SEQ ID NO: 446144 - protein, 9 aa, Influenza virus
KILFIEEGK

SEQ ID NO: 446145 - protein, 9 aa, Influenza virus
KILKIKKGK

SEQ ID NO: 446146 - protein, 9 aa, Influenza virus
KILKIRKGK

SEQ ID NO: 446147 - protein, 9 aa, Influenza virus
KILRTHESE

SEQ ID NO: 446148 - protein, 9 aa, Influenza virus
KILRTQESE

SEQ ID NO: 446149 - protein, 9 aa, Influenza virus
KILRTQESS

SEQ ID NO: 446150 - protein, 9 aa, Influenza virus
KILSIYSCI

SEQ ID NO: 446151 - protein, 9 aa, Influenza virus
KILSIYSCV

SEQ ID NO: 446152 - protein, 9 aa, Influenza virus
KILSIYSSV

SEQ ID NO: 446153 - protein, 9 aa, Influenza virus
KILSIYSTV

SEQ ID NO: 446154 - protein, 9 aa, Influenza virus
KILTDTSRP

SEQ ID NO: 446155 - protein, 9 aa, Influenza virus
KILTIYSTA

SEQ ID NO: 446156 - protein, 9 aa, Influenza virus
KILTIYSTV

SEQ ID NO: 446157 - protein, 9 aa, Influenza virus
KILTSESQL

SEQ ID NO: 446158 - protein, 9 aa, Influenza virus
KILYFHKGL

SEQ ID NO: 446159 - protein, 9 aa, Influenza virus
KIMESGGID

SEQ ID NO: 446160 - protein, 9 aa, Influenza virus
KIMESGGIS

SEQ ID NO: 446161 - protein, 9 aa, Influenza virus
KIMTIGSVS

SEQ ID NO: 446162 - protein, 9 aa, Influenza virus
KIMYFHKGL

SEQ ID NO: 446163 - protein, 9 aa, Influenza virus
KINDQIEDL

SEQ ID NO: 446164 - protein, 9 aa, Influenza virus
KINEVKLEE

SEQ ID NO: 446165 - protein, 9 aa, Influenza virus
KINGKLNRL

SEQ ID NO: 446166 - protein, 9 aa, Influenza virus
KINGVILEE

SEQ ID NO: 446167 - protein, 9 aa, Influenza virus
KINGVKLEE

SEQ ID NO: 446168 - protein, 9 aa, Influenza virus
KINGVRLEE

SEQ ID NO: 446169 - protein, 9 aa, Influenza virus
KINMINDKI

SEQ ID NO: 446170 - protein, 9 aa, Influenza virus
KINNIIDKM

SEQ ID NO: 446171 - protein, 9 aa, Influenza virus
KINNIIEKM

SEQ ID NO: 446172 - protein, 9 aa, Influenza virus
KINNIVDKM

SEQ ID NO: 446173 - protein, 9 aa, Influenza virus
KINPVTLTM

SEQ ID NO: 446174 - protein, 9 aa, Influenza virus
KINRQEIEG

SEQ ID NO: 446175 - protein, 9 aa, Influenza virus
KINSIIDKM

SEQ ID NO: 446176 - protein, 9 aa, Influenza virus
KINSWHIFG

SEQ ID NO: 446177 - protein, 9 aa, Influenza virus
KINTLTERG

SEQ ID NO: 446178 - protein, 9 aa, Influenza virus
KIPAQNAIS

SEQ ID NO: 446179 - protein, 9 aa, Influenza virus
KIPNAETDP

SEQ ID NO: 446180 - protein, 9 aa, Influenza virus
KIPNAGIDP

SEQ ID NO: 446181 - protein, 9 aa, Influenza virus
KIPNAGTDP

SEQ ID NO: 446182 - protein, 9 aa, Influenza virus
KIPVQNAIS

SEQ ID NO: 446183 - protein, 9 aa, Influenza virus
KIQHLEECS

SEQ ID NO: 446184 - protein, 9 aa, Influenza virus
KIQTNGNLI

SEQ ID NO: 446185 - protein, 9 aa, Influenza virus
KIQTSGNLI

SEQ ID NO: 446186 - protein, 9 aa, Influenza virus
KIQWSQDPT

SEQ ID NO: 446187 - protein, 9 aa, Influenza virus
KIQWSQEPT

SEQ ID NO: 446188 - protein, 9 aa, Influenza virus
KIQWSQNPA

SEQ ID NO: 446189 - protein, 9 aa, Influenza virus
KIQWSQNPS

SEQ ID NO: 446190 - protein, 9 aa, Influenza virus
KIQWSQNPT

SEQ ID NO: 446191 - protein, 9 aa, Influenza virus
KIRHLEECS

SEQ ID NO: 446192 - protein, 9 aa, Influenza virus
KIRNGTYDH

SEQ ID NO: 446193 - protein, 9 aa, Influenza virus
KIRRRVDIN

SEQ ID NO: 446194 - protein, 9 aa, Influenza virus
KIRRRVDMN

SEQ ID NO: 446195 - protein, 9 aa, Influenza virus
KIRRRVDTN

SEQ ID NO: 446196 - protein, 9 aa, Influenza virus
KIRRRVDVN

SEQ ID NO: 446197 - protein, 9 aa, Influenza virus
KIRTNGNLI

SEQ ID NO: 446198 - protein, 9 aa, Influenza virus
KIRTRGLFG

SEQ ID NO: 446199 - protein, 9 aa, Influenza virus
KIRVKRRPV

SEQ ID NO: 446200 - protein, 9 aa, Influenza virus
KISGVKLEE

SEQ ID NO: 446201 - protein, 9 aa, Influenza virus
KISHISPLS

SEQ ID NO: 446202 - protein, 9 aa, Influenza virus
KISKRGGSG

SEQ ID NO: 446203 - protein, 9 aa, Influenza virus
KISKRGNSG

SEQ ID NO: 446204 - protein, 9 aa, Influenza virus
KISKRGSSG

SEQ ID NO: 446205 - protein, 9 aa, Influenza virus
KISKSTKST

SEQ ID NO: 446206 - protein, 9 aa, Influenza virus
KISLGHHAV

SEQ ID NO: 446207 - protein, 9 aa, Influenza virus
KISRRGNSG

SEQ ID NO: 446208 - protein, 9 aa, Influenza virus
KISSSFSFG

SEQ ID NO: 446209 - protein, 9 aa, Influenza virus
KITCVCRDN

SEQ ID NO: 446210 - protein, 9 aa, Influenza virus
KITENSFEQ

SEQ ID NO: 446211 - protein, 9 aa, Influenza virus
KITFEATGN

SEQ ID NO: 446212 - protein, 9 aa, Influenza virus
KITGFAPFS

SEQ ID NO: 446213 - protein, 9 aa, Influenza virus
KITLKFAFN

SEQ ID NO: 446214 - protein, 9 aa, Influenza virus
KITNKINNI

SEQ ID NO: 446215 - protein, 9 aa, Influenza virus
KITNKVNNI

SEQ ID NO: 446216 - protein, 9 aa, Influenza virus
KITVDHMAI

SEQ ID NO: 446217 - protein, 9 aa, Influenza virus
KIVHISPLS

SEQ ID NO: 446218 - protein, 9 aa, Influenza virus
KIVTTVGWS

SEQ ID NO: 446219 - protein, 9 aa, Influenza virus
KIYWHLMHP

SEQ ID NO: 446220 - protein, 9 aa, Influenza virus
KKAKLANVV

SEQ ID NO: 446221 - protein, 9 aa, Influenza virus
KKASLRLAV

SEQ ID NO: 446222 - protein, 9 aa, Influenza virus
KKATRRLIQ

SEQ ID NO: 446223 - protein, 9 aa, Influenza virus
KKAVDLGSC

SEQ ID NO: 446224 - protein, 9 aa, Influenza virus
KKEPDTYDF

SEQ ID NO: 446225 - protein, 9 aa, Influenza virus
KKESLRLAI

SEQ ID NO: 446226 - protein, 9 aa, Influenza virus
KKESLRLAL

SEQ ID NO: 446227 - protein, 9 aa, Influenza virus
KKESLRLAV

SEQ ID NO: 446228 - protein, 9 aa, Influenza virus
KKGTYDYPK

SEQ ID NO: 446229 - protein, 9 aa, Influenza virus
KKHPAYCNT

SEQ ID NO: 446230 - protein, 9 aa, Influenza virus
KKIDDGFLD

SEQ ID NO: 446231 - protein, 9 aa, Influenza virus
KKILRTQES

SEQ ID NO: 446232 - protein, 9 aa, Influenza virus
KKINMINDK

SEQ ID NO: 446233 - protein, 9 aa, Influenza virus
KKKKKKRGL

SEQ ID NO: 446234 - protein, 9 aa, Influenza virus
KKKKKRGLF

SEQ ID NO: 446235 - protein, 9 aa, Influenza virus
KKKKRGLFG

SEQ ID NO: 446236 - protein, 9 aa, Influenza virus
KKKNPEAYN

SEQ ID NO: 446237 - protein, 9 aa, Influenza virus
KKKPDIYDF

SEQ ID NO: 446238 - protein, 9 aa, Influenza virus
KKKPDTYDF

SEQ ID NO: 446239 - protein, 9 aa, Influenza virus
KKKRGLFGA

SEQ ID NO: 446240 - protein, 9 aa, Influenza virus
KKKSYINKT

SEQ ID NO: 446241 - protein, 9 aa, Influenza virus
KKKSYINRT

SEQ ID NO: 446242 - protein, 9 aa, Influenza virus
KKLKREITF

SEQ ID NO: 446243 - protein, 9 aa, Influenza virus
KKLKREMTF

SEQ ID NO: 446244 - protein, 9 aa, Influenza virus
KKMEDGFLD

SEQ ID NO: 446245 - protein, 9 aa, Influenza virus
KKMTITFLI

SEQ ID NO: 446246 - protein, 9 aa, Influenza virus
KKNPEAYNF

SEQ ID NO: 446247 - protein, 9 aa, Influenza virus
KKPDIYDFN

SEQ ID NO: 446248 - protein, 9 aa, Influenza virus
KKPDTYDFN

SEQ ID NO: 446249 - protein, 9 aa, Influenza virus
KKQEIEGIK

SEQ ID NO: 446250 - protein, 9 aa, Influenza virus
KKQILRTQE

SEQ ID NO: 446251 - protein, 9 aa, Influenza virus
KKQLRENAE

SEQ ID NO: 446252 - protein, 9 aa, Influenza virus
KKREKRGLF

SEQ ID NO: 446253 - protein, 9 aa, Influenza virus
KKRGLFGAI

SEQ ID NO: 446254 - protein, 9 aa, Influenza virus
KKRKKRGLF

SEQ ID NO: 446255 - protein, 9 aa, Influenza virus
KKRLGSWSW

SEQ ID NO: 446256 - protein, 9 aa, Influenza virus
KKRRKRGLF

SEQ ID NO: 446257 - protein, 9 aa, Influenza virus
KKSYINKTG

SEQ ID NO: 446258 - protein, 9 aa, Influenza virus
KKSYINRTG

SEQ ID NO: 446259 - protein, 9 aa, Influenza virus
KKTGGPIYK

SEQ ID NO: 446260 - protein, 9 aa, Influenza virus
KKTGGPIYR

SEQ ID NO: 446261 - protein, 9 aa, Influenza virus
KKTNEKFHQ

SEQ ID NO: 446262 - protein, 9 aa, Influenza virus
KKVDDGFID

SEQ ID NO: 446263 - protein, 9 aa, Influenza virus
KKVDDGFLD

SEQ ID NO: 446264 - protein, 9 aa, Influenza virus
KKVDDGLLD

SEQ ID NO: 446265 - protein, 9 aa, Influenza virus
KKYERVKMF

SEQ ID NO: 446266 - protein, 9 aa, Influenza virus
KKYGPALSI

SEQ ID NO: 446267 - protein, 9 aa, Influenza virus
KKYTSARQE

SEQ ID NO: 446268 - protein, 9 aa, Influenza virus
KKYTSGRQE

SEQ ID NO: 446269 - protein, 9 aa, Influenza virus
KLAAICTHL

SEQ ID NO: 446270 - protein, 9 aa, Influenza virus
KLAIGLRNV

SEQ ID NO: 446271 - protein, 9 aa, Influenza virus
KLAIGPRNV

SEQ ID NO: 446272 - protein, 9 aa, Influenza virus
KLANVVRKM

SEQ ID NO: 446273 - protein, 9 aa, Influenza virus
KLAQGYKDI

SEQ ID NO: 446274 - protein, 9 aa, Influenza virus
KLASGLRNV

SEQ ID NO: 446275 - protein, 9 aa, Influenza virus
KLATGLKNV

SEQ ID NO: 446276 - protein, 9 aa, Influenza virus
KLATGLRNI

SEQ ID NO: 446277 - protein, 9 aa, Influenza virus
KLATGLRNV

SEQ ID NO: 446278 - protein, 9 aa, Influenza virus
KLATGMRNI

SEQ ID NO: 446279 - protein, 9 aa, Influenza virus
KLATGMRNV

SEQ ID NO: 446280 - protein, 9 aa, Influenza virus
KLATGPRNV

SEQ ID NO: 446281 - protein, 9 aa, Influenza virus
KLCFPGELD

SEQ ID NO: 446282 - protein, 9 aa, Influenza virus
KLCFPGEVD

SEQ ID NO: 446283 - protein, 9 aa, Influenza virus
KLCKLNGIP

SEQ ID NO: 446284 - protein, 9 aa, Influenza virus
KLCRLRGIP

SEQ ID NO: 446285 - protein, 9 aa, Influenza virus
KLCRLSGIP

SEQ ID NO: 446286 - protein, 9 aa, Influenza virus
KLCYPGELD

SEQ ID NO: 446287 - protein, 9 aa, Influenza virus
KLCYPGEVD

SEQ ID NO: 446288 - protein, 9 aa, Influenza virus
KLDINMADY

SEQ ID NO: 446289 - protein, 9 aa, Influenza virus
KLEDVFAGK

SEQ ID NO: 446290 - protein, 9 aa, Influenza virus
KLEENSTYK

SEQ ID NO: 446291 - protein, 9 aa, Influenza virus
KLEENTSYK

SEQ ID NO: 446292 - protein, 9 aa, Influenza virus
KLEENTTYK

SEQ ID NO: 446293 - protein, 9 aa, Influenza virus
KLEENTTYR

SEQ ID NO: 446294 - protein, 9 aa, Influenza virus
KLEFEPFQS

SEQ ID NO: 446295 - protein, 9 aa, Influenza virus
KLEFIAEEF

SEQ ID NO: 446296 - protein, 9 aa, Influenza virus
KLEKSRING

SEQ ID NO: 446297 - protein, 9 aa, Influenza virus
KLEQSGLPV

SEQ ID NO: 446298 - protein, 9 aa, Influenza virus
KLERSKINE

SEQ ID NO: 446299 - protein, 9 aa, Influenza virus
KLERSKING

SEQ ID NO: 446300 - protein, 9 aa, Influenza virus
KLFALSGVA

SEQ ID NO: 446301 - protein, 9 aa, Influenza virus
KLFASSGIA

SEQ ID NO: 446302 - protein, 9 aa, Influenza virus
KLFERVKRQ

SEQ ID NO: 446303 - protein, 9 aa, Influenza virus
KLFERVRHQ

SEQ ID NO: 446304 - protein, 9 aa, Influenza virus
KLFERVRRQ

SEQ ID NO: 446305 - protein, 9 aa, Influenza virus
KLFTLSGVA

SEQ ID NO: 446306 - protein, 9 aa, Influenza virus
KLGQFPVQT

SEQ ID NO: 446307 - protein, 9 aa, Influenza virus
KLGSPLVLD

SEQ ID NO: 446308 - protein, 9 aa, Influenza virus
KLIDNEFTE

SEQ ID NO: 446309 - protein, 9 aa, Influenza virus
KLILATGLR

SEQ ID NO: 446310 - protein, 9 aa, Influenza virus
KLIQGYKDI

SEQ ID NO: 446311 - protein, 9 aa, Influenza virus
KLIQLIVSG

SEQ ID NO: 446312 - protein, 9 aa, Influenza virus
KLITVGSSK

SEQ ID NO: 446313 - protein, 9 aa, Influenza virus
KLKREITFH

SEQ ID NO: 446314 - protein, 9 aa, Influenza virus
KLKREMTFH

SEQ ID NO: 446315 - protein, 9 aa, Influenza virus
KLKRNEIKG

SEQ ID NO: 446316 - protein, 9 aa, Influenza virus
KLKRQEIDG

SEQ ID NO: 446317 - protein, 9 aa, Influenza virus
KLKRQEIEG

SEQ ID NO: 446318 - protein, 9 aa, Influenza virus
KLKRQEING

SEQ ID NO: 446319 - protein, 9 aa, Influenza virus
KLKRRAIAT

SEQ ID NO: 446320 - protein, 9 aa, Influenza virus
KLKSEDNVY

SEQ ID NO: 446321 - protein, 9 aa, Influenza virus
KLKTEDNIY

SEQ ID NO: 446322 - protein, 9 aa, Influenza virus
KLKTEDNVY

SEQ ID NO: 446323 - protein, 9 aa, Influenza virus
KLLGINMSK

SEQ ID NO: 446324 - protein, 9 aa, Influenza virus
KLLKERGFF

SEQ ID NO: 446325 - protein, 9 aa, Influenza virus
KLLPFAAAP

SEQ ID NO: 446326 - protein, 9 aa, Influenza virus
KLLPFASAP

SEQ ID NO: 446327 - protein, 9 aa, Influenza virus
KLLVLIEND

SEQ ID NO: 446328 - protein, 9 aa, Influenza virus
KLLVLLEND

SEQ ID NO: 446329 - protein, 9 aa, Influenza virus
KLLVLLENE

SEQ ID NO: 446330 - protein, 9 aa, Influenza virus
KLLVLLENG

SEQ ID NO: 446331 - protein, 9 aa, Influenza virus
KLNGIPPLE

SEQ ID NO: 446332 - protein, 9 aa, Influenza virus
KLNNVIDKM

SEQ ID NO: 446333 - protein, 9 aa, Influenza virus
KLNRFIEKT

SEQ ID NO: 446334 - protein, 9 aa, Influenza virus
KLNRIIEKT

SEQ ID NO: 446335 - protein, 9 aa, Influenza virus
KLNRLIDKT

SEQ ID NO: 446336 - protein, 9 aa, Influenza virus
KLNRLIDRT

SEQ ID NO: 446337 - protein, 9 aa, Influenza virus
KLNRLIEKT

SEQ ID NO: 446338 - protein, 9 aa, Influenza virus
KLNRLIERT

SEQ ID NO: 446339 - protein, 9 aa, Influenza virus
KLNRLIGKT

SEQ ID NO: 446340 - protein, 9 aa, Influenza virus
KLNRLISKT

SEQ ID NO: 446341 - protein, 9 aa, Influenza virus
KLNRNEIKG

SEQ ID NO: 446342 - protein, 9 aa, Influenza virus
KLNRQEIEG

SEQ ID NO: 446343 - protein, 9 aa, Influenza virus
KLNRQEIGG

SEQ ID NO: 446344 - protein, 9 aa, Influenza virus
KLNRSEIKG

SEQ ID NO: 446345 - protein, 9 aa, Influenza virus
KLNRTEIKG

SEQ ID NO: 446346 - protein, 9 aa, Influenza virus
KLPFQNLSP

SEQ ID NO: 446347 - protein, 9 aa, Influenza virus
KLRLATGLR

SEQ ID NO: 446348 - protein, 9 aa, Influenza virus
KLRMATGLR

SEQ ID NO: 446349 - protein, 9 aa, Influenza virus
KLRMVTGLR

SEQ ID NO: 446350 - protein, 9 aa, Influenza virus
KLRSGFEML

SEQ ID NO: 446351 - protein, 9 aa, Influenza virus
KLSGGYKDI

SEQ ID NO: 446352 - protein, 9 aa, Influenza virus
KLSGGYKDV

SEQ ID NO: 446353 - protein, 9 aa, Influenza virus
KLSIEDPDH

SEQ ID NO: 446354 - protein, 9 aa, Influenza virus
KLSIEDPNH

SEQ ID NO: 446355 - protein, 9 aa, Influenza virus
KLSIEDPSH

SEQ ID NO: 446356 - protein, 9 aa, Influenza virus
KLSIENPSH

SEQ ID NO: 446357 - protein, 9 aa, Influenza virus
KLSNMGIYQ

SEQ ID NO: 446358 - protein, 9 aa, Influenza virus
KLSNMGVYQ

SEQ ID NO: 446359 - protein, 9 aa, Influenza virus
KLSQMPKEV

SEQ ID NO: 446360 - protein, 9 aa, Influenza virus
KLSQMSKEV

SEQ ID NO: 446361 - protein, 9 aa, Influenza virus
KLSQMSKKV

SEQ ID NO: 446362 - protein, 9 aa, Influenza virus
KLSQMSKNV

SEQ ID NO: 446363 - protein, 9 aa, Influenza virus
KLSQMSREV

SEQ ID NO: 446364 - protein, 9 aa, Influenza virus
KLSSGYKDI

SEQ ID NO: 446365 - protein, 9 aa, Influenza virus
KLSSGYKDV

SEQ ID NO: 446366 - protein, 9 aa, Influenza virus
KLSSGYKEV

SEQ ID NO: 446367 - protein, 9 aa, Influenza virus
KLSSMGIYQ

SEQ ID NO: 446368 - protein, 9 aa, Influenza virus
KLSSMGVYQ

SEQ ID NO: 446369 - protein, 9 aa, Influenza virus
KLTIIYSSS

SEQ ID NO: 446370 - protein, 9 aa, Influenza virus
KLTITYSSP

SEQ ID NO: 446371 - protein, 9 aa, Influenza virus
KLTITYSSS

SEQ ID NO: 446372 - protein, 9 aa, Influenza virus
KLTQGRQTF

SEQ ID NO: 446373 - protein, 9 aa, Influenza virus
KLTQGRQTY

SEQ ID NO: 446374 - protein, 9 aa, Influenza virus
KLTQGYKDI

SEQ ID NO: 446375 - protein, 9 aa, Influenza virus
KLTVTHSVN

SEQ ID NO: 446376 - protein, 9 aa, Influenza virus
KLVDGQDCD

SEQ ID NO: 446377 - protein, 9 aa, Influenza virus
KLVGINMSK

SEQ ID NO: 446378 - protein, 9 aa, Influenza virus
KLVLATGLR

SEQ ID NO: 446379 - protein, 9 aa, Influenza virus
KLVLATGPR

SEQ ID NO: 446380 - protein, 9 aa, Influenza virus
KLYDRVRLQ

SEQ ID NO: 446381 - protein, 9 aa, Influenza virus
KLYEKVRRQ

SEQ ID NO: 446382 - protein, 9 aa, Influenza virus
KLYERVKKQ

SEQ ID NO: 446383 - protein, 9 aa, Influenza virus
KLYERVKRQ

SEQ ID NO: 446384 - protein, 9 aa, Influenza virus
KLYERVRKQ

SEQ ID NO: 446385 - protein, 9 aa, Influenza virus
KLYERVRRQ

SEQ ID NO: 446386 - protein, 9 aa, Influenza virus
KLYGAGNKL

SEQ ID NO: 446387 - protein, 9 aa, Influenza virus
KLYGNGNKL

SEQ ID NO: 446388 - protein, 9 aa, Influenza virus
KLYGSGAKL

SEQ ID NO: 446389 - protein, 9 aa, Influenza virus
KLYGSGNKL

SEQ ID NO: 446390 - protein, 9 aa, Influenza virus
KLYGSGSKL

SEQ ID NO: 446391 - protein, 9 aa, Influenza virus
KLYGTGNKL

SEQ ID NO: 446392 - protein, 9 aa, Influenza virus
KLYIWGIHH

SEQ ID NO: 446393 - protein, 9 aa, Influenza virus
KLYIWGVHH

SEQ ID NO: 446394 - protein, 9 aa, Influenza virus
KLYKKLKRE

SEQ ID NO: 446395 - protein, 9 aa, Influenza virus
KLYKNTNTL

SEQ ID NO: 446396 - protein, 9 aa, Influenza virus
KLYRKLKRE

SEQ ID NO: 446397 - protein, 9 aa, Influenza virus
KLYVNKNPY

SEQ ID NO: 446398 - protein, 9 aa, Influenza virus
KLYVWGVHH

SEQ ID NO: 446399 - protein, 9 aa, Influenza virus
KLYWHLMHP

SEQ ID NO: 446400 - protein, 9 aa, Influenza virus
KLYWHLMRP

SEQ ID NO: 446401 - protein, 9 aa, Influenza virus
KLYWHLMSP

SEQ ID NO: 446402 - protein, 9 aa, Influenza virus
KMARLGKGY

SEQ ID NO: 446403 - protein, 9 aa, Influenza virus
KMARLGRGY

SEQ ID NO: 446404 - protein, 9 aa, Influenza virus
KMEAILVVL

SEQ ID NO: 446405 - protein, 9 aa, Influenza virus
KMEDGFLDV

SEQ ID NO: 446406 - protein, 9 aa, Influenza virus
KMEFEPFQS

SEQ ID NO: 446407 - protein, 9 aa, Influenza virus
KMEKIVLLL

SEQ ID NO: 446408 - protein, 9 aa, Influenza virus
KMFDFIKWN

SEQ ID NO: 446409 - protein, 9 aa, Influenza virus
KMFDFSKWN

SEQ ID NO: 446410 - protein, 9 aa, Influenza virus
KMFDFTKWN

SEQ ID NO: 446411 - protein, 9 aa, Influenza virus
KMGVDEYSN

SEQ ID NO: 446412 - protein, 9 aa, Influenza virus
KMGVDEYSS

SEQ ID NO: 446413 - protein, 9 aa, Influenza virus
KMITQRTIG

SEQ ID NO: 446414 - protein, 9 aa, Influenza virus
KMKAIIVVL

SEQ ID NO: 446415 - protein, 9 aa, Influenza virus
KMKAILVVL

SEQ ID NO: 446416 - protein, 9 aa, Influenza virus
KMKWGMELR

SEQ ID NO: 446417 - protein, 9 aa, Influenza virus
KMKWGMEMR

SEQ ID NO: 446418 - protein, 9 aa, Influenza virus
KMMTNSQDT

SEQ ID NO: 446419 - protein, 9 aa, Influenza virus
KMMTSSQDT

SEQ ID NO: 446420 - protein, 9 aa, Influenza virus
KMNGNYDSI

SEQ ID NO: 446421 - protein, 9 aa, Influenza virus
KMNIQFTAV

SEQ ID NO: 446422 - protein, 9 aa, Influenza virus
KMNIQFTSV

SEQ ID NO: 446423 - protein, 9 aa, Influenza virus
KMNIQILIL

SEQ ID NO: 446424 - protein, 9 aa, Influenza virus
KMNNQILIL

SEQ ID NO: 446425 - protein, 9 aa, Influenza virus
KMNPNKKII

SEQ ID NO: 446426 - protein, 9 aa, Influenza virus
KMNPNQKII

SEQ ID NO: 446427 - protein, 9 aa, Influenza virus
KMNPNQKIM

SEQ ID NO: 446428 - protein, 9 aa, Influenza virus
KMNREFEVM

SEQ ID NO: 446429 - protein, 9 aa, Influenza virus
KMNREFEVV

SEQ ID NO: 446430 - protein, 9 aa, Influenza virus
KMNREFGVV

SEQ ID NO: 446431 - protein, 9 aa, Influenza virus
KMNTKILVL

SEQ ID NO: 446432 - protein, 9 aa, Influenza virus
KMNTQFDAV

SEQ ID NO: 446433 - protein, 9 aa, Influenza virus
KMNTQFEAI

SEQ ID NO: 446434 - protein, 9 aa, Influenza virus
KMNTQFEAV

SEQ ID NO: 446435 - protein, 9 aa, Influenza virus
KMNTQFETV

SEQ ID NO: 446436 - protein, 9 aa, Influenza virus
KMNTQFTAV

SEQ ID NO: 446437 - protein, 9 aa, Influenza virus
KMNTQILIF

SEQ ID NO: 446438 - protein, 9 aa, Influenza virus
KMNTQILIL

SEQ ID NO: 446439 - protein, 9 aa, Influenza virus
KMNTQILVF

SEQ ID NO: 446440 - protein, 9 aa, Influenza virus
KMNTRILIL

SEQ ID NO: 446441 - protein, 9 aa, Influenza virus
KMPASRYLT

SEQ ID NO: 446442 - protein, 9 aa, Influenza virus
KMQFSSLTV

SEQ ID NO: 446443 - protein, 9 aa, Influenza virus
KMQLRDNAK

SEQ ID NO: 446444 - protein, 9 aa, Influenza virus
KMRDSIKSW

SEQ ID NO: 446445 - protein, 9 aa, Influenza virus
KMSLLTEVE

SEQ ID NO: 446446 - protein, 9 aa, Influenza virus
KMTDSIKSW

SEQ ID NO: 446447 - protein, 9 aa, Influenza virus
KMTIASDIL

SEQ ID NO: 446448 - protein, 9 aa, Influenza virus
KMTITFLIL

SEQ ID NO: 446449 - protein, 9 aa, Influenza virus
KMVLSAFDE

SEQ ID NO: 446450 - protein, 9 aa, Influenza virus
KMVTQRTIG

SEQ ID NO: 446451 - protein, 9 aa, Influenza virus
KMVTQRTVG

SEQ ID NO: 446452 - protein, 9 aa, Influenza virus
KMYALHQGT

SEQ ID NO: 446453 - protein, 9 aa, Influenza virus
KNADLEALM

SEQ ID NO: 446454 - protein, 9 aa, Influenza virus
KNALGDCPK

SEQ ID NO: 446455 - protein, 9 aa, Influenza virus
KNALGECPK

SEQ ID NO: 446456 - protein, 9 aa, Influenza virus
KNALYGTQS

SEQ ID NO: 446457 - protein, 9 aa, Influenza virus
KNANTLSSV

SEQ ID NO: 446458 - protein, 9 aa, Influenza virus
KNANTLTSV

SEQ ID NO: 446459 - protein, 9 aa, Influenza virus
KNATASFIY

SEQ ID NO: 446460 - protein, 9 aa, Influenza virus
KNATATVYY

SEQ ID NO: 446461 - protein, 9 aa, Influenza virus
KNCINRCFY

SEQ ID NO: 446462 - protein, 9 aa, Influenza virus
KNCTLIDAL

SEQ ID NO: 446463 - protein, 9 aa, Influenza virus
KNDDIDQSL

SEQ ID NO: 446464 - protein, 9 aa, Influenza virus
KNDDVDQSL

SEQ ID NO: 446465 - protein, 9 aa, Influenza virus
KNDEVDQSL

SEQ ID NO: 446466 - protein, 9 aa, Influenza virus
KNDLYGTQP

SEQ ID NO: 446467 - protein, 9 aa, Influenza virus
KNDLYGTQS

SEQ ID NO: 446468 - protein, 9 aa, Influenza virus
KNEIKGVKL

SEQ ID NO: 446469 - protein, 9 aa, Influenza virus
KNELYGTQS

SEQ ID NO: 446470 - protein, 9 aa, Influenza virus
KNGNHAVHY

SEQ ID NO: 446471 - protein, 9 aa, Influenza virus
KNGNLRCTI

SEQ ID NO: 446472 - protein, 9 aa, Influenza virus
KNGNMQCTI

SEQ ID NO: 446473 - protein, 9 aa, Influenza virus
KNGNMRCTI

SEQ ID NO: 446474 - protein, 9 aa, Influenza virus
KNGNMRGTN

SEQ ID NO: 446475 - protein, 9 aa, Influenza virus
KNGTYDHKD

SEQ ID NO: 446476 - protein, 9 aa, Influenza virus
KNGTYDHKE

SEQ ID NO: 446477 - protein, 9 aa, Influenza virus
KNGTYDYPK

SEQ ID NO: 446478 - protein, 9 aa, Influenza virus
KNGTYKYPK

SEQ ID NO: 446479 - protein, 9 aa, Influenza virus
KNGTYNHKD

SEQ ID NO: 446480 - protein, 9 aa, Influenza virus
KNGTYNHKE

SEQ ID NO: 446481 - protein, 9 aa, Influenza virus
KNGTYNRKE

SEQ ID NO: 446482 - protein, 9 aa, Influenza virus
KNGTYNYPK

SEQ ID NO: 446483 - protein, 9 aa, Influenza virus
KNGTYYYPK

SEQ ID NO: 446484 - protein, 9 aa, Influenza virus
KNILEKTHN

SEQ ID NO: 446485 - protein, 9 aa, Influenza virus
KNILRTQES

SEQ ID NO: 446486 - protein, 9 aa, Influenza virus
KNITEIVYL

SEQ ID NO: 446487 - protein, 9 aa, Influenza virus
KNITKIVYL

SEQ ID NO: 446488 - protein, 9 aa, Influenza virus
KNITVTHAQ

SEQ ID NO: 446489 - protein, 9 aa, Influenza virus
KNITVTHSV

SEQ ID NO: 446490 - protein, 9 aa, Influenza virus
KNLFDEVKR

SEQ ID NO: 446491 - protein, 9 aa, Influenza virus
KNLFDEVRR

SEQ ID NO: 446492 - protein, 9 aa, Influenza virus
KNLHDQIKR

SEQ ID NO: 446493 - protein, 9 aa, Influenza virus
KNLHEQVKR

SEQ ID NO: 446494 - protein, 9 aa, Influenza virus
KNLYDKVRL

SEQ ID NO: 446495 - protein, 9 aa, Influenza virus
KNLYDKVRM

SEQ ID NO: 446496 - protein, 9 aa, Influenza virus
KNLYDRVRL

SEQ ID NO: 446497 - protein, 9 aa, Influenza virus
KNLYEKVRL

SEQ ID NO: 446498 - protein, 9 aa, Influenza virus
KNLYEKVRM

SEQ ID NO: 446499 - protein, 9 aa, Influenza virus
KNLYNKVRM

SEQ ID NO: 446500 - protein, 9 aa, Influenza virus
KNNAIDEGD

SEQ ID NO: 446501 - protein, 9 aa, Influenza virus
KNNAKDEGN

SEQ ID NO: 446502 - protein, 9 aa, Influenza virus
KNNMINNDL

SEQ ID NO: 446503 - protein, 9 aa, Influenza virus
KNNQVILCE

SEQ ID NO: 446504 - protein, 9 aa, Influenza virus
KNNQVILCG

SEQ ID NO: 446505 - protein, 9 aa, Influenza virus
KNNWSGYSG

SEQ ID NO: 446506 - protein, 9 aa, Influenza virus
KNPALRMKW

SEQ ID NO: 446507 - protein, 9 aa, Influenza virus
KNPAYCNTD

SEQ ID NO: 446508 - protein, 9 aa, Influenza virus
KNPEAYNFN

SEQ ID NO: 446509 - protein, 9 aa, Influenza virus
KNPSLRMKW

SEQ ID NO: 446510 - protein, 9 aa, Influenza virus
KNPYTLVST

SEQ ID NO: 446511 - protein, 9 aa, Influenza virus
KNQEELRSL

SEQ ID NO: 446512 - protein, 9 aa, Influenza virus
KNRSPYRAL

SEQ ID NO: 446513 - protein, 9 aa, Influenza virus
KNSDLEALM

SEQ ID NO: 446514 - protein, 9 aa, Influenza virus
KNSFYAELK

SEQ ID NO: 446515 - protein, 9 aa, Influenza virus
KNSNGVQDI

SEQ ID NO: 446516 - protein, 9 aa, Influenza virus
KNSRSGYET

SEQ ID NO: 446517 - protein, 9 aa, Influenza virus
KNTDLEALM

SEQ ID NO: 446518 - protein, 9 aa, Influenza virus
KNTDLEVLM

SEQ ID NO: 446519 - protein, 9 aa, Influenza virus
KNTKGRDVL

SEQ ID NO: 446520 - protein, 9 aa, Influenza virus
KNTNTLSSV

SEQ ID NO: 446521 - protein, 9 aa, Influenza virus
KNTYVNNTT

SEQ ID NO: 446522 - protein, 9 aa, Influenza virus
KNVAVTHSV

SEQ ID NO: 446523 - protein, 9 aa, Influenza virus
KNVIFTHAQ

SEQ ID NO: 446524 - protein, 9 aa, Influenza virus
KNVPEKIHT

SEQ ID NO: 446525 - protein, 9 aa, Influenza virus
KNVPEKIRT

SEQ ID NO: 446526 - protein, 9 aa, Influenza virus
KNVPEKIRV

SEQ ID NO: 446527 - protein, 9 aa, Influenza virus
KNVTVTHAK

SEQ ID NO: 446528 - protein, 9 aa, Influenza virus
KNVTVTHAQ

SEQ ID NO: 446529 - protein, 9 aa, Influenza virus
KNVTVTHAV

SEQ ID NO: 446530 - protein, 9 aa, Influenza virus
KNVTVTHSI

SEQ ID NO: 446531 - protein, 9 aa, Influenza virus
KNVTVTHSV

SEQ ID NO: 446532 - protein, 9 aa, Influenza virus
KNVTVTHTQ

SEQ ID NO: 446533 - protein, 9 aa, Influenza virus
KNWILWISF

SEQ ID NO: 446534 - protein, 9 aa, Influenza virus
KNWSGYSGA

SEQ ID NO: 446535 - protein, 9 aa, Influenza virus
KNWSGYSGS

SEQ ID NO: 446536 - protein, 9 aa, Influenza virus
KPCFWVELI

SEQ ID NO: 446537 - protein, 9 aa, Influenza virus
KPDIYDFNE

SEQ ID NO: 446538 - protein, 9 aa, Influenza virus
KPDTYDFNE

SEQ ID NO: 446539 - protein, 9 aa, Influenza virus
KPFHNISRI

SEQ ID NO: 446540 - protein, 9 aa, Influenza virus
KPFQNASRH

SEQ ID NO: 446541 - protein, 9 aa, Influenza virus
KPFQNASRY

SEQ ID NO: 446542 - protein, 9 aa, Influenza virus
KPFQNICKP

SEQ ID NO: 446543 - protein, 9 aa, Influenza virus
KPFQNISRI

SEQ ID NO: 446544 - protein, 9 aa, Influenza virus
KPFQNISRV

SEQ ID NO: 446545 - protein, 9 aa, Influenza virus
KPFQNTSKH

SEQ ID NO: 446546 - protein, 9 aa, Influenza virus
KPFQNTSRH

SEQ ID NO: 446547 - protein, 9 aa, Influenza virus
KPFQNVNKI

SEQ ID NO: 446548 - protein, 9 aa, Influenza virus
KPFQNVNKV

SEQ ID NO: 446549 - protein, 9 aa, Influenza virus
KPFQNVNRI

SEQ ID NO: 446550 - protein, 9 aa, Influenza virus
KPFQNVSRI

SEQ ID NO: 446551 - protein, 9 aa, Influenza virus
KPFQNVSRT

SEQ ID NO: 446552 - protein, 9 aa, Influenza virus
KPGETLKVE

SEQ ID NO: 446553 - protein, 9 aa, Influenza virus
KPGETLNIE

SEQ ID NO: 446554 - protein, 9 aa, Influenza virus
KPGETLNVE

SEQ ID NO: 446555 - protein, 9 aa, Influenza virus
KPGQTLRIR

SEQ ID NO: 446556 - protein, 9 aa, Influenza virus
KPGQTLRVK

SEQ ID NO: 446557 - protein, 9 aa, Influenza virus
KPGQTLRVR

SEQ ID NO: 446558 - protein, 9 aa, Influenza virus
KPGQTVKIK

SEQ ID NO: 446559 - protein, 9 aa, Influenza virus
KPGQTVKIQ

SEQ ID NO: 446560 - protein, 9 aa, Influenza virus
KPKFLPDLY

SEQ ID NO: 446561 - protein, 9 aa, Influenza virus
KPKSLPDLY

SEQ ID NO: 446562 - protein, 9 aa, Influenza virus
KPKYLPDLY

SEQ ID NO: 446563 - protein, 9 aa, Influenza virus
KPLCAVNSW

SEQ ID NO: 446564 - protein, 9 aa, Influenza virus
KPLCEVNSW

SEQ ID NO: 446565 - protein, 9 aa, Influenza virus
KPLCEVSSW

SEQ ID NO: 446566 - protein, 9 aa, Influenza virus
KPLILGDCS

SEQ ID NO: 446567 - protein, 9 aa, Influenza virus
KPLILKDCS

SEQ ID NO: 446568 - protein, 9 aa, Influenza virus
KPLILRDCS

SEQ ID NO: 446569 - protein, 9 aa, Influenza virus
KPLKLVDGQ

SEQ ID NO: 446570 - protein, 9 aa, Influenza virus
KPLQNASRH

SEQ ID NO: 446571 - protein, 9 aa, Influenza virus
KPLQNTSKH

SEQ ID NO: 446572 - protein, 9 aa, Influenza virus
KPNGCIEGK

SEQ ID NO: 446573 - protein, 9 aa, Influenza virus
KPNIGPRPF

SEQ ID NO: 446574 - protein, 9 aa, Influenza virus
KPNIGPRPL

SEQ ID NO: 446575 - protein, 9 aa, Influenza virus
KPPLPLCPF

SEQ ID NO: 446576 - protein, 9 aa, Influenza virus
KPQCEITGF

SEQ ID NO: 446577 - protein, 9 aa, Influenza virus
KPQCHITGF

SEQ ID NO: 446578 - protein, 9 aa, Influenza virus
KPQCKITGF

SEQ ID NO: 446579 - protein, 9 aa, Influenza virus
KPQCLITGF

SEQ ID NO: 446580 - protein, 9 aa, Influenza virus
KPQCQIAGF

SEQ ID NO: 446581 - protein, 9 aa, Influenza virus
KPQCQITGF

SEQ ID NO: 446582 - protein, 9 aa, Influenza virus
KPQCQITGS

SEQ ID NO: 446583 - protein, 9 aa, Influenza virus
KPQCQVTGF

SEQ ID NO: 446584 - protein, 9 aa, Influenza virus
KPRFLPDLY

SEQ ID NO: 446585 - protein, 9 aa, Influenza virus
KPRGLFGAI

SEQ ID NO: 446586 - protein, 9 aa, Influenza virus
KPRPRRGLF

SEQ ID NO: 446587 - protein, 9 aa, Influenza virus
KPRYLPDLY

SEQ ID NO: 446588 - protein, 9 aa, Influenza virus
KPSLPLCPF

SEQ ID NO: 446589 - protein, 9 aa, Influenza virus
KPWARNILR

SEQ ID NO: 446590 - protein, 9 aa, Influenza virus
KPYIGKCPK

SEQ ID NO: 446591 - protein, 9 aa, Influenza virus
KQAKGLFGA

SEQ ID NO: 446592 - protein, 9 aa, Influenza virus
KQASYKIFK

SEQ ID NO: 446593 - protein, 9 aa, Influenza virus
KQDGKSSAC

SEQ ID NO: 446594 - protein, 9 aa, Influenza virus
KQEFKMNPN

SEQ ID NO: 446595 - protein, 9 aa, Influenza virus
KQEIEGIKL

SEQ ID NO: 446596 - protein, 9 aa, Influenza virus
KQEIKMNPN

SEQ ID NO: 446597 - protein, 9 aa, Influenza virus
KQESLLLAT

SEQ ID NO: 446598 - protein, 9 aa, Influenza virus
KQESLMLAT

SEQ ID NO: 446599 - protein, 9 aa, Influenza virus
KQETRVWWT

SEQ ID NO: 446600 - protein, 9 aa, Influenza virus
KQFELIDNE

SEQ ID NO: 446601 - protein, 9 aa, Influenza virus
KQGKTKATK

SEQ ID NO: 446602 - protein, 9 aa, Influenza virus
KQGNSVWAG

SEQ ID NO: 446603 - protein, 9 aa, Influenza virus
KQGSLKLAT

SEQ ID NO: 446604 - protein, 9 aa, Influenza virus
KQGSLMLAT

SEQ ID NO: 446605 - protein, 9 aa, Influenza virus
KQGSLRLAT

SEQ ID NO: 446606 - protein, 9 aa, Influenza virus
KQIDTIMEK

SEQ ID NO: 446607 - protein, 9 aa, Influenza virus
KQIGNVINW

SEQ ID NO: 446608 - protein, 9 aa, Influenza virus
KQILRTQES

SEQ ID NO: 446609 - protein, 9 aa, Influenza virus
KQKSLLLAT

SEQ ID NO: 446610 - protein, 9 aa, Influenza virus
KQKTLKLAT

SEQ ID NO: 446611 - protein, 9 aa, Influenza virus
KQLGNVINW

SEQ ID NO: 446612 - protein, 9 aa, Influenza virus
KQLRENAED

SEQ ID NO: 446613 - protein, 9 aa, Influenza virus
KQLRENAEE

SEQ ID NO: 446614 - protein, 9 aa, Influenza virus
KQLRQNAEE

SEQ ID NO: 446615 - protein, 9 aa, Influenza virus
KQLTHHMRK

SEQ ID NO: 446616 - protein, 9 aa, Influenza virus
KQMTRGLFG

SEQ ID NO: 446617 - protein, 9 aa, Influenza virus
KQNGKSGAC

SEQ ID NO: 446618 - protein, 9 aa, Influenza virus
KQNGKSSAC

SEQ ID NO: 446619 - protein, 9 aa, Influenza virus
KQNPTEEQA

SEQ ID NO: 446620 - protein, 9 aa, Influenza virus
KQNTLKLAT

SEQ ID NO: 446621 - protein, 9 aa, Influenza virus
KQPISLGDC

SEQ ID NO: 446622 - protein, 9 aa, Influenza virus
KQSRMQFSS

SEQ ID NO: 446623 - protein, 9 aa, Influenza virus
KQSSLPLAL

SEQ ID NO: 446624 - protein, 9 aa, Influenza virus
KQSTLKLAT

SEQ ID NO: 446625 - protein, 9 aa, Influenza virus
KQTKTMTIT

SEQ ID NO: 446626 - protein, 9 aa, Influenza virus
KQTRGIFGA

SEQ ID NO: 446627 - protein, 9 aa, Influenza virus
KQTRGLFGA

SEQ ID NO: 446628 - protein, 9 aa, Influenza virus
KQTSLLLAT

SEQ ID NO: 446629 - protein, 9 aa, Influenza virus
KQVCAAWSS

SEQ ID NO: 446630 - protein, 9 aa, Influenza virus
KQVCIAWSS

SEQ ID NO: 446631 - protein, 9 aa, Influenza virus
KQVCIAYSS

SEQ ID NO: 446632 - protein, 9 aa, Influenza virus
KQVCMAWSS

SEQ ID NO: 446633 - protein, 9 aa, Influenza virus
KQVCVAWSS

SEQ ID NO: 446634 - protein, 9 aa, Influenza virus
KQVDTIMEK

SEQ ID NO: 446635 - protein, 9 aa, Influenza virus
KRCINRCFY

SEQ ID NO: 446636 - protein, 9 aa, Influenza virus
KRDSSILTD

SEQ ID NO: 446637 - protein, 9 aa, Influenza virus
KREITFHGA

SEQ ID NO: 446638 - protein, 9 aa, Influenza virus
KREMTFHGA

SEQ ID NO: 446639 - protein, 9 aa, Influenza virus
KRFADQELG

SEQ ID NO: 446640 - protein, 9 aa, Influenza virus
KRGETLKIR

SEQ ID NO: 446641 - protein, 9 aa, Influenza virus
KRGGSGIMK

SEQ ID NO: 446642 - protein, 9 aa, Influenza virus
KRGINDRNF

SEQ ID NO: 446643 - protein, 9 aa, Influenza virus
KRGLFGAIA

SEQ ID NO: 446644 - protein, 9 aa, Influenza virus
KRGNSGIMK

SEQ ID NO: 446645 - protein, 9 aa, Influenza virus
KRGSSGIMK

SEQ ID NO: 446646 - protein, 9 aa, Influenza virus
KRGSSGIVK

SEQ ID NO: 446647 - protein, 9 aa, Influenza virus
KRGSSGVMK

SEQ ID NO: 446648 - protein, 9 aa, Influenza virus
KRGVNDRNF

SEQ ID NO: 446649 - protein, 9 aa, Influenza virus
KRIENLNKK

SEQ ID NO: 446650 - protein, 9 aa, Influenza virus
KRIGSCTSP

SEQ ID NO: 446651 - protein, 9 aa, Influenza virus
KRINMIADR

SEQ ID NO: 446652 - protein, 9 aa, Influenza virus
KRINMINDK

SEQ ID NO: 446653 - protein, 9 aa, Influenza virus
KRINMISDK

SEQ ID NO: 446654 - protein, 9 aa, Influenza virus
KRINMLADR

SEQ ID NO: 446655 - protein, 9 aa, Influenza virus
KRINMLADW

SEQ ID NO: 446656 - protein, 9 aa, Influenza virus
KRINVINDK

SEQ ID NO: 446657 - protein, 9 aa, Influenza virus
KRIRLFDYS

SEQ ID NO: 446658 - protein, 9 aa, Influenza virus
KRKKRGLFG

SEQ ID NO: 446659 - protein, 9 aa, Influenza virus
KRKRDSSIL

SEQ ID NO: 446660 - protein, 9 aa, Influenza virus
KRKRGLFGA

SEQ ID NO: 446661 - protein, 9 aa, Influenza virus
KRKRKTRGL

SEQ ID NO: 446662 - protein, 9 aa, Influenza virus
KRKRNSSIL

SEQ ID NO: 446663 - protein, 9 aa, Influenza virus
KRKTRGLFG

SEQ ID NO: 446664 - protein, 9 aa, Influenza virus
KRLAVLGKD

SEQ ID NO: 446665 - protein, 9 aa, Influenza virus
KRLCKVEGW

SEQ ID NO: 446666 - protein, 9 aa, Influenza virus
KRLCTINSW

SEQ ID NO: 446667 - protein, 9 aa, Influenza virus
KRLENLDKK

SEQ ID NO: 446668 - protein, 9 aa, Influenza virus
KRLENLNKK

SEQ ID NO: 446669 - protein, 9 aa, Influenza virus
KRLGNLNKK

SEQ ID NO: 446670 - protein, 9 aa, Influenza virus
KRLGSWSWH

SEQ ID NO: 446671 - protein, 9 aa, Influenza virus
KRLLRENAE

SEQ ID NO: 446672 - protein, 9 aa, Influenza virus
KRLTIIGKD

SEQ ID NO: 446673 - protein, 9 aa, Influenza virus
KRLTILGKD

SEQ ID NO: 446674 - protein, 9 aa, Influenza virus
KRLTTTIKT

SEQ ID NO: 446675 - protein, 9 aa, Influenza virus
KRLTVLGKD

SEQ ID NO: 446676 - protein, 9 aa, Influenza virus
KRLVLATGL

SEQ ID NO: 446677 - protein, 9 aa, Influenza virus
KRMGLQMQR

SEQ ID NO: 446678 - protein, 9 aa, Influenza virus
KRMGVQIQR

SEQ ID NO: 446679 - protein, 9 aa, Influenza virus
KRMGVQLQR

SEQ ID NO: 446680 - protein, 9 aa, Influenza virus
KRMGVQMHR

SEQ ID NO: 446681 - protein, 9 aa, Influenza virus
KRMGVQMQR

SEQ ID NO: 446682 - protein, 9 aa, Influenza virus
KRMTRGLFG

SEQ ID NO: 446683 - protein, 9 aa, Influenza virus
KRNEIKGVE

SEQ ID NO: 446684 - protein, 9 aa, Influenza virus
KRNEIKGVK

SEQ ID NO: 446685 - protein, 9 aa, Influenza virus
KRNITEIVY

SEQ ID NO: 446686 - protein, 9 aa, Influenza virus
KRNRSILNT

SEQ ID NO: 446687 - protein, 9 aa, Influenza virus
KRNSSILTD

SEQ ID NO: 446688 - protein, 9 aa, Influenza virus
KRPVTEINT

SEQ ID NO: 446689 - protein, 9 aa, Influenza virus
KRQEIDGIK

SEQ ID NO: 446690 - protein, 9 aa, Influenza virus
KRQEIEGIK

SEQ ID NO: 446691 - protein, 9 aa, Influenza virus
KRQEIEGIR

SEQ ID NO: 446692 - protein, 9 aa, Influenza virus
KRQEINGIK

SEQ ID NO: 446693 - protein, 9 aa, Influenza virus
KRQLRENAE

SEQ ID NO: 446694 - protein, 9 aa, Influenza virus
KRRAIATPG

SEQ ID NO: 446695 - protein, 9 aa, Influenza virus
KRRIRDNMT

SEQ ID NO: 446696 - protein, 9 aa, Influenza virus
KRRKKRGLF

SEQ ID NO: 446697 - protein, 9 aa, Influenza virus
KRRPVAKAG

SEQ ID NO: 446698 - protein, 9 aa, Influenza virus
KRRVRDNIT

SEQ ID NO: 446699 - protein, 9 aa, Influenza virus
KRRVRDNMT

SEQ ID NO: 446700 - protein, 9 aa, Influenza virus
KRRVRDNVT

SEQ ID NO: 446701 - protein, 9 aa, Influenza virus
KRRVRDSMT

SEQ ID NO: 446702 - protein, 9 aa, Influenza virus
KRSHEQMET

SEQ ID NO: 446703 - protein, 9 aa, Influenza virus
KRSYEQMET

SEQ ID NO: 446704 - protein, 9 aa, Influenza virus
KRSYNNTSG

SEQ ID NO: 446705 - protein, 9 aa, Influenza virus
KRTNMINDK

SEQ ID NO: 446706 - protein, 9 aa, Influenza virus
KRTVSSFYS

SEQ ID NO: 446707 - protein, 9 aa, Influenza virus
KRVRLFDYS

SEQ ID NO: 446708 - protein, 9 aa, Influenza virus
KRYELEIGA

SEQ ID NO: 446709 - protein, 9 aa, Influenza virus
KRYELEIGT

SEQ ID NO: 446710 - protein, 9 aa, Influenza virus
KRYERVKMF

SEQ ID NO: 446711 - protein, 9 aa, Influenza virus
KRYGPALSI

SEQ ID NO: 446712 - protein, 9 aa, Influenza virus
KSCINRCFY

SEQ ID NO: 446713 - protein, 9 aa, Influenza virus
KSCLPACAY

SEQ ID NO: 446714 - protein, 9 aa, Influenza virus
KSCLPACIY

SEQ ID NO: 446715 - protein, 9 aa, Influenza virus
KSCLPACVY

SEQ ID NO: 446716 - protein, 9 aa, Influenza virus
KSCVNRCFY

SEQ ID NO: 446717 - protein, 9 aa, Influenza virus
KSDKICIGY

SEQ ID NO: 446718 - protein, 9 aa, Influenza virus
KSDKICLGH

SEQ ID NO: 446719 - protein, 9 aa, Influenza virus
KSDKRIGSC

SEQ ID NO: 446720 - protein, 9 aa, Influenza virus
KSDQLKLAT

SEQ ID NO: 446721 - protein, 9 aa, Influenza virus
KSDRICIGY

SEQ ID NO: 446722 - protein, 9 aa, Influenza virus
KSDRLVLAT

SEQ ID NO: 446723 - protein, 9 aa, Influenza virus
KSDVLVTRE

SEQ ID NO: 446724 - protein, 9 aa, Influenza virus
KSEDNVYKV

SEQ ID NO: 446725 - protein, 9 aa, Influenza virus
KSEKLVLAT

SEQ ID NO: 446726 - protein, 9 aa, Influenza virus
KSEQFPVQT

SEQ ID NO: 446727 - protein, 9 aa, Influenza virus
KSERLVLAT

SEQ ID NO: 446728 - protein, 9 aa, Influenza virus
KSFSRTELI

SEQ ID NO: 446729 - protein, 9 aa, Influenza virus
KSFSRTQLI

SEQ ID NO: 446730 - protein, 9 aa, Influenza virus
KSFYRNLVW

SEQ ID NO: 446731 - protein, 9 aa, Influenza virus
KSGACKRAD

SEQ ID NO: 446732 - protein, 9 aa, Influenza virus
KSGACKRAN

SEQ ID NO: 446733 - protein, 9 aa, Influenza virus
KSGQFPVQT

SEQ ID NO: 446734 - protein, 9 aa, Influenza virus
KSGQLKLAT

SEQ ID NO: 446735 - protein, 9 aa, Influenza virus
KSHGRILKN

SEQ ID NO: 446736 - protein, 9 aa, Influenza virus
KSHGRVLKN

SEQ ID NO: 446737 - protein, 9 aa, Influenza virus
KSITQTLVS

SEQ ID NO: 446738 - protein, 9 aa, Influenza virus
KSKLFTLSG

SEQ ID NO: 446739 - protein, 9 aa, Influenza virus
KSKRLVLAT

SEQ ID NO: 446740 - protein, 9 aa, Influenza virus
KSLCEVNSW

SEQ ID NO: 446741 - protein, 9 aa, Influenza virus
KSLCKIEGW

SEQ ID NO: 446742 - protein, 9 aa, Influenza virus
KSLCKVEGW

SEQ ID NO: 446743 - protein, 9 aa, Influenza virus
KSLCNVEGW

SEQ ID NO: 446744 - protein, 9 aa, Influenza virus
KSLCSVEGW

SEQ ID NO: 446745 - protein, 9 aa, Influenza virus
KSLESRRGF

SEQ ID NO: 446746 - protein, 9 aa, Influenza virus
KSLESRSGF

SEQ ID NO: 446747 - protein, 9 aa, Influenza virus
KSLFSSIKK

SEQ ID NO: 446748 - protein, 9 aa, Influenza virus
KSLGIQSDA

SEQ ID NO: 446749 - protein, 9 aa, Influenza virus
KSLIWLWLV

SEQ ID NO: 446750 - protein, 9 aa, Influenza virus
KSLKLASGL

SEQ ID NO: 446751 - protein, 9 aa, Influenza virus
KSLKLATGL

SEQ ID NO: 446752 - protein, 9 aa, Influenza virus
KSLKLATGP

SEQ ID NO: 446753 - protein, 9 aa, Influenza virus
KSLKLVTGL

SEQ ID NO: 446754 - protein, 9 aa, Influenza virus
KSLLLATGM

SEQ ID NO: 446755 - protein, 9 aa, Influenza virus
KSLMLATGM

SEQ ID NO: 446756 - protein, 9 aa, Influenza virus
KSLPDLYDY

SEQ ID NO: 446757 - protein, 9 aa, Influenza virus
KSLRGRGST

SEQ ID NO: 446758 - protein, 9 aa, Influenza virus
KSLTQTLVS

SEQ ID NO: 446759 - protein, 9 aa, Influenza virus
KSLYDKVRM

SEQ ID NO: 446760 - protein, 9 aa, Influenza virus
KSNAIDEGD

SEQ ID NO: 446761 - protein, 9 aa, Influenza virus
KSNGNLIAP

SEQ ID NO: 446762 - protein, 9 aa, Influenza virus
KSPLPLCPF

SEQ ID NO: 446763 - protein, 9 aa, Influenza virus
KSQLIWMAC

SEQ ID NO: 446764 - protein, 9 aa, Influenza virus
KSQLVWMAC

SEQ ID NO: 446765 - protein, 9 aa, Influenza virus
KSRGYKMNI

SEQ ID NO: 446766 - protein, 9 aa, Influenza virus
KSRGYKMNN

SEQ ID NO: 446767 - protein, 9 aa, Influenza virus
KSRGYKMNT

SEQ ID NO: 446768 - protein, 9 aa, Influenza virus
KSRINGVKL

SEQ ID NO: 446769 - protein, 9 aa, Influenza virus
KSRSIIFNM

SEQ ID NO: 446770 - protein, 9 aa, Influenza virus
KSRSNIFNM

SEQ ID NO: 446771 - protein, 9 aa, Influenza virus
KSRVDNHSM

SEQ ID NO: 446772 - protein, 9 aa, Influenza virus
KSSACKRAN

SEQ ID NO: 446773 - protein, 9 aa, Influenza virus
KSSLPLCPF

SEQ ID NO: 446774 - protein, 9 aa, Influenza virus
KSTKSTVLK

SEQ ID NO: 446775 - protein, 9 aa, Influenza virus
KSTPSAIDQ

SEQ ID NO: 446776 - protein, 9 aa, Influenza virus
KSTQAAIDK

SEQ ID NO: 446777 - protein, 9 aa, Influenza virus
KSTQAAIDQ

SEQ ID NO: 446778 - protein, 9 aa, Influenza virus
KSTQAAINQ

SEQ ID NO: 446779 - protein, 9 aa, Influenza virus
KSTQAAVDQ

SEQ ID NO: 446780 - protein, 9 aa, Influenza virus
KSTQAAVNQ

SEQ ID NO: 446781 - protein, 9 aa, Influenza virus
KSTQEAIDK

SEQ ID NO: 446782 - protein, 9 aa, Influenza virus
KSTQEAIEK

SEQ ID NO: 446783 - protein, 9 aa, Influenza virus
KSTQEAIGK

SEQ ID NO: 446784 - protein, 9 aa, Influenza virus
KSTQEAINK

SEQ ID NO: 446785 - protein, 9 aa, Influenza virus
KSTQKAIDG

SEQ ID NO: 446786 - protein, 9 aa, Influenza virus
KSTQKTIDQ

SEQ ID NO: 446787 - protein, 9 aa, Influenza virus
KSTQSAIDQ

SEQ ID NO: 446788 - protein, 9 aa, Influenza virus
KSTQSAINQ

SEQ ID NO: 446789 - protein, 9 aa, Influenza virus
KSTQSAVDQ

SEQ ID NO: 446790 - protein, 9 aa, Influenza virus
KSTQSAVNQ

SEQ ID NO: 446791 - protein, 9 aa, Influenza virus
KSTQTAIDQ

SEQ ID NO: 446792 - protein, 9 aa, Influenza virus
KSTVLKSDK

SEQ ID NO: 446793 - protein, 9 aa, Influenza virus
KSVFNCLYA

SEQ ID NO: 446794 - protein, 9 aa, Influenza virus
KSVFNNLYA

SEQ ID NO: 446795 - protein, 9 aa, Influenza virus
KSVFNSIYA

SEQ ID NO: 446796 - protein, 9 aa, Influenza virus
KSVFNSLYA

SEQ ID NO: 446797 - protein, 9 aa, Influenza virus
KSVFNSLYS

SEQ ID NO: 446798 - protein, 9 aa, Influenza virus
KSVTQTLVS

SEQ ID NO: 446799 - protein, 9 aa, Influenza virus
KSVTVSHAQ

SEQ ID NO: 446800 - protein, 9 aa, Influenza virus
KSWKGNIMR

SEQ ID NO: 446801 - protein, 9 aa, Influenza virus
KSWRKDILR

SEQ ID NO: 446802 - protein, 9 aa, Influenza virus
KSWRRDILR

SEQ ID NO: 446803 - protein, 9 aa, Influenza virus
KSWSKPQCQ

SEQ ID NO: 446804 - protein, 9 aa, Influenza virus
KSYFANLKG

SEQ ID NO: 446805 - protein, 9 aa, Influenza virus
KSYINKTGT

SEQ ID NO: 446806 - protein, 9 aa, Influenza virus
KSYINRTGT

SEQ ID NO: 446807 - protein, 9 aa, Influenza virus
KTAYELTDS

SEQ ID NO: 446808 - protein, 9 aa, Influenza virus
KTDGATSAC

SEQ ID NO: 446809 - protein, 9 aa, Influenza virus
KTEDNIYKI

SEQ ID NO: 446810 - protein, 9 aa, Influenza virus
KTEDNVYKI

SEQ ID NO: 446811 - protein, 9 aa, Influenza virus
KTEDNVYKV

SEQ ID NO: 446812 - protein, 9 aa, Influenza virus
KTFFGWKEP

SEQ ID NO: 446813 - protein, 9 aa, Influenza virus
KTFFGWREP

SEQ ID NO: 446814 - protein, 9 aa, Influenza virus
KTFFLTQGA

SEQ ID NO: 446815 - protein, 9 aa, Influenza virus
KTFQNIDKN

SEQ ID NO: 446816 - protein, 9 aa, Influenza virus
KTFQNIDRN

SEQ ID NO: 446817 - protein, 9 aa, Influenza virus
KTFQNIEKN

SEQ ID NO: 446818 - protein, 9 aa, Influenza virus
KTFQNIERN

SEQ ID NO: 446819 - protein, 9 aa, Influenza virus
KTFQNISPV

SEQ ID NO: 446820 - protein, 9 aa, Influenza virus
KTFQNVSPI

SEQ ID NO: 446821 - protein, 9 aa, Influenza virus
KTFQNVSPL

SEQ ID NO: 446822 - protein, 9 aa, Influenza virus
KTFQNVSPV

SEQ ID NO: 446823 - protein, 9 aa, Influenza virus
KTGGPIYKK

SEQ ID NO: 446824 - protein, 9 aa, Influenza virus
KTGGPIYKR

SEQ ID NO: 446825 - protein, 9 aa, Influenza virus
KTGGPIYRR

SEQ ID NO: 446826 - protein, 9 aa, Influenza virus
KTGTFEFTS

SEQ ID NO: 446827 - protein, 9 aa, Influenza virus
KTGTYDYPK

SEQ ID NO: 446828 - protein, 9 aa, Influenza virus
KTGVDEYSS

SEQ ID NO: 446829 - protein, 9 aa, Influenza virus
KTHIHIFSF

SEQ ID NO: 446830 - protein, 9 aa, Influenza virus
KTHNGKLCK

SEQ ID NO: 446831 - protein, 9 aa, Influenza virus
KTHNGKLCR

SEQ ID NO: 446832 - protein, 9 aa, Influenza virus
KTHNGRLCK

SEQ ID NO: 446833 - protein, 9 aa, Influenza virus
KTIDQVTGK

SEQ ID NO: 446834 - protein, 9 aa, Influenza virus
KTITIGSVS

SEQ ID NO: 446835 - protein, 9 aa, Influenza virus
KTIWTSGSS

SEQ ID NO: 446836 - protein, 9 aa, Influenza virus
KTKATKMEA

SEQ ID NO: 446837 - protein, 9 aa, Influenza virus
KTKATKMKA

SEQ ID NO: 446838 - protein, 9 aa, Influenza virus
KTKCQTYAG

SEQ ID NO: 446839 - protein, 9 aa, Influenza virus
KTKKMTITF

SEQ ID NO: 446840 - protein, 9 aa, Influenza virus
KTKLPFQNL

SEQ ID NO: 446841 - protein, 9 aa, Influenza virus
KTLDEHDAN

SEQ ID NO: 446842 - protein, 9 aa, Influenza virus
KTLDEHDSN

SEQ ID NO: 446843 - protein, 9 aa, Influenza virus
KTLDEHDTN

SEQ ID NO: 446844 - protein, 9 aa, Influenza virus
KTLDEHEAN

SEQ ID NO: 446845 - protein, 9 aa, Influenza virus
KTLDEHVAN

SEQ ID NO: 446846 - protein, 9 aa, Influenza virus
KTLDKHDSN

SEQ ID NO: 446847 - protein, 9 aa, Influenza virus
KTLDLHDAN

SEQ ID NO: 446848 - protein, 9 aa, Influenza virus
KTLDLHDSN

SEQ ID NO: 446849 - protein, 9 aa, Influenza virus
KTLDMHDAN

SEQ ID NO: 446850 - protein, 9 aa, Influenza virus
KTLKLATGM

SEQ ID NO: 446851 - protein, 9 aa, Influenza virus
KTLNMHDAN

SEQ ID NO: 446852 - protein, 9 aa, Influenza virus
KTLTDNHVE

SEQ ID NO: 446853 - protein, 9 aa, Influenza virus
KTLTDTSRP

SEQ ID NO: 446854 - protein, 9 aa, Influenza virus
KTLTNEHEE

SEQ ID NO: 446855 - protein, 9 aa, Influenza virus
KTLTNEKEE

SEQ ID NO: 446856 - protein, 9 aa, Influenza virus
KTLTNEKEK

SEQ ID NO: 446857 - protein, 9 aa, Influenza virus
KTLTNEQEE

SEQ ID NO: 446858 - protein, 9 aa, Influenza virus
KTLTSEKEE

SEQ ID NO: 446859 - protein, 9 aa, Influenza virus
KTMTITFLI

SEQ ID NO: 446860 - protein, 9 aa, Influenza virus
KTNDKYHQI

SEQ ID NO: 446861 - protein, 9 aa, Influenza virus
KTNEKFHQI

SEQ ID NO: 446862 - protein, 9 aa, Influenza virus
KTNEKYHQI

SEQ ID NO: 446863 - protein, 9 aa, Influenza virus
KTNGNLIAP

SEQ ID NO: 446864 - protein, 9 aa, Influenza virus
KTNKQFELI

SEQ ID NO: 446865 - protein, 9 aa, Influenza virus
KTNLYGFII

SEQ ID NO: 446866 - protein, 9 aa, Influenza virus
KTNLYGFIV

SEQ ID NO: 446867 - protein, 9 aa, Influenza virus
KTNQQFELD

SEQ ID NO: 446868 - protein, 9 aa, Influenza virus
KTNQQFELI

SEQ ID NO: 446869 - protein, 9 aa, Influenza virus
KTNQQFEMI

SEQ ID NO: 446870 - protein, 9 aa, Influenza virus
KTNQQFKLI

SEQ ID NO: 446871 - protein, 9 aa, Influenza virus
KTNTEFESI

SEQ ID NO: 446872 - protein, 9 aa, Influenza virus
KTNTQFELI

SEQ ID NO: 446873 - protein, 9 aa, Influenza virus
KTPYRSLIR

SEQ ID NO: 446874 - protein, 9 aa, Influenza virus
KTRFLPVAG

SEQ ID NO: 446875 - protein, 9 aa, Influenza virus
KTRFLPVSG

SEQ ID NO: 446876 - protein, 9 aa, Influenza virus
KTRFLPVTG

SEQ ID NO: 446877 - protein, 9 aa, Influenza virus
KTRGLFGAI

SEQ ID NO: 446878 - protein, 9 aa, Influenza virus
KTRLFTIRQ

SEQ ID NO: 446879 - protein, 9 aa, Influenza virus
KTRPILSPL

SEQ ID NO: 446880 - protein, 9 aa, Influenza virus
KTSIWTSSS

SEQ ID NO: 446881 - protein, 9 aa, Influenza virus
KTSTQKAIN

SEQ ID NO: 446882 - protein, 9 aa, Influenza virus
KTSWSYIVE

SEQ ID NO: 446883 - protein, 9 aa, Influenza virus
KTTVDHMAI

SEQ ID NO: 446884 - protein, 9 aa, Influenza virus
KTVINNITT

SEQ ID NO: 446885 - protein, 9 aa, Influenza virus
KTVVHLNST

SEQ ID NO: 446886 - protein, 9 aa, Influenza virus
KTWAGKILR

SEQ ID NO: 446887 - protein, 9 aa, Influenza virus
KTWAGNILR

SEQ ID NO: 446888 - protein, 9 aa, Influenza virus
KTWAKNILR

SEQ ID NO: 446889 - protein, 9 aa, Influenza virus
KTWARNILR

SEQ ID NO: 446890 - protein, 9 aa, Influenza virus
KTYNNTTGR

SEQ ID NO: 446891 - protein, 9 aa, Influenza virus
KVARLGKGY

SEQ ID NO: 446892 - protein, 9 aa, Influenza virus
KVATGRVTV

SEQ ID NO: 446893 - protein, 9 aa, Influenza virus
KVCRALLAK

SEQ ID NO: 446894 - protein, 9 aa, Influenza virus
KVCRTLLAK

SEQ ID NO: 446895 - protein, 9 aa, Influenza virus
KVCTKGKKA

SEQ ID NO: 446896 - protein, 9 aa, Influenza virus
KVDGSSSAC

SEQ ID NO: 446897 - protein, 9 aa, Influenza virus
KVDLWSYNA

SEQ ID NO: 446898 - protein, 9 aa, Influenza virus
KVDTIIENN

SEQ ID NO: 446899 - protein, 9 aa, Influenza virus
KVDTIIESN

SEQ ID NO: 446900 - protein, 9 aa, Influenza virus
KVDTILERN

SEQ ID NO: 446901 - protein, 9 aa, Influenza virus
KVDTLTEKG

SEQ ID NO: 446902 - protein, 9 aa, Influenza virus
KVDTLTENG

SEQ ID NO: 446903 - protein, 9 aa, Influenza virus
KVDTLTETG

SEQ ID NO: 446904 - protein, 9 aa, Influenza virus
KVEAVIYGN

SEQ ID NO: 446905 - protein, 9 aa, Influenza virus
KVECICRDN

SEQ ID NO: 446906 - protein, 9 aa, Influenza virus
KVECIGWSS

SEQ ID NO: 446907 - protein, 9 aa, Influenza virus
KVECVCRDN

SEQ ID NO: 446908 - protein, 9 aa, Influenza virus
KVEFEPFQS

SEQ ID NO: 446909 - protein, 9 aa, Influenza virus
KVEGWVVVA

SEQ ID NO: 446910 - protein, 9 aa, Influenza virus
KVESNGNLI

SEQ ID NO: 446911 - protein, 9 aa, Influenza virus
KVGVDEYSS

SEQ ID NO: 446912 - protein, 9 aa, Influenza virus
KVGYLCAGI

SEQ ID NO: 446913 - protein, 9 aa, Influenza virus
KVKEIGNGC

SEQ ID NO: 446914 - protein, 9 aa, Influenza virus
KVKMKWGME

SEQ ID NO: 446915 - protein, 9 aa, Influenza virus
KVLAIYSCI

SEQ ID NO: 446916 - protein, 9 aa, Influenza virus
KVLSIYSCI

SEQ ID NO: 446917 - protein, 9 aa, Influenza virus
KVLTDTSRP

SEQ ID NO: 446918 - protein, 9 aa, Influenza virus
KVLYFHKGI

SEQ ID NO: 446919 - protein, 9 aa, Influenza virus
KVLYFHKGL

SEQ ID NO: 446920 - protein, 9 aa, Influenza virus
KVMYFHKGL

SEQ ID NO: 446921 - protein, 9 aa, Influenza virus
KVNGQAGRI

SEQ ID NO: 446922 - protein, 9 aa, Influenza virus
KVNGQSGRI

SEQ ID NO: 446923 - protein, 9 aa, Influenza virus
KVNGVKLEE

SEQ ID NO: 446924 - protein, 9 aa, Influenza virus
KVNNIVDKM

SEQ ID NO: 446925 - protein, 9 aa, Influenza virus
KVNSIIDKM

SEQ ID NO: 446926 - protein, 9 aa, Influenza virus
KVNSIIEKM

SEQ ID NO: 446927 - protein, 9 aa, Influenza virus
KVNSIIGKM

SEQ ID NO: 446928 - protein, 9 aa, Influenza virus
KVNSIINKM

SEQ ID NO: 446929 - protein, 9 aa, Influenza virus
KVNSVIEKM

SEQ ID NO: 446930 - protein, 9 aa, Influenza virus
KVNSVVEKM

SEQ ID NO: 446931 - protein, 9 aa, Influenza virus
KVNTIIENN

SEQ ID NO: 446932 - protein, 9 aa, Influenza virus
KVNTLTEKG

SEQ ID NO: 446933 - protein, 9 aa, Influenza virus
KVNTLTERE

SEQ ID NO: 446934 - protein, 9 aa, Influenza virus
KVNTLTERG

SEQ ID NO: 446935 - protein, 9 aa, Influenza virus
KVNTQFEAV

SEQ ID NO: 446936 - protein, 9 aa, Influenza virus
KVPAQNAIS

SEQ ID NO: 446937 - protein, 9 aa, Influenza virus
KVPEWSYIV

SEQ ID NO: 446938 - protein, 9 aa, Influenza virus
KVPNAEKDP

SEQ ID NO: 446939 - protein, 9 aa, Influenza virus
KVPNAGTDP

SEQ ID NO: 446940 - protein, 9 aa, Influenza virus
KVPNALIDD

SEQ ID NO: 446941 - protein, 9 aa, Influenza virus
KVPNALTDD

SEQ ID NO: 446942 - protein, 9 aa, Influenza virus
KVPNALTDE

SEQ ID NO: 446943 - protein, 9 aa, Influenza virus
KVPNALTDN

SEQ ID NO: 446944 - protein, 9 aa, Influenza virus
KVPVQNAIS

SEQ ID NO: 446945 - protein, 9 aa, Influenza virus
KVPVTQTME

SEQ ID NO: 446946 - protein, 9 aa, Influenza virus
KVQHLEECS

SEQ ID NO: 446947 - protein, 9 aa, Influenza virus
KVRHQLRDN

SEQ ID NO: 446948 - protein, 9 aa, Influenza virus
KVRLQLKDN

SEQ ID NO: 446949 - protein, 9 aa, Influenza virus
KVRLQLRDN

SEQ ID NO: 446950 - protein, 9 aa, Influenza virus
KVRMQLKDN

SEQ ID NO: 446951 - protein, 9 aa, Influenza virus
KVRMQLRDN

SEQ ID NO: 446952 - protein, 9 aa, Influenza virus
KVRNGTYDH

SEQ ID NO: 446953 - protein, 9 aa, Influenza virus
KVRRQLREN

SEQ ID NO: 446954 - protein, 9 aa, Influenza virus
KVSCVCRDN

SEQ ID NO: 446955 - protein, 9 aa, Influenza virus
KVSTQKAIN

SEQ ID NO: 446956 - protein, 9 aa, Influenza virus
KVSTQKALN

SEQ ID NO: 446957 - protein, 9 aa, Influenza virus
KVTCVCRDN

SEQ ID NO: 446958 - protein, 9 aa, Influenza virus
KVTHRENLL

SEQ ID NO: 446959 - protein, 9 aa, Influenza virus
KVTNATETV

SEQ ID NO: 446960 - protein, 9 aa, Influenza virus
KVVHISPLS

SEQ ID NO: 446961 - protein, 9 aa, Influenza virus
KVWWTSNSI

SEQ ID NO: 446962 - protein, 9 aa, Influenza virus
KWALGENMA

SEQ ID NO: 446963 - protein, 9 aa, Influenza virus
KWEKYCILE

SEQ ID NO: 446964 - protein, 9 aa, Influenza virus
KWEKYCVIE

SEQ ID NO: 446965 - protein, 9 aa, Influenza virus
KWEKYCVLE

SEQ ID NO: 446966 - protein, 9 aa, Influenza virus
KWEPLAGTA

SEQ ID NO: 446967 - protein, 9 aa, Influenza virus
KWEPLTGTA

SEQ ID NO: 446968 - protein, 9 aa, Influenza virus
KWERYCVLE

SEQ ID NO: 446969 - protein, 9 aa, Influenza virus
KWESLAGTA

SEQ ID NO: 446970 - protein, 9 aa, Influenza virus
KWESLNGTA

SEQ ID NO: 446971 - protein, 9 aa, Influenza virus
KWESLTGTA

SEQ ID NO: 446972 - protein, 9 aa, Influenza virus
KWGDILDGV

SEQ ID NO: 446973 - protein, 9 aa, Influenza virus
KWGDILEGT

SEQ ID NO: 446974 - protein, 9 aa, Influenza virus
KWGDVLDGV

SEQ ID NO: 446975 - protein, 9 aa, Influenza virus
KWGMELRRC

SEQ ID NO: 446976 - protein, 9 aa, Influenza virus
KWGMEMRRC

SEQ ID NO: 446977 - protein, 9 aa, Influenza virus
KWGNVLDGV

SEQ ID NO: 446978 - protein, 9 aa, Influenza virus
KWLISKSKE

SEQ ID NO: 446979 - protein, 9 aa, Influenza virus
KWLLSNADN

SEQ ID NO: 446980 - protein, 9 aa, Influenza virus
KWLLSNNDN

SEQ ID NO: 446981 - protein, 9 aa, Influenza virus
KWLLSNSDN

SEQ ID NO: 446982 - protein, 9 aa, Influenza virus
KWLLSNSNN

SEQ ID NO: 446983 - protein, 9 aa, Influenza virus
KWLLSNTDN

SEQ ID NO: 446984 - protein, 9 aa, Influenza virus
KWLLSSKAN

SEQ ID NO: 446985 - protein, 9 aa, Influenza virus
KWLLSSKDN

SEQ ID NO: 446986 - protein, 9 aa, Influenza virus
KWLLSSSDN

SEQ ID NO: 446987 - protein, 9 aa, Influenza virus
KWLLSSTDN

SEQ ID NO: 446988 - protein, 9 aa, Influenza virus
KWLSSSGNN

SEQ ID NO: 446989 - protein, 9 aa, Influenza virus
KWLSSSMNN

SEQ ID NO: 446990 - protein, 9 aa, Influenza virus
KWLTLKSGQ

SEQ ID NO: 446991 - protein, 9 aa, Influenza virus
KWLVSKDKG

SEQ ID NO: 446992 - protein, 9 aa, Influenza virus
KWLVSKNKG

SEQ ID NO: 446993 - protein, 9 aa, Influenza virus
KWLVSKSKG

SEQ ID NO: 446994 - protein, 9 aa, Influenza virus
KWLVSKTKG

SEQ ID NO: 446995 - protein, 9 aa, Influenza virus
KWMMAMKYP

SEQ ID NO: 446996 - protein, 9 aa, Influenza virus
KWMMAMRYP

SEQ ID NO: 446997 - protein, 9 aa, Influenza virus
KWNENQNPR

SEQ ID NO: 446998 - protein, 9 aa, Influenza virus
KWNVTHTGT

SEQ ID NO: 446999 - protein, 9 aa, Influenza virus
KWNVTYTGI

SEQ ID NO: 447000 - protein, 9 aa, Influenza virus
KWNVTYTGT

SEQ ID NO: 447001 - protein, 9 aa, Influenza virus
KWREQLSQK

SEQ ID NO: 447002 - protein, 9 aa, Influenza virus
KWSGYSGSF

SEQ ID NO: 447003 - protein, 9 aa, Influenza virus
KWTLGENMA

SEQ ID NO: 447004 - protein, 9 aa, Influenza virus
KWVLGENMA

SEQ ID NO: 447005 - protein, 9 aa, Influenza virus
KWWVWLWLV

SEQ ID NO: 447006 - protein, 9 aa, Influenza virus
KYDGIITDT

SEQ ID NO: 447007 - protein, 9 aa, Influenza virus
KYDNGVWIG

SEQ ID NO: 447008 - protein, 9 aa, Influenza virus
KYEEESKLK

SEQ ID NO: 447009 - protein, 9 aa, Influenza virus
KYEEESKLN

SEQ ID NO: 447010 - protein, 9 aa, Influenza virus
KYEEESRLN

SEQ ID NO: 447011 - protein, 9 aa, Influenza virus
KYERVKMFD

SEQ ID NO: 447012 - protein, 9 aa, Influenza virus
KYGDGVWIG

SEQ ID NO: 447013 - protein, 9 aa, Influenza virus
KYGNGAWIG

SEQ ID NO: 447014 - protein, 9 aa, Influenza virus
KYGNGVWIG

SEQ ID NO: 447015 - protein, 9 aa, Influenza virus
KYGNGVWMG

SEQ ID NO: 447016 - protein, 9 aa, Influenza virus
KYGPALSIN

SEQ ID NO: 447017 - protein, 9 aa, Influenza virus
KYGSGRIFQ

SEQ ID NO: 447018 - protein, 9 aa, Influenza virus
KYGTGRIFQ

SEQ ID NO: 447019 - protein, 9 aa, Influenza virus
KYGYIIEEY

SEQ ID NO: 447020 - protein, 9 aa, Influenza virus
KYHQIEKEF

SEQ ID NO: 447021 - protein, 9 aa, Influenza virus
KYHWNLALD

SEQ ID NO: 447022 - protein, 9 aa, Influenza virus
KYIKQGSLK

SEQ ID NO: 447023 - protein, 9 aa, Influenza virus
KYIKSDQLK

SEQ ID NO: 447024 - protein, 9 aa, Influenza virus
KYIKSGQLK

SEQ ID NO: 447025 - protein, 9 aa, Influenza virus
KYIPSGSLK

SEQ ID NO: 447026 - protein, 9 aa, Influenza virus
KYIPSNSLK

SEQ ID NO: 447027 - protein, 9 aa, Influenza virus
KYIPSRSLK

SEQ ID NO: 447028 - protein, 9 aa, Influenza virus
KYISSGSLK

SEQ ID NO: 447029 - protein, 9 aa, Influenza virus
KYKGIITDT

SEQ ID NO: 447030 - protein, 9 aa, Influenza virus
KYKGIITGT

SEQ ID NO: 447031 - protein, 9 aa, Influenza virus
KYKIFKNGK

SEQ ID NO: 447032 - protein, 9 aa, Influenza virus
KYLEEHPNA

SEQ ID NO: 447033 - protein, 9 aa, Influenza virus
KYLEEHPSA

SEQ ID NO: 447034 - protein, 9 aa, Influenza virus
KYLEEHPST

SEQ ID NO: 447035 - protein, 9 aa, Influenza virus
KYLPDLYDY

SEQ ID NO: 447036 - protein, 9 aa, Influenza virus
KYMNVKSLK

SEQ ID NO: 447037 - protein, 9 aa, Influenza virus
KYNDIITDT

SEQ ID NO: 447038 - protein, 9 aa, Influenza virus
KYNGIITDT

SEQ ID NO: 447039 - protein, 9 aa, Influenza virus
KYNGIITET

SEQ ID NO: 447040 - protein, 9 aa, Influenza virus
KYNGIITGT

SEQ ID NO: 447041 - protein, 9 aa, Influenza virus
KYNGLITDT

SEQ ID NO: 447042 - protein, 9 aa, Influenza virus
KYNGMITDT

SEQ ID NO: 447043 - protein, 9 aa, Influenza virus
KYNGVITDT

SEQ ID NO: 447044 - protein, 9 aa, Influenza virus
KYQQSFSPS

SEQ ID NO: 447045 - protein, 9 aa, Influenza virus
KYQQSFTPS

SEQ ID NO: 447046 - protein, 9 aa, Influenza virus
KYREEAMQN

SEQ ID NO: 447047 - protein, 9 aa, Influenza virus
KYRQSFSPS

SEQ ID NO: 447048 - protein, 9 aa, Influenza virus
KYRTESLQN

SEQ ID NO: 447049 - protein, 9 aa, Influenza virus
KYSRADKIC

SEQ ID NO: 447050 - protein, 9 aa, Influenza virus
KYTSARQEK

SEQ ID NO: 447051 - protein, 9 aa, Influenza virus
KYTSGRQEK

SEQ ID NO: 447052 - protein, 9 aa, Influenza virus
KYVEDTKID

SEQ ID NO: 447053 - protein, 9 aa, Influenza virus
KYVEDTKVD

SEQ ID NO: 447054 - protein, 9 aa, Influenza virus
KYVEWTSNS

SEQ ID NO: 447055 - protein, 9 aa, Influenza virus
KYVKQGSLK

SEQ ID NO: 447056 - protein, 9 aa, Influenza virus
KYVKQGSLM

SEQ ID NO: 447057 - protein, 9 aa, Influenza virus
KYVKQGSLR

SEQ ID NO: 447058 - protein, 9 aa, Influenza virus
KYVKSDRLV

SEQ ID NO: 447059 - protein, 9 aa, Influenza virus
KYVKSEKLV

SEQ ID NO: 447060 - protein, 9 aa, Influenza virus
KYVKSERLV

SEQ ID NO: 447061 - protein, 9 aa, Influenza virus
KYVKSKRLV

SEQ ID NO: 447062 - protein, 9 aa, Influenza virus
KYVNIKSLK

SEQ ID NO: 447063 - protein, 9 aa, Influenza virus
KYVNNTTII

SEQ ID NO: 447064 - protein, 9 aa, Influenza virus
KYVNVKSLK

SEQ ID NO: 447065 - protein, 9 aa, Influenza virus
KYVNVRSLK

SEQ ID NO: 447066 - protein, 9 aa, Influenza virus
KYVRSEKLV

SEQ ID NO: 447067 - protein, 9 aa, Influenza virus
KYVWWASNS

SEQ ID NO: 447068 - protein, 9 aa, Influenza virus
KYVWWTSNS

SEQ ID NO: 447069 - protein, 9 aa, Influenza virus
KYWAIRTRS

SEQ ID NO: 447070 - protein, 9 aa, Influenza virus
LAAGGDIWV

SEQ ID NO: 447071 - protein, 9 aa, Influenza virus
LAAICTHLE

SEQ ID NO: 447072 - protein, 9 aa, Influenza virus
LAATVTLHF

SEQ ID NO: 447073 - protein, 9 aa, Influenza virus
LADQSLPPN

SEQ ID NO: 447074 - protein, 9 aa, Influenza virus
LADRIDDAV

SEQ ID NO: 447075 - protein, 9 aa, Influenza virus
LADRVDDAV

SEQ ID NO: 447076 - protein, 9 aa, Influenza virus
LADSEMDKL

SEQ ID NO: 447077 - protein, 9 aa, Influenza virus
LADSEMKKL

SEQ ID NO: 447078 - protein, 9 aa, Influenza virus
LADSEMNKL

SEQ ID NO: 447079 - protein, 9 aa, Influenza virus
LADSEMSKL

SEQ ID NO: 447080 - protein, 9 aa, Influenza virus
LADWVDDAV

SEQ ID NO: 447081 - protein, 9 aa, Influenza virus
LAEKAMKEH

SEQ ID NO: 447082 - protein, 9 aa, Influenza virus
LAEKAMKEY

SEQ ID NO: 447083 - protein, 9 aa, Influenza virus
LAEKTMKEY

SEQ ID NO: 447084 - protein, 9 aa, Influenza virus
LAERAMKEY

SEQ ID NO: 447085 - protein, 9 aa, Influenza virus
LAFICIKNG

SEQ ID NO: 447086 - protein, 9 aa, Influenza virus
LAFILWACQ

SEQ ID NO: 447087 - protein, 9 aa, Influenza virus
LAFILWACS

SEQ ID NO: 447088 - protein, 9 aa, Influenza virus
LAFIMWACS

SEQ ID NO: 447089 - protein, 9 aa, Influenza virus
LAFMLWACQ

SEQ ID NO: 447090 - protein, 9 aa, Influenza virus
LAFNTVIHE

SEQ ID NO: 447091 - protein, 9 aa, Influenza virus
LAFVLWACQ

SEQ ID NO: 447092 - protein, 9 aa, Influenza virus
LAGSAQHVE

SEQ ID NO: 447093 - protein, 9 aa, Influenza virus
LAGTAKHIE

SEQ ID NO: 447094 - protein, 9 aa, Influenza virus
LAHALKLVV

SEQ ID NO: 447095 - protein, 9 aa, Influenza virus
LAIAMGLIF

SEQ ID NO: 447096 - protein, 9 aa, Influenza virus
LAIAMGLVF

SEQ ID NO: 447097 - protein, 9 aa, Influenza virus
LAIGECPKY

SEQ ID NO: 447098 - protein, 9 aa, Influenza virus
LAIGLRNTP

SEQ ID NO: 447099 - protein, 9 aa, Influenza virus
LAIGLRNVP

SEQ ID NO: 447100 - protein, 9 aa, Influenza virus
LAIGPRNVP

SEQ ID NO: 447101 - protein, 9 aa, Influenza virus
LAIIIAGLS

SEQ ID NO: 447102 - protein, 9 aa, Influenza virus
LAILIAGGL

SEQ ID NO: 447103 - protein, 9 aa, Influenza virus
LAILVAGGL

SEQ ID NO: 447104 - protein, 9 aa, Influenza virus
LAIMIAGIF

SEQ ID NO: 447105 - protein, 9 aa, Influenza virus
LAIMIAGIS

SEQ ID NO: 447106 - protein, 9 aa, Influenza virus
LAIMIAGLF

SEQ ID NO: 447107 - protein, 9 aa, Influenza virus
LAIMIAGLS

SEQ ID NO: 447108 - protein, 9 aa, Influenza virus
LAIMMAGIF

SEQ ID NO: 447109 - protein, 9 aa, Influenza virus
LAIMMAGIS

SEQ ID NO: 447110 - protein, 9 aa, Influenza virus
LAIMMAGLS

SEQ ID NO: 447111 - protein, 9 aa, Influenza virus
LAIMVAGIS

SEQ ID NO: 447112 - protein, 9 aa, Influenza virus
LAIMVAGLS

SEQ ID NO: 447113 - protein, 9 aa, Influenza virus
LAIVMGLVF

SEQ ID NO: 447114 - protein, 9 aa, Influenza virus
LAIYATVAG

SEQ ID NO: 447115 - protein, 9 aa, Influenza virus
LAIYSCIAS

SEQ ID NO: 447116 - protein, 9 aa, Influenza virus
LAIYSTAAS

SEQ ID NO: 447117 - protein, 9 aa, Influenza virus
LAIYSTISS

SEQ ID NO: 447118 - protein, 9 aa, Influenza virus
LAIYSTVAS

SEQ ID NO: 447119 - protein, 9 aa, Influenza virus
LAIYSTVSS

SEQ ID NO: 447120 - protein, 9 aa, Influenza virus
  MOD_RES (3)..(3): Ile or Leu
LAXVMGLVF

SEQ ID NO: 447121 - protein, 9 aa, Influenza virus
LAKCNTKCQ

SEQ ID NO: 447122 - protein, 9 aa, Influenza virus
LAKGEKANV

SEQ ID NO: 447123 - protein, 9 aa, Influenza virus
LAKSVFNCL

SEQ ID NO: 447124 - protein, 9 aa, Influenza virus
LAKSVFNNL

SEQ ID NO: 447125 - protein, 9 aa, Influenza virus
LAKSVFNSL

SEQ ID NO: 447126 - protein, 9 aa, Influenza virus
LALGLRNTP

SEQ ID NO: 447127 - protein, 9 aa, Influenza virus
LALGMKNVP

SEQ ID NO: 447128 - protein, 9 aa, Influenza virus
LALSHTAYS

SEQ ID NO: 447129 - protein, 9 aa, Influenza virus
LAMITYITK

SEQ ID NO: 447130 - protein, 9 aa, Influenza virus
LAMITYITR

SEQ ID NO: 447131 - protein, 9 aa, Influenza virus
LANLGLNIG

SEQ ID NO: 447132 - protein, 9 aa, Influenza virus
LANLGLNVG

SEQ ID NO: 447133 - protein, 9 aa, Influenza virus
LANNGKFEF

SEQ ID NO: 447134 - protein, 9 aa, Influenza virus
LANNGRFEF

SEQ ID NO: 447135 - protein, 9 aa, Influenza virus
LANQSLPPN

SEQ ID NO: 447136 - protein, 9 aa, Influenza virus
LANSEMNKL

SEQ ID NO: 447137 - protein, 9 aa, Influenza virus
LANTIEIFR

SEQ ID NO: 447138 - protein, 9 aa, Influenza virus
LANTIEVFR

SEQ ID NO: 447139 - protein, 9 aa, Influenza virus
LANVVRKMM

SEQ ID NO: 447140 - protein, 9 aa, Influenza virus
LANYSLPPN

SEQ ID NO: 447141 - protein, 9 aa, Influenza virus
LAPGYAFEI

SEQ ID NO: 447142 - protein, 9 aa, Influenza virus
LAPKYGYII

SEQ ID NO: 447143 - protein, 9 aa, Influenza virus
LAPRYAFEI

SEQ ID NO: 447144 - protein, 9 aa, Influenza virus
LAPRYAFEL

SEQ ID NO: 447145 - protein, 9 aa, Influenza virus
LAPRYALEL

SEQ ID NO: 447146 - protein, 9 aa, Influenza virus
LAPRYGYII

SEQ ID NO: 447147 - protein, 9 aa, Influenza virus
LAQGALLGT

SEQ ID NO: 447148 - protein, 9 aa, Influenza virus
LAQGALVGT

SEQ ID NO: 447149 - protein, 9 aa, Influenza virus
LAQGTLLGT

SEQ ID NO: 447150 - protein, 9 aa, Influenza virus
LAQGVLLGT

SEQ ID NO: 447151 - protein, 9 aa, Influenza virus
LAQGYKDII

SEQ ID NO: 447152 - protein, 9 aa, Influenza virus
LARCICEKL

SEQ ID NO: 447153 - protein, 9 aa, Influenza virus
LARGEKANV

SEQ ID NO: 447154 - protein, 9 aa, Influenza virus
LARNICEKL

SEQ ID NO: 447155 - protein, 9 aa, Influenza virus
LARRICEKL

SEQ ID NO: 447156 - protein, 9 aa, Influenza virus
LARSALILR

SEQ ID NO: 447157 - protein, 9 aa, Influenza virus
LARSICEKL

SEQ ID NO: 447158 - protein, 9 aa, Influenza virus
LASCMGLIY

SEQ ID NO: 447159 - protein, 9 aa, Influenza virus
LASGLRNVP

SEQ ID NO: 447160 - protein, 9 aa, Influenza virus
LASLLEMCH

SEQ ID NO: 447161 - protein, 9 aa, Influenza virus
LASSGSLEF

SEQ ID NO: 447162 - protein, 9 aa, Influenza virus
LASTNAHDR

SEQ ID NO: 447163 - protein, 9 aa, Influenza virus
LASTNAYDR

SEQ ID NO: 447164 - protein, 9 aa, Influenza virus
LASTTAKAM

SEQ ID NO: 447165 - protein, 9 aa, Influenza virus
LATGLKNVP

SEQ ID NO: 447166 - protein, 9 aa, Influenza virus
LATGLRNAH

SEQ ID NO: 447167 - protein, 9 aa, Influenza virus
LATGLRNIP

SEQ ID NO: 447168 - protein, 9 aa, Influenza virus
LATGLRNVP

SEQ ID NO: 447169 - protein, 9 aa, Influenza virus
LATGMKNVP

SEQ ID NO: 447170 - protein, 9 aa, Influenza virus
LATGMRNIP

SEQ ID NO: 447171 - protein, 9 aa, Influenza virus
LATGMRNVP

SEQ ID NO: 447172 - protein, 9 aa, Influenza virus
LATGPRNVP

SEQ ID NO: 447173 - protein, 9 aa, Influenza virus
LATRGVQIA

SEQ ID NO: 447174 - protein, 9 aa, Influenza virus
LATTITLHF

SEQ ID NO: 447175 - protein, 9 aa, Influenza virus
LATTVTLHF

SEQ ID NO: 447176 - protein, 9 aa, Influenza virus
LAVGLRNTP

SEQ ID NO: 447177 - protein, 9 aa, Influenza virus
LAVLIAGGL

SEQ ID NO: 447178 - protein, 9 aa, Influenza virus
LAVNVRGSG

SEQ ID NO: 447179 - protein, 9 aa, Influenza virus
LAVTWWNRK

SEQ ID NO: 447180 - protein, 9 aa, Influenza virus
LAVTWWNRN

SEQ ID NO: 447181 - protein, 9 aa, Influenza virus
LAVTWWNRS

SEQ ID NO: 447182 - protein, 9 aa, Influenza virus
LAVVMGLVF

SEQ ID NO: 447183 - protein, 9 aa, Influenza virus
LAYCNTDLG

SEQ ID NO: 447184 - protein, 9 aa, Influenza virus
LAYDKICIG

SEQ ID NO: 447185 - protein, 9 aa, Influenza virus
LCAGIPSDT

SEQ ID NO: 447186 - protein, 9 aa, Influenza virus
LCAGIPTDT

SEQ ID NO: 447187 - protein, 9 aa, Influenza virus
LCAGLPSDT

SEQ ID NO: 447188 - protein, 9 aa, Influenza virus
LCAVNSWHI

SEQ ID NO: 447189 - protein, 9 aa, Influenza virus
LCDVSGFAI

SEQ ID NO: 447190 - protein, 9 aa, Influenza virus
LCEISGFAI

SEQ ID NO: 447191 - protein, 9 aa, Influenza virus
LCEVNSWHI

SEQ ID NO: 447192 - protein, 9 aa, Influenza virus
LCEVSGFAI

SEQ ID NO: 447193 - protein, 9 aa, Influenza virus
LCEVSGFVI

SEQ ID NO: 447194 - protein, 9 aa, Influenza virus
LCEVSSWHI

SEQ ID NO: 447195 - protein, 9 aa, Influenza virus
LCFPGELDN

SEQ ID NO: 447196 - protein, 9 aa, Influenza virus
LCFPGEVDN

SEQ ID NO: 447197 - protein, 9 aa, Influenza virus
LCGSKEQLG

SEQ ID NO: 447198 - protein, 9 aa, Influenza virus
LCGSKERLG

SEQ ID NO: 447199 - protein, 9 aa, Influenza virus
LCGSKKRLG

SEQ ID NO: 447200 - protein, 9 aa, Influenza virus
LCGSPFPVG

SEQ ID NO: 447201 - protein, 9 aa, Influenza virus
LCGSPISVG

SEQ ID NO: 447202 - protein, 9 aa, Influenza virus
LCGSPVPVG

SEQ ID NO: 447203 - protein, 9 aa, Influenza virus
LCGSPVSVG

SEQ ID NO: 447204 - protein, 9 aa, Influenza virus
LCGSRERLG

SEQ ID NO: 447205 - protein, 9 aa, Influenza virus
LCIGYHANN

SEQ ID NO: 447206 - protein, 9 aa, Influenza virus
LCKIEGWVV

SEQ ID NO: 447207 - protein, 9 aa, Influenza virus
LCKLNGIPP

SEQ ID NO: 447208 - protein, 9 aa, Influenza virus
LCKVEGWVV

SEQ ID NO: 447209 - protein, 9 aa, Influenza virus
LCLAILIAG

SEQ ID NO: 447210 - protein, 9 aa, Influenza virus
LCLAILVAG

SEQ ID NO: 447211 - protein, 9 aa, Influenza virus
LCLAVLIAG

SEQ ID NO: 447212 - protein, 9 aa, Influenza virus
LCLGHHAVA

SEQ ID NO: 447213 - protein, 9 aa, Influenza virus
LCLGHHAVP

SEQ ID NO: 447214 - protein, 9 aa, Influenza virus
LCLGHHAVQ

SEQ ID NO: 447215 - protein, 9 aa, Influenza virus
LCLGHHAVS

SEQ ID NO: 447216 - protein, 9 aa, Influenza virus
LCLKNGNMR

SEQ ID NO: 447217 - protein, 9 aa, Influenza virus
LCMCSNGSL

SEQ ID NO: 447218 - protein, 9 aa, Influenza virus
LCNPLNPFV

SEQ ID NO: 447219 - protein, 9 aa, Influenza virus
LCNPMNPFV

SEQ ID NO: 447220 - protein, 9 aa, Influenza virus
LCNVEGWVV

SEQ ID NO: 447221 - protein, 9 aa, Influenza virus
LCNVSGFAI

SEQ ID NO: 447222 - protein, 9 aa, Influenza virus
LCPFKGFFP

SEQ ID NO: 447223 - protein, 9 aa, Influenza virus
LCPFQGFFP

SEQ ID NO: 447224 - protein, 9 aa, Influenza virus
LCPFRGFFP

SEQ ID NO: 447225 - protein, 9 aa, Influenza virus
LCPIKGWAP

SEQ ID NO: 447226 - protein, 9 aa, Influenza virus
LCPIRGWAP

SEQ ID NO: 447227 - protein, 9 aa, Influenza virus
LCPKPLKLV

SEQ ID NO: 447228 - protein, 9 aa, Influenza virus
LCPSPLKLI

SEQ ID NO: 447229 - protein, 9 aa, Influenza virus
LCPSPLKLV

SEQ ID NO: 447230 - protein, 9 aa, Influenza virus
LCPSPLRLI

SEQ ID NO: 447231 - protein, 9 aa, Influenza virus
LCPSPLRLV

SEQ ID NO: 447232 - protein, 9 aa, Influenza virus
LCPVKGWAP

SEQ ID NO: 447233 - protein, 9 aa, Influenza virus
LCRLRGIPP

SEQ ID NO: 447234 - protein, 9 aa, Influenza virus
LCRLSGIPP

SEQ ID NO: 447235 - protein, 9 aa, Influenza virus
LCSGLVGDT

SEQ ID NO: 447236 - protein, 9 aa, Influenza virus
LCSIWFSHY

SEQ ID NO: 447237 - protein, 9 aa, Influenza virus
LCSKILTDT

SEQ ID NO: 447238 - protein, 9 aa, Influenza virus
LCSKTLTDT

SEQ ID NO: 447239 - protein, 9 aa, Influenza virus
LCSKVLTDT

SEQ ID NO: 447240 - protein, 9 aa, Influenza virus
LCSRILTDT

SEQ ID NO: 447241 - protein, 9 aa, Influenza virus
LCSRVLTDT

SEQ ID NO: 447242 - protein, 9 aa, Influenza virus
LCSVEGWVV

SEQ ID NO: 447243 - protein, 9 aa, Influenza virus
LCSVEYASK

SEQ ID NO: 447244 - protein, 9 aa, Influenza virus
LCTGILTDT

SEQ ID NO: 447245 - protein, 9 aa, Influenza virus
LCTGVLTDT

SEQ ID NO: 447246 - protein, 9 aa, Influenza virus
LCTINSWHI

SEQ ID NO: 447247 - protein, 9 aa, Influenza virus
LCVGWSSTS

SEQ ID NO: 447248 - protein, 9 aa, Influenza virus
LCYPGELDN

SEQ ID NO: 447249 - protein, 9 aa, Influenza virus
LCYPGELNN

SEQ ID NO: 447250 - protein, 9 aa, Influenza virus
LCYPGEVDN

SEQ ID NO: 447251 - protein, 9 aa, Influenza virus
LCYPGNFND

SEQ ID NO: 447252 - protein, 9 aa, Influenza virus
LCYPGSFND

SEQ ID NO: 447253 - protein, 9 aa, Influenza virus
LCYPGSFNN

SEQ ID NO: 447254 - protein, 9 aa, Influenza virus
LCYPGSLND

SEQ ID NO: 447255 - protein, 9 aa, Influenza virus
LDDCSLEGI

SEQ ID NO: 447256 - protein, 9 aa, Influenza virus
LDDCSLEGL

SEQ ID NO: 447257 - protein, 9 aa, Influenza virus
LDDCSLKGL

SEQ ID NO: 447258 - protein, 9 aa, Influenza virus
LDEESRARI

SEQ ID NO: 447259 - protein, 9 aa, Influenza virus
LDEHDANAN

SEQ ID NO: 447260 - protein, 9 aa, Influenza virus
LDEHDANVH

SEQ ID NO: 447261 - protein, 9 aa, Influenza virus
LDEHDANVN

SEQ ID NO: 447262 - protein, 9 aa, Influenza virus
LDEHDANVR

SEQ ID NO: 447263 - protein, 9 aa, Influenza virus
LDEHDSNVE

SEQ ID NO: 447264 - protein, 9 aa, Influenza virus
LDEHDSNVK

SEQ ID NO: 447265 - protein, 9 aa, Influenza virus
LDEHDSNVN

SEQ ID NO: 447266 - protein, 9 aa, Influenza virus
LDEHVANVN

SEQ ID NO: 447267 - protein, 9 aa, Influenza virus
LDEIGEDIA

SEQ ID NO: 447268 - protein, 9 aa, Influenza virus
LDEIGEDLA

SEQ ID NO: 447269 - protein, 9 aa, Influenza virus
LDEIGEDVA

SEQ ID NO: 447270 - protein, 9 aa, Influenza virus
LDEQNKLYG

SEQ ID NO: 447271 - protein, 9 aa, Influenza virus
LDFHDSNVK

SEQ ID NO: 447272 - protein, 9 aa, Influenza virus
LDFHDSNVR

SEQ ID NO: 447273 - protein, 9 aa, Influenza virus
LDGVKPLIL

SEQ ID NO: 447274 - protein, 9 aa, Influenza virus
LDGVRPLIL

SEQ ID NO: 447275 - protein, 9 aa, Influenza virus
LDGVTASCL

SEQ ID NO: 447276 - protein, 9 aa, Influenza virus
LDGVTASCR

SEQ ID NO: 447277 - protein, 9 aa, Influenza virus
LDIRTATRE

SEQ ID NO: 447278 - protein, 9 aa, Influenza virus
LDIWTYNAE

SEQ ID NO: 447279 - protein, 9 aa, Influenza virus
LDKHDSNVK

SEQ ID NO: 447280 - protein, 9 aa, Influenza virus
LDKICLGHH

SEQ ID NO: 447281 - protein, 9 aa, Influenza virus
LDKKMEDGF

SEQ ID NO: 447282 - protein, 9 aa, Influenza virus
LDLHDANVK

SEQ ID NO: 447283 - protein, 9 aa, Influenza virus
LDLHDANVR

SEQ ID NO: 447284 - protein, 9 aa, Influenza virus
LDLHDSNVK

SEQ ID NO: 447285 - protein, 9 aa, Influenza virus
LDLHDSNVR

SEQ ID NO: 447286 - protein, 9 aa, Influenza virus
LDLNMGQPF

SEQ ID NO: 447287 - protein, 9 aa, Influenza virus
LDMHDANVK

SEQ ID NO: 447288 - protein, 9 aa, Influenza virus
LDMHDANVR

SEQ ID NO: 447289 - protein, 9 aa, Influenza virus
LDMHDVNVK

SEQ ID NO: 447290 - protein, 9 aa, Influenza virus
LDNCHPIGM

SEQ ID NO: 447291 - protein, 9 aa, Influenza virus
LDNEHSNGT

SEQ ID NO: 447292 - protein, 9 aa, Influenza virus
LDNEPGSGK

SEQ ID NO: 447293 - protein, 9 aa, Influenza virus
LDNEPGSGN

SEQ ID NO: 447294 - protein, 9 aa, Influenza virus
LDNKHSNDT

SEQ ID NO: 447295 - protein, 9 aa, Influenza virus
LDNKHSNGT

SEQ ID NO: 447296 - protein, 9 aa, Influenza virus
LDNKNWSGY

SEQ ID NO: 447297 - protein, 9 aa, Influenza virus
LDNLQAYQK

SEQ ID NO: 447298 - protein, 9 aa, Influenza virus
LDNNGELRH

SEQ ID NO: 447299 - protein, 9 aa, Influenza virus
LDPGDTVTF

SEQ ID NO: 447300 - protein, 9 aa, Influenza virus
LDPNDTVTF

SEQ ID NO: 447301 - protein, 9 aa, Influenza virus
LDQHDANVK

SEQ ID NO: 447302 - protein, 9 aa, Influenza virus
LDQNFRNIR

SEQ ID NO: 447303 - protein, 9 aa, Influenza virus
LDRICLGHH

SEQ ID NO: 447304 - protein, 9 aa, Influenza virus
LDRLRRDQK

SEQ ID NO: 447305 - protein, 9 aa, Influenza virus
LDTDWSGYS

SEQ ID NO: 447306 - protein, 9 aa, Influenza virus
LDTGDGCFE

SEQ ID NO: 447307 - protein, 9 aa, Influenza virus
LDTINFEST

SEQ ID NO: 447308 - protein, 9 aa, Influenza virus
LDVWTYNAE

SEQ ID NO: 447309 - protein, 9 aa, Influenza virus
LDVWTYNTE

SEQ ID NO: 447310 - protein, 9 aa, Influenza virus
LDYHDSNVK

SEQ ID NO: 447311 - protein, 9 aa, Influenza virus
LDYQIGYIC

SEQ ID NO: 447312 - protein, 9 aa, Influenza virus
LDYQIGYVC

SEQ ID NO: 447313 - protein, 9 aa, Influenza virus
LEALMEWIK

SEQ ID NO: 447314 - protein, 9 aa, Influenza virus
LEALMEWLK

SEQ ID NO: 447315 - protein, 9 aa, Influenza virus
LEAMAFLED

SEQ ID NO: 447316 - protein, 9 aa, Influenza virus
LEAMAFLEE

SEQ ID NO: 447317 - protein, 9 aa, Influenza virus
LEAMAFLEK

SEQ ID NO: 447318 - protein, 9 aa, Influenza virus
LEAMAFLEN

SEQ ID NO: 447319 - protein, 9 aa, Influenza virus
LEAMALLEE

SEQ ID NO: 447320 - protein, 9 aa, Influenza virus
LECKTFFLT

SEQ ID NO: 447321 - protein, 9 aa, Influenza virus
LECRTFFLT

SEQ ID NO: 447322 - protein, 9 aa, Influenza virus
LEDEQMYQK

SEQ ID NO: 447323 - protein, 9 aa, Influenza virus
LEDEQMYQR

SEQ ID NO: 447324 - protein, 9 aa, Influenza virus
LEDVFAGKN

SEQ ID NO: 447325 - protein, 9 aa, Influenza virus
LEDVFSGKN

SEQ ID NO: 447326 - protein, 9 aa, Influenza virus
LEECSCYMD

SEQ ID NO: 447327 - protein, 9 aa, Influenza virus
LEECSCYTD

SEQ ID NO: 447328 - protein, 9 aa, Influenza virus
LEECSCYVD

SEQ ID NO: 447329 - protein, 9 aa, Influenza virus
LEEESDEAL

SEQ ID NO: 447330 - protein, 9 aa, Influenza virus
LEEHPNAGK

SEQ ID NO: 447331 - protein, 9 aa, Influenza virus
LEEHPSAGK

SEQ ID NO: 447332 - protein, 9 aa, Influenza virus
LEEHPSAGR

SEQ ID NO: 447333 - protein, 9 aa, Influenza virus
LEEHPSTGK

SEQ ID NO: 447334 - protein, 9 aa, Influenza virus
LEELRFVFS

SEQ ID NO: 447335 - protein, 9 aa, Influenza virus
LEENPSAGK

SEQ ID NO: 447336 - protein, 9 aa, Influenza virus
LEENSTYKI

SEQ ID NO: 447337 - protein, 9 aa, Influenza virus
LEENTSYKI

SEQ ID NO: 447338 - protein, 9 aa, Influenza virus
LEENTTYKI

SEQ ID NO: 447339 - protein, 9 aa, Influenza virus
LEENTTYRI

SEQ ID NO: 447340 - protein, 9 aa, Influenza virus
LEESHPGIF

SEQ ID NO: 447341 - protein, 9 aa, Influenza virus
LEESHPGLF

SEQ ID NO: 447342 - protein, 9 aa, Influenza virus
LEFIAEQFT

SEQ ID NO: 447343 - protein, 9 aa, Influenza virus
LEFKADLII

SEQ ID NO: 447344 - protein, 9 aa, Influenza virus
LEGFSAESR

SEQ ID NO: 447345 - protein, 9 aa, Influenza virus
LEGIILGNP

SEQ ID NO: 447346 - protein, 9 aa, Influenza virus
LEGLILGNP

SEQ ID NO: 447347 - protein, 9 aa, Influenza virus
LEGLILSNP

SEQ ID NO: 447348 - protein, 9 aa, Influenza virus
LEGLVLGNP

SEQ ID NO: 447349 - protein, 9 aa, Influenza virus
LEGRIENLN

SEQ ID NO: 447350 - protein, 9 aa, Influenza virus
LEGTTASCQ

SEQ ID NO: 447351 - protein, 9 aa, Influenza virus
LEGVFAGKN

SEQ ID NO: 447352 - protein, 9 aa, Influenza virus
LEGVKPLIL

SEQ ID NO: 447353 - protein, 9 aa, Influenza virus
LEHTSKYVC

SEQ ID NO: 447354 - protein, 9 aa, Influenza virus
LEHTSRYIC

SEQ ID NO: 447355 - protein, 9 aa, Influenza virus
LEHTSRYVC

SEQ ID NO: 447356 - protein, 9 aa, Influenza virus
LEICFMYSD

SEQ ID NO: 447357 - protein, 9 aa, Influenza virus
LEIGARIGE

SEQ ID NO: 447358 - protein, 9 aa, Influenza virus
LEIGTRIGD

SEQ ID NO: 447359 - protein, 9 aa, Influenza virus
LEIGTRIGE

SEQ ID NO: 447360 - protein, 9 aa, Influenza virus
LEIGVTRRE

SEQ ID NO: 447361 - protein, 9 aa, Influenza virus
LEKAHNGKL

SEQ ID NO: 447362 - protein, 9 aa, Influenza virus
LEKANKIKS

SEQ ID NO: 447363 - protein, 9 aa, Influenza virus
LEKANKIKT

SEQ ID NO: 447364 - protein, 9 aa, Influenza virus
LEKASKIKS

SEQ ID NO: 447365 - protein, 9 aa, Influenza virus
LEKNITVTH

SEQ ID NO: 447366 - protein, 9 aa, Influenza virus
LEKNVTVTH

SEQ ID NO: 447367 - protein, 9 aa, Influenza virus
LEKRIENLN

SEQ ID NO: 447368 - protein, 9 aa, Influenza virus
LEKRLENLD

SEQ ID NO: 447369 - protein, 9 aa, Influenza virus
LEKRLENLN

SEQ ID NO: 447370 - protein, 9 aa, Influenza virus
LEKRLGNLN

SEQ ID NO: 447371 - protein, 9 aa, Influenza virus
LEKSHPGIF

SEQ ID NO: 447372 - protein, 9 aa, Influenza virus
LEKSRINGV

SEQ ID NO: 447373 - protein, 9 aa, Influenza virus
LEKTHNGKL

SEQ ID NO: 447374 - protein, 9 aa, Influenza virus
LEKVHNGKL

SEQ ID NO: 447375 - protein, 9 aa, Influenza virus
LEKYVEDTK

SEQ ID NO: 447376 - protein, 9 aa, Influenza virus
LELDEIGED

SEQ ID NO: 447377 - protein, 9 aa, Influenza virus
LELGDCSIA

SEQ ID NO: 447378 - protein, 9 aa, Influenza virus
LELGDCSIT

SEQ ID NO: 447379 - protein, 9 aa, Influenza virus
LELIRGRPQ

SEQ ID NO: 447380 - protein, 9 aa, Influenza virus
LELIRMIKR

SEQ ID NO: 447381 - protein, 9 aa, Influenza virus
LELRDCKIE

SEQ ID NO: 447382 - protein, 9 aa, Influenza virus
LELRDCKVE

SEQ ID NO: 447383 - protein, 9 aa, Influenza virus
LELRDCSIA

SEQ ID NO: 447384 - protein, 9 aa, Influenza virus
LELRSGYWA

SEQ ID NO: 447385 - protein, 9 aa, Influenza virus
LELRSKYWA

SEQ ID NO: 447386 - protein, 9 aa, Influenza virus
LELRSRYWA

SEQ ID NO: 447387 - protein, 9 aa, Influenza virus
LEMCHGTQI

SEQ ID NO: 447388 - protein, 9 aa, Influenza virus
LEMCHSTQI

SEQ ID NO: 447389 - protein, 9 aa, Influenza virus
LEMCHSTRI

SEQ ID NO: 447390 - protein, 9 aa, Influenza virus
LEMIRGKPE

SEQ ID NO: 447391 - protein, 9 aa, Influenza virus
LEMIRGKPK

SEQ ID NO: 447392 - protein, 9 aa, Influenza virus
LEMIRGRPE

SEQ ID NO: 447393 - protein, 9 aa, Influenza virus
LENDKTLDL

SEQ ID NO: 447394 - protein, 9 aa, Influenza virus
LENDKTLDM

SEQ ID NO: 447395 - protein, 9 aa, Influenza virus
LENDKTLNM

SEQ ID NO: 447396 - protein, 9 aa, Influenza virus
LENDRTLDL

SEQ ID NO: 447397 - protein, 9 aa, Influenza virus
LENDVPVTS

SEQ ID NO: 447398 - protein, 9 aa, Influenza virus
LENEKTLDL

SEQ ID NO: 447399 - protein, 9 aa, Influenza virus
LENERTLDF

SEQ ID NO: 447400 - protein, 9 aa, Influenza virus
LENERTLDL

SEQ ID NO: 447401 - protein, 9 aa, Influenza virus
LENERTLDY

SEQ ID NO: 447402 - protein, 9 aa, Influenza virus
LENGRTLDL

SEQ ID NO: 447403 - protein, 9 aa, Influenza virus
LENGRTLGL

SEQ ID NO: 447404 - protein, 9 aa, Influenza virus
LENGVPVTS

SEQ ID NO: 447405 - protein, 9 aa, Influenza virus
LENKHSNGT

SEQ ID NO: 447406 - protein, 9 aa, Influenza virus
LENLDKKME

SEQ ID NO: 447407 - protein, 9 aa, Influenza virus
LENLNKKME

SEQ ID NO: 447408 - protein, 9 aa, Influenza virus
LENLNKKVE

SEQ ID NO: 447409 - protein, 9 aa, Influenza virus
LENLQAYQK

SEQ ID NO: 447410 - protein, 9 aa, Influenza virus
LENLQTYQK

SEQ ID NO: 447411 - protein, 9 aa, Influenza virus
LENLSKRME

SEQ ID NO: 447412 - protein, 9 aa, Influenza virus
LENNVPVTS

SEQ ID NO: 447413 - protein, 9 aa, Influenza virus
LENQHTIDL

SEQ ID NO: 447414 - protein, 9 aa, Influenza virus
LENQHTIDM

SEQ ID NO: 447415 - protein, 9 aa, Influenza virus
LENQHTIDV

SEQ ID NO: 447416 - protein, 9 aa, Influenza virus
LENQHTIHL

SEQ ID NO: 447417 - protein, 9 aa, Influenza virus
LENQKILDE

SEQ ID NO: 447418 - protein, 9 aa, Influenza virus
LENQKPLDE

SEQ ID NO: 447419 - protein, 9 aa, Influenza virus
LENQKTLDE

SEQ ID NO: 447420 - protein, 9 aa, Influenza virus
LENQKTLDK

SEQ ID NO: 447421 - protein, 9 aa, Influenza virus
LENQNTIDL

SEQ ID NO: 447422 - protein, 9 aa, Influenza virus
LENSHPGIF

SEQ ID NO: 447423 - protein, 9 aa, Influenza virus
LENVFAGKN

SEQ ID NO: 447424 - protein, 9 aa, Influenza virus
LENYVEDTK

SEQ ID NO: 447425 - protein, 9 aa, Influenza virus
LEPGTFDIE

SEQ ID NO: 447426 - protein, 9 aa, Influenza virus
LEPGTFDIG

SEQ ID NO: 447427 - protein, 9 aa, Influenza virus
LEPGTFDLE

SEQ ID NO: 447428 - protein, 9 aa, Influenza virus
LEPGTFDLG

SEQ ID NO: 447429 - protein, 9 aa, Influenza virus
LEQNVTVTH

SEQ ID NO: 447430 - protein, 9 aa, Influenza virus
LEQSGLPVG

SEQ ID NO: 447431 - protein, 9 aa, Influenza virus
LERELVRKT

SEQ ID NO: 447432 - protein, 9 aa, Influenza virus
LERNVTVTH

SEQ ID NO: 447433 - protein, 9 aa, Influenza virus
LERRIENLN

SEQ ID NO: 447434 - protein, 9 aa, Influenza virus
LERRIESLN

SEQ ID NO: 447435 - protein, 9 aa, Influenza virus
LERRLENLN

SEQ ID NO: 447436 - protein, 9 aa, Influenza virus
LERRLENLS

SEQ ID NO: 447437 - protein, 9 aa, Influenza virus
LERSKINEV

SEQ ID NO: 447438 - protein, 9 aa, Influenza virus
LERSKINGV

SEQ ID NO: 447439 - protein, 9 aa, Influenza virus
LERTHNGKL

SEQ ID NO: 447440 - protein, 9 aa, Influenza virus
LERYVEDTK

SEQ ID NO: 447441 - protein, 9 aa, Influenza virus
LESDVPVTS

SEQ ID NO: 447442 - protein, 9 aa, Influenza virus
LESRSGFEM

SEQ ID NO: 447443 - protein, 9 aa, Influenza virus
LESVFAGKN

SEQ ID NO: 447444 - protein, 9 aa, Influenza virus
LETGYICSK

SEQ ID NO: 447445 - protein, 9 aa, Influenza virus
LETGYVCGK

SEQ ID NO: 447446 - protein, 9 aa, Influenza virus
LETGYVCSK

SEQ ID NO: 447447 - protein, 9 aa, Influenza virus
LEVCFMYSD

SEQ ID NO: 447448 - protein, 9 aa, Influenza virus
LEVGTRWMK

SEQ ID NO: 447449 - protein, 9 aa, Influenza virus
LFALSGVAI

SEQ ID NO: 447450 - protein, 9 aa, Influenza virus
LFALSGVAV

SEQ ID NO: 447451 - protein, 9 aa, Influenza virus
LFASSGIAI

SEQ ID NO: 447452 - protein, 9 aa, Influenza virus
LFDEVKRRL

SEQ ID NO: 447453 - protein, 9 aa, Influenza virus
LFDEVRRRL

SEQ ID NO: 447454 - protein, 9 aa, Influenza virus
LFDYSGWNV

SEQ ID NO: 447455 - protein, 9 aa, Influenza virus
LFDYSKWNV

SEQ ID NO: 447456 - protein, 9 aa, Influenza virus
LFDYSRWNV

SEQ ID NO: 447457 - protein, 9 aa, Influenza virus
LFEKFFPSS

SEQ ID NO: 447458 - protein, 9 aa, Influenza virus
LFENSCLET

SEQ ID NO: 447459 - protein, 9 aa, Influenza virus
LFERVKRQL

SEQ ID NO: 447460 - protein, 9 aa, Influenza virus
LFERVRHQL

SEQ ID NO: 447461 - protein, 9 aa, Influenza virus
LFERVRRQL

SEQ ID NO: 447462 - protein, 9 aa, Influenza virus
LFFFCLKNG

SEQ ID NO: 447463 - protein, 9 aa, Influenza virus
LFFWMCSNG

SEQ ID NO: 447464 - protein, 9 aa, Influenza virus
LFGAIAGFI

SEQ ID NO: 447465 - protein, 9 aa, Influenza virus
LFGAIAGFL

SEQ ID NO: 447466 - protein, 9 aa, Influenza virus
LFGAKAGFI

SEQ ID NO: 447467 - protein, 9 aa, Influenza virus
LFHKCDDDC

SEQ ID NO: 447468 - protein, 9 aa, Influenza virus
LFIKDYRYT

SEQ ID NO: 447469 - protein, 9 aa, Influenza virus
LFLAFILWA

SEQ ID NO: 447470 - protein, 9 aa, Influenza virus
LFLVCVSLL

SEQ ID NO: 447471 - protein, 9 aa, Influenza virus
LFLWMCSNG

SEQ ID NO: 447472 - protein, 9 aa, Influenza virus
LFLYVRTNG

SEQ ID NO: 447473 - protein, 9 aa, Influenza virus
LFMIIGGFI

SEQ ID NO: 447474 - protein, 9 aa, Influenza virus
LFNTIGNLI

SEQ ID NO: 447475 - protein, 9 aa, Influenza virus
LFQDILMRM

SEQ ID NO: 447476 - protein, 9 aa, Influenza virus
LFQGGHIEE

SEQ ID NO: 447477 - protein, 9 aa, Influenza virus
LFQQMRDIL

SEQ ID NO: 447478 - protein, 9 aa, Influenza virus
LFQQMRDVL

SEQ ID NO: 447479 - protein, 9 aa, Influenza virus
LFSGIKSFS

SEQ ID NO: 447480 - protein, 9 aa, Influenza virus
LFSGIRSFS

SEQ ID NO: 447481 - protein, 9 aa, Influenza virus
LFSGVNSFS

SEQ ID NO: 447482 - protein, 9 aa, Influenza virus
LFSGYKDII

SEQ ID NO: 447483 - protein, 9 aa, Influenza virus
LFSSIKKYE

SEQ ID NO: 447484 - protein, 9 aa, Influenza virus
LFSSIKRYE

SEQ ID NO: 447485 - protein, 9 aa, Influenza virus
LFTIRQELA

SEQ ID NO: 447486 - protein, 9 aa, Influenza virus
LFTIRQEMA

SEQ ID NO: 447487 - protein, 9 aa, Influenza virus
LFTLSGVAI

SEQ ID NO: 447488 - protein, 9 aa, Influenza virus
LFVLMENER

SEQ ID NO: 447489 - protein, 9 aa, Influenza virus
LFVQSYFQL

SEQ ID NO: 447490 - protein, 9 aa, Influenza virus
LGAIAGFIE

SEQ ID NO: 447491 - protein, 9 aa, Influenza virus
LGAINSSMP

SEQ ID NO: 447492 - protein, 9 aa, Influenza virus
LGAINTTLP

SEQ ID NO: 447493 - protein, 9 aa, Influenza virus
LGAISFWMC

SEQ ID NO: 447494 - protein, 9 aa, Influenza virus
LGALNTTLP

SEQ ID NO: 447495 - protein, 9 aa, Influenza virus
LGAPLELRD

SEQ ID NO: 447496 - protein, 9 aa, Influenza virus
LGAPLVLDD

SEQ ID NO: 447497 - protein, 9 aa, Influenza virus
LGCKMYALH

SEQ ID NO: 447498 - protein, 9 aa, Influenza virus
LGCKTYALH

SEQ ID NO: 447499 - protein, 9 aa, Influenza virus
LGCRMYALH

SEQ ID NO: 447500 - protein, 9 aa, Influenza virus
LGDAPFLDR

SEQ ID NO: 447501 - protein, 9 aa, Influenza virus
LGDCNFEGW

SEQ ID NO: 447502 - protein, 9 aa, Influenza virus
LGDCPKYIK

SEQ ID NO: 447503 - protein, 9 aa, Influenza virus
LGDCRFEGW

SEQ ID NO: 447504 - protein, 9 aa, Influenza virus
LGDCSFAGW

SEQ ID NO: 447505 - protein, 9 aa, Influenza virus
LGDCSFEGW

SEQ ID NO: 447506 - protein, 9 aa, Influenza virus
LGDCSIAGW

SEQ ID NO: 447507 - protein, 9 aa, Influenza virus
LGDCSITGW

SEQ ID NO: 447508 - protein, 9 aa, Influenza virus
LGDCSVAGW

SEQ ID NO: 447509 - protein, 9 aa, Influenza virus
LGEAPSPYN

SEQ ID NO: 447510 - protein, 9 aa, Influenza virus
LGECPKYIK

SEQ ID NO: 447511 - protein, 9 aa, Influenza virus
LGENMAPEK

SEQ ID NO: 447512 - protein, 9 aa, Influenza virus
LGFHDSNVK

SEQ ID NO: 447513 - protein, 9 aa, Influenza virus
LGFIMWACQ

SEQ ID NO: 447514 - protein, 9 aa, Influenza virus
LGFIMWTCQ

SEQ ID NO: 447515 - protein, 9 aa, Influenza virus
LGFIVWACQ

SEQ ID NO: 447516 - protein, 9 aa, Influenza virus
LGFVFTLTV

SEQ ID NO: 447517 - protein, 9 aa, Influenza virus
LGFVLWACQ

SEQ ID NO: 447518 - protein, 9 aa, Influenza virus
LGFVMWACQ

SEQ ID NO: 447519 - protein, 9 aa, Influenza virus
LGGCSFAGW

SEQ ID NO: 447520 - protein, 9 aa, Influenza virus
LGGTISPRS

SEQ ID NO: 447521 - protein, 9 aa, Influenza virus
LGHHAIPNG

SEQ ID NO: 447522 - protein, 9 aa, Influenza virus
LGHHAVANG

SEQ ID NO: 447523 - protein, 9 aa, Influenza virus
LGHHAVENG

SEQ ID NO: 447524 - protein, 9 aa, Influenza virus
LGHHAVPNG

SEQ ID NO: 447525 - protein, 9 aa, Influenza virus
LGHHAVQNG

SEQ ID NO: 447526 - protein, 9 aa, Influenza virus
LGHHAVSNG

SEQ ID NO: 447527 - protein, 9 aa, Influenza virus
LGHHAVTNG

SEQ ID NO: 447528 - protein, 9 aa, Influenza virus
LGIINLLIG

SEQ ID NO: 447529 - protein, 9 aa, Influenza virus
LGIITGPPQ

SEQ ID NO: 447530 - protein, 9 aa, Influenza virus
LGILTGPPQ

SEQ ID NO: 447531 - protein, 9 aa, Influenza virus
LGINMSKKK

SEQ ID NO: 447532 - protein, 9 aa, Influenza virus
LGIPFHLGT

SEQ ID NO: 447533 - protein, 9 aa, Influenza virus
LGIQSDAQI

SEQ ID NO: 447534 - protein, 9 aa, Influenza virus
LGITGPDAT

SEQ ID NO: 447535 - protein, 9 aa, Influenza virus
LGITGPDST

SEQ ID NO: 447536 - protein, 9 aa, Influenza virus
LGITGPDTT

SEQ ID NO: 447537 - protein, 9 aa, Influenza virus
LGIVECVCR

SEQ ID NO: 447538 - protein, 9 aa, Influenza virus
LGIYQILAI

SEQ ID NO: 447539 - protein, 9 aa, Influenza virus
LGKCPRYVK

SEQ ID NO: 447540 - protein, 9 aa, Influenza virus
LGKGYMFES

SEQ ID NO: 447541 - protein, 9 aa, Influenza virus
LGKVECVCR

SEQ ID NO: 447542 - protein, 9 aa, Influenza virus
LGLDIRTAT

SEQ ID NO: 447543 - protein, 9 aa, Influenza virus
LGLHDANVR

SEQ ID NO: 447544 - protein, 9 aa, Influenza virus
LGLNIGLHL

SEQ ID NO: 447545 - protein, 9 aa, Influenza virus
LGLNVGLHL

SEQ ID NO: 447546 - protein, 9 aa, Influenza virus
LGLRISSSF

SEQ ID NO: 447547 - protein, 9 aa, Influenza virus
LGLRNTPSI

SEQ ID NO: 447548 - protein, 9 aa, Influenza virus
LGLSMVKSD

SEQ ID NO: 447549 - protein, 9 aa, Influenza virus
LGLSMVRSD

SEQ ID NO: 447550 - protein, 9 aa, Influenza virus
LGLVCATCE

SEQ ID NO: 447551 - protein, 9 aa, Influenza virus
LGMKNVPEK

SEQ ID NO: 447552 - protein, 9 aa, Influenza virus
LGMQNGSCR

SEQ ID NO: 447553 - protein, 9 aa, Influenza virus
LGMQNGSYR

SEQ ID NO: 447554 - protein, 9 aa, Influenza virus
LGNCHPIGI

SEQ ID NO: 447555 - protein, 9 aa, Influenza virus
LGNCHPIGM

SEQ ID NO: 447556 - protein, 9 aa, Influenza virus
LGNCHPVGM

SEQ ID NO: 447557 - protein, 9 aa, Influenza virus
LGNCPKYIK

SEQ ID NO: 447558 - protein, 9 aa, Influenza virus
LGNGCFEFW

SEQ ID NO: 447559 - protein, 9 aa, Influenza virus
LGNGCFEFY

SEQ ID NO: 447560 - protein, 9 aa, Influenza virus
LGNILLSPE

SEQ ID NO: 447561 - protein, 9 aa, Influenza virus
LGNLNKKME

SEQ ID NO: 447562 - protein, 9 aa, Influenza virus
LGNPECDIL

SEQ ID NO: 447563 - protein, 9 aa, Influenza virus
LGNPECDLF

SEQ ID NO: 447564 - protein, 9 aa, Influenza virus
LGNPECDLL

SEQ ID NO: 447565 - protein, 9 aa, Influenza virus
LGNPECDRL

SEQ ID NO: 447566 - protein, 9 aa, Influenza virus
LGNPKCDLY

SEQ ID NO: 447567 - protein, 9 aa, Influenza virus
LGNPKCDPY

SEQ ID NO: 447568 - protein, 9 aa, Influenza virus
LGNPKCDRL

SEQ ID NO: 447569 - protein, 9 aa, Influenza virus
LGNPLCDEF

SEQ ID NO: 447570 - protein, 9 aa, Influenza virus
LGNPMCDDL

SEQ ID NO: 447571 - protein, 9 aa, Influenza virus
LGNPMCDEF

SEQ ID NO: 447572 - protein, 9 aa, Influenza virus
LGNPMCDEL

SEQ ID NO: 447573 - protein, 9 aa, Influenza virus
LGNPMCDKF

SEQ ID NO: 447574 - protein, 9 aa, Influenza virus
LGNPMCDNL

SEQ ID NO: 447575 - protein, 9 aa, Influenza virus
LGNPMCDYL

SEQ ID NO: 447576 - protein, 9 aa, Influenza virus
LGNPRCDDL

SEQ ID NO: 447577 - protein, 9 aa, Influenza virus
LGNPTCDEF

SEQ ID NO: 447578 - protein, 9 aa, Influenza virus
LGNQKTLDE

SEQ ID NO: 447579 - protein, 9 aa, Influenza virus
LGNVINWTR

SEQ ID NO: 447580 - protein, 9 aa, Influenza virus
LGNYKEICI

SEQ ID NO: 447581 - protein, 9 aa, Influenza virus
LGNYKEICV

SEQ ID NO: 447582 - protein, 9 aa, Influenza virus
LGNYKEMCA

SEQ ID NO: 447583 - protein, 9 aa, Influenza virus
LGNYREICI

SEQ ID NO: 447584 - protein, 9 aa, Influenza virus
LGNYREVCI

SEQ ID NO: 447585 - protein, 9 aa, Influenza virus
LGPATAQMA

SEQ ID NO: 447586 - protein, 9 aa, Influenza virus
LGQCGFLGT

SEQ ID NO: 447587 - protein, 9 aa, Influenza virus
LGQCGILGI

SEQ ID NO: 447588 - protein, 9 aa, Influenza virus
LGQCGLLGI

SEQ ID NO: 447589 - protein, 9 aa, Influenza virus
LGQCGLLGT

SEQ ID NO: 447590 - protein, 9 aa, Influenza virus
LGQFPVQTD

SEQ ID NO: 447591 - protein, 9 aa, Influenza virus
LGQGTPLNN

SEQ ID NO: 447592 - protein, 9 aa, Influenza virus
LGQGTTLDH

SEQ ID NO: 447593 - protein, 9 aa, Influenza virus
LGQGTTLDN

SEQ ID NO: 447594 - protein, 9 aa, Influenza virus
LGQGTTLDS

SEQ ID NO: 447595 - protein, 9 aa, Influenza virus
LGQGTTLEN

SEQ ID NO: 447596 - protein, 9 aa, Influenza virus
LGQGTTLKN

SEQ ID NO: 447597 - protein, 9 aa, Influenza virus
LGQGTTLNN

SEQ ID NO: 447598 - protein, 9 aa, Influenza virus
LGQGTTLSN

SEQ ID NO: 447599 - protein, 9 aa, Influenza virus
LGQGTTLYN

SEQ ID NO: 447600 - protein, 9 aa, Influenza virus
LGQVECVCR

SEQ ID NO: 447601 - protein, 9 aa, Influenza virus
LGQWDWPDG

SEQ ID NO: 447602 - protein, 9 aa, Influenza virus
LGQWNWPDG

SEQ ID NO: 447603 - protein, 9 aa, Influenza virus
LGRCGLLGT

SEQ ID NO: 447604 - protein, 9 aa, Influenza virus
LGRGYMFES

SEQ ID NO: 447605 - protein, 9 aa, Influenza virus
LGRTISIAS

SEQ ID NO: 447606 - protein, 9 aa, Influenza virus
LGRTISKDL

SEQ ID NO: 447607 - protein, 9 aa, Influenza virus
LGRTISKDS

SEQ ID NO: 447608 - protein, 9 aa, Influenza virus
LGRTISKDT

SEQ ID NO: 447609 - protein, 9 aa, Influenza virus
LGRTISPHS

SEQ ID NO: 447610 - protein, 9 aa, Influenza virus
LGRTISPKL

SEQ ID NO: 447611 - protein, 9 aa, Influenza virus
LGRTISPRL

SEQ ID NO: 447612 - protein, 9 aa, Influenza virus
LGRTISPRS

SEQ ID NO: 447613 - protein, 9 aa, Influenza virus
LGRTISTAS

SEQ ID NO: 447614 - protein, 9 aa, Influenza virus
LGRTTSKDS

SEQ ID NO: 447615 - protein, 9 aa, Influenza virus
LGRTTSTAS

SEQ ID NO: 447616 - protein, 9 aa, Influenza virus
LGRTVSING

SEQ ID NO: 447617 - protein, 9 aa, Influenza virus
LGRTVSISG

SEQ ID NO: 447618 - protein, 9 aa, Influenza virus
LGRTVSNSG

SEQ ID NO: 447619 - protein, 9 aa, Influenza virus
LGRTVSTSG

SEQ ID NO: 447620 - protein, 9 aa, Influenza virus
LGSAQHVEE

SEQ ID NO: 447621 - protein, 9 aa, Influenza virus
LGSCGILGT

SEQ ID NO: 447622 - protein, 9 aa, Influenza virus
LGSCHPIGM

SEQ ID NO: 447623 - protein, 9 aa, Influenza virus
LGSPGCDHL

SEQ ID NO: 447624 - protein, 9 aa, Influenza virus
LGSPGCDRL

SEQ ID NO: 447625 - protein, 9 aa, Influenza virus
LGSPLELRD

SEQ ID NO: 447626 - protein, 9 aa, Influenza virus
LGSPLVLDD

SEQ ID NO: 447627 - protein, 9 aa, Influenza virus
LGSPPIVSN

SEQ ID NO: 447628 - protein, 9 aa, Influenza virus
LGSPPMVSN

SEQ ID NO: 447629 - protein, 9 aa, Influenza virus
LGSPPVVSN

SEQ ID NO: 447630 - protein, 9 aa, Influenza virus
LGSSFYAEM

SEQ ID NO: 447631 - protein, 9 aa, Influenza virus
LGSSPNAYQ

SEQ ID NO: 447632 - protein, 9 aa, Influenza virus
LGSWSWHDG

SEQ ID NO: 447633 - protein, 9 aa, Influenza virus
LGTIIGPPQ

SEQ ID NO: 447634 - protein, 9 aa, Influenza virus
LGTITGPPQ

SEQ ID NO: 447635 - protein, 9 aa, Influenza virus
LGTKHSNGT

SEQ ID NO: 447636 - protein, 9 aa, Influenza virus
LGTKQVCAA

SEQ ID NO: 447637 - protein, 9 aa, Influenza virus
LGTKQVCIA

SEQ ID NO: 447638 - protein, 9 aa, Influenza virus
LGTKQVCMA

SEQ ID NO: 447639 - protein, 9 aa, Influenza virus
LGTKQVCVA

SEQ ID NO: 447640 - protein, 9 aa, Influenza virus
LGTLIGPPQ

SEQ ID NO: 447641 - protein, 9 aa, Influenza virus
LGTNHSNGT

SEQ ID NO: 447642 - protein, 9 aa, Influenza virus
LGTPLELRD

SEQ ID NO: 447643 - protein, 9 aa, Influenza virus
LGTPPTVSN

SEQ ID NO: 447644 - protein, 9 aa, Influenza virus
LGTRHSNGT

SEQ ID NO: 447645 - protein, 9 aa, Influenza virus
LGTRQVCIA

SEQ ID NO: 447646 - protein, 9 aa, Influenza virus
LGTRQVCMA

SEQ ID NO: 447647 - protein, 9 aa, Influenza virus
LGTRQVCVA

SEQ ID NO: 447648 - protein, 9 aa, Influenza virus
LGTVTGPPQ

SEQ ID NO: 447649 - protein, 9 aa, Influenza virus
LGVKGFGFK

SEQ ID NO: 447650 - protein, 9 aa, Influenza virus
LGVPFHLAT

SEQ ID NO: 447651 - protein, 9 aa, Influenza virus
LGVPFHLGT

SEQ ID NO: 447652 - protein, 9 aa, Influenza virus
LGVPFYLGT

SEQ ID NO: 447653 - protein, 9 aa, Influenza virus
LGVSFHLGT

SEQ ID NO: 447654 - protein, 9 aa, Influenza virus
LGVSILNLG

SEQ ID NO: 447655 - protein, 9 aa, Influenza virus
LGVSVLNLG

SEQ ID NO: 447656 - protein, 9 aa, Influenza virus
LGVWTYNAE

SEQ ID NO: 447657 - protein, 9 aa, Influenza virus
LGVYQILAI

SEQ ID NO: 447658 - protein, 9 aa, Influenza virus
LGYETFKVI

SEQ ID NO: 447659 - protein, 9 aa, Influenza virus
LGYETFKVV

SEQ ID NO: 447660 - protein, 9 aa, Influenza virus
LGYGVKGFG

SEQ ID NO: 447661 - protein, 9 aa, Influenza virus
LGYSTGALA

SEQ ID NO: 447662 - protein, 9 aa, Influenza virus
LHAYISFRN

SEQ ID NO: 447663 - protein, 9 aa, Influenza virus
LHDANVKNL

SEQ ID NO: 447664 - protein, 9 aa, Influenza virus
LHDANVRNL

SEQ ID NO: 447665 - protein, 9 aa, Influenza virus
LHDSNVKNL

SEQ ID NO: 447666 - protein, 9 aa, Influenza virus
LHDSNVRNL

SEQ ID NO: 447667 - protein, 9 aa, Influenza virus
LHDSNVRSL

SEQ ID NO: 447668 - protein, 9 aa, Influenza virus
LHEKIRRML

SEQ ID NO: 447669 - protein, 9 aa, Influenza virus
LHEKVRQML

SEQ ID NO: 447670 - protein, 9 aa, Influenza virus
LHEKVRRIL

SEQ ID NO: 447671 - protein, 9 aa, Influenza virus
LHEKVRRML

SEQ ID NO: 447672 - protein, 9 aa, Influenza virus
LHERVRRML

SEQ ID NO: 447673 - protein, 9 aa, Influenza virus
LHFKQHDCD

SEQ ID NO: 447674 - protein, 9 aa, Influenza virus
LHFKQHECD

SEQ ID NO: 447675 - protein, 9 aa, Influenza virus
LHFKQHECN

SEQ ID NO: 447676 - protein, 9 aa, Influenza virus
LHFKQHKCD

SEQ ID NO: 447677 - protein, 9 aa, Influenza virus
LHFKQNECS

SEQ ID NO: 447678 - protein, 9 aa, Influenza virus
LHICVTGDD

SEQ ID NO: 447679 - protein, 9 aa, Influenza virus
LHIPEAGLK

SEQ ID NO: 447680 - protein, 9 aa, Influenza virus
LHIPEVCLK

SEQ ID NO: 447681 - protein, 9 aa, Influenza virus
LHKCDNECM

SEQ ID NO: 447682 - protein, 9 aa, Influenza virus
LHKCDNKCM

SEQ ID NO: 447683 - protein, 9 aa, Influenza virus
LHKCNDSCM

SEQ ID NO: 447684 - protein, 9 aa, Influenza virus
LHKCNNECM

SEQ ID NO: 447685 - protein, 9 aa, Influenza virus
LHKCNNSCM

SEQ ID NO: 447686 - protein, 9 aa, Influenza virus
LHKCNNTCM

SEQ ID NO: 447687 - protein, 9 aa, Influenza virus
LHLEFKADL

SEQ ID NO: 447688 - protein, 9 aa, Influenza virus
LHLTGKWDT

SEQ ID NO: 447689 - protein, 9 aa, Influenza virus
LHLTGMWDT

SEQ ID NO: 447690 - protein, 9 aa, Influenza virus
LHLTGTWDT

SEQ ID NO: 447691 - protein, 9 aa, Influenza virus
LHLTQGACW

SEQ ID NO: 447692 - protein, 9 aa, Influenza virus
LHLTQGTCW

SEQ ID NO: 447693 - protein, 9 aa, Influenza virus
LHNGGLIAP

SEQ ID NO: 447694 - protein, 9 aa, Influenza virus
LHNIHPLTI

SEQ ID NO: 447695 - protein, 9 aa, Influenza virus
LHQGTTIRN

SEQ ID NO: 447696 - protein, 9 aa, Influenza virus
LHVCITGDD

SEQ ID NO: 447697 - protein, 9 aa, Influenza virus
LHVCVTGDD

SEQ ID NO: 447698 - protein, 9 aa, Influenza virus
LIAFVLWAC

SEQ ID NO: 447699 - protein, 9 aa, Influenza virus
LIAGGLILG

SEQ ID NO: 447700 - protein, 9 aa, Influenza virus
LIAGWYGFQ

SEQ ID NO: 447701 - protein, 9 aa, Influenza virus
LIALCGSPF

SEQ ID NO: 447702 - protein, 9 aa, Influenza virus
LIALCGSPI

SEQ ID NO: 447703 - protein, 9 aa, Influenza virus
LIALCGSPV

SEQ ID NO: 447704 - protein, 9 aa, Influenza virus
LIAMENQHT

SEQ ID NO: 447705 - protein, 9 aa, Influenza virus
LIAPEFGYL

SEQ ID NO: 447706 - protein, 9 aa, Influenza virus
LIAPEYGFK

SEQ ID NO: 447707 - protein, 9 aa, Influenza virus
LIAPEYGFR

SEQ ID NO: 447708 - protein, 9 aa, Influenza virus
LIAPEYGHL

SEQ ID NO: 447709 - protein, 9 aa, Influenza virus
LIAPEYGYL

SEQ ID NO: 447710 - protein, 9 aa, Influenza virus
LIAPRGHYK

SEQ ID NO: 447711 - protein, 9 aa, Influenza virus
LIAPRGHYR

SEQ ID NO: 447712 - protein, 9 aa, Influenza virus
LIAPRGYFK

SEQ ID NO: 447713 - protein, 9 aa, Influenza virus
LIAPRGYFR

SEQ ID NO: 447714 - protein, 9 aa, Influenza virus
LIAPRGYYK

SEQ ID NO: 447715 - protein, 9 aa, Influenza virus
LIAPRYGYI

SEQ ID NO: 447716 - protein, 9 aa, Influenza virus
LIAPSRVSK

SEQ ID NO: 447717 - protein, 9 aa, Influenza virus
LIAPSRVTK

SEQ ID NO: 447718 - protein, 9 aa, Influenza virus
LIAPWYAFR

SEQ ID NO: 447719 - protein, 9 aa, Influenza virus
LIAPWYAYK

SEQ ID NO: 447720 - protein, 9 aa, Influenza virus
LIAPWYAYR

SEQ ID NO: 447721 - protein, 9 aa, Influenza virus
LIASSGTLE

SEQ ID NO: 447722 - protein, 9 aa, Influenza virus
LICATCEQI

SEQ ID NO: 447723 - protein, 9 aa, Influenza virus
LIDALLGDP

SEQ ID NO: 447724 - protein, 9 aa, Influenza virus
LIDAMLGDP

SEQ ID NO: 447725 - protein, 9 aa, Influenza virus
LIDFLKDVI

SEQ ID NO: 447726 - protein, 9 aa, Influenza virus
LIDFLKDVM

SEQ ID NO: 447727 - protein, 9 aa, Influenza virus
LIDFLKDVT

SEQ ID NO: 447728 - protein, 9 aa, Influenza virus
LIDFLKDVV

SEQ ID NO: 447729 - protein, 9 aa, Influenza virus
LIDGWYGFK

SEQ ID NO: 447730 - protein, 9 aa, Influenza virus
LIDGWYGFR

SEQ ID NO: 447731 - protein, 9 aa, Influenza virus
LIDGWYGYH

SEQ ID NO: 447732 - protein, 9 aa, Influenza virus
LIDGWYGYK

SEQ ID NO: 447733 - protein, 9 aa, Influenza virus
LIDGWYGYR

SEQ ID NO: 447734 - protein, 9 aa, Influenza virus
LIDKTNQQF

SEQ ID NO: 447735 - protein, 9 aa, Influenza virus
LIDNEFTEV

SEQ ID NO: 447736 - protein, 9 aa, Influenza virus
LIDQSGTYP

SEQ ID NO: 447737 - protein, 9 aa, Influenza virus
LIDRTNHQF

SEQ ID NO: 447738 - protein, 9 aa, Influenza virus
LIDSIGSWS

SEQ ID NO: 447739 - protein, 9 aa, Influenza virus
LIEDPAAPH

SEQ ID NO: 447740 - protein, 9 aa, Influenza virus
LIEDPGAPH

SEQ ID NO: 447741 - protein, 9 aa, Influenza virus
LIEDPNAPH

SEQ ID NO: 447742 - protein, 9 aa, Influenza virus
LIEDPNAPN

SEQ ID NO: 447743 - protein, 9 aa, Influenza virus
LIEDPSAPH

SEQ ID NO: 447744 - protein, 9 aa, Influenza virus
LIEDPTAPH

SEQ ID NO: 447745 - protein, 9 aa, Influenza virus
LIEKTNDKY

SEQ ID NO: 447746 - protein, 9 aa, Influenza virus
LIEKTNEKY

SEQ ID NO: 447747 - protein, 9 aa, Influenza virus
LIEKTNKQF

SEQ ID NO: 447748 - protein, 9 aa, Influenza virus
LIEKTNQQF

SEQ ID NO: 447749 - protein, 9 aa, Influenza virus
LIEKTNTEF

SEQ ID NO: 447750 - protein, 9 aa, Influenza virus
LIEKTNTQF

SEQ ID NO: 447751 - protein, 9 aa, Influenza virus
LIEKTSWSY

SEQ ID NO: 447752 - protein, 9 aa, Influenza virus
LIENDRTLD

SEQ ID NO: 447753 - protein, 9 aa, Influenza virus
LIENERTLD

SEQ ID NO: 447754 - protein, 9 aa, Influenza virus
LIENLQAYQ

SEQ ID NO: 447755 - protein, 9 aa, Influenza virus
LIENQKTLD

SEQ ID NO: 447756 - protein, 9 aa, Influenza virus
LIENTYVNN

SEQ ID NO: 447757 - protein, 9 aa, Influenza virus
LIEQKVPVT

SEQ ID NO: 447758 - protein, 9 aa, Influenza virus
LIEQNIPVT

SEQ ID NO: 447759 - protein, 9 aa, Influenza virus
LIEQNVPVT

SEQ ID NO: 447760 - protein, 9 aa, Influenza virus
LIERTNEKY

SEQ ID NO: 447761 - protein, 9 aa, Influenza virus
LIERTNQQF

SEQ ID NO: 447762 - protein, 9 aa, Influenza virus
LIETNHTGT

SEQ ID NO: 447763 - protein, 9 aa, Influenza virus
LIETTHTGT

SEQ ID NO: 447764 - protein, 9 aa, Influenza virus
LIFLARSAL

SEQ ID NO: 447765 - protein, 9 aa, Influenza virus
LIFMARSAL

SEQ ID NO: 447766 - protein, 9 aa, Influenza virus
LIFMCVKNG

SEQ ID NO: 447767 - protein, 9 aa, Influenza virus
LIFNTVIHE

SEQ ID NO: 447768 - protein, 9 aa, Influenza virus
LIFNTVIHG

SEQ ID NO: 447769 - protein, 9 aa, Influenza virus
LIFSARSAL

SEQ ID NO: 447770 - protein, 9 aa, Influenza virus
LIGISNIGL

SEQ ID NO: 447771 - protein, 9 aa, Influenza virus
LIGISNMSL

SEQ ID NO: 447772 - protein, 9 aa, Influenza virus
LIGISNVGL

SEQ ID NO: 447773 - protein, 9 aa, Influenza virus
LIGISNVVL

SEQ ID NO: 447774 - protein, 9 aa, Influenza virus
LIGKTNQQF

SEQ ID NO: 447775 - protein, 9 aa, Influenza virus
LIGKTSWSY

SEQ ID NO: 447776 - protein, 9 aa, Influenza virus
LIGQGDIVL

SEQ ID NO: 447777 - protein, 9 aa, Influenza virus
LIGQGDVVL

SEQ ID NO: 447778 - protein, 9 aa, Influenza virus
LIGVSNVGL

SEQ ID NO: 447779 - protein, 9 aa, Influenza virus
LIHQSETYP

SEQ ID NO: 447780 - protein, 9 aa, Influenza virus
LIHQSGTYP

SEQ ID NO: 447781 - protein, 9 aa, Influenza virus
LIIAARNIV

SEQ ID NO: 447782 - protein, 9 aa, Influenza virus
LIIAARSIV

SEQ ID NO: 447783 - protein, 9 aa, Influenza virus
LIIERKEGT

SEQ ID NO: 447784 - protein, 9 aa, Influenza virus
LIIERREGA

SEQ ID NO: 447785 - protein, 9 aa, Influenza virus
LIIERREGN

SEQ ID NO: 447786 - protein, 9 aa, Influenza virus
LIIERREGS

SEQ ID NO: 447787 - protein, 9 aa, Influenza virus
LIIERREGT

SEQ ID NO: 447788 - protein, 9 aa, Influenza virus
LIIERRNSS

SEQ ID NO: 447789 - protein, 9 aa, Influenza virus
LIIGISNVG

SEQ ID NO: 447790 - protein, 9 aa, Influenza virus
LIISPDLSY

SEQ ID NO: 447791 - protein, 9 aa, Influenza virus
LIIWGIHHP

SEQ ID NO: 447792 - protein, 9 aa, Influenza virus
LIIWGIHHS

SEQ ID NO: 447793 - protein, 9 aa, Influenza virus
LIIWGVHHP

SEQ ID NO: 447794 - protein, 9 aa, Influenza virus
LIIWGVHHS

SEQ ID NO: 447795 - protein, 9 aa, Influenza virus
LIKHENRMV

SEQ ID NO: 447796 - protein, 9 aa, Influenza virus
LILAAIIMG

SEQ ID NO: 447797 - protein, 9 aa, Influenza virus
LILAFILWA

SEQ ID NO: 447798 - protein, 9 aa, Influenza virus
LILAFIMWA

SEQ ID NO: 447799 - protein, 9 aa, Influenza virus
LILAFIMWT

SEQ ID NO: 447800 - protein, 9 aa, Influenza virus
LILATGLRN

SEQ ID NO: 447801 - protein, 9 aa, Influenza virus
LILATGVRN

SEQ ID NO: 447802 - protein, 9 aa, Influenza virus
LILFNTIGN

SEQ ID NO: 447803 - protein, 9 aa, Influenza virus
LILGFVLWA

SEQ ID NO: 447804 - protein, 9 aa, Influenza virus
LILGMQNGS

SEQ ID NO: 447805 - protein, 9 aa, Influenza virus
LILGNPKCD

SEQ ID NO: 447806 - protein, 9 aa, Influenza virus
LILKDCSIA

SEQ ID NO: 447807 - protein, 9 aa, Influenza virus
LILKDCSVA

SEQ ID NO: 447808 - protein, 9 aa, Influenza virus
LILLENERT

SEQ ID NO: 447809 - protein, 9 aa, Influenza virus
LILRDCSVA

SEQ ID NO: 447810 - protein, 9 aa, Influenza virus
LILRGAVAH

SEQ ID NO: 447811 - protein, 9 aa, Influenza virus
LILRGSIAH

SEQ ID NO: 447812 - protein, 9 aa, Influenza virus
LILRGSVAH

SEQ ID NO: 447813 - protein, 9 aa, Influenza virus
LILSFIMWA

SEQ ID NO: 447814 - protein, 9 aa, Influenza virus
LILSNPKCD

SEQ ID NO: 447815 - protein, 9 aa, Influenza virus
LILTFIMWA

SEQ ID NO: 447816 - protein, 9 aa, Influenza virus
LILVALALS

SEQ ID NO: 447817 - protein, 9 aa, Influenza virus
LIMRTVIAL

SEQ ID NO: 447818 - protein, 9 aa, Influenza virus
LIMWGIHHP

SEQ ID NO: 447819 - protein, 9 aa, Influenza virus
LINDPWVLL

SEQ ID NO: 447820 - protein, 9 aa, Influenza virus
LINGALGSP

SEQ ID NO: 447821 - protein, 9 aa, Influenza virus
LINGWYGFQ

SEQ ID NO: 447822 - protein, 9 aa, Influenza virus
LINGWYGFR

SEQ ID NO: 447823 - protein, 9 aa, Influenza virus
LINTYQWII

SEQ ID NO: 447824 - protein, 9 aa, Influenza virus
LIPMISKCK

SEQ ID NO: 447825 - protein, 9 aa, Influenza virus
LIPMISKCR

SEQ ID NO: 447826 - protein, 9 aa, Influenza virus
LIQFPIGTA

SEQ ID NO: 447827 - protein, 9 aa, Influenza virus
LIQFPMGTA

SEQ ID NO: 447828 - protein, 9 aa, Influenza virus
LIQGYKDII

SEQ ID NO: 447829 - protein, 9 aa, Influenza virus
LIQLIVSGK

SEQ ID NO: 447830 - protein, 9 aa, Influenza virus
LIQLIVSGR

SEQ ID NO: 447831 - protein, 9 aa, Influenza virus
LIQNSITIE

SEQ ID NO: 447832 - protein, 9 aa, Influenza virus
LIQNSLTIE

SEQ ID NO: 447833 - protein, 9 aa, Influenza virus
LIQNSMTIE

SEQ ID NO: 447834 - protein, 9 aa, Influenza virus
LIRALTLNT

SEQ ID NO: 447835 - protein, 9 aa, Influenza virus
LIRFPIGTA

SEQ ID NO: 447836 - protein, 9 aa, Influenza virus
LIRFPIGVA

SEQ ID NO: 447837 - protein, 9 aa, Influenza virus
LIRFPVGTA

SEQ ID NO: 447838 - protein, 9 aa, Influenza virus
LIRGMPKES

SEQ ID NO: 447839 - protein, 9 aa, Influenza virus
LIRGMPQET

SEQ ID NO: 447840 - protein, 9 aa, Influenza virus
LIRGNSPIF

SEQ ID NO: 447841 - protein, 9 aa, Influenza virus
LIRGNSPVF

SEQ ID NO: 447842 - protein, 9 aa, Influenza virus
LIRGQQGRM

SEQ ID NO: 447843 - protein, 9 aa, Influenza virus
LIRGRPEEA

SEQ ID NO: 447844 - protein, 9 aa, Influenza virus
LIRGRPEEV

SEQ ID NO: 447845 - protein, 9 aa, Influenza virus
LIRGRPKED

SEQ ID NO: 447846 - protein, 9 aa, Influenza virus
LIRGRPKEE

SEQ ID NO: 447847 - protein, 9 aa, Influenza virus
LIRGRPKEN

SEQ ID NO: 447848 - protein, 9 aa, Influenza virus
LIRGRPKES

SEQ ID NO: 447849 - protein, 9 aa, Influenza virus
LIRGRPKET

SEQ ID NO: 447850 - protein, 9 aa, Influenza virus
LIRGRPQEN

SEQ ID NO: 447851 - protein, 9 aa, Influenza virus
LIRGRPQET

SEQ ID NO: 447852 - protein, 9 aa, Influenza virus
LIRGRPRES

SEQ ID NO: 447853 - protein, 9 aa, Influenza virus
LIRHENRMV

SEQ ID NO: 447854 - protein, 9 aa, Influenza virus
LIRMIKRGI

SEQ ID NO: 447855 - protein, 9 aa, Influenza virus
LIRMIKRGV

SEQ ID NO: 447856 - protein, 9 aa, Influenza virus
LIRMVKRGI

SEQ ID NO: 447857 - protein, 9 aa, Influenza virus
LIRTLTLNT

SEQ ID NO: 447858 - protein, 9 aa, Influenza virus
LISDGGPNL

SEQ ID NO: 447859 - protein, 9 aa, Influenza virus
LISKTNQQF

SEQ ID NO: 447860 - protein, 9 aa, Influenza virus
LISTPLGSP

SEQ ID NO: 447861 - protein, 9 aa, Influenza virus
LISTPLGTP

SEQ ID NO: 447862 - protein, 9 aa, Influenza virus
LISWEMGLA

SEQ ID NO: 447863 - protein, 9 aa, Influenza virus
LISWEMGQA

SEQ ID NO: 447864 - protein, 9 aa, Influenza virus
LISWGMGQA

SEQ ID NO: 447865 - protein, 9 aa, Influenza virus
LISWPLSSP

SEQ ID NO: 447866 - protein, 9 aa, Influenza virus
LISWPQSSP

SEQ ID NO: 447867 - protein, 9 aa, Influenza virus
LITDGPSDA

SEQ ID NO: 447868 - protein, 9 aa, Influenza virus
LITDGPSNA

SEQ ID NO: 447869 - protein, 9 aa, Influenza virus
LITDTIKSW

SEQ ID NO: 447870 - protein, 9 aa, Influenza virus
LITGKSHGR

SEQ ID NO: 447871 - protein, 9 aa, Influenza virus
LITQESECV

SEQ ID NO: 447872 - protein, 9 aa, Influenza virus
LITVGSSKY

SEQ ID NO: 447873 - protein, 9 aa, Influenza virus
LITWGIHHP

SEQ ID NO: 447874 - protein, 9 aa, Influenza virus
LIVFNTIGN

SEQ ID NO: 447875 - protein, 9 aa, Influenza virus
LIVLLENQK

SEQ ID NO: 447876 - protein, 9 aa, Influenza virus
LIVPEWSYI

SEQ ID NO: 447877 - protein, 9 aa, Influenza virus
LIVSLGAIS

SEQ ID NO: 447878 - protein, 9 aa, Influenza virus
LIVWGIHHP

SEQ ID NO: 447879 - protein, 9 aa, Influenza virus
LIVWGIHHS

SEQ ID NO: 447880 - protein, 9 aa, Influenza virus
LIVWGVHHS

SEQ ID NO: 447881 - protein, 9 aa, Influenza virus
LIWLWLVLR

SEQ ID NO: 447882 - protein, 9 aa, Influenza virus
LIWMACHSA

SEQ ID NO: 447883 - protein, 9 aa, Influenza virus
LIYGNPFCD

SEQ ID NO: 447884 - protein, 9 aa, Influenza virus
LIYGNPSCD

SEQ ID NO: 447885 - protein, 9 aa, Influenza virus
LIYGNPSCN

SEQ ID NO: 447886 - protein, 9 aa, Influenza virus
LIYNRMGAV

SEQ ID NO: 447887 - protein, 9 aa, Influenza virus
LIYNRMGTI

SEQ ID NO: 447888 - protein, 9 aa, Influenza virus
LIYNRMGTV

SEQ ID NO: 447889 - protein, 9 aa, Influenza virus
LKAEIAQKL

SEQ ID NO: 447890 - protein, 9 aa, Influenza virus
LKAEIAQRL

SEQ ID NO: 447891 - protein, 9 aa, Influenza virus
LKDCSIAGW

SEQ ID NO: 447892 - protein, 9 aa, Influenza virus
LKDCSVAGW

SEQ ID NO: 447893 - protein, 9 aa, Influenza virus
LKDCSVSGW

SEQ ID NO: 447894 - protein, 9 aa, Influenza virus
LKDEEKIPK

SEQ ID NO: 447895 - protein, 9 aa, Influenza virus
LKDNAIDEG

SEQ ID NO: 447896 - protein, 9 aa, Influenza virus
LKDNAKDEG

SEQ ID NO: 447897 - protein, 9 aa, Influenza virus
LKDNAKDLG

SEQ ID NO: 447898 - protein, 9 aa, Influenza virus
LKDNAKELG

SEQ ID NO: 447899 - protein, 9 aa, Influenza virus
LKDNAKEVG

SEQ ID NO: 447900 - protein, 9 aa, Influenza virus
LKDNANDLG

SEQ ID NO: 447901 - protein, 9 aa, Influenza virus
LKDNARELG

SEQ ID NO: 447902 - protein, 9 aa, Influenza virus
LKDNLEPGT

SEQ ID NO: 447903 - protein, 9 aa, Influenza virus
LKDQAWSYI

SEQ ID NO: 447904 - protein, 9 aa, Influenza virus
LKDQDWSYI

SEQ ID NO: 447905 - protein, 9 aa, Influenza virus
LKDQGWSYI

SEQ ID NO: 447906 - protein, 9 aa, Influenza virus
LKDQSWSYI

SEQ ID NO: 447907 - protein, 9 aa, Influenza virus
LKEQLSTVS

SEQ ID NO: 447908 - protein, 9 aa, Influenza virus
LKFKADLII

SEQ ID NO: 447909 - protein, 9 aa, Influenza virus
LKGKFQTAA

SEQ ID NO: 447910 - protein, 9 aa, Influenza virus
LKGLILGNP

SEQ ID NO: 447911 - protein, 9 aa, Influenza virus
LKGNAKDEG

SEQ ID NO: 447912 - protein, 9 aa, Influenza virus
LKGRHANGT

SEQ ID NO: 447913 - protein, 9 aa, Influenza virus
LKGSAKHIE

SEQ ID NO: 447914 - protein, 9 aa, Influenza virus
LKGSARHIE

SEQ ID NO: 447915 - protein, 9 aa, Influenza virus
LKGVRPLIL

SEQ ID NO: 447916 - protein, 9 aa, Influenza virus
LKHNPTEEQ

SEQ ID NO: 447917 - protein, 9 aa, Influenza virus
LKHRFEIIE

SEQ ID NO: 447918 - protein, 9 aa, Influenza virus
LKIHNAGTD

SEQ ID NO: 447919 - protein, 9 aa, Influenza virus
LKIKKGKIM

SEQ ID NO: 447920 - protein, 9 aa, Influenza virus
LKIKKGKIV

SEQ ID NO: 447921 - protein, 9 aa, Influenza virus
LKIPNAETD

SEQ ID NO: 447922 - protein, 9 aa, Influenza virus
LKIPNAGID

SEQ ID NO: 447923 - protein, 9 aa, Influenza virus
LKIPNAGTD

SEQ ID NO: 447924 - protein, 9 aa, Influenza virus
LKIRKGKIM

SEQ ID NO: 447925 - protein, 9 aa, Influenza virus
LKIRKGKIV

SEQ ID NO: 447926 - protein, 9 aa, Influenza virus
LKIRTNGNL

SEQ ID NO: 447927 - protein, 9 aa, Influenza virus
LKISSSFSF

SEQ ID NO: 447928 - protein, 9 aa, Influenza virus
LKITENSFE

SEQ ID NO: 447929 - protein, 9 aa, Influenza virus
LKIYHKCDN

SEQ ID NO: 447930 - protein, 9 aa, Influenza virus
LKKQEIEGI

SEQ ID NO: 447931 - protein, 9 aa, Influenza virus
LKLAIGLRN

SEQ ID NO: 447932 - protein, 9 aa, Influenza virus
LKLAIGPRN

SEQ ID NO: 447933 - protein, 9 aa, Influenza virus
LKLASGLRN

SEQ ID NO: 447934 - protein, 9 aa, Influenza virus
LKLATGLKN

SEQ ID NO: 447935 - protein, 9 aa, Influenza virus
LKLATGLRN

SEQ ID NO: 447936 - protein, 9 aa, Influenza virus
LKLATGMRN

SEQ ID NO: 447937 - protein, 9 aa, Influenza virus
LKLATGPRN

SEQ ID NO: 447938 - protein, 9 aa, Influenza virus
LKLAVGLKN

SEQ ID NO: 447939 - protein, 9 aa, Influenza virus
LKLAVGLRN

SEQ ID NO: 447940 - protein, 9 aa, Influenza virus
LKLAVGMRN

SEQ ID NO: 447941 - protein, 9 aa, Influenza virus
LKLAVGPRN

SEQ ID NO: 447942 - protein, 9 aa, Influenza virus
LKLGQFPVQ

SEQ ID NO: 447943 - protein, 9 aa, Influenza virus
LKLSIEDPD

SEQ ID NO: 447944 - protein, 9 aa, Influenza virus
LKLSIEDPN

SEQ ID NO: 447945 - protein, 9 aa, Influenza virus
LKLSIEDPS

SEQ ID NO: 447946 - protein, 9 aa, Influenza virus
LKLSIENPS

SEQ ID NO: 447947 - protein, 9 aa, Influenza virus
LKLVDGQDC

SEQ ID NO: 447948 - protein, 9 aa, Influenza virus
LKMATGLRN

SEQ ID NO: 447949 - protein, 9 aa, Influenza virus
LKMPASRYL

SEQ ID NO: 447950 - protein, 9 aa, Influenza virus
LKMSLLTEV

SEQ ID NO: 447951 - protein, 9 aa, Influenza virus
LKMTIASDI

SEQ ID NO: 447952 - protein, 9 aa, Influenza virus
LKNGNMRCT

SEQ ID NO: 447953 - protein, 9 aa, Influenza virus
LKNNAIDEG

SEQ ID NO: 447954 - protein, 9 aa, Influenza virus
LKNNAKDEG

SEQ ID NO: 447955 - protein, 9 aa, Influenza virus
LKPGETLKV

SEQ ID NO: 447956 - protein, 9 aa, Influenza virus
LKPGETLNI

SEQ ID NO: 447957 - protein, 9 aa, Influenza virus
LKPGETLNV

SEQ ID NO: 447958 - protein, 9 aa, Influenza virus
LKPGQTLRI

SEQ ID NO: 447959 - protein, 9 aa, Influenza virus
LKPGQTLRV

SEQ ID NO: 447960 - protein, 9 aa, Influenza virus
LKPGQTVKI

SEQ ID NO: 447961 - protein, 9 aa, Influenza virus
LKPQCQITG

SEQ ID NO: 447962 - protein, 9 aa, Influenza virus
LKQNPTEEQ

SEQ ID NO: 447963 - protein, 9 aa, Influenza virus
LKREITFHG

SEQ ID NO: 447964 - protein, 9 aa, Influenza virus
LKREMTFHG

SEQ ID NO: 447965 - protein, 9 aa, Influenza virus
LKRGETLKI

SEQ ID NO: 447966 - protein, 9 aa, Influenza virus
LKRNEIKGV

SEQ ID NO: 447967 - protein, 9 aa, Influenza virus
LKRQEIDGI

SEQ ID NO: 447968 - protein, 9 aa, Influenza virus
LKRQEIEGI

SEQ ID NO: 447969 - protein, 9 aa, Influenza virus
LKRQEINGI

SEQ ID NO: 447970 - protein, 9 aa, Influenza virus
LKRRAIATP

SEQ ID NO: 447971 - protein, 9 aa, Influenza virus
LKSDKRIGS

SEQ ID NO: 447972 - protein, 9 aa, Influenza virus
LKSEDNVYK

SEQ ID NO: 447973 - protein, 9 aa, Influenza virus
LKSEQFPVQ

SEQ ID NO: 447974 - protein, 9 aa, Influenza virus
LKSGQFPVQ

SEQ ID NO: 447975 - protein, 9 aa, Influenza virus
LKSLFSSIK

SEQ ID NO: 447976 - protein, 9 aa, Influenza virus
LKSNAIDEG

SEQ ID NO: 447977 - protein, 9 aa, Influenza virus
LKSTQAAID

SEQ ID NO: 447978 - protein, 9 aa, Influenza virus
LKSTQAAIN

SEQ ID NO: 447979 - protein, 9 aa, Influenza virus
LKSTQAAIT

SEQ ID NO: 447980 - protein, 9 aa, Influenza virus
LKSTQAAVN

SEQ ID NO: 447981 - protein, 9 aa, Influenza virus
LKSTQTAID

SEQ ID NO: 447982 - protein, 9 aa, Influenza virus
LKSWKGNIM

SEQ ID NO: 447983 - protein, 9 aa, Influenza virus
LKTEDNIYK

SEQ ID NO: 447984 - protein, 9 aa, Influenza virus
LKTEDNVYK

SEQ ID NO: 447985 - protein, 9 aa, Influenza virus
LKTRPILSP

SEQ ID NO: 447986 - protein, 9 aa, Influenza virus
LKVESNGNL

SEQ ID NO: 447987 - protein, 9 aa, Influenza virus
LKVPNAEKD

SEQ ID NO: 447988 - protein, 9 aa, Influenza virus
LKVPNAGTD

SEQ ID NO: 447989 - protein, 9 aa, Influenza virus
LKVPNALTD

SEQ ID NO: 447990 - protein, 9 aa, Influenza virus
LKWALGENM

SEQ ID NO: 447991 - protein, 9 aa, Influenza virus
LKWLISKSK

SEQ ID NO: 447992 - protein, 9 aa, Influenza virus
LKWLVSKDK

SEQ ID NO: 447993 - protein, 9 aa, Influenza virus
LKWLVSKNK

SEQ ID NO: 447994 - protein, 9 aa, Influenza virus
LKWLVSKSK

SEQ ID NO: 447995 - protein, 9 aa, Influenza virus
LKWLVSKTK

SEQ ID NO: 447996 - protein, 9 aa, Influenza virus
LKWTLGENM

SEQ ID NO: 447997 - protein, 9 aa, Influenza virus
LKWVLGENM

SEQ ID NO: 447998 - protein, 9 aa, Influenza virus
LKYKGIITG

SEQ ID NO: 447999 - protein, 9 aa, Influenza virus
LKYNDIITD

SEQ ID NO: 448000 - protein, 9 aa, Influenza virus
LKYNGIITD

SEQ ID NO: 448001 - protein, 9 aa, Influenza virus
LKYNGIITE

SEQ ID NO: 448002 - protein, 9 aa, Influenza virus
LKYNGIITG

SEQ ID NO: 448003 - protein, 9 aa, Influenza virus
LKYNGVITD

SEQ ID NO: 448004 - protein, 9 aa, Influenza virus
LLAFILWAC

SEQ ID NO: 448005 - protein, 9 aa, Influenza virus
LLAFMLWAC

SEQ ID NO: 448006 - protein, 9 aa, Influenza virus
LLAFVLWAC

SEQ ID NO: 448007 - protein, 9 aa, Influenza virus
LLAIAMGLG

SEQ ID NO: 448008 - protein, 9 aa, Influenza virus
LLAIAMGLI

SEQ ID NO: 448009 - protein, 9 aa, Influenza virus
LLAIAMGLV

SEQ ID NO: 448010 - protein, 9 aa, Influenza virus
LLAIVMGLV

SEQ ID NO: 448011 - protein, 9 aa, Influenza virus
  MOD_RES (4)..(4): Ile or Leu
LLAXVMGLV

SEQ ID NO: 448012 - protein, 9 aa, Influenza virus
LLAKSVFNC

SEQ ID NO: 448013 - protein, 9 aa, Influenza virus
LLAKSVFNN

SEQ ID NO: 448014 - protein, 9 aa, Influenza virus
LLAKSVFNS

SEQ ID NO: 448015 - protein, 9 aa, Influenza virus
LLAPKYGYI

SEQ ID NO: 448016 - protein, 9 aa, Influenza virus
LLAPRYGYI

SEQ ID NO: 448017 - protein, 9 aa, Influenza virus
LLASTNAHD

SEQ ID NO: 448018 - protein, 9 aa, Influenza virus
LLASTNAYD

SEQ ID NO: 448019 - protein, 9 aa, Influenza virus
LLATGMKNV

SEQ ID NO: 448020 - protein, 9 aa, Influenza virus
LLATGMRNI

SEQ ID NO: 448021 - protein, 9 aa, Influenza virus
LLATGMRNV

SEQ ID NO: 448022 - protein, 9 aa, Influenza virus
LLAVVMGLV

SEQ ID NO: 448023 - protein, 9 aa, Influenza virus
LLDNLQAYQ

SEQ ID NO: 448024 - protein, 9 aa, Influenza virus
LLDPGDTVT

SEQ ID NO: 448025 - protein, 9 aa, Influenza virus
LLDPNDTVT

SEQ ID NO: 448026 - protein, 9 aa, Influenza virus
LLDVWTYNA

SEQ ID NO: 448027 - protein, 9 aa, Influenza virus
LLEDERTLD

SEQ ID NO: 448028 - protein, 9 aa, Influenza virus
LLEKNVTVT

SEQ ID NO: 448029 - protein, 9 aa, Influenza virus
LLEMCHGTQ

SEQ ID NO: 448030 - protein, 9 aa, Influenza virus
LLEMCHSTQ

SEQ ID NO: 448031 - protein, 9 aa, Influenza virus
LLEMCHSTR

SEQ ID NO: 448032 - protein, 9 aa, Influenza virus
LLENDKTLD

SEQ ID NO: 448033 - protein, 9 aa, Influenza virus
LLENDKTLN

SEQ ID NO: 448034 - protein, 9 aa, Influenza virus
LLENDRTLD

SEQ ID NO: 448035 - protein, 9 aa, Influenza virus
LLENDVPVT

SEQ ID NO: 448036 - protein, 9 aa, Influenza virus
LLENEKTLD

SEQ ID NO: 448037 - protein, 9 aa, Influenza virus
LLENERTLD

SEQ ID NO: 448038 - protein, 9 aa, Influenza virus
LLENGRTLD

SEQ ID NO: 448039 - protein, 9 aa, Influenza virus
LLENGRTLG

SEQ ID NO: 448040 - protein, 9 aa, Influenza virus
LLENGVPVT

SEQ ID NO: 448041 - protein, 9 aa, Influenza virus
LLENLQAYQ

SEQ ID NO: 448042 - protein, 9 aa, Influenza virus
LLENLQTYQ

SEQ ID NO: 448043 - protein, 9 aa, Influenza virus
LLENNVPVT

SEQ ID NO: 448044 - protein, 9 aa, Influenza virus
LLENQKILD

SEQ ID NO: 448045 - protein, 9 aa, Influenza virus
LLENQKPLD

SEQ ID NO: 448046 - protein, 9 aa, Influenza virus
LLENQKTLD

SEQ ID NO: 448047 - protein, 9 aa, Influenza virus
LLESDVPVT

SEQ ID NO: 448048 - protein, 9 aa, Influenza virus
LLEVGTRWM

SEQ ID NO: 448049 - protein, 9 aa, Influenza virus
LLFLEVPAQ

SEQ ID NO: 448050 - protein, 9 aa, Influenza virus
LLFLKIPAQ

SEQ ID NO: 448051 - protein, 9 aa, Influenza virus
LLFLKIPVQ

SEQ ID NO: 448052 - protein, 9 aa, Influenza virus
LLFLKVPAQ

SEQ ID NO: 448053 - protein, 9 aa, Influenza virus
LLFLKVPVQ

SEQ ID NO: 448054 - protein, 9 aa, Influenza virus
LLFMIIGGF

SEQ ID NO: 448055 - protein, 9 aa, Influenza virus
LLFQDILMR

SEQ ID NO: 448056 - protein, 9 aa, Influenza virus
LLGAIAGFI

SEQ ID NO: 448057 - protein, 9 aa, Influenza virus
LLGIITGPP

SEQ ID NO: 448058 - protein, 9 aa, Influenza virus
LLGILIGPP

SEQ ID NO: 448059 - protein, 9 aa, Influenza virus
LLGINMSKK

SEQ ID NO: 448060 - protein, 9 aa, Influenza virus
LLGNPECDI

SEQ ID NO: 448061 - protein, 9 aa, Influenza virus
LLGNPECDL

SEQ ID NO: 448062 - protein, 9 aa, Influenza virus
LLGNPECDR

SEQ ID NO: 448063 - protein, 9 aa, Influenza virus
LLGNPKCDR

SEQ ID NO: 448064 - protein, 9 aa, Influenza virus
LLGNPLCDE

SEQ ID NO: 448065 - protein, 9 aa, Influenza virus
LLGNPMCDA

SEQ ID NO: 448066 - protein, 9 aa, Influenza virus
LLGNPMCDE

SEQ ID NO: 448067 - protein, 9 aa, Influenza virus
LLGNPMCDK

SEQ ID NO: 448068 - protein, 9 aa, Influenza virus
LLGNQKTLD

SEQ ID NO: 448069 - protein, 9 aa, Influenza virus
LLGSAQHVE

SEQ ID NO: 448070 - protein, 9 aa, Influenza virus
LLGTITGPP

SEQ ID NO: 448071 - protein, 9 aa, Influenza virus
LLGTKHSNG

SEQ ID NO: 448072 - protein, 9 aa, Influenza virus
LLGTLIGPP

SEQ ID NO: 448073 - protein, 9 aa, Influenza virus
LLGTLTGPP

SEQ ID NO: 448074 - protein, 9 aa, Influenza virus
LLGTNHSNG

SEQ ID NO: 448075 - protein, 9 aa, Influenza virus
LLGTRHSNG

SEQ ID NO: 448076 - protein, 9 aa, Influenza virus
LLGTVTGPP

SEQ ID NO: 448077 - protein, 9 aa, Influenza virus
LLHKCNDSC

SEQ ID NO: 448078 - protein, 9 aa, Influenza virus
LLHKCNNSC

SEQ ID NO: 448079 - protein, 9 aa, Influenza virus
LLHKCNNTC

SEQ ID NO: 448080 - protein, 9 aa, Influenza virus
LLIAFVLWA

SEQ ID NO: 448081 - protein, 9 aa, Influenza virus
LLIAMENQH

SEQ ID NO: 448082 - protein, 9 aa, Influenza virus
LLIAQALRD

SEQ ID NO: 448083 - protein, 9 aa, Influenza virus
LLIGISNIG

SEQ ID NO: 448084 - protein, 9 aa, Influenza virus
LLIGISNMS

SEQ ID NO: 448085 - protein, 9 aa, Influenza virus
LLIGISNVG

SEQ ID NO: 448086 - protein, 9 aa, Influenza virus
LLIGISNVV

SEQ ID NO: 448087 - protein, 9 aa, Influenza virus
LLIGVSNVG

SEQ ID NO: 448088 - protein, 9 aa, Influenza virus
LLIIWGIHH

SEQ ID NO: 448089 - protein, 9 aa, Influenza virus
LLILLENER

SEQ ID NO: 448090 - protein, 9 aa, Influenza virus
LLILWGIHH

SEQ ID NO: 448091 - protein, 9 aa, Influenza virus
LLISDGGPN

SEQ ID NO: 448092 - protein, 9 aa, Influenza virus
LLITQALRD

SEQ ID NO: 448093 - protein, 9 aa, Influenza virus
LLIVQAFRD

SEQ ID NO: 448094 - protein, 9 aa, Influenza virus
LLIVQALRD

SEQ ID NO: 448095 - protein, 9 aa, Influenza virus
LLKERGFFG

SEQ ID NO: 448096 - protein, 9 aa, Influenza virus
LLKGESHCR

SEQ ID NO: 448097 - protein, 9 aa, Influenza virus
LLKGESHGK

SEQ ID NO: 448098 - protein, 9 aa, Influenza virus
LLKGESHGR

SEQ ID NO: 448099 - protein, 9 aa, Influenza virus
LLKGESYGR

SEQ ID NO: 448100 - protein, 9 aa, Influenza virus
LLKHRFEII

SEQ ID NO: 448101 - protein, 9 aa, Influenza virus
LLKPGQTLR

SEQ ID NO: 448102 - protein, 9 aa, Influenza virus
LLLAFILWA

SEQ ID NO: 448103 - protein, 9 aa, Influenza virus
LLLAFMLWA

SEQ ID NO: 448104 - protein, 9 aa, Influenza virus
LLLAFVLWA

SEQ ID NO: 448105 - protein, 9 aa, Influenza virus
LLLATGMKN

SEQ ID NO: 448106 - protein, 9 aa, Influenza virus
LLLATGMRN

SEQ ID NO: 448107 - protein, 9 aa, Influenza virus
LLLLQANLC

SEQ ID NO: 448108 - protein, 9 aa, Influenza virus
LLLMIIGGF

SEQ ID NO: 448109 - protein, 9 aa, Influenza virus
LLLNKSLCN

SEQ ID NO: 448110 - protein, 9 aa, Influenza virus
LLLNKSLCS

SEQ ID NO: 448111 - protein, 9 aa, Influenza virus
LLLQANLCR

SEQ ID NO: 448112 - protein, 9 aa, Influenza virus
LLLQIISLC

SEQ ID NO: 448113 - protein, 9 aa, Influenza virus
LLLQITSLC

SEQ ID NO: 448114 - protein, 9 aa, Influenza virus
LLLQVTSLC

SEQ ID NO: 448115 - protein, 9 aa, Influenza virus
LLLWMCSNG

SEQ ID NO: 448116 - protein, 9 aa, Influenza virus
LLMDALKLS

SEQ ID NO: 448117 - protein, 9 aa, Influenza virus
LLMDSLKLS

SEQ ID NO: 448118 - protein, 9 aa, Influenza virus
LLMIIGGFI

SEQ ID NO: 448119 - protein, 9 aa, Influenza virus
LLMNELGIP

SEQ ID NO: 448120 - protein, 9 aa, Influenza virus
LLMNELGVP

SEQ ID NO: 448121 - protein, 9 aa, Influenza virus
LLMNELGVS

SEQ ID NO: 448122 - protein, 9 aa, Influenza virus
LLMSELGVP

SEQ ID NO: 448123 - protein, 9 aa, Influenza virus
LLMSTNAYD

SEQ ID NO: 448124 - protein, 9 aa, Influenza virus
LLNASCAAM

SEQ ID NO: 448125 - protein, 9 aa, Influenza virus
LLNASWFNS

SEQ ID NO: 448126 - protein, 9 aa, Influenza virus
LLNDKHFNG

SEQ ID NO: 448127 - protein, 9 aa, Influenza virus
LLNDKHSNE

SEQ ID NO: 448128 - protein, 9 aa, Influenza virus
LLNDKHSNG

SEQ ID NO: 448129 - protein, 9 aa, Influenza virus
LLNDKHSNN

SEQ ID NO: 448130 - protein, 9 aa, Influenza virus
LLNDKHSSG

SEQ ID NO: 448131 - protein, 9 aa, Influenza virus
LLNDRHSNG

SEQ ID NO: 448132 - protein, 9 aa, Influenza virus
LLNKSLCNV

SEQ ID NO: 448133 - protein, 9 aa, Influenza virus
LLNKSLCSV

SEQ ID NO: 448134 - protein, 9 aa, Influenza virus
LLNPFVSHK

SEQ ID NO: 448135 - protein, 9 aa, Influenza virus
LLNRININP

SEQ ID NO: 448136 - protein, 9 aa, Influenza virus
LLNRLNINP

SEQ ID NO: 448137 - protein, 9 aa, Influenza virus
LLNRLNINS

SEQ ID NO: 448138 - protein, 9 aa, Influenza virus
LLNRLSINP

SEQ ID NO: 448139 - protein, 9 aa, Influenza virus
LLPFAAAPP

SEQ ID NO: 448140 - protein, 9 aa, Influenza virus
LLPFASAPP

SEQ ID NO: 448141 - protein, 9 aa, Influenza virus
LLQANLCRF

SEQ ID NO: 448142 - protein, 9 aa, Influenza virus
LLQIISLCS

SEQ ID NO: 448143 - protein, 9 aa, Influenza virus
LLQITSLCS

SEQ ID NO: 448144 - protein, 9 aa, Influenza virus
LLQSAILSL

SEQ ID NO: 448145 - protein, 9 aa, Influenza virus
LLQSLQQIE

SEQ ID NO: 448146 - protein, 9 aa, Influenza virus
LLRENAEED

SEQ ID NO: 448147 - protein, 9 aa, Influenza virus
LLRGESHGR

SEQ ID NO: 448148 - protein, 9 aa, Influenza virus
LLRHFQKDA

SEQ ID NO: 448149 - protein, 9 aa, Influenza virus
LLRHFQKNA

SEQ ID NO: 448150 - protein, 9 aa, Influenza virus
LLSLLEMCH

SEQ ID NO: 448151 - protein, 9 aa, Influenza virus
LLSPEEVSE

SEQ ID NO: 448152 - protein, 9 aa, Influenza virus
LLSSKANQV

SEQ ID NO: 448153 - protein, 9 aa, Influenza virus
LLSSKDNQV

SEQ ID NO: 448154 - protein, 9 aa, Influenza virus
LLTEVETYV

SEQ ID NO: 448155 - protein, 9 aa, Influenza virus
LLVADGGPN

SEQ ID NO: 448156 - protein, 9 aa, Influenza virus
LLVALENQH

SEQ ID NO: 448157 - protein, 9 aa, Influenza virus
LLVALENQN

SEQ ID NO: 448158 - protein, 9 aa, Influenza virus
LLVAMENQH

SEQ ID NO: 448159 - protein, 9 aa, Influenza virus
LLVLIENDR

SEQ ID NO: 448160 - protein, 9 aa, Influenza virus
LLVLIENER

SEQ ID NO: 448161 - protein, 9 aa, Influenza virus
LLVLIENQK

SEQ ID NO: 448162 - protein, 9 aa, Influenza virus
LLVLLEDER

SEQ ID NO: 448163 - protein, 9 aa, Influenza virus
LLVLLENDK

SEQ ID NO: 448164 - protein, 9 aa, Influenza virus
LLVLLENDR

SEQ ID NO: 448165 - protein, 9 aa, Influenza virus
LLVLLENEK

SEQ ID NO: 448166 - protein, 9 aa, Influenza virus
LLVLLENER

SEQ ID NO: 448167 - protein, 9 aa, Influenza virus
LLVLLENGR

SEQ ID NO: 448168 - protein, 9 aa, Influenza virus
LLVLLENQK

SEQ ID NO: 448169 - protein, 9 aa, Influenza virus
LLVLLGNQK

SEQ ID NO: 448170 - protein, 9 aa, Influenza virus
LLVLMENEM

SEQ ID NO: 448171 - protein, 9 aa, Influenza virus
LLVLMENER

SEQ ID NO: 448172 - protein, 9 aa, Influenza virus
LLVLMETER

SEQ ID NO: 448173 - protein, 9 aa, Influenza virus
LLVLWGIHH

SEQ ID NO: 448174 - protein, 9 aa, Influenza virus
LLVLWGVHH

SEQ ID NO: 448175 - protein, 9 aa, Influenza virus
LLVMWGIHH

SEQ ID NO: 448176 - protein, 9 aa, Influenza virus
LLVSDGGPN

SEQ ID NO: 448177 - protein, 9 aa, Influenza virus
LLVSLGAIS

SEQ ID NO: 448178 - protein, 9 aa, Influenza virus
LLVSLGAVS

SEQ ID NO: 448179 - protein, 9 aa, Influenza virus
LLVSTNAYD

SEQ ID NO: 448180 - protein, 9 aa, Influenza virus
LLVVQALRD

SEQ ID NO: 448181 - protein, 9 aa, Influenza virus
LLVWLENEK

SEQ ID NO: 448182 - protein, 9 aa, Influenza virus
LLWMCSNGS

SEQ ID NO: 448183 - protein, 9 aa, Influenza virus
LMDALKLSI

SEQ ID NO: 448184 - protein, 9 aa, Influenza virus
LMDALLGDP

SEQ ID NO: 448185 - protein, 9 aa, Influenza virus
LMDFLKDVM

SEQ ID NO: 448186 - protein, 9 aa, Influenza virus
LMDSLKLSI

SEQ ID NO: 448187 - protein, 9 aa, Influenza virus
LMENEMTLD

SEQ ID NO: 448188 - protein, 9 aa, Influenza virus
LMENERILD

SEQ ID NO: 448189 - protein, 9 aa, Influenza virus
LMENERTLD

SEQ ID NO: 448190 - protein, 9 aa, Influenza virus
LMENERTLY

SEQ ID NO: 448191 - protein, 9 aa, Influenza virus
LMEQNVPVT

SEQ ID NO: 448192 - protein, 9 aa, Influenza virus
LMEWIKTRP

SEQ ID NO: 448193 - protein, 9 aa, Influenza virus
LMEWLKTRP

SEQ ID NO: 448194 - protein, 9 aa, Influenza virus
LMIIGGFIF

SEQ ID NO: 448195 - protein, 9 aa, Influenza virus
LMIWHSNLN

SEQ ID NO: 448196 - protein, 9 aa, Influenza virus
LMLATGMKN

SEQ ID NO: 448197 - protein, 9 aa, Influenza virus
LMLATGMRN

SEQ ID NO: 448198 - protein, 9 aa, Influenza virus
LMLNKSLCK

SEQ ID NO: 448199 - protein, 9 aa, Influenza virus
LMLQSRTRE

SEQ ID NO: 448200 - protein, 9 aa, Influenza virus
LMLSKSLCK

SEQ ID NO: 448201 - protein, 9 aa, Influenza virus
LMNELGIPF

SEQ ID NO: 448202 - protein, 9 aa, Influenza virus
LMNELGVPF

SEQ ID NO: 448203 - protein, 9 aa, Influenza virus
LMNELGVPL

SEQ ID NO: 448204 - protein, 9 aa, Influenza virus
LMNELGVSF

SEQ ID NO: 448205 - protein, 9 aa, Influenza virus
LMQGSTLPR

SEQ ID NO: 448206 - protein, 9 aa, Influenza virus
LMSCPIGEA

SEQ ID NO: 448207 - protein, 9 aa, Influenza virus
LMSCPIGEV

SEQ ID NO: 448208 - protein, 9 aa, Influenza virus
LMSCPIGVA

SEQ ID NO: 448209 - protein, 9 aa, Influenza virus
LMSCPIGVV

SEQ ID NO: 448210 - protein, 9 aa, Influenza virus
LMSCPLGEA

SEQ ID NO: 448211 - protein, 9 aa, Influenza virus
LMSCPMGVA

SEQ ID NO: 448212 - protein, 9 aa, Influenza virus
LMSCPVGEA

SEQ ID NO: 448213 - protein, 9 aa, Influenza virus
LMSCPVGVA

SEQ ID NO: 448214 - protein, 9 aa, Influenza virus
LMSELGVPF

SEQ ID NO: 448215 - protein, 9 aa, Influenza virus
LMSQSRTRE

SEQ ID NO: 448216 - protein, 9 aa, Influenza virus
LMSQSRTRG

SEQ ID NO: 448217 - protein, 9 aa, Influenza virus
LMSTNAYDR

SEQ ID NO: 448218 - protein, 9 aa, Influenza virus
LMSTPLGTP

SEQ ID NO: 448219 - protein, 9 aa, Influenza virus
LMSVLLGSS

SEQ ID NO: 448220 - protein, 9 aa, Influenza virus
LMSVPLGSS

SEQ ID NO: 448221 - protein, 9 aa, Influenza virus
LMTDGPSDA

SEQ ID NO: 448222 - protein, 9 aa, Influenza virus
LMVAYMLER

SEQ ID NO: 448223 - protein, 9 aa, Influenza virus
LMWALGENM

SEQ ID NO: 448224 - protein, 9 aa, Influenza virus
LMWEINGPE

SEQ ID NO: 448225 - protein, 9 aa, Influenza virus
LNASCAAMD

SEQ ID NO: 448226 - protein, 9 aa, Influenza virus
LNASCAAME

SEQ ID NO: 448227 - protein, 9 aa, Influenza virus
LNASWFNSF

SEQ ID NO: 448228 - protein, 9 aa, Influenza virus
LNDATYQRT

SEQ ID NO: 448229 - protein, 9 aa, Influenza virus
LNDKHFNGT

SEQ ID NO: 448230 - protein, 9 aa, Influenza virus
LNDKHSNET

SEQ ID NO: 448231 - protein, 9 aa, Influenza virus
LNDKHSNGT

SEQ ID NO: 448232 - protein, 9 aa, Influenza virus
LNDKHSNNT

SEQ ID NO: 448233 - protein, 9 aa, Influenza virus
LNDRHSNGT

SEQ ID NO: 448234 - protein, 9 aa, Influenza virus
LNDTTYQRT

SEQ ID NO: 448235 - protein, 9 aa, Influenza virus
LNDYEELKH

SEQ ID NO: 448236 - protein, 9 aa, Influenza virus
LNEGIMNTS

SEQ ID NO: 448237 - protein, 9 aa, Influenza virus
LNEGVINTS

SEQ ID NO: 448238 - protein, 9 aa, Influenza virus
LNEGVMNTS

SEQ ID NO: 448239 - protein, 9 aa, Influenza virus
LNEITTKIN

SEQ ID NO: 448240 - protein, 9 aa, Influenza virus
LNFVNRANQ

SEQ ID NO: 448241 - protein, 9 aa, Influenza virus
LNGIPPLEL

SEQ ID NO: 448242 - protein, 9 aa, Influenza virus
LNGISPIHL

SEQ ID NO: 448243 - protein, 9 aa, Influenza virus
LNGISPVHL

SEQ ID NO: 448244 - protein, 9 aa, Influenza virus
LNGNGDPNN

SEQ ID NO: 448245 - protein, 9 aa, Influenza virus
LNGREWSYI

SEQ ID NO: 448246 - protein, 9 aa, Influenza virus
LNGTAKHIE

SEQ ID NO: 448247 - protein, 9 aa, Influenza virus
LNGVKPLIL

SEQ ID NO: 448248 - protein, 9 aa, Influenza virus
LNGVPPLEL

SEQ ID NO: 448249 - protein, 9 aa, Influenza virus
LNGVSPIHL

SEQ ID NO: 448250 - protein, 9 aa, Influenza virus
LNGVSPVHL

SEQ ID NO: 448251 - protein, 9 aa, Influenza virus
LNIESNGNL

SEQ ID NO: 448252 - protein, 9 aa, Influenza virus
LNIGLHLKP

SEQ ID NO: 448253 - protein, 9 aa, Influenza virus
LNIGLHLRP

SEQ ID NO: 448254 - protein, 9 aa, Influenza virus
LNINPVKLS

SEQ ID NO: 448255 - protein, 9 aa, Influenza virus
LNINPVTLS

SEQ ID NO: 448256 - protein, 9 aa, Influenza virus
LNINSVKLS

SEQ ID NO: 448257 - protein, 9 aa, Influenza virus
LNITAASLN

SEQ ID NO: 448258 - protein, 9 aa, Influenza virus
LNKKIDDGF

SEQ ID NO: 448259 - protein, 9 aa, Influenza virus
LNKKMEDDF

SEQ ID NO: 448260 - protein, 9 aa, Influenza virus
LNKKMEDGF

SEQ ID NO: 448261 - protein, 9 aa, Influenza virus
LNKKMEEGF

SEQ ID NO: 448262 - protein, 9 aa, Influenza virus
LNKKVDDGF

SEQ ID NO: 448263 - protein, 9 aa, Influenza virus
LNKKVDDGL

SEQ ID NO: 448264 - protein, 9 aa, Influenza virus
LNKKVEDGF

SEQ ID NO: 448265 - protein, 9 aa, Influenza virus
LNKNEIKGV

SEQ ID NO: 448266 - protein, 9 aa, Influenza virus
LNKRMEDGF

SEQ ID NO: 448267 - protein, 9 aa, Influenza virus
LNKRMEDGL

SEQ ID NO: 448268 - protein, 9 aa, Influenza virus
LNKRMENGF

SEQ ID NO: 448269 - protein, 9 aa, Influenza virus
LNKRMQDGF

SEQ ID NO: 448270 - protein, 9 aa, Influenza virus
LNKSLCKIE

SEQ ID NO: 448271 - protein, 9 aa, Influenza virus
LNKSLCKVE

SEQ ID NO: 448272 - protein, 9 aa, Influenza virus
LNKSLCNVE

SEQ ID NO: 448273 - protein, 9 aa, Influenza virus
LNKSLCSVE

SEQ ID NO: 448274 - protein, 9 aa, Influenza virus
LNLGQKEYT

SEQ ID NO: 448275 - protein, 9 aa, Influenza virus
LNLGQKKYT

SEQ ID NO: 448276 - protein, 9 aa, Influenza virus
LNLGQKRHT

SEQ ID NO: 448277 - protein, 9 aa, Influenza virus
LNLGQKRYT

SEQ ID NO: 448278 - protein, 9 aa, Influenza virus
LNLGQRKYT

SEQ ID NO: 448279 - protein, 9 aa, Influenza virus
LNLIIGISN

SEQ ID NO: 448280 - protein, 9 aa, Influenza virus
LNLLIGISN

SEQ ID NO: 448281 - protein, 9 aa, Influenza virus
LNLLIGVSN

SEQ ID NO: 448282 - protein, 9 aa, Influenza virus
LNLYDRVRK

SEQ ID NO: 448283 - protein, 9 aa, Influenza virus
LNLYERVRK

SEQ ID NO: 448284 - protein, 9 aa, Influenza virus
LNMGQPFYS

SEQ ID NO: 448285 - protein, 9 aa, Influenza virus
LNMHDANVR

SEQ ID NO: 448286 - protein, 9 aa, Influenza virus
LNNEIRWPP

SEQ ID NO: 448287 - protein, 9 aa, Influenza virus
LNNEPGSGN

SEQ ID NO: 448288 - protein, 9 aa, Influenza virus
LNNKHSNGT

SEQ ID NO: 448289 - protein, 9 aa, Influenza virus
LNNKHWSGY

SEQ ID NO: 448290 - protein, 9 aa, Influenza virus
LNNKMEDGF

SEQ ID NO: 448291 - protein, 9 aa, Influenza virus
LNNKNWSGY

SEQ ID NO: 448292 - protein, 9 aa, Influenza virus
LNNKVDDGF

SEQ ID NO: 448293 - protein, 9 aa, Influenza virus
LNNMNWSGY

SEQ ID NO: 448294 - protein, 9 aa, Influenza virus
LNNNGELRH

SEQ ID NO: 448295 - protein, 9 aa, Influenza virus
LNNTEPLCD

SEQ ID NO: 448296 - protein, 9 aa, Influenza virus
LNNTEPLCE

SEQ ID NO: 448297 - protein, 9 aa, Influenza virus
LNNTEPLCN

SEQ ID NO: 448298 - protein, 9 aa, Influenza virus
LNNVIDKMN

SEQ ID NO: 448299 - protein, 9 aa, Influenza virus
LNNVIDKMY

SEQ ID NO: 448300 - protein, 9 aa, Influenza virus
LNPIDGPLP

SEQ ID NO: 448301 - protein, 9 aa, Influenza virus
LNPMHQLLR

SEQ ID NO: 448302 - protein, 9 aa, Influenza virus
LNPNDTITF

SEQ ID NO: 448303 - protein, 9 aa, Influenza virus
LNPNDTVIF

SEQ ID NO: 448304 - protein, 9 aa, Influenza virus
LNPNDTVTF

SEQ ID NO: 448305 - protein, 9 aa, Influenza virus
LNPNGTITF

SEQ ID NO: 448306 - protein, 9 aa, Influenza virus
LNQTYRNNR

SEQ ID NO: 448307 - protein, 9 aa, Influenza virus
LNQTYRNTR

SEQ ID NO: 448308 - protein, 9 aa, Influenza virus
LNRFIEKTN

SEQ ID NO: 448309 - protein, 9 aa, Influenza virus
LNRIIEKTN

SEQ ID NO: 448310 - protein, 9 aa, Influenza virus
LNRKMEDGF

SEQ ID NO: 448311 - protein, 9 aa, Influenza virus
LNRKVDDGF

SEQ ID NO: 448312 - protein, 9 aa, Influenza virus
LNRLIDKTN

SEQ ID NO: 448313 - protein, 9 aa, Influenza virus
LNRLIDRTN

SEQ ID NO: 448314 - protein, 9 aa, Influenza virus
LNRLIEKTN

SEQ ID NO: 448315 - protein, 9 aa, Influenza virus
LNRLIERTN

SEQ ID NO: 448316 - protein, 9 aa, Influenza virus
LNRLIGKTN

SEQ ID NO: 448317 - protein, 9 aa, Influenza virus
LNRLISKTN

SEQ ID NO: 448318 - protein, 9 aa, Influenza virus
LNRLNINPV

SEQ ID NO: 448319 - protein, 9 aa, Influenza virus
LNRLNINSV

SEQ ID NO: 448320 - protein, 9 aa, Influenza virus
LNRLSINPV

SEQ ID NO: 448321 - protein, 9 aa, Influenza virus
LNRNEIKGV

SEQ ID NO: 448322 - protein, 9 aa, Influenza virus
LNRNQPAAT

SEQ ID NO: 448323 - protein, 9 aa, Influenza virus
LNRQEIEGV

SEQ ID NO: 448324 - protein, 9 aa, Influenza virus
LNRQEIGGV

SEQ ID NO: 448325 - protein, 9 aa, Influenza virus
LNTASRSGY

SEQ ID NO: 448326 - protein, 9 aa, Influenza virus
LNTDWSGYS

SEQ ID NO: 448327 - protein, 9 aa, Influenza virus
LNTMHQLLR

SEQ ID NO: 448328 - protein, 9 aa, Influenza virus
LNTMTKDAE

SEQ ID NO: 448329 - protein, 9 aa, Influenza virus
LNTSQRGIL

SEQ ID NO: 448330 - protein, 9 aa, Influenza virus
LNTSQRGVL

SEQ ID NO: 448331 - protein, 9 aa, Influenza virus
LNTTLPFHN

SEQ ID NO: 448332 - protein, 9 aa, Influenza virus
LNVESNGNL

SEQ ID NO: 448333 - protein, 9 aa, Influenza virus
LNVGLHLKP

SEQ ID NO: 448334 - protein, 9 aa, Influenza virus
LNVPEWSYI

SEQ ID NO: 448335 - protein, 9 aa, Influenza virus
LNVWTYNAE

SEQ ID NO: 448336 - protein, 9 aa, Influenza virus
LNWLTKATN

SEQ ID NO: 448337 - protein, 9 aa, Influenza virus
LNWLTKETN

SEQ ID NO: 448338 - protein, 9 aa, Influenza virus
LNWSGYSGS

SEQ ID NO: 448339 - protein, 9 aa, Influenza virus
LPACAYGPA

SEQ ID NO: 448340 - protein, 9 aa, Influenza virus
LPACIYGLV

SEQ ID NO: 448341 - protein, 9 aa, Influenza virus
LPACVYGLA

SEQ ID NO: 448342 - protein, 9 aa, Influenza virus
LPACVYGLV

SEQ ID NO: 448343 - protein, 9 aa, Influenza virus
LPACVYGPA

SEQ ID NO: 448344 - protein, 9 aa, Influenza virus
LPDGAQIQY

SEQ ID NO: 448345 - protein, 9 aa, Influenza virus
LPDLYDYKE

SEQ ID NO: 448346 - protein, 9 aa, Influenza virus
LPFAAAPPE

SEQ ID NO: 448347 - protein, 9 aa, Influenza virus
LPFAAAPPK

SEQ ID NO: 448348 - protein, 9 aa, Influenza virus
LPFAAAPPV

SEQ ID NO: 448349 - protein, 9 aa, Influenza virus
LPFDFDKIS

SEQ ID NO: 448350 - protein, 9 aa, Influenza virus
LPFDIDKII

SEQ ID NO: 448351 - protein, 9 aa, Influenza virus
LPFHNIHPL

SEQ ID NO: 448352 - protein, 9 aa, Influenza virus
LPFHNISKY

SEQ ID NO: 448353 - protein, 9 aa, Influenza virus
LPFHNVHPF

SEQ ID NO: 448354 - protein, 9 aa, Influenza virus
LPFHNVHPL

SEQ ID NO: 448355 - protein, 9 aa, Influenza virus
LPFHNVSKY

SEQ ID NO: 448356 - protein, 9 aa, Influenza virus
LPFQNIDSR

SEQ ID NO: 448357 - protein, 9 aa, Influenza virus
LPFQNIDSW

SEQ ID NO: 448358 - protein, 9 aa, Influenza virus
LPFQNINPK

SEQ ID NO: 448359 - protein, 9 aa, Influenza virus
LPFQNINPR

SEQ ID NO: 448360 - protein, 9 aa, Influenza virus
LPFQNINSR

SEQ ID NO: 448361 - protein, 9 aa, Influenza virus
LPFQNISKY

SEQ ID NO: 448362 - protein, 9 aa, Influenza virus
LPFQNISPR

SEQ ID NO: 448363 - protein, 9 aa, Influenza virus
LPFQNLSPR

SEQ ID NO: 448364 - protein, 9 aa, Influenza virus
LPFQNVNSR

SEQ ID NO: 448365 - protein, 9 aa, Influenza virus
LPFQNVSKY

SEQ ID NO: 448366 - protein, 9 aa, Influenza virus
LPFQNVSRY

SEQ ID NO: 448367 - protein, 9 aa, Influenza virus
LPFQSINPR

SEQ ID NO: 448368 - protein, 9 aa, Influenza virus
LPLALGMKN

SEQ ID NO: 448369 - protein, 9 aa, Influenza virus
LPLCPFKGF

SEQ ID NO: 448370 - protein, 9 aa, Influenza virus
LPLCPFQGF

SEQ ID NO: 448371 - protein, 9 aa, Influenza virus
LPLCPFRGF

SEQ ID NO: 448372 - protein, 9 aa, Influenza virus
LPQSGRIVV

SEQ ID NO: 448373 - protein, 9 aa, Influenza virus
LPRRSGAAG

SEQ ID NO: 448374 - protein, 9 aa, Influenza virus
LPSDTPRGE

SEQ ID NO: 448375 - protein, 9 aa, Influenza virus
LPSFGVSGI

SEQ ID NO: 448376 - protein, 9 aa, Influenza virus
LPSFGVSGV

SEQ ID NO: 448377 - protein, 9 aa, Influenza virus
LPTFDSLNI

SEQ ID NO: 448378 - protein, 9 aa, Influenza virus
LPVAGGTGS

SEQ ID NO: 448379 - protein, 9 aa, Influenza virus
LPVAGGTSS

SEQ ID NO: 448380 - protein, 9 aa, Influenza virus
LPVGGNEKK

SEQ ID NO: 448381 - protein, 9 aa, Influenza virus
LPVSGGTSS

SEQ ID NO: 448382 - protein, 9 aa, Influenza virus
LPVTGGTSS

SEQ ID NO: 448383 - protein, 9 aa, Influenza virus
LQALQLLLE

SEQ ID NO: 448384 - protein, 9 aa, Influenza virus
LQANLCRFL

SEQ ID NO: 448385 - protein, 9 aa, Influenza virus
LQAYQKRMG

SEQ ID NO: 448386 - protein, 9 aa, Influenza virus
LQDNAKDEG

SEQ ID NO: 448387 - protein, 9 aa, Influenza virus
LQDTTWDVF

SEQ ID NO: 448388 - protein, 9 aa, Influenza virus
LQGSARHIE

SEQ ID NO: 448389 - protein, 9 aa, Influenza virus
LQGTKRSYE

SEQ ID NO: 448390 - protein, 9 aa, Influenza virus
LQIISLCSI

SEQ ID NO: 448391 - protein, 9 aa, Influenza virus
LQITSLCSI

SEQ ID NO: 448392 - protein, 9 aa, Influenza virus
LQLFIKDYR

SEQ ID NO: 448393 - protein, 9 aa, Influenza virus
LQLKDNAKE

SEQ ID NO: 448394 - protein, 9 aa, Influenza virus
LQLKDNARE

SEQ ID NO: 448395 - protein, 9 aa, Influenza virus
LQLLFEVEQ

SEQ ID NO: 448396 - protein, 9 aa, Influenza virus
LQLLLEVEN

SEQ ID NO: 448397 - protein, 9 aa, Influenza virus
LQLLLEVEQ

SEQ ID NO: 448398 - protein, 9 aa, Influenza virus
LQLLLEVES

SEQ ID NO: 448399 - protein, 9 aa, Influenza virus
LQLNPIDGP

SEQ ID NO: 448400 - protein, 9 aa, Influenza virus
LQLRDNAKE

SEQ ID NO: 448401 - protein, 9 aa, Influenza virus
LQLRDNARE

SEQ ID NO: 448402 - protein, 9 aa, Influenza virus
LQNASRHYM

SEQ ID NO: 448403 - protein, 9 aa, Influenza virus
LQNNAIDEG

SEQ ID NO: 448404 - protein, 9 aa, Influenza virus
LQNRIMINP

SEQ ID NO: 448405 - protein, 9 aa, Influenza virus
LQNRIQIDP

SEQ ID NO: 448406 - protein, 9 aa, Influenza virus
LQNRIQIDQ

SEQ ID NO: 448407 - protein, 9 aa, Influenza virus
LQNRIQIDS

SEQ ID NO: 448408 - protein, 9 aa, Influenza virus
LQNTSKHYI

SEQ ID NO: 448409 - protein, 9 aa, Influenza virus
LQQIESIIE

SEQ ID NO: 448410 - protein, 9 aa, Influenza virus
LQQIESMIE

SEQ ID NO: 448411 - protein, 9 aa, Influenza virus
LQQIESMVE

SEQ ID NO: 448412 - protein, 9 aa, Influenza virus
LQRRRFIQN

SEQ ID NO: 448413 - protein, 9 aa, Influenza virus
LQRRRFVQN

SEQ ID NO: 448414 - protein, 9 aa, Influenza virus
LQSFTPSPG

SEQ ID NO: 448415 - protein, 9 aa, Influenza virus
LQSLQQIES

SEQ ID NO: 448416 - protein, 9 aa, Influenza virus
LQSRTREIL

SEQ ID NO: 448417 - protein, 9 aa, Influenza virus
LQSSDDFAL

SEQ ID NO: 448418 - protein, 9 aa, Influenza virus
LQTYQKRMG

SEQ ID NO: 448419 - protein, 9 aa, Influenza virus
LRDCKIEAV

SEQ ID NO: 448420 - protein, 9 aa, Influenza virus
LRDCKVEAV

SEQ ID NO: 448421 - protein, 9 aa, Influenza virus
LRDCSIAGW

SEQ ID NO: 448422 - protein, 9 aa, Influenza virus
LRDCSVAGW

SEQ ID NO: 448423 - protein, 9 aa, Influenza virus
LRDNAKDEG

SEQ ID NO: 448424 - protein, 9 aa, Influenza virus
LRDNAKDLG

SEQ ID NO: 448425 - protein, 9 aa, Influenza virus
LRDNAKEIG

SEQ ID NO: 448426 - protein, 9 aa, Influenza virus
LRDNAKELG

SEQ ID NO: 448427 - protein, 9 aa, Influenza virus
LRDNAKETG

SEQ ID NO: 448428 - protein, 9 aa, Influenza virus
LRDNAMILG

SEQ ID NO: 448429 - protein, 9 aa, Influenza virus
LRDNANDLG

SEQ ID NO: 448430 - protein, 9 aa, Influenza virus
LRDNLEPGT

SEQ ID NO: 448431 - protein, 9 aa, Influenza virus
LRDNVKELG

SEQ ID NO: 448432 - protein, 9 aa, Influenza virus
LRDQGWSYI

SEQ ID NO: 448433 - protein, 9 aa, Influenza virus
LRDSLEPGT

SEQ ID NO: 448434 - protein, 9 aa, Influenza virus
LREHLSSVS

SEQ ID NO: 448435 - protein, 9 aa, Influenza virus
LRELWQCYY

SEQ ID NO: 448436 - protein, 9 aa, Influenza virus
LRENAEDIG

SEQ ID NO: 448437 - protein, 9 aa, Influenza virus
LRENAEDKG

SEQ ID NO: 448438 - protein, 9 aa, Influenza virus
LRENAEDLG

SEQ ID NO: 448439 - protein, 9 aa, Influenza virus
LRENAEDMG

SEQ ID NO: 448440 - protein, 9 aa, Influenza virus
LRENAEDQG

SEQ ID NO: 448441 - protein, 9 aa, Influenza virus
LRENAEDRG

SEQ ID NO: 448442 - protein, 9 aa, Influenza virus
LRENAEEDC

SEQ ID NO: 448443 - protein, 9 aa, Influenza virus
LRENAEEDG

SEQ ID NO: 448444 - protein, 9 aa, Influenza virus
LREQKQEFK

SEQ ID NO: 448445 - protein, 9 aa, Influenza virus
LREQLSSVS

SEQ ID NO: 448446 - protein, 9 aa, Influenza virus
LREQLSTVS

SEQ ID NO: 448447 - protein, 9 aa, Influenza virus
LRFLFSSIK

SEQ ID NO: 448448 - protein, 9 aa, Influenza virus
LRFVFSIAA

SEQ ID NO: 448449 - protein, 9 aa, Influenza virus
LRFVFSNAA

SEQ ID NO: 448450 - protein, 9 aa, Influenza virus
LRFVFSSAA

SEQ ID NO: 448451 - protein, 9 aa, Influenza virus
LRGFLIIGK

SEQ ID NO: 448452 - protein, 9 aa, Influenza virus
LRGFLILGK

SEQ ID NO: 448453 - protein, 9 aa, Influenza virus
LRGFLILGR

SEQ ID NO: 448454 - protein, 9 aa, Influenza virus
LRGGRNSFF

SEQ ID NO: 448455 - protein, 9 aa, Influenza virus
LRGIPPLEL

SEQ ID NO: 448456 - protein, 9 aa, Influenza virus
LRGQHANGT

SEQ ID NO: 448457 - protein, 9 aa, Influenza virus
LRGRGSTLG

SEQ ID NO: 448458 - protein, 9 aa, Influenza virus
LRGRHANGT

SEQ ID NO: 448459 - protein, 9 aa, Influenza virus
LRGSARHIE

SEQ ID NO: 448460 - protein, 9 aa, Influenza virus
LRGSIAHKS

SEQ ID NO: 448461 - protein, 9 aa, Influenza virus
LRGSVAHKS

SEQ ID NO: 448462 - protein, 9 aa, Influenza virus
LRHFQKDAK

SEQ ID NO: 448463 - protein, 9 aa, Influenza virus
LRHFQKDAR

SEQ ID NO: 448464 - protein, 9 aa, Influenza virus
LRHFQKNAK

SEQ ID NO: 448465 - protein, 9 aa, Influenza virus
LRHLFSGIK

SEQ ID NO: 448466 - protein, 9 aa, Influenza virus
LRHLFSGIR

SEQ ID NO: 448467 - protein, 9 aa, Influenza virus
LRHLFSGVN

SEQ ID NO: 448468 - protein, 9 aa, Influenza virus
LRIISNGNL

SEQ ID NO: 448469 - protein, 9 aa, Influenza virus
LRILIRGNS

SEQ ID NO: 448470 - protein, 9 aa, Influenza virus
LRILVRGNS

SEQ ID NO: 448471 - protein, 9 aa, Influenza virus
LRIPNAGID

SEQ ID NO: 448472 - protein, 9 aa, Influenza virus
LRIRSNENL

SEQ ID NO: 448473 - protein, 9 aa, Influenza virus
LRIRSNGNL

SEQ ID NO: 448474 - protein, 9 aa, Influenza virus
LRISSSFSF

SEQ ID NO: 448475 - protein, 9 aa, Influenza virus
LRKILRKSG

SEQ ID NO: 448476 - protein, 9 aa, Influenza virus
LRLAIGLRN

SEQ ID NO: 448477 - protein, 9 aa, Influenza virus
LRLALGLRN

SEQ ID NO: 448478 - protein, 9 aa, Influenza virus
LRLATGLRN

SEQ ID NO: 448479 - protein, 9 aa, Influenza virus
LRLAVGLRN

SEQ ID NO: 448480 - protein, 9 aa, Influenza virus
LRMARGLRN

SEQ ID NO: 448481 - protein, 9 aa, Influenza virus
LRMATGLRN

SEQ ID NO: 448482 - protein, 9 aa, Influenza virus
LRMKWMMAM

SEQ ID NO: 448483 - protein, 9 aa, Influenza virus
LRMVTGLRN

SEQ ID NO: 448484 - protein, 9 aa, Influenza virus
LRNDTDVVN

SEQ ID NO: 448485 - protein, 9 aa, Influenza virus
LRNGNMRCT

SEQ ID NO: 448486 - protein, 9 aa, Influenza virus
LRNIPSIQS

SEQ ID NO: 448487 - protein, 9 aa, Influenza virus
LRNIPSVQS

SEQ ID NO: 448488 - protein, 9 aa, Influenza virus
LRNTPSIDP

SEQ ID NO: 448489 - protein, 9 aa, Influenza virus
LRNTPSIEP

SEQ ID NO: 448490 - protein, 9 aa, Influenza virus
LRNTPSVEP

SEQ ID NO: 448491 - protein, 9 aa, Influenza virus
LRNVPSIQS

SEQ ID NO: 448492 - protein, 9 aa, Influenza virus
LRPGETLNV

SEQ ID NO: 448493 - protein, 9 aa, Influenza virus
LRPGQTLRV

SEQ ID NO: 448494 - protein, 9 aa, Influenza virus
LRQIIRESG

SEQ ID NO: 448495 - protein, 9 aa, Influenza virus
LRQILRESG

SEQ ID NO: 448496 - protein, 9 aa, Influenza virus
LRQILRGSG

SEQ ID NO: 448497 - protein, 9 aa, Influenza virus
LRQILRKSG

SEQ ID NO: 448498 - protein, 9 aa, Influenza virus
LRQILRRSG

SEQ ID NO: 448499 - protein, 9 aa, Influenza virus
LRQKIMESG

SEQ ID NO: 448500 - protein, 9 aa, Influenza virus
LRQNAEEDG

SEQ ID NO: 448501 - protein, 9 aa, Influenza virus
LRQNPTEEQ

SEQ ID NO: 448502 - protein, 9 aa, Influenza virus
LRQVLRESG

SEQ ID NO: 448503 - protein, 9 aa, Influenza virus
LRRCLLQSL

SEQ ID NO: 448504 - protein, 9 aa, Influenza virus
LRRDQKSLR

SEQ ID NO: 448505 - protein, 9 aa, Influenza virus
LRRIWRQAN

SEQ ID NO: 448506 - protein, 9 aa, Influenza virus
LRRQKSLIW

SEQ ID NO: 448507 - protein, 9 aa, Influenza virus
LRRQKWWVW

SEQ ID NO: 448508 - protein, 9 aa, Influenza virus
LRSGFEMLK

SEQ ID NO: 448509 - protein, 9 aa, Influenza virus
LRSGYEMLK

SEQ ID NO: 448510 - protein, 9 aa, Influenza virus
LRSGYETFK

SEQ ID NO: 448511 - protein, 9 aa, Influenza virus
LRSGYWAIR

SEQ ID NO: 448512 - protein, 9 aa, Influenza virus
LRSILANNG

SEQ ID NO: 448513 - protein, 9 aa, Influenza virus
LRSILASSG

SEQ ID NO: 448514 - protein, 9 aa, Influenza virus
LRSIVASSG

SEQ ID NO: 448515 - protein, 9 aa, Influenza virus
LRSKYWAIR

SEQ ID NO: 448516 - protein, 9 aa, Influenza virus
LRSLFSSIK

SEQ ID NO: 448517 - protein, 9 aa, Influenza virus
LRSLIASSG

SEQ ID NO: 448518 - protein, 9 aa, Influenza virus
LRSLVASSG

SEQ ID NO: 448519 - protein, 9 aa, Influenza virus
LRSNAPSGI

SEQ ID NO: 448520 - protein, 9 aa, Influenza virus
LRSNAPSGV

SEQ ID NO: 448521 - protein, 9 aa, Influenza virus
LRSRYWAIR

SEQ ID NO: 448522 - protein, 9 aa, Influenza virus
LRTHESECV

SEQ ID NO: 448523 - protein, 9 aa, Influenza virus
LRTQDSECV

SEQ ID NO: 448524 - protein, 9 aa, Influenza virus
LRTQESECA

SEQ ID NO: 448525 - protein, 9 aa, Influenza virus
LRTQESECI

SEQ ID NO: 448526 - protein, 9 aa, Influenza virus
LRTQESECQ

SEQ ID NO: 448527 - protein, 9 aa, Influenza virus
LRTQESECV

SEQ ID NO: 448528 - protein, 9 aa, Influenza virus
LRTQESSCT

SEQ ID NO: 448529 - protein, 9 aa, Influenza virus
LRTQESSCV

SEQ ID NO: 448530 - protein, 9 aa, Influenza virus
LRVKDQQGN

SEQ ID NO: 448531 - protein, 9 aa, Influenza virus
LRVKSNGNL

SEQ ID NO: 448532 - protein, 9 aa, Influenza virus
LRVPEWSYI

SEQ ID NO: 448533 - protein, 9 aa, Influenza virus
LRVPNALTD

SEQ ID NO: 448534 - protein, 9 aa, Influenza virus
LRVRDQLGN

SEQ ID NO: 448535 - protein, 9 aa, Influenza virus
LRVRDQMGN

SEQ ID NO: 448536 - protein, 9 aa, Influenza virus
LRVRDQQGN

SEQ ID NO: 448537 - protein, 9 aa, Influenza virus
LRVRDQRGN

SEQ ID NO: 448538 - protein, 9 aa, Influenza virus
LRVRSDGNL

SEQ ID NO: 448539 - protein, 9 aa, Influenza virus
LRVRSNGNL

SEQ ID NO: 448540 - protein, 9 aa, Influenza virus
LRWALGENM

SEQ ID NO: 448541 - protein, 9 aa, Influenza virus
LSAFDERRN

SEQ ID NO: 448542 - protein, 9 aa, Influenza virus
LSAGGAIWV

SEQ ID NO: 448543 - protein, 9 aa, Influenza virus
LSAGGAVWV

SEQ ID NO: 448544 - protein, 9 aa, Influenza virus
LSAGGDIWI

SEQ ID NO: 448545 - protein, 9 aa, Influenza virus
LSAGGDIWV

SEQ ID NO: 448546 - protein, 9 aa, Influenza virus
LSAGGHIWV

SEQ ID NO: 448547 - protein, 9 aa, Influenza virus
LSAGGNIWI

SEQ ID NO: 448548 - protein, 9 aa, Influenza virus
LSASGDIWI

SEQ ID NO: 448549 - protein, 9 aa, Influenza virus
LSASGDIWV

SEQ ID NO: 448550 - protein, 9 aa, Influenza virus
LSEQNVPVT

SEQ ID NO: 448551 - protein, 9 aa, Influenza virus
LSFQGRGVF

SEQ ID NO: 448552 - protein, 9 aa, Influenza virus
LSFQVDCFL

SEQ ID NO: 448553 - protein, 9 aa, Influenza virus
LSFTITGDN

SEQ ID NO: 448554 - protein, 9 aa, Influenza virus
LSFTVTGDN

SEQ ID NO: 448555 - protein, 9 aa, Influenza virus
LSFWMCSNG

SEQ ID NO: 448556 - protein, 9 aa, Influenza virus
LSGGAQHVE

SEQ ID NO: 448557 - protein, 9 aa, Influenza virus
LSGGGDIWV

SEQ ID NO: 448558 - protein, 9 aa, Influenza virus
LSGGYKDII

SEQ ID NO: 448559 - protein, 9 aa, Influenza virus
LSGGYKDVI

SEQ ID NO: 448560 - protein, 9 aa, Influenza virus
LSGIPPLEL

SEQ ID NO: 448561 - protein, 9 aa, Influenza virus
LSGIPPLVL

SEQ ID NO: 448562 - protein, 9 aa, Influenza virus
LSGMAIALS

SEQ ID NO: 448563 - protein, 9 aa, Influenza virus
LSGNAQHIE

SEQ ID NO: 448564 - protein, 9 aa, Influenza virus
LSGNAQHVE

SEQ ID NO: 448565 - protein, 9 aa, Influenza virus
LSGNGDPNN

SEQ ID NO: 448566 - protein, 9 aa, Influenza virus
LSGREWSYI

SEQ ID NO: 448567 - protein, 9 aa, Influenza virus
LSGSAQHIE

SEQ ID NO: 448568 - protein, 9 aa, Influenza virus
LSGSAQHVE

SEQ ID NO: 448569 - protein, 9 aa, Influenza virus
LSGVAIALN

SEQ ID NO: 448570 - protein, 9 aa, Influenza virus
LSGVAIALS

SEQ ID NO: 448571 - protein, 9 aa, Influenza virus
LSGVAISLS

SEQ ID NO: 448572 - protein, 9 aa, Influenza virus
LSGVAVALS

SEQ ID NO: 448573 - protein, 9 aa, Influenza virus
LSHTAYSQI

SEQ ID NO: 448574 - protein, 9 aa, Influenza virus
LSIAPIMFS

SEQ ID NO: 448575 - protein, 9 aa, Influenza virus
LSIEDPDHE

SEQ ID NO: 448576 - protein, 9 aa, Influenza virus
LSIEDPNHE

SEQ ID NO: 448577 - protein, 9 aa, Influenza virus
LSIEDPSHE

SEQ ID NO: 448578 - protein, 9 aa, Influenza virus
LSIEEPSHE

SEQ ID NO: 448579 - protein, 9 aa, Influenza virus
LSIENPSHE

SEQ ID NO: 448580 - protein, 9 aa, Influenza virus
LSIIPSGPL

SEQ ID NO: 448581 - protein, 9 aa, Influenza virus
LSILNLLIG

SEQ ID NO: 448582 - protein, 9 aa, Influenza virus
LSINPVKLS

SEQ ID NO: 448583 - protein, 9 aa, Influenza virus
LSISIGSST

SEQ ID NO: 448584 - protein, 9 aa, Influenza virus
LSISVESST

SEQ ID NO: 448585 - protein, 9 aa, Influenza virus
LSISVGSST

SEQ ID NO: 448586 - protein, 9 aa, Influenza virus
LSIVPSGPL

SEQ ID NO: 448587 - protein, 9 aa, Influenza virus
LSIYSCIAS

SEQ ID NO: 448588 - protein, 9 aa, Influenza virus
LSIYSCVAS

SEQ ID NO: 448589 - protein, 9 aa, Influenza virus
LSIYSSVAS

SEQ ID NO: 448590 - protein, 9 aa, Influenza virus
LSIYSTAAS

SEQ ID NO: 448591 - protein, 9 aa, Influenza virus
LSIYSTVAA

SEQ ID NO: 448592 - protein, 9 aa, Influenza virus
LSIYSTVAS

SEQ ID NO: 448593 - protein, 9 aa, Influenza virus
LSIYSTVTS

SEQ ID NO: 448594 - protein, 9 aa, Influenza virus
LSIYSTVVS

SEQ ID NO: 448595 - protein, 9 aa, Influenza virus
LSKDNAIRI

SEQ ID NO: 448596 - protein, 9 aa, Influenza virus
LSKDNGIRI

SEQ ID NO: 448597 - protein, 9 aa, Influenza virus
LSKDNSIRL

SEQ ID NO: 448598 - protein, 9 aa, Influenza virus
LSKRMEDGF

SEQ ID NO: 448599 - protein, 9 aa, Influenza virus
LSKSLCKVE

SEQ ID NO: 448600 - protein, 9 aa, Influenza virus
LSLAIMIAG

SEQ ID NO: 448601 - protein, 9 aa, Influenza virus
LSLAIMMAG

SEQ ID NO: 448602 - protein, 9 aa, Influenza virus
LSLAIMVAG

SEQ ID NO: 448603 - protein, 9 aa, Influenza virus
LSLIMRTVI

SEQ ID NO: 448604 - protein, 9 aa, Influenza virus
LSLLEMCHS

SEQ ID NO: 448605 - protein, 9 aa, Influenza virus
LSLWMCSNG

SEQ ID NO: 448606 - protein, 9 aa, Influenza virus
LSMAPIMFS

SEQ ID NO: 448607 - protein, 9 aa, Influenza virus
LSMEFSLTD

SEQ ID NO: 448608 - protein, 9 aa, Influenza virus
LSMVKSDKI

SEQ ID NO: 448609 - protein, 9 aa, Influenza virus
LSMVRSDKI

SEQ ID NO: 448610 - protein, 9 aa, Influenza virus
LSNMGIYQI

SEQ ID NO: 448611 - protein, 9 aa, Influenza virus
LSNMGVYQI

SEQ ID NO: 448612 - protein, 9 aa, Influenza virus
LSNNATDTV

SEQ ID NO: 448613 - protein, 9 aa, Influenza virus
LSNNSSDTV

SEQ ID NO: 448614 - protein, 9 aa, Influenza virus
LSNNSTDKI

SEQ ID NO: 448615 - protein, 9 aa, Influenza virus
LSNNSTDKV

SEQ ID NO: 448616 - protein, 9 aa, Influenza virus
LSNNSTDTV

SEQ ID NO: 448617 - protein, 9 aa, Influenza virus
LSNNSTEKV

SEQ ID NO: 448618 - protein, 9 aa, Influenza virus
LSNNSTERV

SEQ ID NO: 448619 - protein, 9 aa, Influenza virus
LSNPKCDLY

SEQ ID NO: 448620 - protein, 9 aa, Influenza virus
LSPEEVSET

SEQ ID NO: 448621 - protein, 9 aa, Influenza virus
LSPGMMMGM

SEQ ID NO: 448622 - protein, 9 aa, Influenza virus
LSPLTKGIL

SEQ ID NO: 448623 - protein, 9 aa, Influenza virus
LSPLTKGML

SEQ ID NO: 448624 - protein, 9 aa, Influenza virus
LSPNVYQAR

SEQ ID NO: 448625 - protein, 9 aa, Influenza virus
LSPRTVGQC

SEQ ID NO: 448626 - protein, 9 aa, Influenza virus
LSQCGLLGT

SEQ ID NO: 448627 - protein, 9 aa, Influenza virus
LSQGTTIRG

SEQ ID NO: 448628 - protein, 9 aa, Influenza virus
LSQGTTLKG

SEQ ID NO: 448629 - protein, 9 aa, Influenza virus
LSQGTTLRG

SEQ ID NO: 448630 - protein, 9 aa, Influenza virus
LSQKFEEIR

SEQ ID NO: 448631 - protein, 9 aa, Influenza virus
LSRCRETRG

SEQ ID NO: 448632 - protein, 9 aa, Influenza virus
LSRCRKTRG

SEQ ID NO: 448633 - protein, 9 aa, Influenza virus
LSSGYKDII

SEQ ID NO: 448634 - protein, 9 aa, Influenza virus
LSSGYKDVI

SEQ ID NO: 448635 - protein, 9 aa, Influenza virus
LSSGYKEVI

SEQ ID NO: 448636 - protein, 9 aa, Influenza virus
LSSKANQVF

SEQ ID NO: 448637 - protein, 9 aa, Influenza virus
LSSKDNQVF

SEQ ID NO: 448638 - protein, 9 aa, Influenza virus
LSSMGIYQI

SEQ ID NO: 448639 - protein, 9 aa, Influenza virus
LSSMGVYQI

SEQ ID NO: 448640 - protein, 9 aa, Influenza virus
LSSPPTVYN

SEQ ID NO: 448641 - protein, 9 aa, Influenza virus
LSSRISFYW

SEQ ID NO: 448642 - protein, 9 aa, Influenza virus
LSSSGNNQV

SEQ ID NO: 448643 - protein, 9 aa, Influenza virus
LSSSMNNQV

SEQ ID NO: 448644 - protein, 9 aa, Influenza virus
LSSVNTNTI

SEQ ID NO: 448645 - protein, 9 aa, Influenza virus
LSSVSSFEK

SEQ ID NO: 448646 - protein, 9 aa, Influenza virus
LSSVSSFER

SEQ ID NO: 448647 - protein, 9 aa, Influenza virus
LSSVSSFKR

SEQ ID NO: 448648 - protein, 9 aa, Influenza virus
LSSVTTNTI

SEQ ID NO: 448649 - protein, 9 aa, Influenza virus
LSTIALFIG

SEQ ID NO: 448650 - protein, 9 aa, Influenza virus
LSTIALIIG

SEQ ID NO: 448651 - protein, 9 aa, Influenza virus
LSTIALLIG

SEQ ID NO: 448652 - protein, 9 aa, Influenza virus
LSTKALLIG

SEQ ID NO: 448653 - protein, 9 aa, Influenza virus
LSTNSSDKV

SEQ ID NO: 448654 - protein, 9 aa, Influenza virus
LSTNSSEKV

SEQ ID NO: 448655 - protein, 9 aa, Influenza virus
LSTNSSERV

SEQ ID NO: 448656 - protein, 9 aa, Influenza virus
LSTNSTEKV

SEQ ID NO: 448657 - protein, 9 aa, Influenza virus
LSTNSTETV

SEQ ID NO: 448658 - protein, 9 aa, Influenza virus
LSTRGIQIA

SEQ ID NO: 448659 - protein, 9 aa, Influenza virus
LSTRGVQIA

SEQ ID NO: 448660 - protein, 9 aa, Influenza virus
LSTRGVQVA

SEQ ID NO: 448661 - protein, 9 aa, Influenza virus
LSTVLGVSI

SEQ ID NO: 448662 - protein, 9 aa, Influenza virus
LSTVSSFER

SEQ ID NO: 448663 - protein, 9 aa, Influenza virus
LSVAPIMFS

SEQ ID NO: 448664 - protein, 9 aa, Influenza virus
LSVIPSGPL

SEQ ID NO: 448665 - protein, 9 aa, Influenza virus
LSVLNLLIG

SEQ ID NO: 448666 - protein, 9 aa, Influenza virus
LSVPEWSYI

SEQ ID NO: 448667 - protein, 9 aa, Influenza virus
LSVVNLLIG

SEQ ID NO: 448668 - protein, 9 aa, Influenza virus
LSVVSLLIG

SEQ ID NO: 448669 - protein, 9 aa, Influenza virus
LSVVSLLVG

SEQ ID NO: 448670 - protein, 9 aa, Influenza virus
LSVYSTVAS

SEQ ID NO: 448671 - protein, 9 aa, Influenza virus
LSYKVGYLC

SEQ ID NO: 448672 - protein, 9 aa, Influenza virus
LSYQVGYLC

SEQ ID NO: 448673 - protein, 9 aa, Influenza virus
LSYRVGYLC

SEQ ID NO: 448674 - protein, 9 aa, Influenza virus
LSYSAGALA

SEQ ID NO: 448675 - protein, 9 aa, Influenza virus
LSYSTGALA

SEQ ID NO: 448676 - protein, 9 aa, Influenza virus
LSYSVGYLC

SEQ ID NO: 448677 - protein, 9 aa, Influenza virus
LSYTVGYLC

SEQ ID NO: 448678 - protein, 9 aa, Influenza virus
LTDAEMNKL

SEQ ID NO: 448679 - protein, 9 aa, Influenza virus
LTDKGSIQS

SEQ ID NO: 448680 - protein, 9 aa, Influenza virus
LTDNHVEVV

SEQ ID NO: 448681 - protein, 9 aa, Influenza virus
LTDNPRPND

SEQ ID NO: 448682 - protein, 9 aa, Influenza virus
LTDSEMNKL

SEQ ID NO: 448683 - protein, 9 aa, Influenza virus
LTDSEMSKL

SEQ ID NO: 448684 - protein, 9 aa, Influenza virus
LTDSQTATK

SEQ ID NO: 448685 - protein, 9 aa, Influenza virus
LTDTSRPGD

SEQ ID NO: 448686 - protein, 9 aa, Influenza virus
LTDTSRPKD

SEQ ID NO: 448687 - protein, 9 aa, Influenza virus
LTDTSRPND

SEQ ID NO: 448688 - protein, 9 aa, Influenza virus
LTDTSRPSD

SEQ ID NO: 448689 - protein, 9 aa, Influenza virus
LTDTSRPTD

SEQ ID NO: 448690 - protein, 9 aa, Influenza virus
LTDWSGYSG

SEQ ID NO: 448691 - protein, 9 aa, Influenza virus
LTEIWSYNA

SEQ ID NO: 448692 - protein, 9 aa, Influenza virus
LTEKGIEVV

SEQ ID NO: 448693 - protein, 9 aa, Influenza virus
LTEKGVEVV

SEQ ID NO: 448694 - protein, 9 aa, Influenza virus
LTENGVPVT

SEQ ID NO: 448695 - protein, 9 aa, Influenza virus
LTEQNVPVT

SEQ ID NO: 448696 - protein, 9 aa, Influenza virus
LTEREVEVV

SEQ ID NO: 448697 - protein, 9 aa, Influenza virus
LTERGIEVV

SEQ ID NO: 448698 - protein, 9 aa, Influenza virus
LTERGVEVV

SEQ ID NO: 448699 - protein, 9 aa, Influenza virus
LTETGVPVT

SEQ ID NO: 448700 - protein, 9 aa, Influenza virus
LTEVETYVL

SEQ ID NO: 448701 - protein, 9 aa, Influenza virus
LTFLARSAL

SEQ ID NO: 448702 - protein, 9 aa, Influenza virus
LTGGQSFYR

SEQ ID NO: 448703 - protein, 9 aa, Influenza virus
LTGIWDTLI

SEQ ID NO: 448704 - protein, 9 aa, Influenza virus
LTGMWDTLI

SEQ ID NO: 448705 - protein, 9 aa, Influenza virus
LTGNLQTLK

SEQ ID NO: 448706 - protein, 9 aa, Influenza virus
LTGNLQTLR

SEQ ID NO: 448707 - protein, 9 aa, Influenza virus
LTGRGIEVV

SEQ ID NO: 448708 - protein, 9 aa, Influenza virus
LTGSAQHIE

SEQ ID NO: 448709 - protein, 9 aa, Influenza virus
LTGTAKHIE

SEQ ID NO: 448710 - protein, 9 aa, Influenza virus
LTGTWDTLI

SEQ ID NO: 448711 - protein, 9 aa, Influenza virus
LTHALRELW

SEQ ID NO: 448712 - protein, 9 aa, Influenza virus
LTHGSLLND

SEQ ID NO: 448713 - protein, 9 aa, Influenza virus
LTHHMRKKR

SEQ ID NO: 448714 - protein, 9 aa, Influenza virus
LTHIMIWHS

SEQ ID NO: 448715 - protein, 9 aa, Influenza virus
LTHLMIWHS

SEQ ID NO: 448716 - protein, 9 aa, Influenza virus
LTHMMIWHS

SEQ ID NO: 448717 - protein, 9 aa, Influenza virus
LTHQSGTYP

SEQ ID NO: 448718 - protein, 9 aa, Influenza virus
LTIAMGLVF

SEQ ID NO: 448719 - protein, 9 aa, Influenza virus
LTIGECPKY

SEQ ID NO: 448720 - protein, 9 aa, Influenza virus
LTIGECPRY

SEQ ID NO: 448721 - protein, 9 aa, Influenza virus
LTIGISGPD

SEQ ID NO: 448722 - protein, 9 aa, Influenza virus
LTIGITGPD

SEQ ID NO: 448723 - protein, 9 aa, Influenza virus
LTIGKCPKY

SEQ ID NO: 448724 - protein, 9 aa, Influenza virus
LTIGVSGPD

SEQ ID NO: 448725 - protein, 9 aa, Influenza virus
LTIIYSSSM

SEQ ID NO: 448726 - protein, 9 aa, Influenza virus
LTILGKDAG

SEQ ID NO: 448727 - protein, 9 aa, Influenza virus
LTITYSSPM

SEQ ID NO: 448728 - protein, 9 aa, Influenza virus
LTITYSSSL

SEQ ID NO: 448729 - protein, 9 aa, Influenza virus
LTITYSSSM

SEQ ID NO: 448730 - protein, 9 aa, Influenza virus
LTIYSTAAS

SEQ ID NO: 448731 - protein, 9 aa, Influenza virus
LTIYSTVAS

SEQ ID NO: 448732 - protein, 9 aa, Influenza virus
LTKATNGNY

SEQ ID NO: 448733 - protein, 9 aa, Influenza virus
LTKELCTIN

SEQ ID NO: 448734 - protein, 9 aa, Influenza virus
LTKETNGNY

SEQ ID NO: 448735 - protein, 9 aa, Influenza virus
LTKGEKANV

SEQ ID NO: 448736 - protein, 9 aa, Influenza virus
LTKGILGFV

SEQ ID NO: 448737 - protein, 9 aa, Influenza virus
LTKGLCTIN

SEQ ID NO: 448738 - protein, 9 aa, Influenza virus
LTKGMLGFV

SEQ ID NO: 448739 - protein, 9 aa, Influenza virus
LTKGVLGFV

SEQ ID NO: 448740 - protein, 9 aa, Influenza virus
LTKINNGDY

SEQ ID NO: 448741 - protein, 9 aa, Influenza virus
LTKITVDHM

SEQ ID NO: 448742 - protein, 9 aa, Influenza virus
LTKKEPDTY

SEQ ID NO: 448743 - protein, 9 aa, Influenza virus
LTKKKNPEA

SEQ ID NO: 448744 - protein, 9 aa, Influenza virus
LTKKKPDIY

SEQ ID NO: 448745 - protein, 9 aa, Influenza virus
LTKKKPDTY

SEQ ID NO: 448746 - protein, 9 aa, Influenza virus
LTKRLCTIN

SEQ ID NO: 448747 - protein, 9 aa, Influenza virus
LTKTNNGDY

SEQ ID NO: 448748 - protein, 9 aa, Influenza virus
LTKTTVDHM

SEQ ID NO: 448749 - protein, 9 aa, Influenza virus
LTKVNNGDY

SEQ ID NO: 448750 - protein, 9 aa, Influenza virus
LTKVNNGNY

SEQ ID NO: 448751 - protein, 9 aa, Influenza virus
LTKVNSGDY

SEQ ID NO: 448752 - protein, 9 aa, Influenza virus
LTLGITGPD

SEQ ID NO: 448753 - protein, 9 aa, Influenza virus
LTLKLGQFP

SEQ ID NO: 448754 - protein, 9 aa, Influenza virus
LTLKSEQFP

SEQ ID NO: 448755 - protein, 9 aa, Influenza virus
LTLKSGQFP

SEQ ID NO: 448756 - protein, 9 aa, Influenza virus
LTLNTMTKD

SEQ ID NO: 448757 - protein, 9 aa, Influenza virus
LTMGECPKY

SEQ ID NO: 448758 - protein, 9 aa, Influenza virus
LTMGYKDII

SEQ ID NO: 448759 - protein, 9 aa, Influenza virus
LTMITYITR

SEQ ID NO: 448760 - protein, 9 aa, Influenza virus
LTNSEMNKL

SEQ ID NO: 448761 - protein, 9 aa, Influenza virus
LTQGACWEQ

SEQ ID NO: 448762 - protein, 9 aa, Influenza virus
LTQGALLND

SEQ ID NO: 448763 - protein, 9 aa, Influenza virus
LTQGRQTFD

SEQ ID NO: 448764 - protein, 9 aa, Influenza virus
LTQGRQTYD

SEQ ID NO: 448765 - protein, 9 aa, Influenza virus
LTQGSLLND

SEQ ID NO: 448766 - protein, 9 aa, Influenza virus
LTQGSLPND

SEQ ID NO: 448767 - protein, 9 aa, Influenza virus
LTQGTCWEQ

SEQ ID NO: 448768 - protein, 9 aa, Influenza virus
LTQGYKDII

SEQ ID NO: 448769 - protein, 9 aa, Influenza virus
LTQISNTNI

SEQ ID NO: 448770 - protein, 9 aa, Influenza virus
LTQTLVSNN

SEQ ID NO: 448771 - protein, 9 aa, Influenza virus
LTRELCTIN

SEQ ID NO: 448772 - protein, 9 aa, Influenza virus
LTREPYVSC

SEQ ID NO: 448773 - protein, 9 aa, Influenza virus
LTRGLCTIN

SEQ ID NO: 448774 - protein, 9 aa, Influenza virus
LTRTTVDHM

SEQ ID NO: 448775 - protein, 9 aa, Influenza virus
LTSLPFQNI

SEQ ID NO: 448776 - protein, 9 aa, Influenza virus
LTSVTTNTI

SEQ ID NO: 448777 - protein, 9 aa, Influenza virus
LTTGKSHGR

SEQ ID NO: 448778 - protein, 9 aa, Influenza virus
LTTIGLLLQ

SEQ ID NO: 448779 - protein, 9 aa, Influenza virus
LTTRGVQIA

SEQ ID NO: 448780 - protein, 9 aa, Influenza virus
LTTTIKPWA

SEQ ID NO: 448781 - protein, 9 aa, Influenza virus
LTTTIKTWA

SEQ ID NO: 448782 - protein, 9 aa, Influenza virus
LTTTIRTWA

SEQ ID NO: 448783 - protein, 9 aa, Influenza virus
LTTTPTKSY

SEQ ID NO: 448784 - protein, 9 aa, Influenza virus
LTTTVKTWA

SEQ ID NO: 448785 - protein, 9 aa, Influenza virus
LTTVGLLLQ

SEQ ID NO: 448786 - protein, 9 aa, Influenza virus
LTVEVPYVC

SEQ ID NO: 448787 - protein, 9 aa, Influenza virus
LTVLGKDAG

SEQ ID NO: 448788 - protein, 9 aa, Influenza virus
LTVNVRGSG

SEQ ID NO: 448789 - protein, 9 aa, Influenza virus
LTVNVRGTG

SEQ ID NO: 448790 - protein, 9 aa, Influenza virus
LTVPEWSYI

SEQ ID NO: 448791 - protein, 9 aa, Influenza virus
LTVPSERGL

SEQ ID NO: 448792 - protein, 9 aa, Influenza virus
LTVSVRGSG

SEQ ID NO: 448793 - protein, 9 aa, Influenza virus
LVADGGPNL

SEQ ID NO: 448794 - protein, 9 aa, Influenza virus
LVAGGLILG

SEQ ID NO: 448795 - protein, 9 aa, Influenza virus
LVAGWYGFQ

SEQ ID NO: 448796 - protein, 9 aa, Influenza virus
LVAIENQHT

SEQ ID NO: 448797 - protein, 9 aa, Influenza virus
LVALALSHT

SEQ ID NO: 448798 - protein, 9 aa, Influenza virus
LVALCGSPI

SEQ ID NO: 448799 - protein, 9 aa, Influenza virus
LVALCGSPV

SEQ ID NO: 448800 - protein, 9 aa, Influenza virus
LVALENQHT

SEQ ID NO: 448801 - protein, 9 aa, Influenza virus
LVALENQNT

SEQ ID NO: 448802 - protein, 9 aa, Influenza virus
LVAMENQHT

SEQ ID NO: 448803 - protein, 9 aa, Influenza virus
LVAPEYGFK

SEQ ID NO: 448804 - protein, 9 aa, Influenza virus
LVAPRGHYK

SEQ ID NO: 448805 - protein, 9 aa, Influenza virus
LVAPRGYFK

SEQ ID NO: 448806 - protein, 9 aa, Influenza virus
LVAPSRVSK

SEQ ID NO: 448807 - protein, 9 aa, Influenza virus
LVAPWYAYK

SEQ ID NO: 448808 - protein, 9 aa, Influenza virus
LVAPWYAYR

SEQ ID NO: 448809 - protein, 9 aa, Influenza virus
LVASSGNLE

SEQ ID NO: 448810 - protein, 9 aa, Influenza virus
LVASSGTLE

SEQ ID NO: 448811 - protein, 9 aa, Influenza virus
LVAVENQHT

SEQ ID NO: 448812 - protein, 9 aa, Influenza virus
LVCATCEQI

SEQ ID NO: 448813 - protein, 9 aa, Influenza virus
LVCVSLLQS

SEQ ID NO: 448814 - protein, 9 aa, Influenza virus
LVDALLGDP

SEQ ID NO: 448815 - protein, 9 aa, Influenza virus
LVDGQDCDL

SEQ ID NO: 448816 - protein, 9 aa, Influenza virus
LVDGWYGFR

SEQ ID NO: 448817 - protein, 9 aa, Influenza virus
LVDGWYGYH

SEQ ID NO: 448818 - protein, 9 aa, Influenza virus
LVDSIGSWS

SEQ ID NO: 448819 - protein, 9 aa, Influenza virus
LVDSIVSWS

SEQ ID NO: 448820 - protein, 9 aa, Influenza virus
LVETNHTDE

SEQ ID NO: 448821 - protein, 9 aa, Influenza virus
LVETNHTGT

SEQ ID NO: 448822 - protein, 9 aa, Influenza virus
LVETSHTGT

SEQ ID NO: 448823 - protein, 9 aa, Influenza virus
LVFFCLKNG

SEQ ID NO: 448824 - protein, 9 aa, Influenza virus
LVFFCLRNG

SEQ ID NO: 448825 - protein, 9 aa, Influenza virus
LVFICIKNG

SEQ ID NO: 448826 - protein, 9 aa, Influenza virus
LVFICMKNG

SEQ ID NO: 448827 - protein, 9 aa, Influenza virus
LVFICVKNG

SEQ ID NO: 448828 - protein, 9 aa, Influenza virus
LVFMCVKNG

SEQ ID NO: 448829 - protein, 9 aa, Influenza virus
LVFNTVIHE

SEQ ID NO: 448830 - protein, 9 aa, Influenza virus
LVFNTVIHG

SEQ ID NO: 448831 - protein, 9 aa, Influenza virus
LVFREQKQE

SEQ ID NO: 448832 - protein, 9 aa, Influenza virus
LVGDTPRND

SEQ ID NO: 448833 - protein, 9 aa, Influenza virus
LVGDTPRNE

SEQ ID NO: 448834 - protein, 9 aa, Influenza virus
LVGDTPRNG

SEQ ID NO: 448835 - protein, 9 aa, Influenza virus
LVGDTPRNN

SEQ ID NO: 448836 - protein, 9 aa, Influenza virus
LVGDTPRSD

SEQ ID NO: 448837 - protein, 9 aa, Influenza virus
LVGIDPFKL

SEQ ID NO: 448838 - protein, 9 aa, Influenza virus
LVGIDPFRL

SEQ ID NO: 448839 - protein, 9 aa, Influenza virus
LVGINMSKK

SEQ ID NO: 448840 - protein, 9 aa, Influenza virus
LVGINMSKR

SEQ ID NO: 448841 - protein, 9 aa, Influenza virus
LVGLILAFI

SEQ ID NO: 448842 - protein, 9 aa, Influenza virus
LVGLILSFI

SEQ ID NO: 448843 - protein, 9 aa, Influenza virus
LVGLILTFI

SEQ ID NO: 448844 - protein, 9 aa, Influenza virus
LVGPILSFI

SEQ ID NO: 448845 - protein, 9 aa, Influenza virus
LVGSSTYQN

SEQ ID NO: 448846 - protein, 9 aa, Influenza virus
LVGTKHSNG

SEQ ID NO: 448847 - protein, 9 aa, Influenza virus
LVGVDPFKL

SEQ ID NO: 448848 - protein, 9 aa, Influenza virus
LVGVDPFRL

SEQ ID NO: 448849 - protein, 9 aa, Influenza virus
LVHQSGTYP

SEQ ID NO: 448850 - protein, 9 aa, Influenza virus
LVIAARNIV

SEQ ID NO: 448851 - protein, 9 aa, Influenza virus
LVISPDLSY

SEQ ID NO: 448852 - protein, 9 aa, Influenza virus
LVISSDLSY

SEQ ID NO: 448853 - protein, 9 aa, Influenza virus
LVISTDLSY

SEQ ID NO: 448854 - protein, 9 aa, Influenza virus
LVIWGIHHP

SEQ ID NO: 448855 - protein, 9 aa, Influenza virus
LVIWGVHHP

SEQ ID NO: 448856 - protein, 9 aa, Influenza virus
LVIWGVHHS

SEQ ID NO: 448857 - protein, 9 aa, Influenza virus
LVLAAGLRN

SEQ ID NO: 448858 - protein, 9 aa, Influenza virus
LVLAAIIMG

SEQ ID NO: 448859 - protein, 9 aa, Influenza virus
LVLAALIMG

SEQ ID NO: 448860 - protein, 9 aa, Influenza virus
LVLAALNMG

SEQ ID NO: 448861 - protein, 9 aa, Influenza virus
LVLAASIMG

SEQ ID NO: 448862 - protein, 9 aa, Influenza virus
LVLATGLRN

SEQ ID NO: 448863 - protein, 9 aa, Influenza virus
LVLATGPRN

SEQ ID NO: 448864 - protein, 9 aa, Influenza virus
LVLDDCSLE

SEQ ID NO: 448865 - protein, 9 aa, Influenza virus
LVLDDCSLK

SEQ ID NO: 448866 - protein, 9 aa, Influenza virus
LVLGDCSIA

SEQ ID NO: 448867 - protein, 9 aa, Influenza virus
LVLGLSMVK

SEQ ID NO: 448868 - protein, 9 aa, Influenza virus
LVLGLSMVR

SEQ ID NO: 448869 - protein, 9 aa, Influenza virus
LVLGNPKCD

SEQ ID NO: 448870 - protein, 9 aa, Influenza virus
LVLIENDRT

SEQ ID NO: 448871 - protein, 9 aa, Influenza virus
LVLIENERT

SEQ ID NO: 448872 - protein, 9 aa, Influenza virus
LVLIENQKT

SEQ ID NO: 448873 - protein, 9 aa, Influenza virus
LVLIVSLGA

SEQ ID NO: 448874 - protein, 9 aa, Influenza virus
LVLLEDERT

SEQ ID NO: 448875 - protein, 9 aa, Influenza virus
LVLLENDKT

SEQ ID NO: 448876 - protein, 9 aa, Influenza virus
LVLLENDRT

SEQ ID NO: 448877 - protein, 9 aa, Influenza virus
LVLLENEKT

SEQ ID NO: 448878 - protein, 9 aa, Influenza virus
LVLLENERT

SEQ ID NO: 448879 - protein, 9 aa, Influenza virus
LVLLENGRT

SEQ ID NO: 448880 - protein, 9 aa, Influenza virus
LVLLENQKI

SEQ ID NO: 448881 - protein, 9 aa, Influenza virus
LVLLENQKP

SEQ ID NO: 448882 - protein, 9 aa, Influenza virus
LVLLENQKT

SEQ ID NO: 448883 - protein, 9 aa, Influenza virus
LVLLFMIIG

SEQ ID NO: 448884 - protein, 9 aa, Influenza virus
LVLLGNQKT

SEQ ID NO: 448885 - protein, 9 aa, Influenza virus
LVLLLMIIG

SEQ ID NO: 448886 - protein, 9 aa, Influenza virus
LVLLVSLGA

SEQ ID NO: 448887 - protein, 9 aa, Influenza virus
LVLMENEMT

SEQ ID NO: 448888 - protein, 9 aa, Influenza virus
LVLMENERT

SEQ ID NO: 448889 - protein, 9 aa, Influenza virus
LVLNKSLCK

SEQ ID NO: 448890 - protein, 9 aa, Influenza virus
LVLVVSLGA

SEQ ID NO: 448891 - protein, 9 aa, Influenza virus
LVLWAIHHP

SEQ ID NO: 448892 - protein, 9 aa, Influenza virus
LVLWGIHHP

SEQ ID NO: 448893 - protein, 9 aa, Influenza virus
LVLWGVHHP

SEQ ID NO: 448894 - protein, 9 aa, Influenza virus
LVMGQQGRM

SEQ ID NO: 448895 - protein, 9 aa, Influenza virus
LVMKRKRDS

SEQ ID NO: 448896 - protein, 9 aa, Influenza virus
LVMKRKRNS

SEQ ID NO: 448897 - protein, 9 aa, Influenza virus
LVMWGIHHP

SEQ ID NO: 448898 - protein, 9 aa, Influenza virus
LVMWGLHHP

SEQ ID NO: 448899 - protein, 9 aa, Influenza virus
LVNGQRGRI

SEQ ID NO: 448900 - protein, 9 aa, Influenza virus
LVNLGLNIG

SEQ ID NO: 448901 - protein, 9 aa, Influenza virus
LVNPGDSII

SEQ ID NO: 448902 - protein, 9 aa, Influenza virus
LVNTYQWII

SEQ ID NO: 448903 - protein, 9 aa, Influenza virus
LVNTYQWVI

SEQ ID NO: 448904 - protein, 9 aa, Influenza virus
LVPCEPIII

SEQ ID NO: 448905 - protein, 9 aa, Influenza virus
LVPCFWLEM

SEQ ID NO: 448906 - protein, 9 aa, Influenza virus
LVPCFWVEM

SEQ ID NO: 448907 - protein, 9 aa, Influenza virus
LVQLIVSGK

SEQ ID NO: 448908 - protein, 9 aa, Influenza virus
LVQLIVSGR

SEQ ID NO: 448909 - protein, 9 aa, Influenza virus
LVQNSITIE

SEQ ID NO: 448910 - protein, 9 aa, Influenza virus
LVREQQGRM

SEQ ID NO: 448911 - protein, 9 aa, Influenza virus
LVRGNSPAF

SEQ ID NO: 448912 - protein, 9 aa, Influenza virus
LVRGNSPVF

SEQ ID NO: 448913 - protein, 9 aa, Influenza virus
LVRGQQGRM

SEQ ID NO: 448914 - protein, 9 aa, Influenza virus
LVRGQQGTM

SEQ ID NO: 448915 - protein, 9 aa, Influenza virus
LVRGQQGWM

SEQ ID NO: 448916 - protein, 9 aa, Influenza virus
LVRGRPKES

SEQ ID NO: 448917 - protein, 9 aa, Influenza virus
LVRGRPQET

SEQ ID NO: 448918 - protein, 9 aa, Influenza virus
LVRKTRFLP

SEQ ID NO: 448919 - protein, 9 aa, Influenza virus
LVRMIKRGI

SEQ ID NO: 448920 - protein, 9 aa, Influenza virus
LVRSGMDPR

SEQ ID NO: 448921 - protein, 9 aa, Influenza virus
LVRTGMDPR

SEQ ID NO: 448922 - protein, 9 aa, Influenza virus
LVSDGGPNL

SEQ ID NO: 448923 - protein, 9 aa, Influenza virus
LVSLGAIGF

SEQ ID NO: 448924 - protein, 9 aa, Influenza virus
LVSLGAISF

SEQ ID NO: 448925 - protein, 9 aa, Influenza virus
LVSLGAVSF

SEQ ID NO: 448926 - protein, 9 aa, Influenza virus
LVSNNDWSG

SEQ ID NO: 448927 - protein, 9 aa, Influenza virus
LVSNSDWSG

SEQ ID NO: 448928 - protein, 9 aa, Influenza virus
LVSTKEWSK

SEQ ID NO: 448929 - protein, 9 aa, Influenza virus
LVSTKEWSR

SEQ ID NO: 448930 - protein, 9 aa, Influenza virus
LVSTNAYDR

SEQ ID NO: 448931 - protein, 9 aa, Influenza virus
LVSWEMGQA

SEQ ID NO: 448932 - protein, 9 aa, Influenza virus
LVSWPLSSP

SEQ ID NO: 448933 - protein, 9 aa, Influenza virus
LVTDGPSDA

SEQ ID NO: 448934 - protein, 9 aa, Influenza virus
LVTGKSHGR

SEQ ID NO: 448935 - protein, 9 aa, Influenza virus
LVTREPYIS

SEQ ID NO: 448936 - protein, 9 aa, Influenza virus
LVTREPYLS

SEQ ID NO: 448937 - protein, 9 aa, Influenza virus
LVTREPYVS

SEQ ID NO: 448938 - protein, 9 aa, Influenza virus
LVTTVTLHF

SEQ ID NO: 448939 - protein, 9 aa, Influenza virus
LVVPEYGFK

SEQ ID NO: 448940 - protein, 9 aa, Influenza virus
LVVSLGAIS

SEQ ID NO: 448941 - protein, 9 aa, Influenza virus
LVVSPDLSY

SEQ ID NO: 448942 - protein, 9 aa, Influenza virus
LVWLENEKT

SEQ ID NO: 448943 - protein, 9 aa, Influenza virus
LVWMACHSA

SEQ ID NO: 448944 - protein, 9 aa, Influenza virus
LVWMACNSA

SEQ ID NO: 448945 - protein, 9 aa, Influenza virus
LVYGNPACD

SEQ ID NO: 448946 - protein, 9 aa, Influenza virus
LVYGNPSCD

SEQ ID NO: 448947 - protein, 9 aa, Influenza virus
LWACQNGNI

SEQ ID NO: 448948 - protein, 9 aa, Influenza virus
LWACQNGNL

SEQ ID NO: 448949 - protein, 9 aa, Influenza virus
LWACQNGNV

SEQ ID NO: 448950 - protein, 9 aa, Influenza virus
LWACQTGNI

SEQ ID NO: 448951 - protein, 9 aa, Influenza virus
LWACSSGNC

SEQ ID NO: 448952 - protein, 9 aa, Influenza virus
LWAYNAELL

SEQ ID NO: 448953 - protein, 9 aa, Influenza virus
LWCKIVTTV

SEQ ID NO: 448954 - protein, 9 aa, Influenza virus
LWDSFRQSE

SEQ ID NO: 448955 - protein, 9 aa, Influenza virus
LWFSFGASC

SEQ ID NO: 448956 - protein, 9 aa, Influenza virus
LWFSFGASS

SEQ ID NO: 448957 - protein, 9 aa, Influenza virus
LWFSLGASC

SEQ ID NO: 448958 - protein, 9 aa, Influenza virus
LWGIHHPDS

SEQ ID NO: 448959 - protein, 9 aa, Influenza virus
LWGIHHPDT

SEQ ID NO: 448960 - protein, 9 aa, Influenza virus
LWGIHHPPD

SEQ ID NO: 448961 - protein, 9 aa, Influenza virus
LWGIHHPPN

SEQ ID NO: 448962 - protein, 9 aa, Influenza virus
LWGVHHPSS

SEQ ID NO: 448963 - protein, 9 aa, Influenza virus
LWHVRKRFA

SEQ ID NO: 448964 - protein, 9 aa, Influenza virus
LWISFAISC

SEQ ID NO: 448965 - protein, 9 aa, Influenza virus
LWISFAMSC

SEQ ID NO: 448966 - protein, 9 aa, Influenza virus
LWISFATSC

SEQ ID NO: 448967 - protein, 9 aa, Influenza virus
LWISFSISC

SEQ ID NO: 448968 - protein, 9 aa, Influenza virus
LWISFSMSC

SEQ ID NO: 448969 - protein, 9 aa, Influenza virus
LWLVLREKM

SEQ ID NO: 448970 - protein, 9 aa, Influenza virus
LWMCFNGSL

SEQ ID NO: 448971 - protein, 9 aa, Influenza virus
LWMCSNGSL

SEQ ID NO: 448972 - protein, 9 aa, Influenza virus
LWMCSNGSY

SEQ ID NO: 448973 - protein, 9 aa, Influenza virus
LWSYNAELL

SEQ ID NO: 448974 - protein, 9 aa, Influenza virus
LWSYNAGLL

SEQ ID NO: 448975 - protein, 9 aa, Influenza virus
LWSYNAQLL

SEQ ID NO: 448976 - protein, 9 aa, Influenza virus
LWTSNSIVA

SEQ ID NO: 448977 - protein, 9 aa, Influenza virus
LWTSNSIVV

SEQ ID NO: 448978 - protein, 9 aa, Influenza virus
LWTSNSMVA

SEQ ID NO: 448979 - protein, 9 aa, Influenza virus
LWTSNSVVA

SEQ ID NO: 448980 - protein, 9 aa, Influenza virus
LWTYNAELL

SEQ ID NO: 448981 - protein, 9 aa, Influenza virus
LWVSFSISC

SEQ ID NO: 448982 - protein, 9 aa, Influenza virus
LYASKNPYT

SEQ ID NO: 448983 - protein, 9 aa, Influenza virus
LYASPQLEG

SEQ ID NO: 448984 - protein, 9 aa, Influenza virus
LYASSQLEG

SEQ ID NO: 448985 - protein, 9 aa, Influenza virus
LYDAIEECL

SEQ ID NO: 448986 - protein, 9 aa, Influenza virus
LYDKVRFQL

SEQ ID NO: 448987 - protein, 9 aa, Influenza virus
LYDKVRHQL

SEQ ID NO: 448988 - protein, 9 aa, Influenza virus
LYDKVRLQL

SEQ ID NO: 448989 - protein, 9 aa, Influenza virus
LYDKVRMQL

SEQ ID NO: 448990 - protein, 9 aa, Influenza virus
LYDRVRKQL

SEQ ID NO: 448991 - protein, 9 aa, Influenza virus
LYDRVRLQL

SEQ ID NO: 448992 - protein, 9 aa, Influenza virus
LYDRVRMQL

SEQ ID NO: 448993 - protein, 9 aa, Influenza virus
LYDYKEDRF

SEQ ID NO: 448994 - protein, 9 aa, Influenza virus
LYDYKENRF

SEQ ID NO: 448995 - protein, 9 aa, Influenza virus
LYDYKESRF

SEQ ID NO: 448996 - protein, 9 aa, Influenza virus
LYDYKKNRF

SEQ ID NO: 448997 - protein, 9 aa, Influenza virus
LYEAIEECL

SEQ ID NO: 448998 - protein, 9 aa, Influenza virus
LYEKVRLQL

SEQ ID NO: 448999 - protein, 9 aa, Influenza virus
LYEKVRMQL

SEQ ID NO: 449000 - protein, 9 aa, Influenza virus
LYEKVRRQL

SEQ ID NO: 449001 - protein, 9 aa, Influenza virus
LYENNPGRV

SEQ ID NO: 449002 - protein, 9 aa, Influenza virus
LYERVKKQL

SEQ ID NO: 449003 - protein, 9 aa, Influenza virus
LYERVKRQL

SEQ ID NO: 449004 - protein, 9 aa, Influenza virus
LYERVRKQL

SEQ ID NO: 449005 - protein, 9 aa, Influenza virus
LYERVRRQL

SEQ ID NO: 449006 - protein, 9 aa, Influenza virus
LYESIEECL

SEQ ID NO: 449007 - protein, 9 aa, Influenza virus
LYFWGIHHP

SEQ ID NO: 449008 - protein, 9 aa, Influenza virus
LYFWGVHHP

SEQ ID NO: 449009 - protein, 9 aa, Influenza virus
LYGAGNKLI

SEQ ID NO: 449010 - protein, 9 aa, Influenza virus
LYGAIEECL

SEQ ID NO: 449011 - protein, 9 aa, Influenza virus
LYGAQSLSI

SEQ ID NO: 449012 - protein, 9 aa, Influenza virus
LYGFIIKGR

SEQ ID NO: 449013 - protein, 9 aa, Influenza virus
LYGFIVKGR

SEQ ID NO: 449014 - protein, 9 aa, Influenza virus
LYGNGAKLI

SEQ ID NO: 449015 - protein, 9 aa, Influenza virus
LYGNGNKLI

SEQ ID NO: 449016 - protein, 9 aa, Influenza virus
LYGNGNKLV

SEQ ID NO: 449017 - protein, 9 aa, Influenza virus
LYGSGAKLI

SEQ ID NO: 449018 - protein, 9 aa, Influenza virus
LYGSGNKLI

SEQ ID NO: 449019 - protein, 9 aa, Influenza virus
LYGSGNKLV

SEQ ID NO: 449020 - protein, 9 aa, Influenza virus
LYGSGSKLI

SEQ ID NO: 449021 - protein, 9 aa, Influenza virus
LYGTGNKLI

SEQ ID NO: 449022 - protein, 9 aa, Influenza virus
LYGTQPLSI

SEQ ID NO: 449023 - protein, 9 aa, Influenza virus
LYGTQSLSI

SEQ ID NO: 449024 - protein, 9 aa, Influenza virus
LYIRTNGTS

SEQ ID NO: 449025 - protein, 9 aa, Influenza virus
LYIWGIHHP

SEQ ID NO: 449026 - protein, 9 aa, Influenza virus
LYIWGVHHP

SEQ ID NO: 449027 - protein, 9 aa, Influenza virus
LYKKDISYV

SEQ ID NO: 449028 - protein, 9 aa, Influenza virus
LYKKDNSYV

SEQ ID NO: 449029 - protein, 9 aa, Influenza virus
LYKKDSSHV

SEQ ID NO: 449030 - protein, 9 aa, Influenza virus
LYKKDSSYI

SEQ ID NO: 449031 - protein, 9 aa, Influenza virus
LYKKDSSYV

SEQ ID NO: 449032 - protein, 9 aa, Influenza virus
LYKKLKREI

SEQ ID NO: 449033 - protein, 9 aa, Influenza virus
LYKKLKREM

SEQ ID NO: 449034 - protein, 9 aa, Influenza virus
LYKNANTLS

SEQ ID NO: 449035 - protein, 9 aa, Influenza virus
LYKNANTLT

SEQ ID NO: 449036 - protein, 9 aa, Influenza virus
LYKNNPGRV

SEQ ID NO: 449037 - protein, 9 aa, Influenza virus
LYKNSPGRV

SEQ ID NO: 449038 - protein, 9 aa, Influenza virus
LYKNTNTLS

SEQ ID NO: 449039 - protein, 9 aa, Influenza virus
LYKSNPGRV

SEQ ID NO: 449040 - protein, 9 aa, Influenza virus
LYKVATGRV

SEQ ID NO: 449041 - protein, 9 aa, Influenza virus
LYLNGREWS

SEQ ID NO: 449042 - protein, 9 aa, Influenza virus
LYLSGREWS

SEQ ID NO: 449043 - protein, 9 aa, Influenza virus
LYLTGTWDT

SEQ ID NO: 449044 - protein, 9 aa, Influenza virus
LYLWGVHHP

SEQ ID NO: 449045 - protein, 9 aa, Influenza virus
LYNIRNLHI

SEQ ID NO: 449046 - protein, 9 aa, Influenza virus
LYNKHSNGT

SEQ ID NO: 449047 - protein, 9 aa, Influenza virus
LYNKIEFEP

SEQ ID NO: 449048 - protein, 9 aa, Influenza virus
LYNKLEFEP

SEQ ID NO: 449049 - protein, 9 aa, Influenza virus
LYNKMEFEP

SEQ ID NO: 449050 - protein, 9 aa, Influenza virus
LYNKVEFEP

SEQ ID NO: 449051 - protein, 9 aa, Influenza virus
LYNKVRLQL

SEQ ID NO: 449052 - protein, 9 aa, Influenza virus
LYNKVRMQL

SEQ ID NO: 449053 - protein, 9 aa, Influenza virus
LYQEVGTYV

SEQ ID NO: 449054 - protein, 9 aa, Influenza virus
LYQKVGTYV

SEQ ID NO: 449055 - protein, 9 aa, Influenza virus
LYQNVETYV

SEQ ID NO: 449056 - protein, 9 aa, Influenza virus
LYQNVGTYV

SEQ ID NO: 449057 - protein, 9 aa, Influenza virus
LYRKLKREI

SEQ ID NO: 449058 - protein, 9 aa, Influenza virus
LYSGFVRTL

SEQ ID NO: 449059 - protein, 9 aa, Influenza virus
LYSSPQLEG

SEQ ID NO: 449060 - protein, 9 aa, Influenza virus
LYVNKNPYT

SEQ ID NO: 449061 - protein, 9 aa, Influenza virus
LYVRTNGTS

SEQ ID NO: 449062 - protein, 9 aa, Influenza virus
LYVWGVHHP

SEQ ID NO: 449063 - protein, 9 aa, Influenza virus
LYWHLMHPG

SEQ ID NO: 449064 - protein, 9 aa, Influenza virus
LYWHLMRPG

SEQ ID NO: 449065 - protein, 9 aa, Influenza virus
LYWHLMSPG

SEQ ID NO: 449066 - protein, 9 aa, Influenza virus
MAADKESTQ

SEQ ID NO: 449067 - protein, 9 aa, Influenza virus
MAADQKSTQ

SEQ ID NO: 449068 - protein, 9 aa, Influenza virus
MAADRDSTQ

SEQ ID NO: 449069 - protein, 9 aa, Influenza virus
MACHSAAFE

SEQ ID NO: 449070 - protein, 9 aa, Influenza virus
MACNSAAFE

SEQ ID NO: 449071 - protein, 9 aa, Influenza virus
MADSEMLNL

SEQ ID NO: 449072 - protein, 9 aa, Influenza virus
MADSIKSWR

SEQ ID NO: 449073 - protein, 9 aa, Influenza virus
MADSTMLNL

SEQ ID NO: 449074 - protein, 9 aa, Influenza virus
MAFLEDSHP

SEQ ID NO: 449075 - protein, 9 aa, Influenza virus
MAFLEESHP

SEQ ID NO: 449076 - protein, 9 aa, Influenza virus
MAFLEKSHP

SEQ ID NO: 449077 - protein, 9 aa, Influenza virus
MAFLENSHP

SEQ ID NO: 449078 - protein, 9 aa, Influenza virus
MAGLSFWMC

SEQ ID NO: 449079 - protein, 9 aa, Influenza virus
MAGSSEQAA

SEQ ID NO: 449080 - protein, 9 aa, Influenza virus
MAIDNMQNK

SEQ ID NO: 449081 - protein, 9 aa, Influenza virus
MAIIKKYTS

SEQ ID NO: 449082 - protein, 9 aa, Influenza virus
MAIIKRYTS

SEQ ID NO: 449083 - protein, 9 aa, Influenza virus
MAINWGRIV

SEQ ID NO: 449084 - protein, 9 aa, Influenza virus
MAKCNTKCQ

SEQ ID NO: 449085 - protein, 9 aa, Influenza virus
MALLEESHP

SEQ ID NO: 449086 - protein, 9 aa, Influenza virus
MALQGTKRS

SEQ ID NO: 449087 - protein, 9 aa, Influenza virus
MALQLFIKD

SEQ ID NO: 449088 - protein, 9 aa, Influenza virus
MALSVVSLL

SEQ ID NO: 449089 - protein, 9 aa, Influenza virus
MAMKYPITA

SEQ ID NO: 449090 - protein, 9 aa, Influenza virus
MAMRYPITA

SEQ ID NO: 449091 - protein, 9 aa, Influenza virus
MANIRNNTY

SEQ ID NO: 449092 - protein, 9 aa, Influenza virus
MAPEKIDFE

SEQ ID NO: 449093 - protein, 9 aa, Influenza virus
MAPEKMDFE

SEQ ID NO: 449094 - protein, 9 aa, Influenza virus
MAPEKVDFD

SEQ ID NO: 449095 - protein, 9 aa, Influenza virus
MAPEKVDFE

SEQ ID NO: 449096 - protein, 9 aa, Influenza virus
MAPIMFSNK

SEQ ID NO: 449097 - protein, 9 aa, Influenza virus
MARAVKLYK

SEQ ID NO: 449098 - protein, 9 aa, Influenza virus
MARCNTKCQ

SEQ ID NO: 449099 - protein, 9 aa, Influenza virus
MARLGKGYM

SEQ ID NO: 449100 - protein, 9 aa, Influenza virus
MARLGRGYM

SEQ ID NO: 449101 - protein, 9 aa, Influenza virus
MARSALILR

SEQ ID NO: 449102 - protein, 9 aa, Influenza virus
MASIRNNTY

SEQ ID NO: 449103 - protein, 9 aa, Influenza virus
MASIRNSTY

SEQ ID NO: 449104 - protein, 9 aa, Influenza virus
MASQGTKRP

SEQ ID NO: 449105 - protein, 9 aa, Influenza virus
MASQGTKRS

SEQ ID NO: 449106 - protein, 9 aa, Influenza virus
MATGLRNIP

SEQ ID NO: 449107 - protein, 9 aa, Influenza virus
MATGLRNVP

SEQ ID NO: 449108 - protein, 9 aa, Influenza virus
MATIRNGTY

SEQ ID NO: 449109 - protein, 9 aa, Influenza virus
MATLCLGHH

SEQ ID NO: 449110 - protein, 9 aa, Influenza virus
MATNECRII

SEQ ID NO: 449111 - protein, 9 aa, Influenza virus
MAWSSSSCH

SEQ ID NO: 449112 - protein, 9 aa, Influenza virus
MCFNGSLQC

SEQ ID NO: 449113 - protein, 9 aa, Influenza virus
MCHGTQIGG

SEQ ID NO: 449114 - protein, 9 aa, Influenza virus
MCHSTQIGG

SEQ ID NO: 449115 - protein, 9 aa, Influenza virus
MCHSTRIGG

SEQ ID NO: 449116 - protein, 9 aa, Influenza virus
MCLNGSMQC

SEQ ID NO: 449117 - protein, 9 aa, Influenza virus
MCNILKGKF

SEQ ID NO: 449118 - protein, 9 aa, Influenza virus
MCPNGSLQC

SEQ ID NO: 449119 - protein, 9 aa, Influenza virus
MCSGHSCRI

SEQ ID NO: 449120 - protein, 9 aa, Influenza virus
MCSGLVGDT

SEQ ID NO: 449121 - protein, 9 aa, Influenza virus
MCSLMQGST

SEQ ID NO: 449122 - protein, 9 aa, Influenza virus
MCSNGSLHG

SEQ ID NO: 449123 - protein, 9 aa, Influenza virus
MCSNGSLQC

SEQ ID NO: 449124 - protein, 9 aa, Influenza virus
MCSNGSLRC

SEQ ID NO: 449125 - protein, 9 aa, Influenza virus
MCSNGSMQC

SEQ ID NO: 449126 - protein, 9 aa, Influenza virus
MCSNSSMQC

SEQ ID NO: 449127 - protein, 9 aa, Influenza virus
MCSSTEFLG

SEQ ID NO: 449128 - protein, 9 aa, Influenza virus
MCTELKLND

SEQ ID NO: 449129 - protein, 9 aa, Influenza virus
MCTELKLSD

SEQ ID NO: 449130 - protein, 9 aa, Influenza virus
MCTELKLSE

SEQ ID NO: 449131 - protein, 9 aa, Influenza virus
MCTELQLSD

SEQ ID NO: 449132 - protein, 9 aa, Influenza virus
MCVCRDNWH

SEQ ID NO: 449133 - protein, 9 aa, Influenza virus
MCVGWSSTT

SEQ ID NO: 449134 - protein, 9 aa, Influenza virus
MCVKNGNLR

SEQ ID NO: 449135 - protein, 9 aa, Influenza virus
MCVKNGNMR

SEQ ID NO: 449136 - protein, 9 aa, Influenza virus
MCYPGFVEN

SEQ ID NO: 449137 - protein, 9 aa, Influenza virus
MCYPGSIEN

SEQ ID NO: 449138 - protein, 9 aa, Influenza virus
MCYPGSVEN

SEQ ID NO: 449139 - protein, 9 aa, Influenza virus
MDAGNGCFD

SEQ ID NO: 449140 - protein, 9 aa, Influenza virus
MDALKLSIE

SEQ ID NO: 449141 - protein, 9 aa, Influenza virus
MDALLGDPH

SEQ ID NO: 449142 - protein, 9 aa, Influenza virus
MDDFQLIPM

SEQ ID NO: 449143 - protein, 9 aa, Influenza virus
MDEFQLIPM

SEQ ID NO: 449144 - protein, 9 aa, Influenza virus
MDGVTNKVN

SEQ ID NO: 449145 - protein, 9 aa, Influenza virus
MDGWYGFRH

SEQ ID NO: 449146 - protein, 9 aa, Influenza virus
MDHTSQYLC

SEQ ID NO: 449147 - protein, 9 aa, Influenza virus
MDKAVKLYK

SEQ ID NO: 449148 - protein, 9 aa, Influenza virus
MDKAVKLYR

SEQ ID NO: 449149 - protein, 9 aa, Influenza virus
MDKLFERVR

SEQ ID NO: 449150 - protein, 9 aa, Influenza virus
MDKQTKTMT

SEQ ID NO: 449151 - protein, 9 aa, Influenza virus
MDNKTKKMT

SEQ ID NO: 449152 - protein, 9 aa, Influenza virus
MDNQTKKMT

SEQ ID NO: 449153 - protein, 9 aa, Influenza virus
MDNQTKTMT

SEQ ID NO: 449154 - protein, 9 aa, Influenza virus
MDPRMCSLM

SEQ ID NO: 449155 - protein, 9 aa, Influenza virus
MDQVREGRN

SEQ ID NO: 449156 - protein, 9 aa, Influenza virus
MDQVRESRN

SEQ ID NO: 449157 - protein, 9 aa, Influenza virus
MDRAVKLYK

SEQ ID NO: 449158 - protein, 9 aa, Influenza virus
MDRAVKLYR

SEQ ID NO: 449159 - protein, 9 aa, Influenza virus
MDSLKLSIE

SEQ ID NO: 449160 - protein, 9 aa, Influenza virus
MDSRSGYET

SEQ ID NO: 449161 - protein, 9 aa, Influenza virus
MDSVKNGTY

SEQ ID NO: 449162 - protein, 9 aa, Influenza virus
MDSVRNGTY

SEQ ID NO: 449163 - protein, 9 aa, Influenza virus
MDTIRNGTY

SEQ ID NO: 449164 - protein, 9 aa, Influenza virus
MDTVNRTHQ

SEQ ID NO: 449165 - protein, 9 aa, Influenza virus
MDTVSRTHQ

SEQ ID NO: 449166 - protein, 9 aa, Influenza virus
MDVNPTLLF

SEQ ID NO: 449167 - protein, 9 aa, Influenza virus
MDVWTYNAE

SEQ ID NO: 449168 - protein, 9 aa, Influenza virus
MDYYWAILK

SEQ ID NO: 449169 - protein, 9 aa, Influenza virus
MDYYWAVLK

SEQ ID NO: 449170 - protein, 9 aa, Influenza virus
MDYYWGILK

SEQ ID NO: 449171 - protein, 9 aa, Influenza virus
MEAIRNGTY

SEQ ID NO: 449172 - protein, 9 aa, Influenza virus
MEAMVSRAR

SEQ ID NO: 449173 - protein, 9 aa, Influenza virus
MECRTFFLT

SEQ ID NO: 449174 - protein, 9 aa, Influenza virus
MEDFVRQCF

SEQ ID NO: 449175 - protein, 9 aa, Influenza virus
MEDGFIDVW

SEQ ID NO: 449176 - protein, 9 aa, Influenza virus
MEDGFLDVW

SEQ ID NO: 449177 - protein, 9 aa, Influenza virus
MEDGFLGVW

SEQ ID NO: 449178 - protein, 9 aa, Influenza virus
MEDGFRDVW

SEQ ID NO: 449179 - protein, 9 aa, Influenza virus
MEEFVRQCF

SEQ ID NO: 449180 - protein, 9 aa, Influenza virus
MEEGSIGKV

SEQ ID NO: 449181 - protein, 9 aa, Influenza virus
MEEVTNATE

SEQ ID NO: 449182 - protein, 9 aa, Influenza virus
MEFEPFQSL

SEQ ID NO: 449183 - protein, 9 aa, Influenza virus
MEFSLTDPK

SEQ ID NO: 449184 - protein, 9 aa, Influenza virus
MEFSLTDPR

SEQ ID NO: 449185 - protein, 9 aa, Influenza virus
MEGFVRQCF

SEQ ID NO: 449186 - protein, 9 aa, Influenza virus
MEGICYPGS

SEQ ID NO: 449187 - protein, 9 aa, Influenza virus
MEGVCYPGS

SEQ ID NO: 449188 - protein, 9 aa, Influenza virus
MEHTSQYLC

SEQ ID NO: 449189 - protein, 9 aa, Influenza virus
MEKANKIKS

SEQ ID NO: 449190 - protein, 9 aa, Influenza virus
MEKFIILST

SEQ ID NO: 449191 - protein, 9 aa, Influenza virus
MEKFITLST

SEQ ID NO: 449192 - protein, 9 aa, Influenza virus
MEKFIVLSI

SEQ ID NO: 449193 - protein, 9 aa, Influenza virus
MEKFIVLSV

SEQ ID NO: 449194 - protein, 9 aa, Influenza virus
MEKNITVTH

SEQ ID NO: 449195 - protein, 9 aa, Influenza virus
MEKNVTVTH

SEQ ID NO: 449196 - protein, 9 aa, Influenza virus
MELDEIGED

SEQ ID NO: 449197 - protein, 9 aa, Influenza virus
MELIRMIKR

SEQ ID NO: 449198 - protein, 9 aa, Influenza virus
MELIRMVKR

SEQ ID NO: 449199 - protein, 9 aa, Influenza virus
MELPSFGVS

SEQ ID NO: 449200 - protein, 9 aa, Influenza virus
MELRRCLLQ

SEQ ID NO: 449201 - protein, 9 aa, Influenza virus
MELVEAEKH

SEQ ID NO: 449202 - protein, 9 aa, Influenza virus
MELVETEKH

SEQ ID NO: 449203 - protein, 9 aa, Influenza virus
MELVETEKN

SEQ ID NO: 449204 - protein, 9 aa, Influenza virus
MELVETKKH

SEQ ID NO: 449205 - protein, 9 aa, Influenza virus
MELVRMIKR

SEQ ID NO: 449206 - protein, 9 aa, Influenza virus
MEMRRCLLQ

SEQ ID NO: 449207 - protein, 9 aa, Influenza virus
MENEMTLDF

SEQ ID NO: 449208 - protein, 9 aa, Influenza virus
MENERILDF

SEQ ID NO: 449209 - protein, 9 aa, Influenza virus
MENERTLDF

SEQ ID NO: 449210 - protein, 9 aa, Influenza virus
MENERTLDL

SEQ ID NO: 449211 - protein, 9 aa, Influenza virus
MENERTLDY

SEQ ID NO: 449212 - protein, 9 aa, Influenza virus
MENERTLYF

SEQ ID NO: 449213 - protein, 9 aa, Influenza virus
MENFVRQCF

SEQ ID NO: 449214 - protein, 9 aa, Influenza virus
MENLNKKVD

SEQ ID NO: 449215 - protein, 9 aa, Influenza virus
MENQHIIDL

SEQ ID NO: 449216 - protein, 9 aa, Influenza virus
MENQHTIDL

SEQ ID NO: 449217 - protein, 9 aa, Influenza virus
MENQHTIDM

SEQ ID NO: 449218 - protein, 9 aa, Influenza virus
MEQMAGSSE

SEQ ID NO: 449219 - protein, 9 aa, Influenza virus
MEQNVPVTQ

SEQ ID NO: 449220 - protein, 9 aa, Influenza virus
MEQVAGSSE

SEQ ID NO: 449221 - protein, 9 aa, Influenza virus
MERIRNNTY

SEQ ID NO: 449222 - protein, 9 aa, Influenza virus
MERNVTVTH

SEQ ID NO: 449223 - protein, 9 aa, Influenza virus
MESGGIDKI

SEQ ID NO: 449224 - protein, 9 aa, Influenza virus
MESGGIDKV

SEQ ID NO: 449225 - protein, 9 aa, Influenza virus
MESGGISKI

SEQ ID NO: 449226 - protein, 9 aa, Influenza virus
MESGGISKM

SEQ ID NO: 449227 - protein, 9 aa, Influenza virus
MESIKNGTY

SEQ ID NO: 449228 - protein, 9 aa, Influenza virus
MESIRNGTY

SEQ ID NO: 449229 - protein, 9 aa, Influenza virus
MESIRNNTY

SEQ ID NO: 449230 - protein, 9 aa, Influenza virus
MESRGLFGA

SEQ ID NO: 449231 - protein, 9 aa, Influenza virus
MESVKNGTY

SEQ ID NO: 449232 - protein, 9 aa, Influenza virus
MESVRNGTY

SEQ ID NO: 449233 - protein, 9 aa, Influenza virus
METERTLDF

SEQ ID NO: 449234 - protein, 9 aa, Influenza virus
METIKNGTY

SEQ ID NO: 449235 - protein, 9 aa, Influenza virus
METIRNGTY

SEQ ID NO: 449236 - protein, 9 aa, Influenza virus
METTRNGTY

SEQ ID NO: 449237 - protein, 9 aa, Influenza virus
MEVCFMYSD

SEQ ID NO: 449238 - protein, 9 aa, Influenza virus
MEVVFPNEV

SEQ ID NO: 449239 - protein, 9 aa, Influenza virus
MEWIKTRPI

SEQ ID NO: 449240 - protein, 9 aa, Influenza virus
MEWLKTRPI

SEQ ID NO: 449241 - protein, 9 aa, Influenza virus
MEYDAVATT

SEQ ID NO: 449242 - protein, 9 aa, Influenza virus
MFALSQGTT

SEQ ID NO: 449243 - protein, 9 aa, Influenza virus
MFDFIKWNV

SEQ ID NO: 449244 - protein, 9 aa, Influenza virus
MFDFSKWNV

SEQ ID NO: 449245 - protein, 9 aa, Influenza virus
MFDFTKWNV

SEQ ID NO: 449246 - protein, 9 aa, Influenza virus
MFESNGGLI

SEQ ID NO: 449247 - protein, 9 aa, Influenza virus
MFESNGGLL

SEQ ID NO: 449248 - protein, 9 aa, Influenza virus
MFLAMITYI

SEQ ID NO: 449249 - protein, 9 aa, Influenza virus
MFLYIRTNG

SEQ ID NO: 449250 - protein, 9 aa, Influenza virus
MFLYVRTNG

SEQ ID NO: 449251 - protein, 9 aa, Influenza virus
MFNMLSTVL

SEQ ID NO: 449252 - protein, 9 aa, Influenza virus
MFSNKMARL

SEQ ID NO: 449253 - protein, 9 aa, Influenza virus
MFSNKVARL

SEQ ID NO: 449254 - protein, 9 aa, Influenza virus
MGAINSSMP

SEQ ID NO: 449255 - protein, 9 aa, Influenza virus
MGARPQVNG

SEQ ID NO: 449256 - protein, 9 aa, Influenza virus
MGAVNSSMP

SEQ ID NO: 449257 - protein, 9 aa, Influenza virus
MGEAMVSRA

SEQ ID NO: 449258 - protein, 9 aa, Influenza virus
MGECPEYVK

SEQ ID NO: 449259 - protein, 9 aa, Influenza virus
MGECPKYAK

SEQ ID NO: 449260 - protein, 9 aa, Influenza virus
MGECPKYVK

SEQ ID NO: 449261 - protein, 9 aa, Influenza virus
MGECPKYVR

SEQ ID NO: 449262 - protein, 9 aa, Influenza virus
MGECPNYVK

SEQ ID NO: 449263 - protein, 9 aa, Influenza virus
MGFRYSGIK

SEQ ID NO: 449264 - protein, 9 aa, Influenza virus
MGFRYSGIR

SEQ ID NO: 449265 - protein, 9 aa, Influenza virus
MGFTYSGIR

SEQ ID NO: 449266 - protein, 9 aa, Influenza virus
MGFTYTGVR

SEQ ID NO: 449267 - protein, 9 aa, Influenza virus
MGIYQILAI

SEQ ID NO: 449268 - protein, 9 aa, Influenza virus
MGKCNTKCQ

SEQ ID NO: 449269 - protein, 9 aa, Influenza virus
MGKVECVCR

SEQ ID NO: 449270 - protein, 9 aa, Influenza virus
MGLAPSPYN

SEQ ID NO: 449271 - protein, 9 aa, Influenza virus
MGLFFFCLK

SEQ ID NO: 449272 - protein, 9 aa, Influenza virus
MGLIFMCVK

SEQ ID NO: 449273 - protein, 9 aa, Influenza virus
MGLIYNRMG

SEQ ID NO: 449274 - protein, 9 aa, Influenza virus
MGLKISSSF

SEQ ID NO: 449275 - protein, 9 aa, Influenza virus
MGLQMQRFK

SEQ ID NO: 449276 - protein, 9 aa, Influenza virus
MGLRISSSF

SEQ ID NO: 449277 - protein, 9 aa, Influenza virus
MGLVFFCLK

SEQ ID NO: 449278 - protein, 9 aa, Influenza virus
MGLVFFCLR

SEQ ID NO: 449279 - protein, 9 aa, Influenza virus
MGLVFICIK

SEQ ID NO: 449280 - protein, 9 aa, Influenza virus
MGLVFICMK

SEQ ID NO: 449281 - protein, 9 aa, Influenza virus
MGLVFICVK

SEQ ID NO: 449282 - protein, 9 aa, Influenza virus
MGLVFMCVK

SEQ ID NO: 449283 - protein, 9 aa, Influenza virus
MGMAADKES

SEQ ID NO: 449284 - protein, 9 aa, Influenza virus
MGMFNMLST

SEQ ID NO: 449285 - protein, 9 aa, Influenza virus
MGNGCFEFY

SEQ ID NO: 449286 - protein, 9 aa, Influenza virus
MGNGCFKIY

SEQ ID NO: 449287 - protein, 9 aa, Influenza virus
MGNGCFRIY

SEQ ID NO: 449288 - protein, 9 aa, Influenza virus
MGNGCFTIY

SEQ ID NO: 449289 - protein, 9 aa, Influenza virus
MGNGCLKIY

SEQ ID NO: 449290 - protein, 9 aa, Influenza virus
MGQAADLKS

SEQ ID NO: 449291 - protein, 9 aa, Influenza virus
MGQAPSPYN

SEQ ID NO: 449292 - protein, 9 aa, Influenza virus
MGQAPSPYT

SEQ ID NO: 449293 - protein, 9 aa, Influenza virus
MGQCGLLGT

SEQ ID NO: 449294 - protein, 9 aa, Influenza virus
MGQQGRMDY

SEQ ID NO: 449295 - protein, 9 aa, Influenza virus
MGRTISKDS

SEQ ID NO: 449296 - protein, 9 aa, Influenza virus
MGRTISMDS

SEQ ID NO: 449297 - protein, 9 aa, Influenza virus
MGRTISRDS

SEQ ID NO: 449298 - protein, 9 aa, Influenza virus
MGSIRNNTY

SEQ ID NO: 449299 - protein, 9 aa, Influenza virus
MGSSPNAYQ

SEQ ID NO: 449300 - protein, 9 aa, Influenza virus
MGTAPVLGN

SEQ ID NO: 449301 - protein, 9 aa, Influenza virus
MGTIRNGTY

SEQ ID NO: 449302 - protein, 9 aa, Influenza virus
MGVAPSPSN

SEQ ID NO: 449303 - protein, 9 aa, Influenza virus
MGVDEYSNA

SEQ ID NO: 449304 - protein, 9 aa, Influenza virus
MGVDEYSSA

SEQ ID NO: 449305 - protein, 9 aa, Influenza virus
MGVDEYSST

SEQ ID NO: 449306 - protein, 9 aa, Influenza virus
MGVQIQRFK

SEQ ID NO: 449307 - protein, 9 aa, Influenza virus
MGVQLQRFK

SEQ ID NO: 449308 - protein, 9 aa, Influenza virus
MGVQMHRFK

SEQ ID NO: 449309 - protein, 9 aa, Influenza virus
MGVQMQRFK

SEQ ID NO: 449310 - protein, 9 aa, Influenza virus
MGVYQILAI

SEQ ID NO: 449311 - protein, 9 aa, Influenza virus
MGVYQILVI

SEQ ID NO: 449312 - protein, 9 aa, Influenza virus
MGYICSGIF

SEQ ID NO: 449313 - protein, 9 aa, Influenza virus
MGYICSGVF

SEQ ID NO: 449314 - protein, 9 aa, Influenza virus
MGYKDIILW

SEQ ID NO: 449315 - protein, 9 aa, Influenza virus
MHDANVKNL

SEQ ID NO: 449316 - protein, 9 aa, Influenza virus
MHDANVRNL

SEQ ID NO: 449317 - protein, 9 aa, Influenza virus
MHDRSPFRA

SEQ ID NO: 449318 - protein, 9 aa, Influenza virus
MHDRTKIRQ

SEQ ID NO: 449319 - protein, 9 aa, Influenza virus
MHQLLRHFQ

SEQ ID NO: 449320 - protein, 9 aa, Influenza virus
MIADRVDDA

SEQ ID NO: 449321 - protein, 9 aa, Influenza virus
MIALILVAL

SEQ ID NO: 449322 - protein, 9 aa, Influenza virus
MIDGWYGFH

SEQ ID NO: 449323 - protein, 9 aa, Influenza virus
MIDGWYGFR

SEQ ID NO: 449324 - protein, 9 aa, Influenza virus
MIDGWYGYH

SEQ ID NO: 449325 - protein, 9 aa, Influenza virus
MIEAESSIK

SEQ ID NO: 449326 - protein, 9 aa, Influenza virus
MIEAESSVK

SEQ ID NO: 449327 - protein, 9 aa, Influenza virus
MIEAESSVR

SEQ ID NO: 449328 - protein, 9 aa, Influenza virus
MIICIQGNN

SEQ ID NO: 449329 - protein, 9 aa, Influenza virus
MIIGGFIFG

SEQ ID NO: 449330 - protein, 9 aa, Influenza virus
MIKAVRGDL

SEQ ID NO: 449331 - protein, 9 aa, Influenza virus
MIKRGINDR

SEQ ID NO: 449332 - protein, 9 aa, Influenza virus
MIKRGVNDR

SEQ ID NO: 449333 - protein, 9 aa, Influenza virus
MILSVVSLL

SEQ ID NO: 449334 - protein, 9 aa, Influenza virus
MINDKIDDQ

SEQ ID NO: 449335 - protein, 9 aa, Influenza virus
MINDKINDQ

SEQ ID NO: 449336 - protein, 9 aa, Influenza virus
MINNDLGPA

SEQ ID NO: 449337 - protein, 9 aa, Influenza virus
MINPVKLSG

SEQ ID NO: 449338 - protein, 9 aa, Influenza virus
MINPVKLSS

SEQ ID NO: 449339 - protein, 9 aa, Influenza virus
MINSKIDDQ

SEQ ID NO: 449340 - protein, 9 aa, Influenza virus
MINSKIEDQ

SEQ ID NO: 449341 - protein, 9 aa, Influenza virus
MINSKINDQ

SEQ ID NO: 449342 - protein, 9 aa, Influenza virus
MINSQIDDQ

SEQ ID NO: 449343 - protein, 9 aa, Influenza virus
MIQLIVSGR

SEQ ID NO: 449344 - protein, 9 aa, Influenza virus
MIRGKPEEG

SEQ ID NO: 449345 - protein, 9 aa, Influenza virus
MIRGKPEER

SEQ ID NO: 449346 - protein, 9 aa, Influenza virus
MIRGKPKER

SEQ ID NO: 449347 - protein, 9 aa, Influenza virus
MIRGQPKEK

SEQ ID NO: 449348 - protein, 9 aa, Influenza virus
MIRGQPNER

SEQ ID NO: 449349 - protein, 9 aa, Influenza virus
MIRGRPEER

SEQ ID NO: 449350 - protein, 9 aa, Influenza virus
MISDKIDDQ

SEQ ID NO: 449351 - protein, 9 aa, Influenza virus
MISKCKTKE

SEQ ID NO: 449352 - protein, 9 aa, Influenza virus
MISKCRTKE

SEQ ID NO: 449353 - protein, 9 aa, Influenza virus
MISKCRTRE

SEQ ID NO: 449354 - protein, 9 aa, Influenza virus
MISKSRTKE

SEQ ID NO: 449355 - protein, 9 aa, Influenza virus
MISPLAVTW

SEQ ID NO: 449356 - protein, 9 aa, Influenza virus
MISRARIDA

SEQ ID NO: 449357 - protein, 9 aa, Influenza virus
MITDTIKSW

SEQ ID NO: 449358 - protein, 9 aa, Influenza virus
MITQRTIGK

SEQ ID NO: 449359 - protein, 9 aa, Influenza virus
MIWDANGWV

SEQ ID NO: 449360 - protein, 9 aa, Influenza virus
MIWDPDGWT

SEQ ID NO: 449361 - protein, 9 aa, Influenza virus
MIWDPNGWT

SEQ ID NO: 449362 - protein, 9 aa, Influenza virus
MIWHSNLND

SEQ ID NO: 449363 - protein, 9 aa, Influenza virus
MKDRSPYRT

SEQ ID NO: 449364 - protein, 9 aa, Influenza virus
MKGVYINTA

SEQ ID NO: 449365 - protein, 9 aa, Influenza virus
MKGVYMNTA

SEQ ID NO: 449366 - protein, 9 aa, Influenza virus
MKGVYVNTA

SEQ ID NO: 449367 - protein, 9 aa, Influenza virus
MKHTSQYIC

SEQ ID NO: 449368 - protein, 9 aa, Influenza virus
MKHTSQYLC

SEQ ID NO: 449369 - protein, 9 aa, Influenza virus
MKIIRVGCV

SEQ ID NO: 449370 - protein, 9 aa, Influenza virus
MKIYWHLMH

SEQ ID NO: 449371 - protein, 9 aa, Influenza virus
MKKFIILST

SEQ ID NO: 449372 - protein, 9 aa, Influenza virus
MKKLYERVR

SEQ ID NO: 449373 - protein, 9 aa, Influenza virus
MKLYWHLMH

SEQ ID NO: 449374 - protein, 9 aa, Influenza virus
MKLYWHLMR

SEQ ID NO: 449375 - protein, 9 aa, Influenza virus
MKLYWHLMS

SEQ ID NO: 449376 - protein, 9 aa, Influenza virus
MKNGNMQCT

SEQ ID NO: 449377 - protein, 9 aa, Influenza virus
MKNVPEIPK

SEQ ID NO: 449378 - protein, 9 aa, Influenza virus
MKNVPEIPR

SEQ ID NO: 449379 - protein, 9 aa, Influenza virus
MKNVPEKIH

SEQ ID NO: 449380 - protein, 9 aa, Influenza virus
MKNVPEKIR

SEQ ID NO: 449381 - protein, 9 aa, Influenza virus
MKNVPETPK

SEQ ID NO: 449382 - protein, 9 aa, Influenza virus
MKRKRDSSI

SEQ ID NO: 449383 - protein, 9 aa, Influenza virus
MKRKRNSSI

SEQ ID NO: 449384 - protein, 9 aa, Influenza virus
MKSRGYKMN

SEQ ID NO: 449385 - protein, 9 aa, Influenza virus
MKTIIIVLS

SEQ ID NO: 449386 - protein, 9 aa, Influenza virus
MKWGMELRR

SEQ ID NO: 449387 - protein, 9 aa, Influenza virus
MKWGMEMRR

SEQ ID NO: 449388 - protein, 9 aa, Influenza virus
MKWLLSNAD

SEQ ID NO: 449389 - protein, 9 aa, Influenza virus
MKWLLSNND

SEQ ID NO: 449390 - protein, 9 aa, Influenza virus
MKWLLSNSD

SEQ ID NO: 449391 - protein, 9 aa, Influenza virus
MKWLLSNTD

SEQ ID NO: 449392 - protein, 9 aa, Influenza virus
MKWLLSSKA

SEQ ID NO: 449393 - protein, 9 aa, Influenza virus
MKWLLSSKD

SEQ ID NO: 449394 - protein, 9 aa, Influenza virus
MKWLLSSSD

SEQ ID NO: 449395 - protein, 9 aa, Influenza virus
MKWLLSSTD

SEQ ID NO: 449396 - protein, 9 aa, Influenza virus
MKWLSSSGN

SEQ ID NO: 449397 - protein, 9 aa, Influenza virus
MKWLSSSMN

SEQ ID NO: 449398 - protein, 9 aa, Influenza virus
MKWLTLKSG

SEQ ID NO: 449399 - protein, 9 aa, Influenza virus
MKWMMAMKY

SEQ ID NO: 449400 - protein, 9 aa, Influenza virus
MKWMMAMRY

SEQ ID NO: 449401 - protein, 9 aa, Influenza virus
MLADRIDDA

SEQ ID NO: 449402 - protein, 9 aa, Influenza virus
MLADRVDDA

SEQ ID NO: 449403 - protein, 9 aa, Influenza virus
MLADWVDDA

SEQ ID NO: 449404 - protein, 9 aa, Influenza virus
MLATGMKNV

SEQ ID NO: 449405 - protein, 9 aa, Influenza virus
MLATGMRNI

SEQ ID NO: 449406 - protein, 9 aa, Influenza virus
MLATGMRNV

SEQ ID NO: 449407 - protein, 9 aa, Influenza virus
MLERELVRK

SEQ ID NO: 449408 - protein, 9 aa, Influenza virus
MLFVQSYFQ

SEQ ID NO: 449409 - protein, 9 aa, Influenza virus
MLGFVFTLT

SEQ ID NO: 449410 - protein, 9 aa, Influenza virus
MLKIHNAGT

SEQ ID NO: 449411 - protein, 9 aa, Influenza virus
MLKIPNAET

SEQ ID NO: 449412 - protein, 9 aa, Influenza virus
MLKIPNAGI

SEQ ID NO: 449413 - protein, 9 aa, Influenza virus
MLKIPNAGT

SEQ ID NO: 449414 - protein, 9 aa, Influenza virus
MLKMSLLTE

SEQ ID NO: 449415 - protein, 9 aa, Influenza virus
MLKPGETLN

SEQ ID NO: 449416 - protein, 9 aa, Influenza virus
MLKVPNAGT

SEQ ID NO: 449417 - protein, 9 aa, Influenza virus
MLKVPNALI

SEQ ID NO: 449418 - protein, 9 aa, Influenza virus
MLKVPNALT

SEQ ID NO: 449419 - protein, 9 aa, Influenza virus
MLLAIAMGL

SEQ ID NO: 449420 - protein, 9 aa, Influenza virus
MLLDPGDTV

SEQ ID NO: 449421 - protein, 9 aa, Influenza virus
MLNASCAAM

SEQ ID NO: 449422 - protein, 9 aa, Influenza virus
MLNKSLCKI

SEQ ID NO: 449423 - protein, 9 aa, Influenza virus
MLNKSLCKV

SEQ ID NO: 449424 - protein, 9 aa, Influenza virus
MLNLYDRVR

SEQ ID NO: 449425 - protein, 9 aa, Influenza virus
MLNLYERVR

SEQ ID NO: 449426 - protein, 9 aa, Influenza virus
MLNPNDTIT

SEQ ID NO: 449427 - protein, 9 aa, Influenza virus
MLNPNDTVI

SEQ ID NO: 449428 - protein, 9 aa, Influenza virus
MLNPNDTVT

SEQ ID NO: 449429 - protein, 9 aa, Influenza virus
MLQSRTREI

SEQ ID NO: 449430 - protein, 9 aa, Influenza virus
MLRIPNAGI

SEQ ID NO: 449431 - protein, 9 aa, Influenza virus
MLSKSLCKV

SEQ ID NO: 449432 - protein, 9 aa, Influenza virus
MLSLIMRTV

SEQ ID NO: 449433 - protein, 9 aa, Influenza virus
MLSTVLGVS

SEQ ID NO: 449434 - protein, 9 aa, Influenza virus
MLTGNLQTL

SEQ ID NO: 449435 - protein, 9 aa, Influenza virus
MLWACQNGN

SEQ ID NO: 449436 - protein, 9 aa, Influenza virus
MMAMKYPIT

SEQ ID NO: 449437 - protein, 9 aa, Influenza virus
MMAMRYPIT

SEQ ID NO: 449438 - protein, 9 aa, Influenza virus
MMDGWYGFR

SEQ ID NO: 449439 - protein, 9 aa, Influenza virus
MMDQVREGR

SEQ ID NO: 449440 - protein, 9 aa, Influenza virus
MMDQVRESR

SEQ ID NO: 449441 - protein, 9 aa, Influenza virus
MMEAMVSRA

SEQ ID NO: 449442 - protein, 9 aa, Influenza virus
MMGMFNMLS

SEQ ID NO: 449443 - protein, 9 aa, Influenza virus
MMIWHSNLN

SEQ ID NO: 449444 - protein, 9 aa, Influenza virus
MMKAVRGDL

SEQ ID NO: 449445 - protein, 9 aa, Influenza virus
MMMGMFNML

SEQ ID NO: 449446 - protein, 9 aa, Influenza virus
MMSRARIDA

SEQ ID NO: 449447 - protein, 9 aa, Influenza virus
MMTHTSQYI

SEQ ID NO: 449448 - protein, 9 aa, Influenza virus
MMTNSQDTE

SEQ ID NO: 449449 - protein, 9 aa, Influenza virus
MMTSSQDTE

SEQ ID NO: 449450 - protein, 9 aa, Influenza virus
MMWEINGPD

SEQ ID NO: 449451 - protein, 9 aa, Influenza virus
MMWEINGPE

SEQ ID NO: 449452 - protein, 9 aa, Influenza virus
MMWEVNGPE

SEQ ID NO: 449453 - protein, 9 aa, Influenza virus
MNELGIPFH

SEQ ID NO: 449454 - protein, 9 aa, Influenza virus
MNELGVPFH

SEQ ID NO: 449455 - protein, 9 aa, Influenza virus
MNELGVPFN

SEQ ID NO: 449456 - protein, 9 aa, Influenza virus
MNELGVPFY

SEQ ID NO: 449457 - protein, 9 aa, Influenza virus
MNELGVPLH

SEQ ID NO: 449458 - protein, 9 aa, Influenza virus
MNELGVSFH

SEQ ID NO: 449459 - protein, 9 aa, Influenza virus
MNGNYDSIR

SEQ ID NO: 449460 - protein, 9 aa, Influenza virus
MNGQSGRID

SEQ ID NO: 449461 - protein, 9 aa, Influenza virus
MNIQFTAVG

SEQ ID NO: 449462 - protein, 9 aa, Influenza virus
MNIQFTSVG

SEQ ID NO: 449463 - protein, 9 aa, Influenza virus
MNKLFERIR

SEQ ID NO: 449464 - protein, 9 aa, Influenza virus
MNKLFERVK

SEQ ID NO: 449465 - protein, 9 aa, Influenza virus
MNKLFERVR

SEQ ID NO: 449466 - protein, 9 aa, Influenza virus
MNKLYEKVR

SEQ ID NO: 449467 - protein, 9 aa, Influenza virus
MNKLYERVK

SEQ ID NO: 449468 - protein, 9 aa, Influenza virus
MNKLYERVR

SEQ ID NO: 449469 - protein, 9 aa, Influenza virus
MNKRMEDGF

SEQ ID NO: 449470 - protein, 9 aa, Influenza virus
MNLLIGISN

SEQ ID NO: 449471 - protein, 9 aa, Influenza virus
MNNEGSYFF

SEQ ID NO: 449472 - protein, 9 aa, Influenza virus
MNNETILET

SEQ ID NO: 449473 - protein, 9 aa, Influenza virus
MNNQVFPQL

SEQ ID NO: 449474 - protein, 9 aa, Influenza virus
MNPIKKIIT

SEQ ID NO: 449475 - protein, 9 aa, Influenza virus
MNPKSKLFT

SEQ ID NO: 449476 - protein, 9 aa, Influenza virus
MNPNKKIIT

SEQ ID NO: 449477 - protein, 9 aa, Influenza virus
MNPNQKIIA

SEQ ID NO: 449478 - protein, 9 aa, Influenza virus
MNPNQKIIC

SEQ ID NO: 449479 - protein, 9 aa, Influenza virus
MNPNQKIIT

SEQ ID NO: 449480 - protein, 9 aa, Influenza virus
MNPNQKILC

SEQ ID NO: 449481 - protein, 9 aa, Influenza virus
MNPNQKILF

SEQ ID NO: 449482 - protein, 9 aa, Influenza virus
MNPNQKIMC

SEQ ID NO: 449483 - protein, 9 aa, Influenza virus
MNPNQKIQC

SEQ ID NO: 449484 - protein, 9 aa, Influenza virus
MNPNQKITC

SEQ ID NO: 449485 - protein, 9 aa, Influenza virus
MNPNQKIVT

SEQ ID NO: 449486 - protein, 9 aa, Influenza virus
MNPNQKLFA

SEQ ID NO: 449487 - protein, 9 aa, Influenza virus
MNPNQKLFT

SEQ ID NO: 449488 - protein, 9 aa, Influenza virus
MNPNQKTIT

SEQ ID NO: 449489 - protein, 9 aa, Influenza virus
MNPNQRIIT

SEQ ID NO: 449490 - protein, 9 aa, Influenza virus
MNPNQSIIT

SEQ ID NO: 449491 - protein, 9 aa, Influenza virus
MNPSQKLFA

SEQ ID NO: 449492 - protein, 9 aa, Influenza virus
MNREFEVMN

SEQ ID NO: 449493 - protein, 9 aa, Influenza virus
MNREFEVVD

SEQ ID NO: 449494 - protein, 9 aa, Influenza virus
MNREFEVVN

SEQ ID NO: 449495 - protein, 9 aa, Influenza virus
MNREFGVVN

SEQ ID NO: 449496 - protein, 9 aa, Influenza virus
MNRLFERVR

SEQ ID NO: 449497 - protein, 9 aa, Influenza virus
MNSVKNGTY

SEQ ID NO: 449498 - protein, 9 aa, Influenza virus
MNSVKTGTY

SEQ ID NO: 449499 - protein, 9 aa, Influenza virus
MNSVRNGTY

SEQ ID NO: 449500 - protein, 9 aa, Influenza virus
MNTALLNAS

SEQ ID NO: 449501 - protein, 9 aa, Influenza virus
MNTQFEAIG

SEQ ID NO: 449502 - protein, 9 aa, Influenza virus
MNTQFEAVG

SEQ ID NO: 449503 - protein, 9 aa, Influenza virus
MNTQFTAVG

SEQ ID NO: 449504 - protein, 9 aa, Influenza virus
MNTQFTSVG

SEQ ID NO: 449505 - protein, 9 aa, Influenza virus
MNTQFTVVG

SEQ ID NO: 449506 - protein, 9 aa, Influenza virus
MNTQIIVIL

SEQ ID NO: 449507 - protein, 9 aa, Influenza virus
MNTRFEAVG

SEQ ID NO: 449508 - protein, 9 aa, Influenza virus
MNTSKPFQN

SEQ ID NO: 449509 - protein, 9 aa, Influenza virus
MNTSKPLQN

SEQ ID NO: 449510 - protein, 9 aa, Influenza virus
MNVKSLKLA

SEQ ID NO: 449511 - protein, 9 aa, Influenza virus
MNWSGYSGS

SEQ ID NO: 449512 - protein, 9 aa, Influenza virus
MPASRYLTD

SEQ ID NO: 449513 - protein, 9 aa, Influenza virus
MPESMREEY

SEQ ID NO: 449514 - protein, 9 aa, Influenza virus
MPFHNIHPL

SEQ ID NO: 449515 - protein, 9 aa, Influenza virus
MPFHNVHPF

SEQ ID NO: 449516 - protein, 9 aa, Influenza virus
MPFHNVHPL

SEQ ID NO: 449517 - protein, 9 aa, Influenza virus
MPLHNIHPL

SEQ ID NO: 449518 - protein, 9 aa, Influenza virus
MPTDVVRSW

SEQ ID NO: 449519 - protein, 9 aa, Influenza virus
MQALQLLFE

SEQ ID NO: 449520 - protein, 9 aa, Influenza virus
MQALQLLLE

SEQ ID NO: 449521 - protein, 9 aa, Influenza virus
MQCRICIGS

SEQ ID NO: 449522 - protein, 9 aa, Influenza virus
MQFSSLAVN

SEQ ID NO: 449523 - protein, 9 aa, Influenza virus
MQFSSLTVN

SEQ ID NO: 449524 - protein, 9 aa, Influenza virus
MQFSSLTVS

SEQ ID NO: 449525 - protein, 9 aa, Influenza virus
MQGSTLPRR

SEQ ID NO: 449526 - protein, 9 aa, Influenza virus
MQIRGFVHF

SEQ ID NO: 449527 - protein, 9 aa, Influenza virus
MQIRGFVYF

SEQ ID NO: 449528 - protein, 9 aa, Influenza virus
MQLKDNAKE

SEQ ID NO: 449529 - protein, 9 aa, Influenza virus
MQLRDNAKE

SEQ ID NO: 449530 - protein, 9 aa, Influenza virus
MQLRDNVKE

SEQ ID NO: 449531 - protein, 9 aa, Influenza virus
MQNGSCRCM

SEQ ID NO: 449532 - protein, 9 aa, Influenza virus
MQNGSYRCM

SEQ ID NO: 449533 - protein, 9 aa, Influenza virus
MQNKLNNVI

SEQ ID NO: 449534 - protein, 9 aa, Influenza virus
MQNRIQIDP

SEQ ID NO: 449535 - protein, 9 aa, Influenza virus
MQNRLNNVI

SEQ ID NO: 449536 - protein, 9 aa, Influenza virus
MQRFRRPDS

SEQ ID NO: 449537 - protein, 9 aa, Influenza virus
MRCTISLVK

SEQ ID NO: 449538 - protein, 9 aa, Influenza virus
MRDILGTFD

SEQ ID NO: 449539 - protein, 9 aa, Influenza virus
MRDVIGTFD

SEQ ID NO: 449540 - protein, 9 aa, Influenza virus
MRDVLGTFD

SEQ ID NO: 449541 - protein, 9 aa, Influenza virus
MREPFISCS

SEQ ID NO: 449542 - protein, 9 aa, Influenza virus
MRFTYSGIR

SEQ ID NO: 449543 - protein, 9 aa, Influenza virus
MRILIRGNS

SEQ ID NO: 449544 - protein, 9 aa, Influenza virus
MRILVRGNS

SEQ ID NO: 449545 - protein, 9 aa, Influenza virus
MRINNETIL

SEQ ID NO: 449546 - protein, 9 aa, Influenza virus
MRISNETIL

SEQ ID NO: 449547 - protein, 9 aa, Influenza virus
MRIWRQANN

SEQ ID NO: 449548 - protein, 9 aa, Influenza virus
MRKKRGLFG

SEQ ID NO: 449549 - protein, 9 aa, Influenza virus
MRNIPEKPK

SEQ ID NO: 449550 - protein, 9 aa, Influenza virus
MRNIPEKQT

SEQ ID NO: 449551 - protein, 9 aa, Influenza virus
MRNIPENPK

SEQ ID NO: 449552 - protein, 9 aa, Influenza virus
MRNIPERQT

SEQ ID NO: 449553 - protein, 9 aa, Influenza virus
MRNIPGKQA

SEQ ID NO: 449554 - protein, 9 aa, Influenza virus
MRNVPEKPK

SEQ ID NO: 449555 - protein, 9 aa, Influenza virus
MRNVPEKQT

SEQ ID NO: 449556 - protein, 9 aa, Influenza virus
MRNVPENPK

SEQ ID NO: 449557 - protein, 9 aa, Influenza virus
MRNVPERQT

SEQ ID NO: 449558 - protein, 9 aa, Influenza virus
MRNVPETQT

SEQ ID NO: 449559 - protein, 9 aa, Influenza virus
MRPCFWVEL

SEQ ID NO: 449560 - protein, 9 aa, Influenza virus
MRRCLLQSL

SEQ ID NO: 449561 - protein, 9 aa, Influenza virus
MRTFSFQLI

SEQ ID NO: 449562 - protein, 9 aa, Influenza virus
MRTPIAFLT

SEQ ID NO: 449563 - protein, 9 aa, Influenza virus
MRTQESECA

SEQ ID NO: 449564 - protein, 9 aa, Influenza virus
MRTQESECV

SEQ ID NO: 449565 - protein, 9 aa, Influenza virus
MRTQESSCT

SEQ ID NO: 449566 - protein, 9 aa, Influenza virus
MRWLTLKLG

SEQ ID NO: 449567 - protein, 9 aa, Influenza virus
MRWLTLKSE

SEQ ID NO: 449568 - protein, 9 aa, Influenza virus
MRWLTLKSG

SEQ ID NO: 449569 - protein, 9 aa, Influenza virus
MSCFVFVAL

SEQ ID NO: 449570 - protein, 9 aa, Influenza virus
MSCHIGVAP

SEQ ID NO: 449571 - protein, 9 aa, Influenza virus
MSCPIGEAP

SEQ ID NO: 449572 - protein, 9 aa, Influenza virus
MSCPIGEVP

SEQ ID NO: 449573 - protein, 9 aa, Influenza virus
MSCPIGVAP

SEQ ID NO: 449574 - protein, 9 aa, Influenza virus
MSCPLGEAP

SEQ ID NO: 449575 - protein, 9 aa, Influenza virus
MSCPMGVAP

SEQ ID NO: 449576 - protein, 9 aa, Influenza virus
MSCPVGEAP

SEQ ID NO: 449577 - protein, 9 aa, Influenza virus
MSCPVGVAP

SEQ ID NO: 449578 - protein, 9 aa, Influenza virus
MSDIEAMAS

SEQ ID NO: 449579 - protein, 9 aa, Influenza virus
MSDIEAMAT

SEQ ID NO: 449580 - protein, 9 aa, Influenza virus
MSDIGAMAS

SEQ ID NO: 449581 - protein, 9 aa, Influenza virus
MSDINIMAS

SEQ ID NO: 449582 - protein, 9 aa, Influenza virus
MSDSIKSWR

SEQ ID NO: 449583 - protein, 9 aa, Influenza virus
MSELGVPFH

SEQ ID NO: 449584 - protein, 9 aa, Influenza virus
MSELGVPFN

SEQ ID NO: 449585 - protein, 9 aa, Influenza virus
MSFQGRGVF

SEQ ID NO: 449586 - protein, 9 aa, Influenza virus
MSGPNDNAS

SEQ ID NO: 449587 - protein, 9 aa, Influenza virus
MSGPNNNAS

SEQ ID NO: 449588 - protein, 9 aa, Influenza virus
MSGYSGIFS

SEQ ID NO: 449589 - protein, 9 aa, Influenza virus
MSICISGPN

SEQ ID NO: 449590 - protein, 9 aa, Influenza virus
MSICMSGPN

SEQ ID NO: 449591 - protein, 9 aa, Influenza virus
MSICVSGPN

SEQ ID NO: 449592 - protein, 9 aa, Influenza virus
MSIGITVIK

SEQ ID NO: 449593 - protein, 9 aa, Influenza virus
MSIGVTVIK

SEQ ID NO: 449594 - protein, 9 aa, Influenza virus
MSIGVTVIR

SEQ ID NO: 449595 - protein, 9 aa, Influenza virus
MSKEGSYFF

SEQ ID NO: 449596 - protein, 9 aa, Influenza virus
MSKKKSYIN

SEQ ID NO: 449597 - protein, 9 aa, Influenza virus
MSKLYERVK

SEQ ID NO: 449598 - protein, 9 aa, Influenza virus
MSKLYERVR

SEQ ID NO: 449599 - protein, 9 aa, Influenza virus
MSKRKSYIN

SEQ ID NO: 449600 - protein, 9 aa, Influenza virus
MSLLTEVET

SEQ ID NO: 449601 - protein, 9 aa, Influenza virus
MSLNISLYS

SEQ ID NO: 449602 - protein, 9 aa, Influenza virus
MSNEGSYFF

SEQ ID NO: 449603 - protein, 9 aa, Influenza virus
MSNNSTEKV

SEQ ID NO: 449604 - protein, 9 aa, Influenza virus
MSQSRTREI

SEQ ID NO: 449605 - protein, 9 aa, Influenza virus
MSQSRTRGI

SEQ ID NO: 449606 - protein, 9 aa, Influenza virus
MSRARIDAR

SEQ ID NO: 449607 - protein, 9 aa, Influenza virus
MSSVKNGTY

SEQ ID NO: 449608 - protein, 9 aa, Influenza virus
MSTNAYDRI

SEQ ID NO: 449609 - protein, 9 aa, Influenza virus
MSTPLGTPP

SEQ ID NO: 449610 - protein, 9 aa, Influenza virus
MSVCISGPN

SEQ ID NO: 449611 - protein, 9 aa, Influenza virus
MSVCMSGPN

SEQ ID NO: 449612 - protein, 9 aa, Influenza virus
MSVLLGSSP

SEQ ID NO: 449613 - protein, 9 aa, Influenza virus
MSVPLGSSP

SEQ ID NO: 449614 - protein, 9 aa, Influenza virus
MSVPLGSSS

SEQ ID NO: 449615 - protein, 9 aa, Influenza virus
MTDGNASGK

SEQ ID NO: 449616 - protein, 9 aa, Influenza virus
MTDGPANKQ

SEQ ID NO: 449617 - protein, 9 aa, Influenza virus
MTDGPANNQ

SEQ ID NO: 449618 - protein, 9 aa, Influenza virus
MTDGPANRQ

SEQ ID NO: 449619 - protein, 9 aa, Influenza virus
MTDGPANSQ

SEQ ID NO: 449620 - protein, 9 aa, Influenza virus
MTDGPASNQ

SEQ ID NO: 449621 - protein, 9 aa, Influenza virus
MTDGPASSQ

SEQ ID NO: 449622 - protein, 9 aa, Influenza virus
MTDGPSDAQ

SEQ ID NO: 449623 - protein, 9 aa, Influenza virus
MTDGSANSQ

SEQ ID NO: 449624 - protein, 9 aa, Influenza virus
MTDGSASGK

SEQ ID NO: 449625 - protein, 9 aa, Influenza virus
MTDGSASGQ

SEQ ID NO: 449626 - protein, 9 aa, Influenza virus
MTDGSASGR

SEQ ID NO: 449627 - protein, 9 aa, Influenza virus
MTDGSASRK

SEQ ID NO: 449628 - protein, 9 aa, Influenza virus
MTDGSASSQ

SEQ ID NO: 449629 - protein, 9 aa, Influenza virus
MTDGSASSR

SEQ ID NO: 449630 - protein, 9 aa, Influenza virus
MTDSEMLNL

SEQ ID NO: 449631 - protein, 9 aa, Influenza virus
MTDSEMNKL

SEQ ID NO: 449632 - protein, 9 aa, Influenza virus
MTDSIKSWR

SEQ ID NO: 449633 - protein, 9 aa, Influenza virus
MTEIWSYNA

SEQ ID NO: 449634 - protein, 9 aa, Influenza virus
MTEVWSYNA

SEQ ID NO: 449635 - protein, 9 aa, Influenza virus
MTFHGAKEV

SEQ ID NO: 449636 - protein, 9 aa, Influenza virus
MTHISKYLC

SEQ ID NO: 449637 - protein, 9 aa, Influenza virus
MTHMSKYLC

SEQ ID NO: 449638 - protein, 9 aa, Influenza virus
MTHSSKYLC

SEQ ID NO: 449639 - protein, 9 aa, Influenza virus
MTHTSKYLC

SEQ ID NO: 449640 - protein, 9 aa, Influenza virus
MTHTSQYIC

SEQ ID NO: 449641 - protein, 9 aa, Influenza virus
MTHTSRYLC

SEQ ID NO: 449642 - protein, 9 aa, Influenza virus
MTIASDILK

SEQ ID NO: 449643 - protein, 9 aa, Influenza virus
MTIASDILT

SEQ ID NO: 449644 - protein, 9 aa, Influenza virus
MTICIQGNN

SEQ ID NO: 449645 - protein, 9 aa, Influenza virus
MTICVQGDN

SEQ ID NO: 449646 - protein, 9 aa, Influenza virus
MTICVQGNN

SEQ ID NO: 449647 - protein, 9 aa, Influenza virus
MTKDAERGK

SEQ ID NO: 449648 - protein, 9 aa, Influenza virus
MTLDFHDSN

SEQ ID NO: 449649 - protein, 9 aa, Influenza virus
MTLSVVSLL

SEQ ID NO: 449650 - protein, 9 aa, Influenza virus
MTNVQNNYT

SEQ ID NO: 449651 - protein, 9 aa, Influenza virus
MTRGLFGAI

SEQ ID NO: 449652 - protein, 9 aa, Influenza virus
MTSIRNNTY

SEQ ID NO: 449653 - protein, 9 aa, Influenza virus
MVAYMLERE

SEQ ID NO: 449654 - protein, 9 aa, Influenza virus
MVDGWYGFH

SEQ ID NO: 449655 - protein, 9 aa, Influenza virus
MVDGWYGFR

SEQ ID NO: 449656 - protein, 9 aa, Influenza virus
MVDGWYGYH

SEQ ID NO: 449657 - protein, 9 aa, Influenza virus
MVDQVRESR

SEQ ID NO: 449658 - protein, 9 aa, Influenza virus
MVDTILERN

SEQ ID NO: 449659 - protein, 9 aa, Influenza virus
MVEAESSVK

SEQ ID NO: 449660 - protein, 9 aa, Influenza virus
MVEAMISRA

SEQ ID NO: 449661 - protein, 9 aa, Influenza virus
MVEAMMSRA

SEQ ID NO: 449662 - protein, 9 aa, Influenza virus
MVEAMVSRA

SEQ ID NO: 449663 - protein, 9 aa, Influenza virus
MVFSQEDCM

SEQ ID NO: 449664 - protein, 9 aa, Influenza virus
MVFSQEDCV

SEQ ID NO: 449665 - protein, 9 aa, Influenza virus
MVFSQEECM

SEQ ID NO: 449666 - protein, 9 aa, Influenza virus
MVGLILAFI

SEQ ID NO: 449667 - protein, 9 aa, Influenza virus
MVHAMRTIG

SEQ ID NO: 449668 - protein, 9 aa, Influenza virus
MVIASTTAK

SEQ ID NO: 449669 - protein, 9 aa, Influenza virus
MVKAVRGDL

SEQ ID NO: 449670 - protein, 9 aa, Influenza virus
MVKRGINDR

SEQ ID NO: 449671 - protein, 9 aa, Influenza virus
MVKSDKICL

SEQ ID NO: 449672 - protein, 9 aa, Influenza virus
MVLASTTAK

SEQ ID NO: 449673 - protein, 9 aa, Influenza virus
MVLSAFDER

SEQ ID NO: 449674 - protein, 9 aa, Influenza virus
MVNERTLDF

SEQ ID NO: 449675 - protein, 9 aa, Influenza virus
MVNGWYGFR

SEQ ID NO: 449676 - protein, 9 aa, Influenza virus
MVQAMRAIG

SEQ ID NO: 449677 - protein, 9 aa, Influenza virus
MVQAMRAVG

SEQ ID NO: 449678 - protein, 9 aa, Influenza virus
MVQAMRTIG

SEQ ID NO: 449679 - protein, 9 aa, Influenza virus
MVQAMRTVG

SEQ ID NO: 449680 - protein, 9 aa, Influenza virus
MVRSDKICL

SEQ ID NO: 449681 - protein, 9 aa, Influenza virus
MVSPLAITW

SEQ ID NO: 449682 - protein, 9 aa, Influenza virus
MVSPLAVTW

SEQ ID NO: 449683 - protein, 9 aa, Influenza virus
MVSRARIDA

SEQ ID NO: 449684 - protein, 9 aa, Influenza virus
MVTFCGLDN

SEQ ID NO: 449685 - protein, 9 aa, Influenza virus
MVTGLRNIP

SEQ ID NO: 449686 - protein, 9 aa, Influenza virus
MVTQRTIGK

SEQ ID NO: 449687 - protein, 9 aa, Influenza virus
MVTQRTMGK

SEQ ID NO: 449688 - protein, 9 aa, Influenza virus
MVTQRTVGK

SEQ ID NO: 449689 - protein, 9 aa, Influenza virus
MVVYAELLV

SEQ ID NO: 449690 - protein, 9 aa, Influenza virus
MVWDANGWV

SEQ ID NO: 449691 - protein, 9 aa, Influenza virus
MVWDPNGWT

SEQ ID NO: 449692 - protein, 9 aa, Influenza virus
MWACNSGNC

SEQ ID NO: 449693 - protein, 9 aa, Influenza virus
MWACQKGNI

SEQ ID NO: 449694 - protein, 9 aa, Influenza virus
MWACQRGNI

SEQ ID NO: 449695 - protein, 9 aa, Influenza virus
MWACSNGNC

SEQ ID NO: 449696 - protein, 9 aa, Influenza virus
MWACSNGSC

SEQ ID NO: 449697 - protein, 9 aa, Influenza virus
MWACSSGNC

SEQ ID NO: 449698 - protein, 9 aa, Influenza virus
MWAIHHPPT

SEQ ID NO: 449699 - protein, 9 aa, Influenza virus
MWALGENMA

SEQ ID NO: 449700 - protein, 9 aa, Influenza virus
MWDTLIERD

SEQ ID NO: 449701 - protein, 9 aa, Influenza virus
MWEINGPDS

SEQ ID NO: 449702 - protein, 9 aa, Influenza virus
MWEINGPES

SEQ ID NO: 449703 - protein, 9 aa, Influenza virus
MWEVNGPES

SEQ ID NO: 449704 - protein, 9 aa, Influenza virus
MWGIHHPSS

SEQ ID NO: 449705 - protein, 9 aa, Influenza virus
MWSYNAELL

SEQ ID NO: 449706 - protein, 9 aa, Influenza virus
MWTCNSGNC

SEQ ID NO: 449707 - protein, 9 aa, Influenza virus
MWTCQKGNI

SEQ ID NO: 449708 - protein, 9 aa, Influenza virus
MYALHQGTT

SEQ ID NO: 449709 - protein, 9 aa, Influenza virus
MYQKCCNLF

SEQ ID NO: 449710 - protein, 9 aa, Influenza virus
MYQKCCSLF

SEQ ID NO: 449711 - protein, 9 aa, Influenza virus
MYQKCCTLF

SEQ ID NO: 449712 - protein, 9 aa, Influenza virus
MYQRCCNLF

SEQ ID NO: 449713 - protein, 9 aa, Influenza virus
MYSDFHFID

SEQ ID NO: 449714 - protein, 9 aa, Influenza virus
MYSDFHFIN

SEQ ID NO: 449715 - protein, 9 aa, Influenza virus
NAASYKRIR

SEQ ID NO: 449716 - protein, 9 aa, Influenza virus
NADHRIYWI

SEQ ID NO: 449717 - protein, 9 aa, Influenza virus
NADHRVYWI

SEQ ID NO: 449718 - protein, 9 aa, Influenza virus
NADKICLGH

SEQ ID NO: 449719 - protein, 9 aa, Influenza virus
NADLEALME

SEQ ID NO: 449720 - protein, 9 aa, Influenza virus
NADLLVAME

SEQ ID NO: 449721 - protein, 9 aa, Influenza virus
NADVLVALE

SEQ ID NO: 449722 - protein, 9 aa, Influenza virus
NAEDIGNGC

SEQ ID NO: 449723 - protein, 9 aa, Influenza virus
NAEDKGNGC

SEQ ID NO: 449724 - protein, 9 aa, Influenza virus
NAEDMGDGC

SEQ ID NO: 449725 - protein, 9 aa, Influenza virus
NAEDMGGGC

SEQ ID NO: 449726 - protein, 9 aa, Influenza virus
NAEDMGNGC

SEQ ID NO: 449727 - protein, 9 aa, Influenza virus
NAEDQGNGC

SEQ ID NO: 449728 - protein, 9 aa, Influenza virus
NAEDRGNGC

SEQ ID NO: 449729 - protein, 9 aa, Influenza virus
NAEEDCTGC

SEQ ID NO: 449730 - protein, 9 aa, Influenza virus
NAEEDGKGC

SEQ ID NO: 449731 - protein, 9 aa, Influenza virus
NAEEDGNGC

SEQ ID NO: 449732 - protein, 9 aa, Influenza virus
NAEEDGRGC

SEQ ID NO: 449733 - protein, 9 aa, Influenza virus
NAEEDGTGC

SEQ ID NO: 449734 - protein, 9 aa, Influenza virus
NAEEMGNGC

SEQ ID NO: 449735 - protein, 9 aa, Influenza virus
NAEEYRRLR

SEQ ID NO: 449736 - protein, 9 aa, Influenza virus
NAEFLVALE

SEQ ID NO: 449737 - protein, 9 aa, Influenza virus
NAEFLVAME

SEQ ID NO: 449738 - protein, 9 aa, Influenza virus
NAEFLVAVE

SEQ ID NO: 449739 - protein, 9 aa, Influenza virus
NAEGIGIAA

SEQ ID NO: 449740 - protein, 9 aa, Influenza virus
NAEGTGIAA

SEQ ID NO: 449741 - protein, 9 aa, Influenza virus
NAEGTGMAA

SEQ ID NO: 449742 - protein, 9 aa, Influenza virus
NAEGTGTAA

SEQ ID NO: 449743 - protein, 9 aa, Influenza virus
NAEIEDLIF

SEQ ID NO: 449744 - protein, 9 aa, Influenza virus
NAEIEDLTF

SEQ ID NO: 449745 - protein, 9 aa, Influenza virus
NAEILVALE

SEQ ID NO: 449746 - protein, 9 aa, Influenza virus
NAEILVLME

SEQ ID NO: 449747 - protein, 9 aa, Influenza virus
NAELFVLME

SEQ ID NO: 449748 - protein, 9 aa, Influenza virus
NAELIVLLE

SEQ ID NO: 449749 - protein, 9 aa, Influenza virus
NAELLIAME

SEQ ID NO: 449750 - protein, 9 aa, Influenza virus
NAELLILLE

SEQ ID NO: 449751 - protein, 9 aa, Influenza virus
NAELLVALE

SEQ ID NO: 449752 - protein, 9 aa, Influenza virus
NAELLVAME

SEQ ID NO: 449753 - protein, 9 aa, Influenza virus
NAELLVLIE

SEQ ID NO: 449754 - protein, 9 aa, Influenza virus
NAELLVLLE

SEQ ID NO: 449755 - protein, 9 aa, Influenza virus
NAELLVLLG

SEQ ID NO: 449756 - protein, 9 aa, Influenza virus
NAELLVLME

SEQ ID NO: 449757 - protein, 9 aa, Influenza virus
NAEVLVLME

SEQ ID NO: 449758 - protein, 9 aa, Influenza virus
NAFRGLIST

SEQ ID NO: 449759 - protein, 9 aa, Influenza virus
NAGKDPKKT

SEQ ID NO: 449760 - protein, 9 aa, Influenza virus
NAGLLVALE

SEQ ID NO: 449761 - protein, 9 aa, Influenza virus
NAHDRICIG

SEQ ID NO: 449762 - protein, 9 aa, Influenza virus
NAHILVTRE

SEQ ID NO: 449763 - protein, 9 aa, Influenza virus
NAIDAGDGC

SEQ ID NO: 449764 - protein, 9 aa, Influenza virus
NAIDAGNGC

SEQ ID NO: 449765 - protein, 9 aa, Influenza virus
NAIDEGDGC

SEQ ID NO: 449766 - protein, 9 aa, Influenza virus
NAIDEGNGC

SEQ ID NO: 449767 - protein, 9 aa, Influenza virus
NAIDNGDGC

SEQ ID NO: 449768 - protein, 9 aa, Influenza virus
NAIDTGDGC

SEQ ID NO: 449769 - protein, 9 aa, Influenza virus
NAIDTGKGC

SEQ ID NO: 449770 - protein, 9 aa, Influenza virus
NAIDTGNGC

SEQ ID NO: 449771 - protein, 9 aa, Influenza virus
NAIGDCPKY

SEQ ID NO: 449772 - protein, 9 aa, Influenza virus
NAINEGNGC

SEQ ID NO: 449773 - protein, 9 aa, Influenza virus
NAIRFGEGE

SEQ ID NO: 449774 - protein, 9 aa, Influenza virus
NAIRFGESE

SEQ ID NO: 449775 - protein, 9 aa, Influenza virus
NAIRIGEDA

SEQ ID NO: 449776 - protein, 9 aa, Influenza virus
NAIRIGEDS

SEQ ID NO: 449777 - protein, 9 aa, Influenza virus
NAIRIGEEA

SEQ ID NO: 449778 - protein, 9 aa, Influenza virus
NAIRIGEGA

SEQ ID NO: 449779 - protein, 9 aa, Influenza virus
NAIRIGENA

SEQ ID NO: 449780 - protein, 9 aa, Influenza virus
NAIRIGENS

SEQ ID NO: 449781 - protein, 9 aa, Influenza virus
NAIRIGGNS

SEQ ID NO: 449782 - protein, 9 aa, Influenza virus
NAIRLGENK

SEQ ID NO: 449783 - protein, 9 aa, Influenza virus
NAIRPGENK

SEQ ID NO: 449784 - protein, 9 aa, Influenza virus
NAISTTFPY

SEQ ID NO: 449785 - protein, 9 aa, Influenza virus
NAITRSGQN

SEQ ID NO: 449786 - protein, 9 aa, Influenza virus
NAKDEGNGC

SEQ ID NO: 449787 - protein, 9 aa, Influenza virus
NAKDLGNGC

SEQ ID NO: 449788 - protein, 9 aa, Influenza virus
NAKEIGNGC

SEQ ID NO: 449789 - protein, 9 aa, Influenza virus
NAKELGNGC

SEQ ID NO: 449790 - protein, 9 aa, Influenza virus
NAKEMGNGC

SEQ ID NO: 449791 - protein, 9 aa, Influenza virus
NAKETGNGC

SEQ ID NO: 449792 - protein, 9 aa, Influenza virus
NAKEVGNGC

SEQ ID NO: 449793 - protein, 9 aa, Influenza virus
NAKLLVLIE

SEQ ID NO: 449794 - protein, 9 aa, Influenza virus
NAKLLVLLE

SEQ ID NO: 449795 - protein, 9 aa, Influenza virus
NALDTGDGC

SEQ ID NO: 449796 - protein, 9 aa, Influenza virus
NALGDCPKY

SEQ ID NO: 449797 - protein, 9 aa, Influenza virus
NALGECPKY

SEQ ID NO: 449798 - protein, 9 aa, Influenza virus
NALGNCPKY

SEQ ID NO: 449799 - protein, 9 aa, Influenza virus
NALIDDRSK

SEQ ID NO: 449800 - protein, 9 aa, Influenza virus
NALLKHRFE

SEQ ID NO: 449801 - protein, 9 aa, Influenza virus
NALNGNGDP

SEQ ID NO: 449802 - protein, 9 aa, Influenza virus
NALRLAENK

SEQ ID NO: 449803 - protein, 9 aa, Influenza virus
NALSGNGDP

SEQ ID NO: 449804 - protein, 9 aa, Influenza virus
NALSIAPIM

SEQ ID NO: 449805 - protein, 9 aa, Influenza virus
NALTDDKSK

SEQ ID NO: 449806 - protein, 9 aa, Influenza virus
NALTDDRSK

SEQ ID NO: 449807 - protein, 9 aa, Influenza virus
NALTDNRSK

SEQ ID NO: 449808 - protein, 9 aa, Influenza virus
NALTGGQSF

SEQ ID NO: 449809 - protein, 9 aa, Influenza virus
NALTNDRSK

SEQ ID NO: 449810 - protein, 9 aa, Influenza virus
NALYGTQSL

SEQ ID NO: 449811 - protein, 9 aa, Influenza virus
NAMDAGNGC

SEQ ID NO: 449812 - protein, 9 aa, Influenza virus
NANDLGNGC

SEQ ID NO: 449813 - protein, 9 aa, Influenza virus
NANTLSSVN

SEQ ID NO: 449814 - protein, 9 aa, Influenza virus
NANTLSSVT

SEQ ID NO: 449815 - protein, 9 aa, Influenza virus
NANTLTSVT

SEQ ID NO: 449816 - protein, 9 aa, Influenza virus
NAPHKLCFP

SEQ ID NO: 449817 - protein, 9 aa, Influenza virus
NAPHKLCYP

SEQ ID NO: 449818 - protein, 9 aa, Influenza virus
NAPNKFCYP

SEQ ID NO: 449819 - protein, 9 aa, Influenza virus
NAPNKLCFP

SEQ ID NO: 449820 - protein, 9 aa, Influenza virus
NAPNKLCYP

SEQ ID NO: 449821 - protein, 9 aa, Influenza virus
NAPSGIEYN

SEQ ID NO: 449822 - protein, 9 aa, Influenza virus
NAPSGVEYN

SEQ ID NO: 449823 - protein, 9 aa, Influenza virus
NAQAFYKIL

SEQ ID NO: 449824 - protein, 9 aa, Influenza virus
NAQGEGIAA

SEQ ID NO: 449825 - protein, 9 aa, Influenza virus
NAQGEGTAA

SEQ ID NO: 449826 - protein, 9 aa, Influenza virus
NAQGIGQAA

SEQ ID NO: 449827 - protein, 9 aa, Influenza virus
NAQGQGTAA

SEQ ID NO: 449828 - protein, 9 aa, Influenza virus
NAQGSGYAA

SEQ ID NO: 449829 - protein, 9 aa, Influenza virus
NAQGTGLAA

SEQ ID NO: 449830 - protein, 9 aa, Influenza virus
NAQGTGQAA

SEQ ID NO: 449831 - protein, 9 aa, Influenza virus
NAQHIEECS

SEQ ID NO: 449832 - protein, 9 aa, Influenza virus
NAQHVEECS

SEQ ID NO: 449833 - protein, 9 aa, Influenza virus
NAQLLVLLE

SEQ ID NO: 449834 - protein, 9 aa, Influenza virus
NAQLLVWLE

SEQ ID NO: 449835 - protein, 9 aa, Influenza virus
NARELGNGC

SEQ ID NO: 449836 - protein, 9 aa, Influenza virus
NARLLVLLE

SEQ ID NO: 449837 - protein, 9 aa, Influenza virus
NASAIVWYN

SEQ ID NO: 449838 - protein, 9 aa, Influenza virus
NASAVIWYK

SEQ ID NO: 449839 - protein, 9 aa, Influenza virus
NASAVIWYN

SEQ ID NO: 449840 - protein, 9 aa, Influenza virus
NASAVVWYN

SEQ ID NO: 449841 - protein, 9 aa, Influenza virus
NASCAAMDD

SEQ ID NO: 449842 - protein, 9 aa, Influenza virus
NASCAAMDE

SEQ ID NO: 449843 - protein, 9 aa, Influenza virus
NASCAAMED

SEQ ID NO: 449844 - protein, 9 aa, Influenza virus
NASPVIWYN

SEQ ID NO: 449845 - protein, 9 aa, Influenza virus
NASRHHMGE

SEQ ID NO: 449846 - protein, 9 aa, Influenza virus
NASRHYMGE

SEQ ID NO: 449847 - protein, 9 aa, Influenza virus
NASRYYMGE

SEQ ID NO: 449848 - protein, 9 aa, Influenza virus
NASTGAQSF

SEQ ID NO: 449849 - protein, 9 aa, Influenza virus
NASTGGQAF

SEQ ID NO: 449850 - protein, 9 aa, Influenza virus
NASTGGQSF

SEQ ID NO: 449851 - protein, 9 aa, Influenza virus
NASWFNSFL

SEQ ID NO: 449852 - protein, 9 aa, Influenza virus
NATASFIYD

SEQ ID NO: 449853 - protein, 9 aa, Influenza virus
NATASFIYE

SEQ ID NO: 449854 - protein, 9 aa, Influenza virus
NATASFIYG

SEQ ID NO: 449855 - protein, 9 aa, Influenza virus
NATASFIYN

SEQ ID NO: 449856 - protein, 9 aa, Influenza virus
NATASFVYD

SEQ ID NO: 449857 - protein, 9 aa, Influenza virus
NATASLIYD

SEQ ID NO: 449858 - protein, 9 aa, Influenza virus
NATASLIYN

SEQ ID NO: 449859 - protein, 9 aa, Influenza virus
NATATVYYD

SEQ ID NO: 449860 - protein, 9 aa, Influenza virus
NATATVYYN

SEQ ID NO: 449861 - protein, 9 aa, Influenza virus
NATDTVDTL

SEQ ID NO: 449862 - protein, 9 aa, Influenza virus
NATETVEIT

SEQ ID NO: 449863 - protein, 9 aa, Influenza virus
NATETVENK

SEQ ID NO: 449864 - protein, 9 aa, Influenza virus
NATETVERT

SEQ ID NO: 449865 - protein, 9 aa, Influenza virus
NATETVESK

SEQ ID NO: 449866 - protein, 9 aa, Influenza virus
NATETVESR

SEQ ID NO: 449867 - protein, 9 aa, Influenza virus
NATETVEST

SEQ ID NO: 449868 - protein, 9 aa, Influenza virus
NATETVETA

SEQ ID NO: 449869 - protein, 9 aa, Influenza virus
NATETVETT

SEQ ID NO: 449870 - protein, 9 aa, Influenza virus
NATETVETV

SEQ ID NO: 449871 - protein, 9 aa, Influenza virus
NAVDEGNGC

SEQ ID NO: 449872 - protein, 9 aa, Influenza virus
NAVDTGDGC

SEQ ID NO: 449873 - protein, 9 aa, Influenza virus
NAVDTGNGC

SEQ ID NO: 449874 - protein, 9 aa, Influenza virus
NAVRFGESE

SEQ ID NO: 449875 - protein, 9 aa, Influenza virus
NAVRIGEDA

SEQ ID NO: 449876 - protein, 9 aa, Influenza virus
NAVRIGEDS

SEQ ID NO: 449877 - protein, 9 aa, Influenza virus
NAVRIGENS

SEQ ID NO: 449878 - protein, 9 aa, Influenza virus
NAYDRICIG

SEQ ID NO: 449879 - protein, 9 aa, Influenza virus
NAYQAKFES

SEQ ID NO: 449880 - protein, 9 aa, Influenza virus
NAYQARFES

SEQ ID NO: 449881 - protein, 9 aa, Influenza virus
NBNGVKGFS

SEQ ID NO: 449882 - protein, 9 aa, Influenza virus
NCDAKCQTP

SEQ ID NO: 449883 - protein, 9 aa, Influenza virus
NCDTKCQTP

SEQ ID NO: 449884 - protein, 9 aa, Influenza virus
NCETKCQSP

SEQ ID NO: 449885 - protein, 9 aa, Influenza virus
NCETKCQTP

SEQ ID NO: 449886 - protein, 9 aa, Influenza virus
NCETQCQTP

SEQ ID NO: 449887 - protein, 9 aa, Influenza virus
NCHTKCQTY

SEQ ID NO: 449888 - protein, 9 aa, Influenza virus
NCIESIRNG

SEQ ID NO: 449889 - protein, 9 aa, Influenza virus
NCIKPCFWV

SEQ ID NO: 449890 - protein, 9 aa, Influenza virus
NCINRCFYV

SEQ ID NO: 449891 - protein, 9 aa, Influenza virus
NCIRPCFWV

SEQ ID NO: 449892 - protein, 9 aa, Influenza virus
NCKDPNNER

SEQ ID NO: 449893 - protein, 9 aa, Influenza virus
NCKTKCQTY

SEQ ID NO: 449894 - protein, 9 aa, Influenza virus
NCLVPCFWV

SEQ ID NO: 449895 - protein, 9 aa, Influenza virus
NCLYASPQL

SEQ ID NO: 449896 - protein, 9 aa, Influenza virus
NCMERIRNN

SEQ ID NO: 449897 - protein, 9 aa, Influenza virus
NCMESIRDN

SEQ ID NO: 449898 - protein, 9 aa, Influenza virus
NCMESIRNN

SEQ ID NO: 449899 - protein, 9 aa, Influenza virus
NCMRPCFWV

SEQ ID NO: 449900 - protein, 9 aa, Influenza virus
NCNAKCQTP

SEQ ID NO: 449901 - protein, 9 aa, Influenza virus
NCNTKCQTP

SEQ ID NO: 449902 - protein, 9 aa, Influenza virus
NCNTKCQTY

SEQ ID NO: 449903 - protein, 9 aa, Influenza virus
NCPKYIKSG

SEQ ID NO: 449904 - protein, 9 aa, Influenza virus
NCPKYVKQG

SEQ ID NO: 449905 - protein, 9 aa, Influenza virus
NCRDPNNEK

SEQ ID NO: 449906 - protein, 9 aa, Influenza virus
NCRDPNNER

SEQ ID NO: 449907 - protein, 9 aa, Influenza virus
NCRDPNNES

SEQ ID NO: 449908 - protein, 9 aa, Influenza virus
NCRDSNNER

SEQ ID NO: 449909 - protein, 9 aa, Influenza virus
NCRNPNNEK

SEQ ID NO: 449910 - protein, 9 aa, Influenza virus
NCRNPNNER

SEQ ID NO: 449911 - protein, 9 aa, Influenza virus
NCTIPCFWV

SEQ ID NO: 449912 - protein, 9 aa, Influenza virus
NCTVPCFWV

SEQ ID NO: 449913 - protein, 9 aa, Influenza virus
NCWSFALAQ

SEQ ID NO: 449914 - protein, 9 aa, Influenza virus
NCYPGATVN

SEQ ID NO: 449915 - protein, 9 aa, Influenza virus
NCYQFALGQ

SEQ ID NO: 449916 - protein, 9 aa, Influenza virus
NCYTKCQTY

SEQ ID NO: 449917 - protein, 9 aa, Influenza virus
NCYWVMTDG

SEQ ID NO: 449918 - protein, 9 aa, Influenza virus
NDATYQRTR

SEQ ID NO: 449919 - protein, 9 aa, Influenza virus
NDAYAVIHY

SEQ ID NO: 449920 - protein, 9 aa, Influenza virus
NDCESKCFW

SEQ ID NO: 449921 - protein, 9 aa, Influenza virus
NDDIDQSLI

SEQ ID NO: 449922 - protein, 9 aa, Influenza virus
NDDSSSNSN

SEQ ID NO: 449923 - protein, 9 aa, Influenza virus
NDDSSSSSN

SEQ ID NO: 449924 - protein, 9 aa, Influenza virus
NDDVDQSLI

SEQ ID NO: 449925 - protein, 9 aa, Influenza virus
NDDVDQSLV

SEQ ID NO: 449926 - protein, 9 aa, Influenza virus
NDDVSWASN

SEQ ID NO: 449927 - protein, 9 aa, Influenza virus
NDDVSWTSN

SEQ ID NO: 449928 - protein, 9 aa, Influenza virus
NDEGTGIAA

SEQ ID NO: 449929 - protein, 9 aa, Influenza virus
NDERGNPGV

SEQ ID NO: 449930 - protein, 9 aa, Influenza virus
NDEVSWTSN

SEQ ID NO: 449931 - protein, 9 aa, Influenza virus
NDFFKRLNW

SEQ ID NO: 449932 - protein, 9 aa, Influenza virus
NDFFNRLNW

SEQ ID NO: 449933 - protein, 9 aa, Influenza virus
NDFFRRLNW

SEQ ID NO: 449934 - protein, 9 aa, Influenza virus
NDGKVECVC

SEQ ID NO: 449935 - protein, 9 aa, Influenza virus
NDIWMGRTI

SEQ ID NO: 449936 - protein, 9 aa, Influenza virus
NDKHSNETV

SEQ ID NO: 449937 - protein, 9 aa, Influenza virus
NDKHSNGTA

SEQ ID NO: 449938 - protein, 9 aa, Influenza virus
NDKHSNGTI

SEQ ID NO: 449939 - protein, 9 aa, Influenza virus
NDKHSNGTM

SEQ ID NO: 449940 - protein, 9 aa, Influenza virus
NDKHSNGTV

SEQ ID NO: 449941 - protein, 9 aa, Influenza virus
NDKHSNNTV

SEQ ID NO: 449942 - protein, 9 aa, Influenza virus
NDKIDDQIE

SEQ ID NO: 449943 - protein, 9 aa, Influenza virus
NDKINDQIE

SEQ ID NO: 449944 - protein, 9 aa, Influenza virus
NDKPFQNVN

SEQ ID NO: 449945 - protein, 9 aa, Influenza virus
NDKTLDLHD

SEQ ID NO: 449946 - protein, 9 aa, Influenza virus
NDKTLDMHD

SEQ ID NO: 449947 - protein, 9 aa, Influenza virus
NDKTLNMHD

SEQ ID NO: 449948 - protein, 9 aa, Influenza virus
NDKYHQIEK

SEQ ID NO: 449949 - protein, 9 aa, Influenza virus
NDLGNGCFE

SEQ ID NO: 449950 - protein, 9 aa, Influenza virus
NDLGPATAQ

SEQ ID NO: 449951 - protein, 9 aa, Influenza virus
NDLWMGRTI

SEQ ID NO: 449952 - protein, 9 aa, Influenza virus
NDLYGTQPL

SEQ ID NO: 449953 - protein, 9 aa, Influenza virus
NDLYGTQSL

SEQ ID NO: 449954 - protein, 9 aa, Influenza virus
NDNASAVVW

SEQ ID NO: 449955 - protein, 9 aa, Influenza virus
NDNATATVY

SEQ ID NO: 449956 - protein, 9 aa, Influenza virus
NDNCMESIR

SEQ ID NO: 449957 - protein, 9 aa, Influenza virus
NDNVSWTSN

SEQ ID NO: 449958 - protein, 9 aa, Influenza virus
NDNWSGYSG

SEQ ID NO: 449959 - protein, 9 aa, Influenza virus
NDPSGYAQT

SEQ ID NO: 449960 - protein, 9 aa, Influenza virus
NDPWVLLNA

SEQ ID NO: 449961 - protein, 9 aa, Influenza virus
NDPYPGNNN

SEQ ID NO: 449962 - protein, 9 aa, Influenza virus
NDPYPGNSN

SEQ ID NO: 449963 - protein, 9 aa, Influenza virus
NDQGAGYAA

SEQ ID NO: 449964 - protein, 9 aa, Influenza virus
NDQGSGYAA

SEQ ID NO: 449965 - protein, 9 aa, Influenza virus
NDQIEDLWA

SEQ ID NO: 449966 - protein, 9 aa, Influenza virus
NDQITDIWA

SEQ ID NO: 449967 - protein, 9 aa, Influenza virus
NDRHSNGTI

SEQ ID NO: 449968 - protein, 9 aa, Influenza virus
NDRHSNGTV

SEQ ID NO: 449969 - protein, 9 aa, Influenza virus
NDRNFWRGD

SEQ ID NO: 449970 - protein, 9 aa, Influenza virus
NDRNFWRGE

SEQ ID NO: 449971 - protein, 9 aa, Influenza virus
NDRSPFRAL

SEQ ID NO: 449972 - protein, 9 aa, Influenza virus
NDRSPHRTL

SEQ ID NO: 449973 - protein, 9 aa, Influenza virus
NDRTLDLHD

SEQ ID NO: 449974 - protein, 9 aa, Influenza virus
NDRTPYRSL

SEQ ID NO: 449975 - protein, 9 aa, Influenza virus
NDSCMDTIR

SEQ ID NO: 449976 - protein, 9 aa, Influenza virus
NDSCMEAIR

SEQ ID NO: 449977 - protein, 9 aa, Influenza virus
NDSCMETIR

SEQ ID NO: 449978 - protein, 9 aa, Influenza virus
NDTDVVNFL

SEQ ID NO: 449979 - protein, 9 aa, Influenza virus
NDTDVVNFV

SEQ ID NO: 449980 - protein, 9 aa, Influenza virus
NDTDVVNYV

SEQ ID NO: 449981 - protein, 9 aa, Influenza virus
NDTINYYNE

SEQ ID NO: 449982 - protein, 9 aa, Influenza virus
NDTITFSFN

SEQ ID NO: 449983 - protein, 9 aa, Influenza virus
NDTTYQRTR

SEQ ID NO: 449984 - protein, 9 aa, Influenza virus
NDTVIFSFN

SEQ ID NO: 449985 - protein, 9 aa, Influenza virus
NDTVNFSFN

SEQ ID NO: 449986 - protein, 9 aa, Influenza virus
NDTVTFIFN

SEQ ID NO: 449987 - protein, 9 aa, Influenza virus
NDTVTFNFN

SEQ ID NO: 449988 - protein, 9 aa, Influenza virus
NDTVTFSFN

SEQ ID NO: 449989 - protein, 9 aa, Influenza virus
NDTVTFTFN

SEQ ID NO: 449990 - protein, 9 aa, Influenza virus
NDVWLGRTI

SEQ ID NO: 449991 - protein, 9 aa, Influenza virus
NDVWLGRTV

SEQ ID NO: 449992 - protein, 9 aa, Influenza virus
NDVWMGRTI

SEQ ID NO: 449993 - protein, 9 aa, Influenza virus
NDWSGYSGS

SEQ ID NO: 449994 - protein, 9 aa, Influenza virus
NDYEELKHF

SEQ ID NO: 449995 - protein, 9 aa, Influenza virus
NDYEELKHL

SEQ ID NO: 449996 - protein, 9 aa, Influenza virus
NDYEELKLL

SEQ ID NO: 449997 - protein, 9 aa, Influenza virus
NDYEELKYL

SEQ ID NO: 449998 - protein, 9 aa, Influenza virus
NEAINNRFQ

SEQ ID NO: 449999 - protein, 9 aa, Influenza virus
NEALNNRFQ

SEQ ID NO: 450000 - protein, 9 aa, Influenza virus
NEAVAVLKY

SEQ ID NO: 450001 - protein, 9 aa, Influenza virus
NECIEKIRN

SEQ ID NO: 450002 - protein, 9 aa, Influenza virus
NECIEKVRN

SEQ ID NO: 450003 - protein, 9 aa, Influenza virus
NECIERVRN

SEQ ID NO: 450004 - protein, 9 aa, Influenza virus
NECMETIKN

SEQ ID NO: 450005 - protein, 9 aa, Influenza virus
NECRFYALS

SEQ ID NO: 450006 - protein, 9 aa, Influenza virus
NECRTFFLT

SEQ ID NO: 450007 - protein, 9 aa, Influenza virus
NECYNPCFY

SEQ ID NO: 450008 - protein, 9 aa, Influenza virus
NEDGDIIFL

SEQ ID NO: 450009 - protein, 9 aa, Influenza virus
NEDGNIIFL

SEQ ID NO: 450010 - protein, 9 aa, Influenza virus
NEDGSSSSN

SEQ ID NO: 450011 - protein, 9 aa, Influenza virus
NEDIPIENC

SEQ ID NO: 450012 - protein, 9 aa, Influenza virus
NEDIPIGNC

SEQ ID NO: 450013 - protein, 9 aa, Influenza virus
NEDIPIGSC

SEQ ID NO: 450014 - protein, 9 aa, Influenza virus
NEDSSSNSN

SEQ ID NO: 450015 - protein, 9 aa, Influenza virus
NEDSSSSSN

SEQ ID NO: 450016 - protein, 9 aa, Influenza virus
NEEALRQII

SEQ ID NO: 450017 - protein, 9 aa, Influenza virus
NEEALRQIL

SEQ ID NO: 450018 - protein, 9 aa, Influenza virus
NEEALRQKI

SEQ ID NO: 450019 - protein, 9 aa, Influenza virus
NEEGDIIFL

SEQ ID NO: 450020 - protein, 9 aa, Influenza virus
NEEGTGIAA

SEQ ID NO: 450021 - protein, 9 aa, Influenza virus
NEEPLRQIL

SEQ ID NO: 450022 - protein, 9 aa, Influenza virus
NEERGNPGV

SEQ ID NO: 450023 - protein, 9 aa, Influenza virus
NEERGSPGV

SEQ ID NO: 450024 - protein, 9 aa, Influenza virus
NEESLRQIL

SEQ ID NO: 450025 - protein, 9 aa, Influenza virus
NEESLRQVL

SEQ ID NO: 450026 - protein, 9 aa, Influenza virus
NEFNEIEQQ

SEQ ID NO: 450027 - protein, 9 aa, Influenza virus
NEFNEVEQQ

SEQ ID NO: 450028 - protein, 9 aa, Influenza virus
NEFNKACEL

SEQ ID NO: 450029 - protein, 9 aa, Influenza virus
NEFSEIEQQ

SEQ ID NO: 450030 - protein, 9 aa, Influenza virus
NEFTEIEQQ

SEQ ID NO: 450031 - protein, 9 aa, Influenza virus
NEFTEVEKQ

SEQ ID NO: 450032 - protein, 9 aa, Influenza virus
NEFTEVEQQ

SEQ ID NO: 450033 - protein, 9 aa, Influenza virus
NEGALRQKI

SEQ ID NO: 450034 - protein, 9 aa, Influenza virus
NEGHIEECS

SEQ ID NO: 450035 - protein, 9 aa, Influenza virus
NEGIMNTSK

SEQ ID NO: 450036 - protein, 9 aa, Influenza virus
NEGKVECIC

SEQ ID NO: 450037 - protein, 9 aa, Influenza virus
NEGKVECVC

SEQ ID NO: 450038 - protein, 9 aa, Influenza virus
NEGNGCFEL

SEQ ID NO: 450039 - protein, 9 aa, Influenza virus
NEGRLIQNS

SEQ ID NO: 450040 - protein, 9 aa, Influenza virus
NEGRTSDMR

SEQ ID NO: 450041 - protein, 9 aa, Influenza virus
NEGSYFFGD

SEQ ID NO: 450042 - protein, 9 aa, Influenza virus
NEGVINTSK

SEQ ID NO: 450043 - protein, 9 aa, Influenza virus
NEGVMNTSK

SEQ ID NO: 450044 - protein, 9 aa, Influenza virus
NEHSNGTIH

SEQ ID NO: 450045 - protein, 9 aa, Influenza virus
NEHSNGTTH

SEQ ID NO: 450046 - protein, 9 aa, Influenza virus
NEIEHQIGN

SEQ ID NO: 450047 - protein, 9 aa, Influenza virus
NEIEQQIGN

SEQ ID NO: 450048 - protein, 9 aa, Influenza virus
NEIEYQIGN

SEQ ID NO: 450049 - protein, 9 aa, Influenza virus
NEIGVPFHL

SEQ ID NO: 450050 - protein, 9 aa, Influenza virus
NEIKGVELS

SEQ ID NO: 450051 - protein, 9 aa, Influenza virus
NEIKGVKLS

SEQ ID NO: 450052 - protein, 9 aa, Influenza virus
NEIRASVGR

SEQ ID NO: 450053 - protein, 9 aa, Influenza virus
NEITTKINN

SEQ ID NO: 450054 - protein, 9 aa, Influenza virus
NEKFHQIEK

SEQ ID NO: 450055 - protein, 9 aa, Influenza virus
NEKGNPGVK

SEQ ID NO: 450056 - protein, 9 aa, Influenza virus
NEKGNQGVK

SEQ ID NO: 450057 - protein, 9 aa, Influenza virus
NEKKAKLAN

SEQ ID NO: 450058 - protein, 9 aa, Influenza virus
NEKPFQNVN

SEQ ID NO: 450059 - protein, 9 aa, Influenza virus
NEKTLDLHD

SEQ ID NO: 450060 - protein, 9 aa, Influenza virus
NEKYHQIEK

SEQ ID NO: 450061 - protein, 9 aa, Influenza virus
NELGIPFHL

SEQ ID NO: 450062 - protein, 9 aa, Influenza virus
NELGVPFHL

SEQ ID NO: 450063 - protein, 9 aa, Influenza virus
NELGVPFHM

SEQ ID NO: 450064 - protein, 9 aa, Influenza virus
NELGVPFNL

SEQ ID NO: 450065 - protein, 9 aa, Influenza virus
NELGVPFYL

SEQ ID NO: 450066 - protein, 9 aa, Influenza virus
NELGVPLHL

SEQ ID NO: 450067 - protein, 9 aa, Influenza virus
NELGVSFHL

SEQ ID NO: 450068 - protein, 9 aa, Influenza virus
NELYGTQSL

SEQ ID NO: 450069 - protein, 9 aa, Influenza virus
NEMTLDFHD

SEQ ID NO: 450070 - protein, 9 aa, Influenza virus
NENATATVY

SEQ ID NO: 450071 - protein, 9 aa, Influenza virus
NENGDIIFL

SEQ ID NO: 450072 - protein, 9 aa, Influenza virus
NENPAHKSQ

SEQ ID NO: 450073 - protein, 9 aa, Influenza virus
NENPVHKSQ

SEQ ID NO: 450074 - protein, 9 aa, Influenza virus
NENQNPRIF

SEQ ID NO: 450075 - protein, 9 aa, Influenza virus
NENQNPRMF

SEQ ID NO: 450076 - protein, 9 aa, Influenza virus
NENQNPRVF

SEQ ID NO: 450077 - protein, 9 aa, Influenza virus
NEPGSGDWP

SEQ ID NO: 450078 - protein, 9 aa, Influenza virus
NEPGSGNWP

SEQ ID NO: 450079 - protein, 9 aa, Influenza virus
NEPSGYAQT

SEQ ID NO: 450080 - protein, 9 aa, Influenza virus
NEPTGYAQT

SEQ ID NO: 450081 - protein, 9 aa, Influenza virus
NEPYPGNNN

SEQ ID NO: 450082 - protein, 9 aa, Influenza virus
NEQGGGYAA

SEQ ID NO: 450083 - protein, 9 aa, Influenza virus
NEQGMGMAA

SEQ ID NO: 450084 - protein, 9 aa, Influenza virus
NEQGSGFAA

SEQ ID NO: 450085 - protein, 9 aa, Influenza virus
NEQGSGYAA

SEQ ID NO: 450086 - protein, 9 aa, Influenza virus
NEQGTGIAA

SEQ ID NO: 450087 - protein, 9 aa, Influenza virus
NEQGVGIAA

SEQ ID NO: 450088 - protein, 9 aa, Influenza virus
NEQGVGMAA

SEQ ID NO: 450089 - protein, 9 aa, Influenza virus
NEQTDLYKV

SEQ ID NO: 450090 - protein, 9 aa, Influenza virus
NERGLFGAI

SEQ ID NO: 450091 - protein, 9 aa, Influenza virus
NERGNHGVK

SEQ ID NO: 450092 - protein, 9 aa, Influenza virus
NERGNPGVK

SEQ ID NO: 450093 - protein, 9 aa, Influenza virus
NERGNQGVK

SEQ ID NO: 450094 - protein, 9 aa, Influenza virus
NERGTQGVK

SEQ ID NO: 450095 - protein, 9 aa, Influenza virus
NERILDFHD

SEQ ID NO: 450096 - protein, 9 aa, Influenza virus
NERTLDFHD

SEQ ID NO: 450097 - protein, 9 aa, Influenza virus
NERTLDLHD

SEQ ID NO: 450098 - protein, 9 aa, Influenza virus
NERTLDMHD

SEQ ID NO: 450099 - protein, 9 aa, Influenza virus
NERTLDQHD

SEQ ID NO: 450100 - protein, 9 aa, Influenza virus
NERTLDYHD

SEQ ID NO: 450101 - protein, 9 aa, Influenza virus
NERTLYFHD

SEQ ID NO: 450102 - protein, 9 aa, Influenza virus
NESADMSIG

SEQ ID NO: 450103 - protein, 9 aa, Influenza virus
NESGRLIDF

SEQ ID NO: 450104 - protein, 9 aa, Influenza virus
NESGRLMDF

SEQ ID NO: 450105 - protein, 9 aa, Influenza virus
NETFVNMTN

SEQ ID NO: 450106 - protein, 9 aa, Influenza virus
NETFVNVTH

SEQ ID NO: 450107 - protein, 9 aa, Influenza virus
NETFVNVTN

SEQ ID NO: 450108 - protein, 9 aa, Influenza virus
NETIIETGY

SEQ ID NO: 450109 - protein, 9 aa, Influenza virus
NETILETGY

SEQ ID NO: 450110 - protein, 9 aa, Influenza virus
NETIVETGY

SEQ ID NO: 450111 - protein, 9 aa, Influenza virus
NETVKDRSP

SEQ ID NO: 450112 - protein, 9 aa, Influenza virus
NEVEQQIGN

SEQ ID NO: 450113 - protein, 9 aa, Influenza virus
NEVGAKILT

SEQ ID NO: 450114 - protein, 9 aa, Influenza virus
NEVGARIIT

SEQ ID NO: 450115 - protein, 9 aa, Influenza virus
NEVGARILT

SEQ ID NO: 450116 - protein, 9 aa, Influenza virus
NEVKLEENT

SEQ ID NO: 450117 - protein, 9 aa, Influenza virus
NEWSGYSGS

SEQ ID NO: 450118 - protein, 9 aa, Influenza virus
NFDSNGNFI

SEQ ID NO: 450119 - protein, 9 aa, Influenza virus
NFEGWIVGN

SEQ ID NO: 450120 - protein, 9 aa, Influenza virus
NFEKEGYSL

SEQ ID NO: 450121 - protein, 9 aa, Influenza virus
NFESNGNFI

SEQ ID NO: 450122 - protein, 9 aa, Influenza virus
NFESNGNLI

SEQ ID NO: 450123 - protein, 9 aa, Influenza virus
NFESTGNLI

SEQ ID NO: 450124 - protein, 9 aa, Influenza virus
NFESTGNLV

SEQ ID NO: 450125 - protein, 9 aa, Influenza virus
NFFHKCNDS

SEQ ID NO: 450126 - protein, 9 aa, Influenza virus
NFHYEECSC

SEQ ID NO: 450127 - protein, 9 aa, Influenza virus
NFIAPENAY

SEQ ID NO: 450128 - protein, 9 aa, Influenza virus
NFIAPEYAF

SEQ ID NO: 450129 - protein, 9 aa, Influenza virus
NFIAPEYAY

SEQ ID NO: 450130 - protein, 9 aa, Influenza virus
NFKPNIGPR

SEQ ID NO: 450131 - protein, 9 aa, Influenza virus
NFLSMEFSL

SEQ ID NO: 450132 - protein, 9 aa, Influenza virus
NFMPYISFA

SEQ ID NO: 450133 - protein, 9 aa, Influenza virus
NFNDYEELK

SEQ ID NO: 450134 - protein, 9 aa, Influenza virus
NFNGAFIAP

SEQ ID NO: 450135 - protein, 9 aa, Influenza virus
NFNGAFVAP

SEQ ID NO: 450136 - protein, 9 aa, Influenza virus
NFPQTANTY

SEQ ID NO: 450137 - protein, 9 aa, Influenza virus
NFPQTTNTY

SEQ ID NO: 450138 - protein, 9 aa, Influenza virus
NFPRTTNTY

SEQ ID NO: 450139 - protein, 9 aa, Influenza virus
NFQPNIGPR

SEQ ID NO: 450140 - protein, 9 aa, Influenza virus
NFRAYVDGF

SEQ ID NO: 450141 - protein, 9 aa, Influenza virus
NFRTYVDGF

SEQ ID NO: 450142 - protein, 9 aa, Influenza virus
NFRVYVDGF

SEQ ID NO: 450143 - protein, 9 aa, Influenza virus
NFSFNGAFI

SEQ ID NO: 450144 - protein, 9 aa, Influenza virus
NFSMELPSF

SEQ ID NO: 450145 - protein, 9 aa, Influenza virus
NFVIEKMNT

SEQ ID NO: 450146 - protein, 9 aa, Influenza virus
NFVNRANQR

SEQ ID NO: 450147 - protein, 9 aa, Influenza virus
NFVPVIGAR

SEQ ID NO: 450148 - protein, 9 aa, Influenza virus
NFVPVMGAR

SEQ ID NO: 450149 - protein, 9 aa, Influenza virus
NFVPVVGAR

SEQ ID NO: 450150 - protein, 9 aa, Influenza virus
NFVPVVRAR

SEQ ID NO: 450151 - protein, 9 aa, Influenza virus
NFVRQCFNP

SEQ ID NO: 450152 - protein, 9 aa, Influenza virus
NFVSMEFSL

SEQ ID NO: 450153 - protein, 9 aa, Influenza virus
NFWRGDNGR

SEQ ID NO: 450154 - protein, 9 aa, Influenza virus
NFWRGENGR

SEQ ID NO: 450155 - protein, 9 aa, Influenza virus
NFYYEECSC

SEQ ID NO: 450156 - protein, 9 aa, Influenza virus
NGAFIAPDR

SEQ ID NO: 450157 - protein, 9 aa, Influenza virus
NGAFIAPNR

SEQ ID NO: 450158 - protein, 9 aa, Influenza virus
NGAFIAPRY

SEQ ID NO: 450159 - protein, 9 aa, Influenza virus
NGAFLAPGY

SEQ ID NO: 450160 - protein, 9 aa, Influenza virus
NGAFLAPRY

SEQ ID NO: 450161 - protein, 9 aa, Influenza virus
NGAFVAPDR

SEQ ID NO: 450162 - protein, 9 aa, Influenza virus
NGAKVNTLT

SEQ ID NO: 450163 - protein, 9 aa, Influenza virus
NGALGSPGC

SEQ ID NO: 450164 - protein, 9 aa, Influenza virus
NGALLAPRY

SEQ ID NO: 450165 - protein, 9 aa, Influenza virus
NGAQIQYFS

SEQ ID NO: 450166 - protein, 9 aa, Influenza virus
NGAVAVLKY

SEQ ID NO: 450167 - protein, 9 aa, Influenza virus
NGAVAVVKY

SEQ ID NO: 450168 - protein, 9 aa, Influenza virus
NGAWIGRTK

SEQ ID NO: 450169 - protein, 9 aa, Influenza virus
NGCFDILHK

SEQ ID NO: 450170 - protein, 9 aa, Influenza virus
NGCFEFWHK

SEQ ID NO: 450171 - protein, 9 aa, Influenza virus
NGCFEFYHK

SEQ ID NO: 450172 - protein, 9 aa, Influenza virus
NGCFEFYHR

SEQ ID NO: 450173 - protein, 9 aa, Influenza virus
NGCFEIFHK

SEQ ID NO: 450174 - protein, 9 aa, Influenza virus
NGCFEIFHQ

SEQ ID NO: 450175 - protein, 9 aa, Influenza virus
NGCFEIFHR

SEQ ID NO: 450176 - protein, 9 aa, Influenza virus
NGCFELLHK

SEQ ID NO: 450177 - protein, 9 aa, Influenza virus
NGCFELYHK

SEQ ID NO: 450178 - protein, 9 aa, Influenza virus
NGCFKIYHK

SEQ ID NO: 450179 - protein, 9 aa, Influenza virus
NGCFPFYHK

SEQ ID NO: 450180 - protein, 9 aa, Influenza virus
NGCFQPCFY

SEQ ID NO: 450181 - protein, 9 aa, Influenza virus
NGCFTFYHK

SEQ ID NO: 450182 - protein, 9 aa, Influenza virus
NGCFTIYHK

SEQ ID NO: 450183 - protein, 9 aa, Influenza virus
NGCIEGKLS

SEQ ID NO: 450184 - protein, 9 aa, Influenza virus
NGCIESKLS

SEQ ID NO: 450185 - protein, 9 aa, Influenza virus
NGCLKIYHK

SEQ ID NO: 450186 - protein, 9 aa, Influenza virus
NGDDVWMGR

SEQ ID NO: 450187 - protein, 9 aa, Influenza virus
NGDGCFEIL

SEQ ID NO: 450188 - protein, 9 aa, Influenza virus
NGDIIFLWG

SEQ ID NO: 450189 - protein, 9 aa, Influenza virus
NGDPNNMDK

SEQ ID NO: 450190 - protein, 9 aa, Influenza virus
NGDPNNMDR

SEQ ID NO: 450191 - protein, 9 aa, Influenza virus
NGDYARLYI

SEQ ID NO: 450192 - protein, 9 aa, Influenza virus
NGDYTRLYI

SEQ ID NO: 450193 - protein, 9 aa, Influenza virus
NGEALRQIL

SEQ ID NO: 450194 - protein, 9 aa, Influenza virus
NGELRHLFS

SEQ ID NO: 450195 - protein, 9 aa, Influenza virus
NGEPGVKGF

SEQ ID NO: 450196 - protein, 9 aa, Influenza virus
NGEQILIIW

SEQ ID NO: 450197 - protein, 9 aa, Influenza virus
NGFAPFSKD

SEQ ID NO: 450198 - protein, 9 aa, Influenza virus
NGFCFTVMT

SEQ ID NO: 450199 - protein, 9 aa, Influenza virus
NGFEMLKIP

SEQ ID NO: 450200 - protein, 9 aa, Influenza virus
NGFLDVWTY

SEQ ID NO: 450201 - protein, 9 aa, Influenza virus
NGGFLAPRY

SEQ ID NO: 450202 - protein, 9 aa, Influenza virus
NGGHIEECS

SEQ ID NO: 450203 - protein, 9 aa, Influenza virus
NGGLGVKGF

SEQ ID NO: 450204 - protein, 9 aa, Influenza virus
NGGLIAPDR

SEQ ID NO: 450205 - protein, 9 aa, Influenza virus
NGGLIAPNR

SEQ ID NO: 450206 - protein, 9 aa, Influenza virus
NGGLIAPRY

SEQ ID NO: 450207 - protein, 9 aa, Influenza virus
NGGLIAPSR

SEQ ID NO: 450208 - protein, 9 aa, Influenza virus
NGGLLAPKY

SEQ ID NO: 450209 - protein, 9 aa, Influenza virus
NGGLLAPRY

SEQ ID NO: 450210 - protein, 9 aa, Influenza virus
NGGPGVKGF

SEQ ID NO: 450211 - protein, 9 aa, Influenza virus
NGGRIAPSR

SEQ ID NO: 450212 - protein, 9 aa, Influenza virus
NGICPVVFT

SEQ ID NO: 450213 - protein, 9 aa, Influenza virus
NGICTVVMT

SEQ ID NO: 450214 - protein, 9 aa, Influenza virus
NGICYPGIL

SEQ ID NO: 450215 - protein, 9 aa, Influenza virus
NGICYPGSL

SEQ ID NO: 450216 - protein, 9 aa, Influenza virus
NGICYPGTL

SEQ ID NO: 450217 - protein, 9 aa, Influenza virus
NGIITDTFK

SEQ ID NO: 450218 - protein, 9 aa, Influenza virus
NGIITDTLK

SEQ ID NO: 450219 - protein, 9 aa, Influenza virus
NGIKVDTLT

SEQ ID NO: 450220 - protein, 9 aa, Influenza virus
NGIPPLELG

SEQ ID NO: 450221 - protein, 9 aa, Influenza virus
NGIRIGSKG

SEQ ID NO: 450222 - protein, 9 aa, Influenza virus
NGIRIGSRG

SEQ ID NO: 450223 - protein, 9 aa, Influenza virus
NGIRVGSRG

SEQ ID NO: 450224 - protein, 9 aa, Influenza virus
NGISPIHLG

SEQ ID NO: 450225 - protein, 9 aa, Influenza virus
NGISPVHLG

SEQ ID NO: 450226 - protein, 9 aa, Influenza virus
NGITNKVNS

SEQ ID NO: 450227 - protein, 9 aa, Influenza virus
NGKAPISLG

SEQ ID NO: 450228 - protein, 9 aa, Influenza virus
NGKEPISLG

SEQ ID NO: 450229 - protein, 9 aa, Influenza virus
NGKFEFIAE

SEQ ID NO: 450230 - protein, 9 aa, Influenza virus
NGKFEFIVE

SEQ ID NO: 450231 - protein, 9 aa, Influenza virus
NGKGRYGVK

SEQ ID NO: 450232 - protein, 9 aa, Influenza virus
NGKLCKLNG

SEQ ID NO: 450233 - protein, 9 aa, Influenza virus
NGKLCKLSG

SEQ ID NO: 450234 - protein, 9 aa, Influenza virus
NGKLCRLNG

SEQ ID NO: 450235 - protein, 9 aa, Influenza virus
NGKLCRLRG

SEQ ID NO: 450236 - protein, 9 aa, Influenza virus
NGKLCRLSG

SEQ ID NO: 450237 - protein, 9 aa, Influenza virus
NGKLEFIAE

SEQ ID NO: 450238 - protein, 9 aa, Influenza virus
NGKLNRLIE

SEQ ID NO: 450239 - protein, 9 aa, Influenza virus
NGKPFQNVN

SEQ ID NO: 450240 - protein, 9 aa, Influenza virus
NGKQPISLG

SEQ ID NO: 450241 - protein, 9 aa, Influenza virus
NGKSGACKR

SEQ ID NO: 450242 - protein, 9 aa, Influenza virus
NGKSLGIQS

SEQ ID NO: 450243 - protein, 9 aa, Influenza virus
NGKSSACKR

SEQ ID NO: 450244 - protein, 9 aa, Influenza virus
NGKVECICR

SEQ ID NO: 450245 - protein, 9 aa, Influenza virus
NGKWREQLS

SEQ ID NO: 450246 - protein, 9 aa, Influenza virus
NGKYPVIKG

SEQ ID NO: 450247 - protein, 9 aa, Influenza virus
NGNCRFNVC

SEQ ID NO: 450248 - protein, 9 aa, Influenza virus
NGNDVWMGR

SEQ ID NO: 450249 - protein, 9 aa, Influenza virus
NGNFIAPEN

SEQ ID NO: 450250 - protein, 9 aa, Influenza virus
NGNFIAPEY

SEQ ID NO: 450251 - protein, 9 aa, Influenza virus
NGNFITPEY

SEQ ID NO: 450252 - protein, 9 aa, Influenza virus
NGNGCFELY

SEQ ID NO: 450253 - protein, 9 aa, Influenza virus
NGNGDPNNM

SEQ ID NO: 450254 - protein, 9 aa, Influenza virus
NGNHAVHYC

SEQ ID NO: 450255 - protein, 9 aa, Influenza virus
NGNIRCQIC

SEQ ID NO: 450256 - protein, 9 aa, Influenza virus
NGNIRCTFC

SEQ ID NO: 450257 - protein, 9 aa, Influenza virus
NGNLIAPEF

SEQ ID NO: 450258 - protein, 9 aa, Influenza virus
NGNLIAPEY

SEQ ID NO: 450259 - protein, 9 aa, Influenza virus
NGNLIAPLY

SEQ ID NO: 450260 - protein, 9 aa, Influenza virus
NGNLIAPRG

SEQ ID NO: 450261 - protein, 9 aa, Influenza virus
NGNLIAPWF

SEQ ID NO: 450262 - protein, 9 aa, Influenza virus
NGNLIAPWY

SEQ ID NO: 450263 - protein, 9 aa, Influenza virus
NGNLRCQIC

SEQ ID NO: 450264 - protein, 9 aa, Influenza virus
NGNLRCTIC

SEQ ID NO: 450265 - protein, 9 aa, Influenza virus
NGNLVAPRG

SEQ ID NO: 450266 - protein, 9 aa, Influenza virus
NGNLVAPWY

SEQ ID NO: 450267 - protein, 9 aa, Influenza virus
NGNMQCTIC

SEQ ID NO: 450268 - protein, 9 aa, Influenza virus
NGNMRCTIC

SEQ ID NO: 450269 - protein, 9 aa, Influenza virus
NGNMRCTIL

SEQ ID NO: 450270 - protein, 9 aa, Influenza virus
NGNMRCTSC

SEQ ID NO: 450271 - protein, 9 aa, Influenza virus
NGNVRCQIC

SEQ ID NO: 450272 - protein, 9 aa, Influenza virus
NGNVRCTFC

SEQ ID NO: 450273 - protein, 9 aa, Influenza virus
NGNYARLYI

SEQ ID NO: 450274 - protein, 9 aa, Influenza virus
NGNYDSIRG

SEQ ID NO: 450275 - protein, 9 aa, Influenza virus
NGNYGPINV

SEQ ID NO: 450276 - protein, 9 aa, Influenza virus
NGPDSVLVN

SEQ ID NO: 450277 - protein, 9 aa, Influenza virus
NGPESVLIN

SEQ ID NO: 450278 - protein, 9 aa, Influenza virus
NGPESVLVN

SEQ ID NO: 450279 - protein, 9 aa, Influenza virus
NGQAGRIDF

SEQ ID NO: 450280 - protein, 9 aa, Influenza virus
NGQAGRMTF

SEQ ID NO: 450281 - protein, 9 aa, Influenza virus
NGQFGRIDF

SEQ ID NO: 450282 - protein, 9 aa, Influenza virus
NGQFGRINF

SEQ ID NO: 450283 - protein, 9 aa, Influenza virus
NGQGSGYAA

SEQ ID NO: 450284 - protein, 9 aa, Influenza virus
NGQKSWMKI

SEQ ID NO: 450285 - protein, 9 aa, Influenza virus
NGQKSWTKI

SEQ ID NO: 450286 - protein, 9 aa, Influenza virus
NGQRGRIDF

SEQ ID NO: 450287 - protein, 9 aa, Influenza virus
NGQRSWMKI

SEQ ID NO: 450288 - protein, 9 aa, Influenza virus
NGQSGRIDF

SEQ ID NO: 450289 - protein, 9 aa, Influenza virus
NGQSGRIEF

SEQ ID NO: 450290 - protein, 9 aa, Influenza virus
NGQSGRINF

SEQ ID NO: 450291 - protein, 9 aa, Influenza virus
NGQSGRIVF

SEQ ID NO: 450292 - protein, 9 aa, Influenza virus
NGQTGRIDF

SEQ ID NO: 450293 - protein, 9 aa, Influenza virus
NGREWSYIV

SEQ ID NO: 450294 - protein, 9 aa, Influenza virus
NGRFEFIAE

SEQ ID NO: 450295 - protein, 9 aa, Influenza virus
NGRSGFEVI

SEQ ID NO: 450296 - protein, 9 aa, Influenza virus
NGRSSFFRN

SEQ ID NO: 450297 - protein, 9 aa, Influenza virus
NGRTLDLHD

SEQ ID NO: 450298 - protein, 9 aa, Influenza virus
NGRTLDMHD

SEQ ID NO: 450299 - protein, 9 aa, Influenza virus
NGRTLGLHD

SEQ ID NO: 450300 - protein, 9 aa, Influenza virus
NGSCAVVMT

SEQ ID NO: 450301 - protein, 9 aa, Influenza virus
NGSCFTIMT

SEQ ID NO: 450302 - protein, 9 aa, Influenza virus
NGSCFTVLT

SEQ ID NO: 450303 - protein, 9 aa, Influenza virus
NGSCFTVMT

SEQ ID NO: 450304 - protein, 9 aa, Influenza virus
NGSCRCMFC

SEQ ID NO: 450305 - protein, 9 aa, Influenza virus
NGSCRCTIC

SEQ ID NO: 450306 - protein, 9 aa, Influenza virus
NGSCRFNVC

SEQ ID NO: 450307 - protein, 9 aa, Influenza virus
NGSCTVVMT

SEQ ID NO: 450308 - protein, 9 aa, Influenza virus
NGSIPNDKP

SEQ ID NO: 450309 - protein, 9 aa, Influenza virus
NGSIPNEKP

SEQ ID NO: 450310 - protein, 9 aa, Influenza virus
NGSIPNGKP

SEQ ID NO: 450311 - protein, 9 aa, Influenza virus
NGSIPNNKP

SEQ ID NO: 450312 - protein, 9 aa, Influenza virus
NGSISNDKP

SEQ ID NO: 450313 - protein, 9 aa, Influenza virus
NGSLHGRIC

SEQ ID NO: 450314 - protein, 9 aa, Influenza virus
NGSLQCKIC

SEQ ID NO: 450315 - protein, 9 aa, Influenza virus
NGSLQCRIA

SEQ ID NO: 450316 - protein, 9 aa, Influenza virus
NGSLQCRIC

SEQ ID NO: 450317 - protein, 9 aa, Influenza virus
NGSLQCRVC

SEQ ID NO: 450318 - protein, 9 aa, Influenza virus
NGSLQCTIC

SEQ ID NO: 450319 - protein, 9 aa, Influenza virus
NGSLRCRIC

SEQ ID NO: 450320 - protein, 9 aa, Influenza virus
NGSYRCMFC

SEQ ID NO: 450321 - protein, 9 aa, Influenza virus
NGTAKDRSP

SEQ ID NO: 450322 - protein, 9 aa, Influenza virus
NGTAKHIEE

SEQ ID NO: 450323 - protein, 9 aa, Influenza virus
NGTCAVVMT

SEQ ID NO: 450324 - protein, 9 aa, Influenza virus
NGTCTVIMT

SEQ ID NO: 450325 - protein, 9 aa, Influenza virus
NGTCTVVMT

SEQ ID NO: 450326 - protein, 9 aa, Influenza virus
NGTCVVIMT

SEQ ID NO: 450327 - protein, 9 aa, Influenza virus
NGTCVVVMT

SEQ ID NO: 450328 - protein, 9 aa, Influenza virus
NGTIHDRAA

SEQ ID NO: 450329 - protein, 9 aa, Influenza virus
NGTIHDRSP

SEQ ID NO: 450330 - protein, 9 aa, Influenza virus
NGTIHDRSQ

SEQ ID NO: 450331 - protein, 9 aa, Influenza virus
NGTIHDRTA

SEQ ID NO: 450332 - protein, 9 aa, Influenza virus
NGTIHDRTT

SEQ ID NO: 450333 - protein, 9 aa, Influenza virus
NGTIKDRSP

SEQ ID NO: 450334 - protein, 9 aa, Influenza virus
NGTINDRSP

SEQ ID NO: 450335 - protein, 9 aa, Influenza virus
NGTIVKTIT

SEQ ID NO: 450336 - protein, 9 aa, Influenza virus
NGTIVKTLT

SEQ ID NO: 450337 - protein, 9 aa, Influenza virus
NGTIVRTIT

SEQ ID NO: 450338 - protein, 9 aa, Influenza virus
NGTIVTTLT

SEQ ID NO: 450339 - protein, 9 aa, Influenza virus
NGTKINTLT

SEQ ID NO: 450340 - protein, 9 aa, Influenza virus
NGTKVDTLT

SEQ ID NO: 450341 - protein, 9 aa, Influenza virus
NGTKVNTLT

SEQ ID NO: 450342 - protein, 9 aa, Influenza virus
NGTLVKTIT

SEQ ID NO: 450343 - protein, 9 aa, Influenza virus
NGTMHDRSP

SEQ ID NO: 450344 - protein, 9 aa, Influenza virus
NGTMKDRSP

SEQ ID NO: 450345 - protein, 9 aa, Influenza virus
NGTMVKTLA

SEQ ID NO: 450346 - protein, 9 aa, Influenza virus
NGTMVKTLT

SEQ ID NO: 450347 - protein, 9 aa, Influenza virus
NGTRVNTLT

SEQ ID NO: 450348 - protein, 9 aa, Influenza virus
NGTSKIKMK

SEQ ID NO: 450349 - protein, 9 aa, Influenza virus
NGTSKVKMK

SEQ ID NO: 450350 - protein, 9 aa, Influenza virus
NGTSVKTLT

SEQ ID NO: 450351 - protein, 9 aa, Influenza virus
NGTTGNPII

SEQ ID NO: 450352 - protein, 9 aa, Influenza virus
NGTTHDRTA

SEQ ID NO: 450353 - protein, 9 aa, Influenza virus
NGTTVKTLT

SEQ ID NO: 450354 - protein, 9 aa, Influenza virus
NGTVKDRSP

SEQ ID NO: 450355 - protein, 9 aa, Influenza virus
NGTVNDRSP

SEQ ID NO: 450356 - protein, 9 aa, Influenza virus
NGTVVKTIT

SEQ ID NO: 450357 - protein, 9 aa, Influenza virus
NGTVVKTLT

SEQ ID NO: 450358 - protein, 9 aa, Influenza virus
NGTWAVVMT

SEQ ID NO: 450359 - protein, 9 aa, Influenza virus
NGTYDHKDY

SEQ ID NO: 450360 - protein, 9 aa, Influenza virus
NGTYDHKEF

SEQ ID NO: 450361 - protein, 9 aa, Influenza virus
NGTYDHKEY

SEQ ID NO: 450362 - protein, 9 aa, Influenza virus
NGTYDHNIY

SEQ ID NO: 450363 - protein, 9 aa, Influenza virus
NGTYDYPHY

SEQ ID NO: 450364 - protein, 9 aa, Influenza virus
NGTYDYPKY

SEQ ID NO: 450365 - protein, 9 aa, Influenza virus
NGTYDYPQY

SEQ ID NO: 450366 - protein, 9 aa, Influenza virus
NGTYDYPRY

SEQ ID NO: 450367 - protein, 9 aa, Influenza virus
NGTYDYSKY

SEQ ID NO: 450368 - protein, 9 aa, Influenza virus
NGTYNHEDY

SEQ ID NO: 450369 - protein, 9 aa, Influenza virus
NGTYNHKDY

SEQ ID NO: 450370 - protein, 9 aa, Influenza virus
NGTYNHKEY

SEQ ID NO: 450371 - protein, 9 aa, Influenza virus
NGTYNRKEY

SEQ ID NO: 450372 - protein, 9 aa, Influenza virus
NGTYNYPKY

SEQ ID NO: 450373 - protein, 9 aa, Influenza virus
NGTYNYPQY

SEQ ID NO: 450374 - protein, 9 aa, Influenza virus
NGTYNYSKY

SEQ ID NO: 450375 - protein, 9 aa, Influenza virus
NGTYSYPQY

SEQ ID NO: 450376 - protein, 9 aa, Influenza virus
NGTYYYPKY

SEQ ID NO: 450377 - protein, 9 aa, Influenza virus
NGVCPVVFT

SEQ ID NO: 450378 - protein, 9 aa, Influenza virus
NGVILEENT

SEQ ID NO: 450379 - protein, 9 aa, Influenza virus
NGVITDTLK

SEQ ID NO: 450380 - protein, 9 aa, Influenza virus
NGVKGFAYL

SEQ ID NO: 450381 - protein, 9 aa, Influenza virus
NGVKGFSYL

SEQ ID NO: 450382 - protein, 9 aa, Influenza virus
NGVKLEENS

SEQ ID NO: 450383 - protein, 9 aa, Influenza virus
NGVKLEENT

SEQ ID NO: 450384 - protein, 9 aa, Influenza virus
NGVKVDGSS

SEQ ID NO: 450385 - protein, 9 aa, Influenza virus
NGVPVTSSI

SEQ ID NO: 450386 - protein, 9 aa, Influenza virus
NGVPVTSSV

SEQ ID NO: 450387 - protein, 9 aa, Influenza virus
NGVQDIIDN

SEQ ID NO: 450388 - protein, 9 aa, Influenza virus
NGVRLEENT

SEQ ID NO: 450389 - protein, 9 aa, Influenza virus
NGVSPIHLG

SEQ ID NO: 450390 - protein, 9 aa, Influenza virus
NGVSPVHLG

SEQ ID NO: 450391 - protein, 9 aa, Influenza virus
NGVTNKVNS

SEQ ID NO: 450392 - protein, 9 aa, Influenza virus
NGVWIGRTK

SEQ ID NO: 450393 - protein, 9 aa, Influenza virus
NGVWMGRTK

SEQ ID NO: 450394 - protein, 9 aa, Influenza virus
NGWEGLIDG

SEQ ID NO: 450395 - protein, 9 aa, Influenza virus
NGWEGLING

SEQ ID NO: 450396 - protein, 9 aa, Influenza virus
NGWEGLVDG

SEQ ID NO: 450397 - protein, 9 aa, Influenza virus
NGWEGMIDG

SEQ ID NO: 450398 - protein, 9 aa, Influenza virus
NGWEGMMDG

SEQ ID NO: 450399 - protein, 9 aa, Influenza virus
NGWEGMVDG

SEQ ID NO: 450400 - protein, 9 aa, Influenza virus
NGWEGMVNG

SEQ ID NO: 450401 - protein, 9 aa, Influenza virus
NGWQGLIDG

SEQ ID NO: 450402 - protein, 9 aa, Influenza virus
NGWVSTDKD

SEQ ID NO: 450403 - protein, 9 aa, Influenza virus
NGWVSTDKN

SEQ ID NO: 450404 - protein, 9 aa, Influenza virus
NGWVTADKD

SEQ ID NO: 450405 - protein, 9 aa, Influenza virus
NGWYGFQHQ

SEQ ID NO: 450406 - protein, 9 aa, Influenza virus
NGWYGFQHR

SEQ ID NO: 450407 - protein, 9 aa, Influenza virus
NGWYGFRHQ

SEQ ID NO: 450408 - protein, 9 aa, Influenza virus
NGYCFTVMT

SEQ ID NO: 450409 - protein, 9 aa, Influenza virus
NGYIEGKLS

SEQ ID NO: 450410 - protein, 9 aa, Influenza virus
NGYKDVILW

SEQ ID NO: 450411 - protein, 9 aa, Influenza virus
NHEDYKEES

SEQ ID NO: 450412 - protein, 9 aa, Influenza virus
NHEDYREES

SEQ ID NO: 450413 - protein, 9 aa, Influenza virus
NHEGEGIPL

SEQ ID NO: 450414 - protein, 9 aa, Influenza virus
NHGICAVAT

SEQ ID NO: 450415 - protein, 9 aa, Influenza virus
NHGSLVLSL

SEQ ID NO: 450416 - protein, 9 aa, Influenza virus
NHGVKGWAF

SEQ ID NO: 450417 - protein, 9 aa, Influenza virus
NHKDYEEEA

SEQ ID NO: 450418 - protein, 9 aa, Influenza virus
NHKEYEEEA

SEQ ID NO: 450419 - protein, 9 aa, Influenza virus
NHLIGKTNQ

SEQ ID NO: 450420 - protein, 9 aa, Influenza virus
NHQFELIDN

SEQ ID NO: 450421 - protein, 9 aa, Influenza virus
NHSMSDIEA

SEQ ID NO: 450422 - protein, 9 aa, Influenza virus
NHSNGTIHD

SEQ ID NO: 450423 - protein, 9 aa, Influenza virus
NHTDELCPS

SEQ ID NO: 450424 - protein, 9 aa, Influenza virus
NHTEYRQEA

SEQ ID NO: 450425 - protein, 9 aa, Influenza virus
NHTGTYCSL

SEQ ID NO: 450426 - protein, 9 aa, Influenza virus
NHTTINNIT

SEQ ID NO: 450427 - protein, 9 aa, Influenza virus
NHVEVVSAK

SEQ ID NO: 450428 - protein, 9 aa, Influenza virus
NIAEYSIDS

SEQ ID NO: 450429 - protein, 9 aa, Influenza virus
NIAPEKVDF

SEQ ID NO: 450430 - protein, 9 aa, Influenza virus
NICEKLEQS

SEQ ID NO: 450431 - protein, 9 aa, Influenza virus
NICKPYIGK

SEQ ID NO: 450432 - protein, 9 aa, Influenza virus
NIDKNALGD

SEQ ID NO: 450433 - protein, 9 aa, Influenza virus
NIDKNALGE

SEQ ID NO: 450434 - protein, 9 aa, Influenza virus
NIDRFLRVR

SEQ ID NO: 450435 - protein, 9 aa, Influenza virus
NIDRNAIGD

SEQ ID NO: 450436 - protein, 9 aa, Influenza virus
NIDRNALGD

SEQ ID NO: 450437 - protein, 9 aa, Influenza virus
NIDSRAVGK

SEQ ID NO: 450438 - protein, 9 aa, Influenza virus
NIDSWAVGR

SEQ ID NO: 450439 - protein, 9 aa, Influenza virus
NIECVCRDN

SEQ ID NO: 450440 - protein, 9 aa, Influenza virus
NIEKNALGD

SEQ ID NO: 450441 - protein, 9 aa, Influenza virus
NIERNALGD

SEQ ID NO: 450442 - protein, 9 aa, Influenza virus
NIERNALGN

SEQ ID NO: 450443 - protein, 9 aa, Influenza virus
NIESNGNLI

SEQ ID NO: 450444 - protein, 9 aa, Influenza virus
NIFNMERIK

SEQ ID NO: 450445 - protein, 9 aa, Influenza virus
NIGLNVSLH

SEQ ID NO: 450446 - protein, 9 aa, Influenza virus
NIGPRALVR

SEQ ID NO: 450447 - protein, 9 aa, Influenza virus
NIGPRPFVR

SEQ ID NO: 450448 - protein, 9 aa, Influenza virus
NIGPRPLIR

SEQ ID NO: 450449 - protein, 9 aa, Influenza virus
NIGPRPLVM

SEQ ID NO: 450450 - protein, 9 aa, Influenza virus
NIGPRPLVR

SEQ ID NO: 450451 - protein, 9 aa, Influenza virus
NIGSRPRVR

SEQ ID NO: 450452 - protein, 9 aa, Influenza virus
NIHPLAIGE

SEQ ID NO: 450453 - protein, 9 aa, Influenza virus
NIHPLTIGE

SEQ ID NO: 450454 - protein, 9 aa, Influenza virus
NIHPLTIGK

SEQ ID NO: 450455 - protein, 9 aa, Influenza virus
NIIDKMNGN

SEQ ID NO: 450456 - protein, 9 aa, Influenza virus
NIIEKMNGN

SEQ ID NO: 450457 - protein, 9 aa, Influenza virus
NIIFLWGIH

SEQ ID NO: 450458 - protein, 9 aa, Influenza virus
NIIFSHNGG

SEQ ID NO: 450459 - protein, 9 aa, Influenza virus
NIKSLKLAT

SEQ ID NO: 450460 - protein, 9 aa, Influenza virus
NILEKTHNG

SEQ ID NO: 450461 - protein, 9 aa, Influenza virus
NILITQESE

SEQ ID NO: 450462 - protein, 9 aa, Influenza virus
NILKGKFQT

SEQ ID NO: 450463 - protein, 9 aa, Influenza virus
NILKTQESE

SEQ ID NO: 450464 - protein, 9 aa, Influenza virus
NILLHIASI

SEQ ID NO: 450465 - protein, 9 aa, Influenza virus
NILLHIVSI

SEQ ID NO: 450466 - protein, 9 aa, Influenza virus
NILLHVASI

SEQ ID NO: 450467 - protein, 9 aa, Influenza virus
NILLSPEEV

SEQ ID NO: 450468 - protein, 9 aa, Influenza virus
NILRTQDSE

SEQ ID NO: 450469 - protein, 9 aa, Influenza virus
NILRTQESE

SEQ ID NO: 450470 - protein, 9 aa, Influenza virus
NILRTQESS

SEQ ID NO: 450471 - protein, 9 aa, Influenza virus
NILSIAPIM

SEQ ID NO: 450472 - protein, 9 aa, Influenza virus
NILSMAPIM

SEQ ID NO: 450473 - protein, 9 aa, Influenza virus
NIMASQGTK

SEQ ID NO: 450474 - protein, 9 aa, Influenza virus
NIMRTQESE

SEQ ID NO: 450475 - protein, 9 aa, Influenza virus
NINFMPYIS

SEQ ID NO: 450476 - protein, 9 aa, Influenza virus
NINIREWSY

SEQ ID NO: 450477 - protein, 9 aa, Influenza virus
NINPVKLSS

SEQ ID NO: 450478 - protein, 9 aa, Influenza virus
NINPVTLSS

SEQ ID NO: 450479 - protein, 9 aa, Influenza virus
NINRITYGA

SEQ ID NO: 450480 - protein, 9 aa, Influenza virus
NINSVKLSS

SEQ ID NO: 450481 - protein, 9 aa, Influenza virus
NIPEKQTRG

SEQ ID NO: 450482 - protein, 9 aa, Influenza virus
NIPERQTRG

SEQ ID NO: 450483 - protein, 9 aa, Influenza virus
NIPGKQAKG

SEQ ID NO: 450484 - protein, 9 aa, Influenza virus
NIPQIESRG

SEQ ID NO: 450485 - protein, 9 aa, Influenza virus
NIPSIQSRG

SEQ ID NO: 450486 - protein, 9 aa, Influenza virus
NIPSVQSRG

SEQ ID NO: 450487 - protein, 9 aa, Influenza virus
NIPVTQTME

SEQ ID NO: 450488 - protein, 9 aa, Influenza virus
NIPVTQVEE

SEQ ID NO: 450489 - protein, 9 aa, Influenza virus
NIQFEAVGR

SEQ ID NO: 450490 - protein, 9 aa, Influenza virus
NIQFTAVGK

SEQ ID NO: 450491 - protein, 9 aa, Influenza virus
NIQFTSVGK

SEQ ID NO: 450492 - protein, 9 aa, Influenza virus
NIREWSYLI

SEQ ID NO: 450493 - protein, 9 aa, Influenza virus
NIRIGSKGD

SEQ ID NO: 450494 - protein, 9 aa, Influenza virus
NIRNLHIPE

SEQ ID NO: 450495 - protein, 9 aa, Influenza virus
NISSRSGFE

SEQ ID NO: 450496 - protein, 9 aa, Influenza virus
NITAASLND

SEQ ID NO: 450497 - protein, 9 aa, Influenza virus
NITEIVYLN

SEQ ID NO: 450498 - protein, 9 aa, Influenza virus
NITFSDNGG

SEQ ID NO: 450499 - protein, 9 aa, Influenza virus
NITFSHNGG

SEQ ID NO: 450500 - protein, 9 aa, Influenza virus
NITKIVYLN

SEQ ID NO: 450501 - protein, 9 aa, Influenza virus
NITVTHAQD

SEQ ID NO: 450502 - protein, 9 aa, Influenza virus
NITVTHSVE

SEQ ID NO: 450503 - protein, 9 aa, Influenza virus
NITVTHSVN

SEQ ID NO: 450504 - protein, 9 aa, Influenza virus
NITVTSSVE

SEQ ID NO: 450505 - protein, 9 aa, Influenza virus
NIVDKMNRE

SEQ ID NO: 450506 - protein, 9 aa, Influenza virus
NIVRRAAVS

SEQ ID NO: 450507 - protein, 9 aa, Influenza virus
NIVRRAIVS

SEQ ID NO: 450508 - protein, 9 aa, Influenza virus
NIVRRATVS

SEQ ID NO: 450509 - protein, 9 aa, Influenza virus
NIWAYNAEL

SEQ ID NO: 450510 - protein, 9 aa, Influenza virus
NIWITREPY

SEQ ID NO: 450511 - protein, 9 aa, Influenza virus
NIWSYNAQL

SEQ ID NO: 450512 - protein, 9 aa, Influenza virus
NIYKILSIY

SEQ ID NO: 450513 - protein, 9 aa, Influenza virus
NIYRDEAIN

SEQ ID NO: 450514 - protein, 9 aa, Influenza virus
NKACELTDS

SEQ ID NO: 450515 - protein, 9 aa, Influenza virus
NKADHRIYW

SEQ ID NO: 450516 - protein, 9 aa, Influenza virus
NKCIERVRN

SEQ ID NO: 450517 - protein, 9 aa, Influenza virus
NKCIESIRN

SEQ ID NO: 450518 - protein, 9 aa, Influenza virus
NKCMETIKN

SEQ ID NO: 450519 - protein, 9 aa, Influenza virus
NKCYQFALG

SEQ ID NO: 450520 - protein, 9 aa, Influenza virus
NKDGDIIFL

SEQ ID NO: 450521 - protein, 9 aa, Influenza virus
NKFAAICTH

SEQ ID NO: 450522 - protein, 9 aa, Influenza virus
NKFASICTH

SEQ ID NO: 450523 - protein, 9 aa, Influenza virus
NKHSNDTIH

SEQ ID NO: 450524 - protein, 9 aa, Influenza virus
NKHSNDTVH

SEQ ID NO: 450525 - protein, 9 aa, Influenza virus
NKHSNGTIH

SEQ ID NO: 450526 - protein, 9 aa, Influenza virus
NKHSNGTKH

SEQ ID NO: 450527 - protein, 9 aa, Influenza virus
NKHSNGTTH

SEQ ID NO: 450528 - protein, 9 aa, Influenza virus
NKHSNSTTH

SEQ ID NO: 450529 - protein, 9 aa, Influenza virus
NKHWSGYSG

SEQ ID NO: 450530 - protein, 9 aa, Influenza virus
NKIEFEPFQ

SEQ ID NO: 450531 - protein, 9 aa, Influenza virus
NKINNIVDK

SEQ ID NO: 450532 - protein, 9 aa, Influenza virus
NKITNKVNN

SEQ ID NO: 450533 - protein, 9 aa, Influenza virus
NKITYGACP

SEQ ID NO: 450534 - protein, 9 aa, Influenza virus
NKKIDDGFL

SEQ ID NO: 450535 - protein, 9 aa, Influenza virus
NKKMEDGFL

SEQ ID NO: 450536 - protein, 9 aa, Influenza virus
NKKVDDGFI

SEQ ID NO: 450537 - protein, 9 aa, Influenza virus
NKKVDDGFL

SEQ ID NO: 450538 - protein, 9 aa, Influenza virus
NKKVDDGLL

SEQ ID NO: 450539 - protein, 9 aa, Influenza virus
NKKYGPALS

SEQ ID NO: 450540 - protein, 9 aa, Influenza virus
NKLAAICTH

SEQ ID NO: 450541 - protein, 9 aa, Influenza virus
NKLEFEPFQ

SEQ ID NO: 450542 - protein, 9 aa, Influenza virus
NKLFERVRR

SEQ ID NO: 450543 - protein, 9 aa, Influenza virus
NKLITVGSS

SEQ ID NO: 450544 - protein, 9 aa, Influenza virus
NKLNNVIDK

SEQ ID NO: 450545 - protein, 9 aa, Influenza virus
NKLYEKVRR

SEQ ID NO: 450546 - protein, 9 aa, Influenza virus
NKLYERVKR

SEQ ID NO: 450547 - protein, 9 aa, Influenza virus
NKLYERVRK

SEQ ID NO: 450548 - protein, 9 aa, Influenza virus
NKLYERVRR

SEQ ID NO: 450549 - protein, 9 aa, Influenza virus
NKLYGAGNK

SEQ ID NO: 450550 - protein, 9 aa, Influenza virus
NKLYGTGNK

SEQ ID NO: 450551 - protein, 9 aa, Influenza virus
NKLYVNKNP

SEQ ID NO: 450552 - protein, 9 aa, Influenza virus
NKMARLGKG

SEQ ID NO: 450553 - protein, 9 aa, Influenza virus
NKMARLGRG

SEQ ID NO: 450554 - protein, 9 aa, Influenza virus
NKMEFEPFQ

SEQ ID NO: 450555 - protein, 9 aa, Influenza virus
NKMNTQFEA

SEQ ID NO: 450556 - protein, 9 aa, Influenza virus
NKNATATVY

SEQ ID NO: 450557 - protein, 9 aa, Influenza virus
NKNEIKGVK

SEQ ID NO: 450558 - protein, 9 aa, Influenza virus
NKNPYTLVS

SEQ ID NO: 450559 - protein, 9 aa, Influenza virus
NKNWSGYSG

SEQ ID NO: 450560 - protein, 9 aa, Influenza virus
NKPFQNVNK

SEQ ID NO: 450561 - protein, 9 aa, Influenza virus
NKQASYKIF

SEQ ID NO: 450562 - protein, 9 aa, Influenza virus
NKQFELIDN

SEQ ID NO: 450563 - protein, 9 aa, Influenza virus
NKRLCKVEG

SEQ ID NO: 450564 - protein, 9 aa, Influenza virus
NKRMEDGFL

SEQ ID NO: 450565 - protein, 9 aa, Influenza virus
NKRMEDGLL

SEQ ID NO: 450566 - protein, 9 aa, Influenza virus
NKRMENGFL

SEQ ID NO: 450567 - protein, 9 aa, Influenza virus
NKRMQDGFL

SEQ ID NO: 450568 - protein, 9 aa, Influenza virus
NKRMQDGFM

SEQ ID NO: 450569 - protein, 9 aa, Influenza virus
NKRYGPALS

SEQ ID NO: 450570 - protein, 9 aa, Influenza virus
NKSLCKIEG

SEQ ID NO: 450571 - protein, 9 aa, Influenza virus
NKSLCKVEG

SEQ ID NO: 450572 - protein, 9 aa, Influenza virus
NKSLCNVEG

SEQ ID NO: 450573 - protein, 9 aa, Influenza virus
NKSLCSVEG

SEQ ID NO: 450574 - protein, 9 aa, Influenza virus
NKTFQNIDK

SEQ ID NO: 450575 - protein, 9 aa, Influenza virus
NKTFQNIDR

SEQ ID NO: 450576 - protein, 9 aa, Influenza virus
NKTFQNIEK

SEQ ID NO: 450577 - protein, 9 aa, Influenza virus
NKTFQNIER

SEQ ID NO: 450578 - protein, 9 aa, Influenza virus
NKTFQNISP

SEQ ID NO: 450579 - protein, 9 aa, Influenza virus
NKTFQNVSP

SEQ ID NO: 450580 - protein, 9 aa, Influenza virus
NKTGTFEFT

SEQ ID NO: 450581 - protein, 9 aa, Influenza virus
NKTKKMTIT

SEQ ID NO: 450582 - protein, 9 aa, Influenza virus
NKTVINNIT

SEQ ID NO: 450583 - protein, 9 aa, Influenza virus
NKVARLGKG

SEQ ID NO: 450584 - protein, 9 aa, Influenza virus
NKVCTKGKK

SEQ ID NO: 450585 - protein, 9 aa, Influenza virus
NKVEFEPFQ

SEQ ID NO: 450586 - protein, 9 aa, Influenza virus
NKVKEIGNG

SEQ ID NO: 450587 - protein, 9 aa, Influenza virus
NKVNNIVDK

SEQ ID NO: 450588 - protein, 9 aa, Influenza virus
NKVNSIIDK

SEQ ID NO: 450589 - protein, 9 aa, Influenza virus
NKVNSIIEK

SEQ ID NO: 450590 - protein, 9 aa, Influenza virus
NKVNSIIGK

SEQ ID NO: 450591 - protein, 9 aa, Influenza virus
NKVNSIINK

SEQ ID NO: 450592 - protein, 9 aa, Influenza virus
NKVNSVIEK

SEQ ID NO: 450593 - protein, 9 aa, Influenza virus
NKVNSVVEK

SEQ ID NO: 450594 - protein, 9 aa, Influenza virus
NKVRMQLRD

SEQ ID NO: 450595 - protein, 9 aa, Influenza virus
NKWGDILDG

SEQ ID NO: 450596 - protein, 9 aa, Influenza virus
NKWGNVLDG

SEQ ID NO: 450597 - protein, 9 aa, Influenza virus
NKYLEEHPN

SEQ ID NO: 450598 - protein, 9 aa, Influenza virus
NKYLEEHPS

SEQ ID NO: 450599 - protein, 9 aa, Influenza virus
NKYVNNTTI

SEQ ID NO: 450600 - protein, 9 aa, Influenza virus
NLAFNAVIH

SEQ ID NO: 450601 - protein, 9 aa, Influenza virus
NLALDIVDS

SEQ ID NO: 450602 - protein, 9 aa, Influenza virus
NLCQVECVC

SEQ ID NO: 450603 - protein, 9 aa, Influenza virus
NLCRFLETR

SEQ ID NO: 450604 - protein, 9 aa, Influenza virus
NLCYPGSLN

SEQ ID NO: 450605 - protein, 9 aa, Influenza virus
NLDLNMGQP

SEQ ID NO: 450606 - protein, 9 aa, Influenza virus
NLDYQIGYV

SEQ ID NO: 450607 - protein, 9 aa, Influenza virus
NLEELRFVF

SEQ ID NO: 450608 - protein, 9 aa, Influenza virus
NLEKRLENL

SEQ ID NO: 450609 - protein, 9 aa, Influenza virus
NLEPGTFDI

SEQ ID NO: 450610 - protein, 9 aa, Influenza virus
NLEPGTFDL

SEQ ID NO: 450611 - protein, 9 aa, Influenza virus
NLERRLENL

SEQ ID NO: 450612 - protein, 9 aa, Influenza virus
NLFDEVKRR

SEQ ID NO: 450613 - protein, 9 aa, Influenza virus
NLFDEVRRR

SEQ ID NO: 450614 - protein, 9 aa, Influenza virus
NLFEKFFPS

SEQ ID NO: 450615 - protein, 9 aa, Influenza virus
NLGKVECVC

SEQ ID NO: 450616 - protein, 9 aa, Influenza virus
NLGLNIGIH

SEQ ID NO: 450617 - protein, 9 aa, Influenza virus
NLGLNIGLH

SEQ ID NO: 450618 - protein, 9 aa, Influenza virus
NLGLNVGLH

SEQ ID NO: 450619 - protein, 9 aa, Influenza virus
NLGQVECVC

SEQ ID NO: 450620 - protein, 9 aa, Influenza virus
NLHAYISFR

SEQ ID NO: 450621 - protein, 9 aa, Influenza virus
NLHIPEAGL

SEQ ID NO: 450622 - protein, 9 aa, Influenza virus
NLHIPEVCL

SEQ ID NO: 450623 - protein, 9 aa, Influenza virus
NLIAPEFGY

SEQ ID NO: 450624 - protein, 9 aa, Influenza virus
NLIAPEYGF

SEQ ID NO: 450625 - protein, 9 aa, Influenza virus
NLIAPEYGH

SEQ ID NO: 450626 - protein, 9 aa, Influenza virus
NLIAPEYGY

SEQ ID NO: 450627 - protein, 9 aa, Influenza virus
NLIAPLYGH

SEQ ID NO: 450628 - protein, 9 aa, Influenza virus
NLIAPRGHY

SEQ ID NO: 450629 - protein, 9 aa, Influenza virus
NLIAPRGYF

SEQ ID NO: 450630 - protein, 9 aa, Influenza virus
NLIAPRGYY

SEQ ID NO: 450631 - protein, 9 aa, Influenza virus
NLIAPWFGH

SEQ ID NO: 450632 - protein, 9 aa, Influenza virus
NLIAPWYAF

SEQ ID NO: 450633 - protein, 9 aa, Influenza virus
NLIAPWYAY

SEQ ID NO: 450634 - protein, 9 aa, Influenza virus
NLIAPWYGH

SEQ ID NO: 450635 - protein, 9 aa, Influenza virus
NLIAPWYGY

SEQ ID NO: 450636 - protein, 9 aa, Influenza virus
NLIFNAVIH

SEQ ID NO: 450637 - protein, 9 aa, Influenza virus
NLIFNTVIH

SEQ ID NO: 450638 - protein, 9 aa, Influenza virus
NLIGKTSWS

SEQ ID NO: 450639 - protein, 9 aa, Influenza virus
NLIIERREG

SEQ ID NO: 450640 - protein, 9 aa, Influenza virus
NLIIERSEG

SEQ ID NO: 450641 - protein, 9 aa, Influenza virus
NLIIGISNV

SEQ ID NO: 450642 - protein, 9 aa, Influenza virus
NLIVERREG

SEQ ID NO: 450643 - protein, 9 aa, Influenza virus
NLIVFNTIG

SEQ ID NO: 450644 - protein, 9 aa, Influenza virus
NLKLATGLR

SEQ ID NO: 450645 - protein, 9 aa, Influenza virus
NLLENLQAY

SEQ ID NO: 450646 - protein, 9 aa, Influenza virus
NLLHKCNDS

SEQ ID NO: 450647 - protein, 9 aa, Influenza virus
NLLIGISNI

SEQ ID NO: 450648 - protein, 9 aa, Influenza virus
NLLIGISNM

SEQ ID NO: 450649 - protein, 9 aa, Influenza virus
NLLIGISNV

SEQ ID NO: 450650 - protein, 9 aa, Influenza virus
NLLIGVSNV

SEQ ID NO: 450651 - protein, 9 aa, Influenza virus
NLNDATYQR

SEQ ID NO: 450652 - protein, 9 aa, Influenza virus
NLNDTTYQR

SEQ ID NO: 450653 - protein, 9 aa, Influenza virus
NLNKKIDDG

SEQ ID NO: 450654 - protein, 9 aa, Influenza virus
NLNKKMEDG

SEQ ID NO: 450655 - protein, 9 aa, Influenza virus
NLNKKVDDG

SEQ ID NO: 450656 - protein, 9 aa, Influenza virus
NLNKKVEDG

SEQ ID NO: 450657 - protein, 9 aa, Influenza virus
NLNKRMEDG

SEQ ID NO: 450658 - protein, 9 aa, Influenza virus
NLNKRMENG

SEQ ID NO: 450659 - protein, 9 aa, Influenza virus
NLNKRMQDG

SEQ ID NO: 450660 - protein, 9 aa, Influenza virus
NLNKRVDDG

SEQ ID NO: 450661 - protein, 9 aa, Influenza virus
NLNRKMEDG

SEQ ID NO: 450662 - protein, 9 aa, Influenza virus
NLNRKVDDG

SEQ ID NO: 450663 - protein, 9 aa, Influenza virus
NLNWSGYSG

SEQ ID NO: 450664 - protein, 9 aa, Influenza virus
NLPFQNINS

SEQ ID NO: 450665 - protein, 9 aa, Influenza virus
NLPFQNVHP

SEQ ID NO: 450666 - protein, 9 aa, Influenza virus
NLPFQNVNS

SEQ ID NO: 450667 - protein, 9 aa, Influenza virus
NLQAYQKRM

SEQ ID NO: 450668 - protein, 9 aa, Influenza virus
NLQTYQKRM

SEQ ID NO: 450669 - protein, 9 aa, Influenza virus
NLSGYSGSF

SEQ ID NO: 450670 - protein, 9 aa, Influenza virus
NLSKRMEDG

SEQ ID NO: 450671 - protein, 9 aa, Influenza virus
NLSPRTVGQ

SEQ ID NO: 450672 - protein, 9 aa, Influenza virus
NLTKELCTI

SEQ ID NO: 450673 - protein, 9 aa, Influenza virus
NLTKGLCTI

SEQ ID NO: 450674 - protein, 9 aa, Influenza virus
NLTKINNGD

SEQ ID NO: 450675 - protein, 9 aa, Influenza virus
NLTKRLCTI

SEQ ID NO: 450676 - protein, 9 aa, Influenza virus
NLTKTNNGD

SEQ ID NO: 450677 - protein, 9 aa, Influenza virus
NLTKVNNGD

SEQ ID NO: 450678 - protein, 9 aa, Influenza virus
NLTKVNNGN

SEQ ID NO: 450679 - protein, 9 aa, Influenza virus
NLTKVNSGD

SEQ ID NO: 450680 - protein, 9 aa, Influenza virus
NLTRELCTI

SEQ ID NO: 450681 - protein, 9 aa, Influenza virus
NLTRGLCTI

SEQ ID NO: 450682 - protein, 9 aa, Influenza virus
NLVAPEYGF

SEQ ID NO: 450683 - protein, 9 aa, Influenza virus
NLVAPRGHY

SEQ ID NO: 450684 - protein, 9 aa, Influenza virus
NLVAPRGYF

SEQ ID NO: 450685 - protein, 9 aa, Influenza virus
NLVAPWYAY

SEQ ID NO: 450686 - protein, 9 aa, Influenza virus
NLVAPWYGH

SEQ ID NO: 450687 - protein, 9 aa, Influenza virus
NLVFNTVIH

SEQ ID NO: 450688 - protein, 9 aa, Influenza virus
NLWAYNAEL

SEQ ID NO: 450689 - protein, 9 aa, Influenza virus
NLYASKNPY

SEQ ID NO: 450690 - protein, 9 aa, Influenza virus
NLYDKVRFQ

SEQ ID NO: 450691 - protein, 9 aa, Influenza virus
NLYDKVRHQ

SEQ ID NO: 450692 - protein, 9 aa, Influenza virus
NLYDKVRLQ

SEQ ID NO: 450693 - protein, 9 aa, Influenza virus
NLYDKVRMQ

SEQ ID NO: 450694 - protein, 9 aa, Influenza virus
NLYDRVRKQ

SEQ ID NO: 450695 - protein, 9 aa, Influenza virus
NLYDRVRLQ

SEQ ID NO: 450696 - protein, 9 aa, Influenza virus
NLYDRVRMQ

SEQ ID NO: 450697 - protein, 9 aa, Influenza virus
NLYEKVRLQ

SEQ ID NO: 450698 - protein, 9 aa, Influenza virus
NLYEKVRMQ

SEQ ID NO: 450699 - protein, 9 aa, Influenza virus
NLYERVRKQ

SEQ ID NO: 450700 - protein, 9 aa, Influenza virus
NLYGFIIKG

SEQ ID NO: 450701 - protein, 9 aa, Influenza virus
NLYGFIVKG

SEQ ID NO: 450702 - protein, 9 aa, Influenza virus
NLYNIRNLH

SEQ ID NO: 450703 - protein, 9 aa, Influenza virus
NLYNKVRLQ

SEQ ID NO: 450704 - protein, 9 aa, Influenza virus
NLYNKVRMQ

SEQ ID NO: 450705 - protein, 9 aa, Influenza virus
NLYVNKNPY

SEQ ID NO: 450706 - protein, 9 aa, Influenza virus
NMADYSIDS

SEQ ID NO: 450707 - protein, 9 aa, Influenza virus
NMAPEKIDF

SEQ ID NO: 450708 - protein, 9 aa, Influenza virus
NMAPEKMDF

SEQ ID NO: 450709 - protein, 9 aa, Influenza virus
NMAPEKVDF

SEQ ID NO: 450710 - protein, 9 aa, Influenza virus
NMARAVKLY

SEQ ID NO: 450711 - protein, 9 aa, Influenza virus
NMDKAVKLY

SEQ ID NO: 450712 - protein, 9 aa, Influenza virus
NMDRAVKLY

SEQ ID NO: 450713 - protein, 9 aa, Influenza virus
NMEDYSIDS

SEQ ID NO: 450714 - protein, 9 aa, Influenza virus
NMERIKELR

SEQ ID NO: 450715 - protein, 9 aa, Influenza virus
NMGIYQILA

SEQ ID NO: 450716 - protein, 9 aa, Influenza virus
NMGKVECVC

SEQ ID NO: 450717 - protein, 9 aa, Influenza virus
NMGVYQILA

SEQ ID NO: 450718 - protein, 9 aa, Influenza virus
NMGVYQVLA

SEQ ID NO: 450719 - protein, 9 aa, Influenza virus
NMHDANVRN

SEQ ID NO: 450720 - protein, 9 aa, Influenza virus
NMIADRVDD

SEQ ID NO: 450721 - protein, 9 aa, Influenza virus
NMINDKIDD

SEQ ID NO: 450722 - protein, 9 aa, Influenza virus
NMINDKIND

SEQ ID NO: 450723 - protein, 9 aa, Influenza virus
NMINNDLGP

SEQ ID NO: 450724 - protein, 9 aa, Influenza virus
NMINSKIDD

SEQ ID NO: 450725 - protein, 9 aa, Influenza virus
NMINSKIED

SEQ ID NO: 450726 - protein, 9 aa, Influenza virus
NMINSKIND

SEQ ID NO: 450727 - protein, 9 aa, Influenza virus
NMINSQIDD

SEQ ID NO: 450728 - protein, 9 aa, Influenza virus
NMISDKIDD

SEQ ID NO: 450729 - protein, 9 aa, Influenza virus
NMLADRIDD

SEQ ID NO: 450730 - protein, 9 aa, Influenza virus
NMLADRVDD

SEQ ID NO: 450731 - protein, 9 aa, Influenza virus
NMLADWVDD

SEQ ID NO: 450732 - protein, 9 aa, Influenza virus
NMLSTVLGV

SEQ ID NO: 450733 - protein, 9 aa, Influenza virus
NMNKRMEDG

SEQ ID NO: 450734 - protein, 9 aa, Influenza virus
NMNWSGYSG

SEQ ID NO: 450735 - protein, 9 aa, Influenza virus
NMQNKLNNV

SEQ ID NO: 450736 - protein, 9 aa, Influenza virus
NMQNRLNNV

SEQ ID NO: 450737 - protein, 9 aa, Influenza virus
NMRCTISLV

SEQ ID NO: 450738 - protein, 9 aa, Influenza virus
NMRWLTLKS

SEQ ID NO: 450739 - protein, 9 aa, Influenza virus
NMSKKKSYI

SEQ ID NO: 450740 - protein, 9 aa, Influenza virus
NMSKRKSYI

SEQ ID NO: 450741 - protein, 9 aa, Influenza virus
NMSLNISLY

SEQ ID NO: 450742 - protein, 9 aa, Influenza virus
NMTNVQNNY

SEQ ID NO: 450743 - protein, 9 aa, Influenza virus
NMVDYSIDS

SEQ ID NO: 450744 - protein, 9 aa, Influenza virus
NNADHRIYW

SEQ ID NO: 450745 - protein, 9 aa, Influenza virus
NNADHRVYW

SEQ ID NO: 450746 - protein, 9 aa, Influenza virus
NNAIDEGDG

SEQ ID NO: 450747 - protein, 9 aa, Influenza virus
NNAKDEGNG

SEQ ID NO: 450748 - protein, 9 aa, Influenza virus
NNAKEIGNG

SEQ ID NO: 450749 - protein, 9 aa, Influenza virus
NNAKELGNG

SEQ ID NO: 450750 - protein, 9 aa, Influenza virus
NNAKEVGNG

SEQ ID NO: 450751 - protein, 9 aa, Influenza virus
NNAQEIGNG

SEQ ID NO: 450752 - protein, 9 aa, Influenza virus
NNARELGNG

SEQ ID NO: 450753 - protein, 9 aa, Influenza virus
NNASAIVWY

SEQ ID NO: 450754 - protein, 9 aa, Influenza virus
NNASAVIWY

SEQ ID NO: 450755 - protein, 9 aa, Influenza virus
NNASAVVWY

SEQ ID NO: 450756 - protein, 9 aa, Influenza virus
NNASTVIWY

SEQ ID NO: 450757 - protein, 9 aa, Influenza virus
NNATASFIY

SEQ ID NO: 450758 - protein, 9 aa, Influenza virus
NNATATVYY

SEQ ID NO: 450759 - protein, 9 aa, Influenza virus
NNATDTVDT

SEQ ID NO: 450760 - protein, 9 aa, Influenza virus
NNBNGVKGF

SEQ ID NO: 450761 - protein, 9 aa, Influenza virus
NNCESKCFW

SEQ ID NO: 450762 - protein, 9 aa, Influenza virus
NNCIESIRN

SEQ ID NO: 450763 - protein, 9 aa, Influenza virus
NNCMESIRN

SEQ ID NO: 450764 - protein, 9 aa, Influenza virus
NNDLGPATA

SEQ ID NO: 450765 - protein, 9 aa, Influenza virus
NNDNATATV

SEQ ID NO: 450766 - protein, 9 aa, Influenza virus
NNDWSGYSG

SEQ ID NO: 450767 - protein, 9 aa, Influenza virus
NNECMETIK

SEQ ID NO: 450768 - protein, 9 aa, Influenza virus
NNEDGDIIF

SEQ ID NO: 450769 - protein, 9 aa, Influenza virus
NNEDGNIIF

SEQ ID NO: 450770 - protein, 9 aa, Influenza virus
NNEEGDIIF

SEQ ID NO: 450771 - protein, 9 aa, Influenza virus
NNEGSYFFG

SEQ ID NO: 450772 - protein, 9 aa, Influenza virus
NNEKGNPGV

SEQ ID NO: 450773 - protein, 9 aa, Influenza virus
NNEKGNQGV

SEQ ID NO: 450774 - protein, 9 aa, Influenza virus
NNENATATV

SEQ ID NO: 450775 - protein, 9 aa, Influenza virus
NNENGDIIF

SEQ ID NO: 450776 - protein, 9 aa, Influenza virus
NNEPGSGNW

SEQ ID NO: 450777 - protein, 9 aa, Influenza virus
NNEPSGYAQ

SEQ ID NO: 450778 - protein, 9 aa, Influenza virus
NNEQGSGYA

SEQ ID NO: 450779 - protein, 9 aa, Influenza virus
NNERGNPGV

SEQ ID NO: 450780 - protein, 9 aa, Influenza virus
NNERGNQGV

SEQ ID NO: 450781 - protein, 9 aa, Influenza virus
NNERGTQGV

SEQ ID NO: 450782 - protein, 9 aa, Influenza virus
NNERGYPGV

SEQ ID NO: 450783 - protein, 9 aa, Influenza virus
NNETIIETG

SEQ ID NO: 450784 - protein, 9 aa, Influenza virus
NNETILETG

SEQ ID NO: 450785 - protein, 9 aa, Influenza virus
NNETIVETG

SEQ ID NO: 450786 - protein, 9 aa, Influenza virus
NNFVPVIGA

SEQ ID NO: 450787 - protein, 9 aa, Influenza virus
NNFVPVMGA

SEQ ID NO: 450788 - protein, 9 aa, Influenza virus
NNFVPVVGA

SEQ ID NO: 450789 - protein, 9 aa, Influenza virus
NNFVPVVRA

SEQ ID NO: 450790 - protein, 9 aa, Influenza virus
NNGDYARLY

SEQ ID NO: 450791 - protein, 9 aa, Influenza virus
NNGDYTRLY

SEQ ID NO: 450792 - protein, 9 aa, Influenza virus
NNGELRHLF

SEQ ID NO: 450793 - protein, 9 aa, Influenza virus
NNGKFEFIA

SEQ ID NO: 450794 - protein, 9 aa, Influenza virus
NNGKFEFIV

SEQ ID NO: 450795 - protein, 9 aa, Influenza virus
NNGKGRYGV

SEQ ID NO: 450796 - protein, 9 aa, Influenza virus
NNGKLEFIA

SEQ ID NO: 450797 - protein, 9 aa, Influenza virus
NNGNYARLY

SEQ ID NO: 450798 - protein, 9 aa, Influenza virus
NNGRFEFIA

SEQ ID NO: 450799 - protein, 9 aa, Influenza virus
NNGSCRCTI

SEQ ID NO: 450800 - protein, 9 aa, Influenza virus
NNGVKGFAY

SEQ ID NO: 450801 - protein, 9 aa, Influenza virus
NNGVKGFSY

SEQ ID NO: 450802 - protein, 9 aa, Influenza virus
NNIIDKMNG

SEQ ID NO: 450803 - protein, 9 aa, Influenza virus
NNIIEKMNG

SEQ ID NO: 450804 - protein, 9 aa, Influenza virus
NNIKGRDVL

SEQ ID NO: 450805 - protein, 9 aa, Influenza virus
NNILRTQES

SEQ ID NO: 450806 - protein, 9 aa, Influenza virus
NNIRIGSKG

SEQ ID NO: 450807 - protein, 9 aa, Influenza virus
NNITTTIIA

SEQ ID NO: 450808 - protein, 9 aa, Influenza virus
NNITTTIIT

SEQ ID NO: 450809 - protein, 9 aa, Influenza virus
NNITTTITT

SEQ ID NO: 450810 - protein, 9 aa, Influenza virus
NNITTTIVT

SEQ ID NO: 450811 - protein, 9 aa, Influenza virus
NNIVDKMNR

SEQ ID NO: 450812 - protein, 9 aa, Influenza virus
NNKDGDIIF

SEQ ID NO: 450813 - protein, 9 aa, Influenza virus
NNKHSNGTI

SEQ ID NO: 450814 - protein, 9 aa, Influenza virus
NNKHWSGYS

SEQ ID NO: 450815 - protein, 9 aa, Influenza virus
NNKNATATV

SEQ ID NO: 450816 - protein, 9 aa, Influenza virus
NNKNWSGYS

SEQ ID NO: 450817 - protein, 9 aa, Influenza virus
NNKPFQNVN

SEQ ID NO: 450818 - protein, 9 aa, Influenza virus
NNLEKRLEN

SEQ ID NO: 450819 - protein, 9 aa, Influenza virus
NNLERRLEN

SEQ ID NO: 450820 - protein, 9 aa, Influenza virus
NNLPFQNIN

SEQ ID NO: 450821 - protein, 9 aa, Influenza virus
NNLSGYSGS

SEQ ID NO: 450822 - protein, 9 aa, Influenza virus
NNLTKGLCT

SEQ ID NO: 450823 - protein, 9 aa, Influenza virus
NNLTKRLCT

SEQ ID NO: 450824 - protein, 9 aa, Influenza virus
NNLTRELCT

SEQ ID NO: 450825 - protein, 9 aa, Influenza virus
NNLTRGLCK

SEQ ID NO: 450826 - protein, 9 aa, Influenza virus
NNLTRGLCT

SEQ ID NO: 450827 - protein, 9 aa, Influenza virus
NNMARAVKL

SEQ ID NO: 450828 - protein, 9 aa, Influenza virus
NNMDKAVKL

SEQ ID NO: 450829 - protein, 9 aa, Influenza virus
NNMDRAVKL

SEQ ID NO: 450830 - protein, 9 aa, Influenza virus
NNMINNDLG

SEQ ID NO: 450831 - protein, 9 aa, Influenza virus
NNMTTTIIN

SEQ ID NO: 450832 - protein, 9 aa, Influenza virus
NNNASAIVW

SEQ ID NO: 450833 - protein, 9 aa, Influenza virus
NNNASAVIW

SEQ ID NO: 450834 - protein, 9 aa, Influenza virus
NNNASAVVW

SEQ ID NO: 450835 - protein, 9 aa, Influenza virus
NNNASPVIW

SEQ ID NO: 450836 - protein, 9 aa, Influenza virus
NNNATATVY

SEQ ID NO: 450837 - protein, 9 aa, Influenza virus
NNNGELRHL

SEQ ID NO: 450838 - protein, 9 aa, Influenza virus
NNNGVKGFA

SEQ ID NO: 450839 - protein, 9 aa, Influenza virus
NNNGVKGFS

SEQ ID NO: 450840 - protein, 9 aa, Influenza virus
NNNKGAVFK

SEQ ID NO: 450841 - protein, 9 aa, Influenza virus
NNNLSGYSG

SEQ ID NO: 450842 - protein, 9 aa, Influenza virus
NNNNATATV

SEQ ID NO: 450843 - protein, 9 aa, Influenza virus
NNNNGVKGF

SEQ ID NO: 450844 - protein, 9 aa, Influenza virus
NNNNNTATL

SEQ ID NO: 450845 - protein, 9 aa, Influenza virus
NNNWFGYFG

SEQ ID NO: 450846 - protein, 9 aa, Influenza virus
NNNWSGYSG

SEQ ID NO: 450847 - protein, 9 aa, Influenza virus
NNPGRVSVS

SEQ ID NO: 450848 - protein, 9 aa, Influenza virus
NNPGRVTVS

SEQ ID NO: 450849 - protein, 9 aa, Influenza virus
NNPITGSPG

SEQ ID NO: 450850 - protein, 9 aa, Influenza virus
NNQASYKIF

SEQ ID NO: 450851 - protein, 9 aa, Influenza virus
NNQASYRIF

SEQ ID NO: 450852 - protein, 9 aa, Influenza virus
NNQDWSGYS

SEQ ID NO: 450853 - protein, 9 aa, Influenza virus
NNQNWSGYS

SEQ ID NO: 450854 - protein, 9 aa, Influenza virus
NNQVFPQLN

SEQ ID NO: 450855 - protein, 9 aa, Influenza virus
NNRFQIQGI

SEQ ID NO: 450856 - protein, 9 aa, Influenza virus
NNRFQIQGV

SEQ ID NO: 450857 - protein, 9 aa, Influenza virus
NNRIKINPV

SEQ ID NO: 450858 - protein, 9 aa, Influenza virus
NNRKEPALI

SEQ ID NO: 450859 - protein, 9 aa, Influenza virus
NNRNWSGYS

SEQ ID NO: 450860 - protein, 9 aa, Influenza virus
NNRSGYSGI

SEQ ID NO: 450861 - protein, 9 aa, Influenza virus
NNSCMETIR

SEQ ID NO: 450862 - protein, 9 aa, Influenza virus
NNSKKQIDT

SEQ ID NO: 450863 - protein, 9 aa, Influenza virus
NNSSDTVDT

SEQ ID NO: 450864 - protein, 9 aa, Influenza virus
NNSTATLCL

SEQ ID NO: 450865 - protein, 9 aa, Influenza virus
NNSTDKIDT

SEQ ID NO: 450866 - protein, 9 aa, Influenza virus
NNSTDKVDT

SEQ ID NO: 450867 - protein, 9 aa, Influenza virus
NNSTDKVNT

SEQ ID NO: 450868 - protein, 9 aa, Influenza virus
NNSTDTIDT

SEQ ID NO: 450869 - protein, 9 aa, Influenza virus
NNSTDTVDT

SEQ ID NO: 450870 - protein, 9 aa, Influenza virus
NNSTDTVNT

SEQ ID NO: 450871 - protein, 9 aa, Influenza virus
NNSTEHVDT

SEQ ID NO: 450872 - protein, 9 aa, Influenza virus
NNSTEKIDT

SEQ ID NO: 450873 - protein, 9 aa, Influenza virus
NNSTEKVDT

SEQ ID NO: 450874 - protein, 9 aa, Influenza virus
NNSTEMVDT

SEQ ID NO: 450875 - protein, 9 aa, Influenza virus
NNSTEQVDT

SEQ ID NO: 450876 - protein, 9 aa, Influenza virus
NNSTERVDT

SEQ ID NO: 450877 - protein, 9 aa, Influenza virus
NNSTETVDT

SEQ ID NO: 450878 - protein, 9 aa, Influenza virus
NNSTETVNT

SEQ ID NO: 450879 - protein, 9 aa, Influenza virus
NNSTKKVDT

SEQ ID NO: 450880 - protein, 9 aa, Influenza virus
NNSTKQIDT

SEQ ID NO: 450881 - protein, 9 aa, Influenza virus
NNSTKQVDT

SEQ ID NO: 450882 - protein, 9 aa, Influenza virus
NNSTNTVNT

SEQ ID NO: 450883 - protein, 9 aa, Influenza virus
NNSTTKVDT

SEQ ID NO: 450884 - protein, 9 aa, Influenza virus
NNSTTQIDT

SEQ ID NO: 450885 - protein, 9 aa, Influenza virus
NNSTTQVDT

SEQ ID NO: 450886 - protein, 9 aa, Influenza virus
NNSTTQVNT

SEQ ID NO: 450887 - protein, 9 aa, Influenza virus
NNSTVQVDT

SEQ ID NO: 450888 - protein, 9 aa, Influenza virus
NNSYDHSKY

SEQ ID NO: 450889 - protein, 9 aa, Influenza virus
NNTCMETIR

SEQ ID NO: 450890 - protein, 9 aa, Influenza virus
NNTEPLCDV

SEQ ID NO: 450891 - protein, 9 aa, Influenza virus
NNTEPLCEV

SEQ ID NO: 450892 - protein, 9 aa, Influenza virus
NNTEPLCNV

SEQ ID NO: 450893 - protein, 9 aa, Influenza virus
NNTKGGDVL

SEQ ID NO: 450894 - protein, 9 aa, Influenza virus
NNTKGRDVL

SEQ ID NO: 450895 - protein, 9 aa, Influenza virus
NNTKGRYVL

SEQ ID NO: 450896 - protein, 9 aa, Influenza virus
NNTNGEQIL

SEQ ID NO: 450897 - protein, 9 aa, Influenza virus
NNTSGEQIL

SEQ ID NO: 450898 - protein, 9 aa, Influenza virus
NNTSGEQML

SEQ ID NO: 450899 - protein, 9 aa, Influenza virus
NNTSGEQVL

SEQ ID NO: 450900 - protein, 9 aa, Influenza virus
NNTSGKQML

SEQ ID NO: 450901 - protein, 9 aa, Influenza virus
NNTTGRDVL

SEQ ID NO: 450902 - protein, 9 aa, Influenza virus
NNTTLIENT

SEQ ID NO: 450903 - protein, 9 aa, Influenza virus
NNTTNYYNE

SEQ ID NO: 450904 - protein, 9 aa, Influenza virus
NNTTVVENT

SEQ ID NO: 450905 - protein, 9 aa, Influenza virus
NNTVINNIT

SEQ ID NO: 450906 - protein, 9 aa, Influenza virus
NNTVKDRSP

SEQ ID NO: 450907 - protein, 9 aa, Influenza virus
NNTVVNNIT

SEQ ID NO: 450908 - protein, 9 aa, Influenza virus
NNTWLGRTI

SEQ ID NO: 450909 - protein, 9 aa, Influenza virus
NNTWVNQTF

SEQ ID NO: 450910 - protein, 9 aa, Influenza virus
NNTWVNQTY

SEQ ID NO: 450911 - protein, 9 aa, Influenza virus
NNTYDHAQY

SEQ ID NO: 450912 - protein, 9 aa, Influenza virus
NNTYDHKKY

SEQ ID NO: 450913 - protein, 9 aa, Influenza virus
NNTYDHSHY

SEQ ID NO: 450914 - protein, 9 aa, Influenza virus
NNTYDHSKY

SEQ ID NO: 450915 - protein, 9 aa, Influenza virus
NNTYDHSQY

SEQ ID NO: 450916 - protein, 9 aa, Influenza virus
NNTYDHSRY

SEQ ID NO: 450917 - protein, 9 aa, Influenza virus
NNTYDHSTY

SEQ ID NO: 450918 - protein, 9 aa, Influenza virus
NNTYDHTKY

SEQ ID NO: 450919 - protein, 9 aa, Influenza virus
NNTYDHTQY

SEQ ID NO: 450920 - protein, 9 aa, Influenza virus
NNTYNHTEY

SEQ ID NO: 450921 - protein, 9 aa, Influenza virus
NNTYNHTQY

SEQ ID NO: 450922 - protein, 9 aa, Influenza virus
NNVIDKMNK

SEQ ID NO: 450923 - protein, 9 aa, Influenza virus
NNVIDKMNN

SEQ ID NO: 450924 - protein, 9 aa, Influenza virus
NNVIDKMYK

SEQ ID NO: 450925 - protein, 9 aa, Influenza virus
NNVTVTSSV

SEQ ID NO: 450926 - protein, 9 aa, Influenza virus
NNWFGYFGI

SEQ ID NO: 450927 - protein, 9 aa, Influenza virus
NNWSGYSGI

SEQ ID NO: 450928 - protein, 9 aa, Influenza virus
NNWSGYSGS

SEQ ID NO: 450929 - protein, 9 aa, Influenza virus
NNYEELKHL

SEQ ID NO: 450930 - protein, 9 aa, Influenza virus
NNYGVKGFG

SEQ ID NO: 450931 - protein, 9 aa, Influenza virus
NPAHKSQLI

SEQ ID NO: 450932 - protein, 9 aa, Influenza virus
NPAHKSQLV

SEQ ID NO: 450933 - protein, 9 aa, Influenza virus
NPALRMKWM

SEQ ID NO: 450934 - protein, 9 aa, Influenza virus
NPANGICYP

SEQ ID NO: 450935 - protein, 9 aa, Influenza virus
NPAYCNTDL

SEQ ID NO: 450936 - protein, 9 aa, Influenza virus
NPCFYVELI

SEQ ID NO: 450937 - protein, 9 aa, Influenza virus
NPDPGVKGF

SEQ ID NO: 450938 - protein, 9 aa, Influenza virus
NPEAYNFNE

SEQ ID NO: 450939 - protein, 9 aa, Influenza virus
NPECDRFLS

SEQ ID NO: 450940 - protein, 9 aa, Influenza virus
NPECDRLLN

SEQ ID NO: 450941 - protein, 9 aa, Influenza virus
NPECDRLLR

SEQ ID NO: 450942 - protein, 9 aa, Influenza virus
NPECDRLLS

SEQ ID NO: 450943 - protein, 9 aa, Influenza virus
NPECDRLLT

SEQ ID NO: 450944 - protein, 9 aa, Influenza virus
NPGDSIIFN

SEQ ID NO: 450945 - protein, 9 aa, Influenza virus
NPGNAEIED

SEQ ID NO: 450946 - protein, 9 aa, Influenza virus
NPGRVSVST

SEQ ID NO: 450947 - protein, 9 aa, Influenza virus
NPGRVTVST

SEQ ID NO: 450948 - protein, 9 aa, Influenza virus
NPGVKGWAF

SEQ ID NO: 450949 - protein, 9 aa, Influenza virus
NPIDGPLPD

SEQ ID NO: 450950 - protein, 9 aa, Influenza virus
NPIDGPLPE

SEQ ID NO: 450951 - protein, 9 aa, Influenza virus
NPIDGPLPK

SEQ ID NO: 450952 - protein, 9 aa, Influenza virus
NPIDGPLPV

SEQ ID NO: 450953 - protein, 9 aa, Influenza virus
NPIICLGHH

SEQ ID NO: 450954 - protein, 9 aa, Influenza virus
NPINGICYP

SEQ ID NO: 450955 - protein, 9 aa, Influenza virus
NPITGSPCA

SEQ ID NO: 450956 - protein, 9 aa, Influenza virus
NPITGSPEA

SEQ ID NO: 450957 - protein, 9 aa, Influenza virus
NPITGSPGA

SEQ ID NO: 450958 - protein, 9 aa, Influenza virus
NPITGSPGS

SEQ ID NO: 450959 - protein, 9 aa, Influenza virus
NPITGSPGV

SEQ ID NO: 450960 - protein, 9 aa, Influenza virus
NPITGSPSA

SEQ ID NO: 450961 - protein, 9 aa, Influenza virus
NPIVPSFDM

SEQ ID NO: 450962 - protein, 9 aa, Influenza virus
NPIVPSFEM

SEQ ID NO: 450963 - protein, 9 aa, Influenza virus
NPKCDIHLK

SEQ ID NO: 450964 - protein, 9 aa, Influenza virus
NPKCDIHLR

SEQ ID NO: 450965 - protein, 9 aa, Influenza virus
NPKCDLYLN

SEQ ID NO: 450966 - protein, 9 aa, Influenza virus
NPKCDLYLS

SEQ ID NO: 450967 - protein, 9 aa, Influenza virus
NPKCDPYLN

SEQ ID NO: 450968 - protein, 9 aa, Influenza virus
NPKCDTHLK

SEQ ID NO: 450969 - protein, 9 aa, Influenza virus
NPKCDVHLK

SEQ ID NO: 450970 - protein, 9 aa, Influenza virus
NPKSKLFTL

SEQ ID NO: 450971 - protein, 9 aa, Influenza virus
NPLIKHENR

SEQ ID NO: 450972 - protein, 9 aa, Influenza virus
NPLIRHENR

SEQ ID NO: 450973 - protein, 9 aa, Influenza virus
NPLNPFVGH

SEQ ID NO: 450974 - protein, 9 aa, Influenza virus
NPLNPFVNH

SEQ ID NO: 450975 - protein, 9 aa, Influenza virus
NPLNPFVSH

SEQ ID NO: 450976 - protein, 9 aa, Influenza virus
NPLNPFVTH

SEQ ID NO: 450977 - protein, 9 aa, Influenza virus
NPMCDDLIG

SEQ ID NO: 450978 - protein, 9 aa, Influenza virus
NPMCDELIG

SEQ ID NO: 450979 - protein, 9 aa, Influenza virus
NPMCDNLIG

SEQ ID NO: 450980 - protein, 9 aa, Influenza virus
NPMCDYLIG

SEQ ID NO: 450981 - protein, 9 aa, Influenza virus
NPMHQLLRH

SEQ ID NO: 450982 - protein, 9 aa, Influenza virus
NPMIAELAE

SEQ ID NO: 450983 - protein, 9 aa, Influenza virus
NPMIIELAE

SEQ ID NO: 450984 - protein, 9 aa, Influenza virus
NPMIVELAE

SEQ ID NO: 450985 - protein, 9 aa, Influenza virus
NPMNPFVSH

SEQ ID NO: 450986 - protein, 9 aa, Influenza virus
NPMTVELAE

SEQ ID NO: 450987 - protein, 9 aa, Influenza virus
NPMVVELAE

SEQ ID NO: 450988 - protein, 9 aa, Influenza virus
NPNQKIICI

SEQ ID NO: 450989 - protein, 9 aa, Influenza virus
NPNQKIITI

SEQ ID NO: 450990 - protein, 9 aa, Influenza virus
NPNQKILCA

SEQ ID NO: 450991 - protein, 9 aa, Influenza virus
NPNQKILCT

SEQ ID NO: 450992 - protein, 9 aa, Influenza virus
NPNQKILFA

SEQ ID NO: 450993 - protein, 9 aa, Influenza virus
NPNQKIMCI

SEQ ID NO: 450994 - protein, 9 aa, Influenza virus
NPNQKIQCT

SEQ ID NO: 450995 - protein, 9 aa, Influenza virus
NPNQKITCI

SEQ ID NO: 450996 - protein, 9 aa, Influenza virus
NPNQKIVTI

SEQ ID NO: 450997 - protein, 9 aa, Influenza virus
NPNQKLFAL

SEQ ID NO: 450998 - protein, 9 aa, Influenza virus
NPNQKLFAS

SEQ ID NO: 450999 - protein, 9 aa, Influenza virus
NPNQKLFTL

SEQ ID NO: 451000 - protein, 9 aa, Influenza virus
NPNQKTITI

SEQ ID NO: 451001 - protein, 9 aa, Influenza virus
NPNQMIITI

SEQ ID NO: 451002 - protein, 9 aa, Influenza virus
NPNWSGYSG

SEQ ID NO: 451003 - protein, 9 aa, Influenza virus
NPRCDDLIG

SEQ ID NO: 451004 - protein, 9 aa, Influenza virus
NPRIFLAMI

SEQ ID NO: 451005 - protein, 9 aa, Influenza virus
NPRMFLAMI

SEQ ID NO: 451006 - protein, 9 aa, Influenza virus
NPRVFLAMI

SEQ ID NO: 451007 - protein, 9 aa, Influenza virus
NPRVFLTMI

SEQ ID NO: 451008 - protein, 9 aa, Influenza virus
NPSAGKDPK

SEQ ID NO: 451009 - protein, 9 aa, Influenza virus
NPSCASNIN

SEQ ID NO: 451010 - protein, 9 aa, Influenza virus
NPSCATNIN

SEQ ID NO: 451011 - protein, 9 aa, Influenza virus
NPSHEGEGI

SEQ ID NO: 451012 - protein, 9 aa, Influenza virus
NPSLRMKWM

SEQ ID NO: 451013 - protein, 9 aa, Influenza virus
NPSQKLFAL

SEQ ID NO: 451014 - protein, 9 aa, Influenza virus
NPTEEQAVD

SEQ ID NO: 451015 - protein, 9 aa, Influenza virus
NPTEEQAVE

SEQ ID NO: 451016 - protein, 9 aa, Influenza virus
NPTEEQAVG

SEQ ID NO: 451017 - protein, 9 aa, Influenza virus
NPTEEQAVN

SEQ ID NO: 451018 - protein, 9 aa, Influenza virus
NPTLLFLEV

SEQ ID NO: 451019 - protein, 9 aa, Influenza virus
NPTLLFLKI

SEQ ID NO: 451020 - protein, 9 aa, Influenza virus
NPTLLFLKM

SEQ ID NO: 451021 - protein, 9 aa, Influenza virus
NPTLLFLKV

SEQ ID NO: 451022 - protein, 9 aa, Influenza virus
NPTNGICYP

SEQ ID NO: 451023 - protein, 9 aa, Influenza virus
NPVELSSGY

SEQ ID NO: 451024 - protein, 9 aa, Influenza virus
NPVHKSQLI

SEQ ID NO: 451025 - protein, 9 aa, Influenza virus
NPVICLGHH

SEQ ID NO: 451026 - protein, 9 aa, Influenza virus
NPVICMGHH

SEQ ID NO: 451027 - protein, 9 aa, Influenza virus
NPVKLNSGY

SEQ ID NO: 451028 - protein, 9 aa, Influenza virus
NPVKLSGGY

SEQ ID NO: 451029 - protein, 9 aa, Influenza virus
NPVKLSSGY

SEQ ID NO: 451030 - protein, 9 aa, Influenza virus
NPVKLSSSY

SEQ ID NO: 451031 - protein, 9 aa, Influenza virus
NPVNGICYP

SEQ ID NO: 451032 - protein, 9 aa, Influenza virus
NPVTLSSGY

SEQ ID NO: 451033 - protein, 9 aa, Influenza virus
NPVTLTMGY

SEQ ID NO: 451034 - protein, 9 aa, Influenza virus
NPVVPSFDM

SEQ ID NO: 451035 - protein, 9 aa, Influenza virus
NPYTLVSTK

SEQ ID NO: 451036 - protein, 9 aa, Influenza virus
NQASYKIFK

SEQ ID NO: 451037 - protein, 9 aa, Influenza virus
NQASYRIFK

SEQ ID NO: 451038 - protein, 9 aa, Influenza virus
NQCMESIRN

SEQ ID NO: 451039 - protein, 9 aa, Influenza virus
NQDSFYRSM

SEQ ID NO: 451040 - protein, 9 aa, Influenza virus
NQDWSGYSG

SEQ ID NO: 451041 - protein, 9 aa, Influenza virus
NQEELKSLF

SEQ ID NO: 451042 - protein, 9 aa, Influenza virus
NQEELRFLF

SEQ ID NO: 451043 - protein, 9 aa, Influenza virus
NQEELRSLF

SEQ ID NO: 451044 - protein, 9 aa, Influenza virus
NQEYTSGRQ

SEQ ID NO: 451045 - protein, 9 aa, Influenza virus
NQFALGQGT

SEQ ID NO: 451046 - protein, 9 aa, Influenza virus
NQGSFYRNM

SEQ ID NO: 451047 - protein, 9 aa, Influenza virus
NQGSFYRSI

SEQ ID NO: 451048 - protein, 9 aa, Influenza virus
NQGSFYRSM

SEQ ID NO: 451049 - protein, 9 aa, Influenza virus
NQGVKGWAF

SEQ ID NO: 451050 - protein, 9 aa, Influenza virus
NQHTIDLAD

SEQ ID NO: 451051 - protein, 9 aa, Influenza virus
NQHTIDLAE

SEQ ID NO: 451052 - protein, 9 aa, Influenza virus
NQHTIDLTD

SEQ ID NO: 451053 - protein, 9 aa, Influenza virus
NQHTIDLTN

SEQ ID NO: 451054 - protein, 9 aa, Influenza virus
NQHTIDMAD

SEQ ID NO: 451055 - protein, 9 aa, Influenza virus
NQHTIDMTD

SEQ ID NO: 451056 - protein, 9 aa, Influenza virus
NQHTIDSTD

SEQ ID NO: 451057 - protein, 9 aa, Influenza virus
NQHTIDVTD

SEQ ID NO: 451058 - protein, 9 aa, Influenza virus
NQHTIHLTD

SEQ ID NO: 451059 - protein, 9 aa, Influenza virus
NQIKIRRRV

SEQ ID NO: 451060 - protein, 9 aa, Influenza virus
NQINGKLNR

SEQ ID NO: 451061 - protein, 9 aa, Influenza virus
NQITGKLNR

SEQ ID NO: 451062 - protein, 9 aa, Influenza virus
NQKIICISA

SEQ ID NO: 451063 - protein, 9 aa, Influenza virus
NQKIICIST

SEQ ID NO: 451064 - protein, 9 aa, Influenza virus
NQKIITIDS

SEQ ID NO: 451065 - protein, 9 aa, Influenza virus
NQKIITIGS

SEQ ID NO: 451066 - protein, 9 aa, Influenza virus
NQKIITMGS

SEQ ID NO: 451067 - protein, 9 aa, Influenza virus
NQKILCASA

SEQ ID NO: 451068 - protein, 9 aa, Influenza virus
NQKILCTSA

SEQ ID NO: 451069 - protein, 9 aa, Influenza virus
NQKILDEHD

SEQ ID NO: 451070 - protein, 9 aa, Influenza virus
NQKILFASA

SEQ ID NO: 451071 - protein, 9 aa, Influenza virus
NQKIMCISA

SEQ ID NO: 451072 - protein, 9 aa, Influenza virus
NQKITCISA

SEQ ID NO: 451073 - protein, 9 aa, Influenza virus
NQKIVTIGS

SEQ ID NO: 451074 - protein, 9 aa, Influenza virus
NQKLFALSG

SEQ ID NO: 451075 - protein, 9 aa, Influenza virus
NQKLFASSG

SEQ ID NO: 451076 - protein, 9 aa, Influenza virus
NQKLFTLSG

SEQ ID NO: 451077 - protein, 9 aa, Influenza virus
NQKPLDEHD

SEQ ID NO: 451078 - protein, 9 aa, Influenza virus
NQKTITIGS

SEQ ID NO: 451079 - protein, 9 aa, Influenza virus
NQKTLDEHD

SEQ ID NO: 451080 - protein, 9 aa, Influenza virus
NQKTLDEHE

SEQ ID NO: 451081 - protein, 9 aa, Influenza virus
NQKTLDEHV

SEQ ID NO: 451082 - protein, 9 aa, Influenza virus
NQKTLDKHD

SEQ ID NO: 451083 - protein, 9 aa, Influenza virus
NQMIITIGS

SEQ ID NO: 451084 - protein, 9 aa, Influenza virus
NQNNTTVVE

SEQ ID NO: 451085 - protein, 9 aa, Influenza virus
NQNPRIFLA

SEQ ID NO: 451086 - protein, 9 aa, Influenza virus
NQNPRMFLA

SEQ ID NO: 451087 - protein, 9 aa, Influenza virus
NQNPRVFLA

SEQ ID NO: 451088 - protein, 9 aa, Influenza virus
NQNPRVFLT

SEQ ID NO: 451089 - protein, 9 aa, Influenza virus
NQNQNPRMF

SEQ ID NO: 451090 - protein, 9 aa, Influenza virus
NQNSTWVSQ

SEQ ID NO: 451091 - protein, 9 aa, Influenza virus
NQNWSGYSG

SEQ ID NO: 451092 - protein, 9 aa, Influenza virus
NQPAATALA

SEQ ID NO: 451093 - protein, 9 aa, Influenza virus
NQQFELIDH

SEQ ID NO: 451094 - protein, 9 aa, Influenza virus
NQQFELIDN

SEQ ID NO: 451095 - protein, 9 aa, Influenza virus
NQQFELINN

SEQ ID NO: 451096 - protein, 9 aa, Influenza virus
NQQFEMIDN

SEQ ID NO: 451097 - protein, 9 aa, Influenza virus
NQQFKLIDN

SEQ ID NO: 451098 - protein, 9 aa, Influenza virus
NQRLNPMHQ

SEQ ID NO: 451099 - protein, 9 aa, Influenza virus
NQRLNTMHQ

SEQ ID NO: 451100 - protein, 9 aa, Influenza virus
NQSGRISIY

SEQ ID NO: 451101 - protein, 9 aa, Influenza virus
NQSLPPNFS

SEQ ID NO: 451102 - protein, 9 aa, Influenza virus
NQTIINNYY

SEQ ID NO: 451103 - protein, 9 aa, Influenza virus
NQTKKMTIT

SEQ ID NO: 451104 - protein, 9 aa, Influenza virus
NQTKTMTIT

SEQ ID NO: 451105 - protein, 9 aa, Influenza virus
NQTLVSNND

SEQ ID NO: 451106 - protein, 9 aa, Influenza virus
NQTYRNNRK

SEQ ID NO: 451107 - protein, 9 aa, Influenza virus
NQTYRNTRK

SEQ ID NO: 451108 - protein, 9 aa, Influenza virus
NQVEKRINM

SEQ ID NO: 451109 - protein, 9 aa, Influenza virus
NQVENRINM

SEQ ID NO: 451110 - protein, 9 aa, Influenza virus
NQVEQRINM

SEQ ID NO: 451111 - protein, 9 aa, Influenza virus
NQVFPQLNQ

SEQ ID NO: 451112 - protein, 9 aa, Influenza virus
NQVKIRRRV

SEQ ID NO: 451113 - protein, 9 aa, Influenza virus
NRANQRLNP

SEQ ID NO: 451114 - protein, 9 aa, Influenza virus
NRANQRLNT

SEQ ID NO: 451115 - protein, 9 aa, Influenza virus
NRCFYVELI

SEQ ID NO: 451116 - protein, 9 aa, Influenza virus
NRCFYVELV

SEQ ID NO: 451117 - protein, 9 aa, Influenza virus
NRCYQFALG

SEQ ID NO: 451118 - protein, 9 aa, Influenza virus
NRDITIGSI

SEQ ID NO: 451119 - protein, 9 aa, Influenza virus
NREFEVMNH

SEQ ID NO: 451120 - protein, 9 aa, Influenza virus
NREFEVVDH

SEQ ID NO: 451121 - protein, 9 aa, Influenza virus
NREFEVVNH

SEQ ID NO: 451122 - protein, 9 aa, Influenza virus
NREFGVVNH

SEQ ID NO: 451123 - protein, 9 aa, Influenza virus
NRFIEKTNQ

SEQ ID NO: 451124 - protein, 9 aa, Influenza virus
NRFQIQGIK

SEQ ID NO: 451125 - protein, 9 aa, Influenza virus
NRFQIQGVK

SEQ ID NO: 451126 - protein, 9 aa, Influenza virus
NRFQIQGVR

SEQ ID NO: 451127 - protein, 9 aa, Influenza virus
NRFYRTCKL

SEQ ID NO: 451128 - protein, 9 aa, Influenza virus
NRGLFGAIA

SEQ ID NO: 451129 - protein, 9 aa, Influenza virus
NRGLFGAKA

SEQ ID NO: 451130 - protein, 9 aa, Influenza virus
NRGSFYRSM

SEQ ID NO: 451131 - protein, 9 aa, Influenza virus
NRHSNGTIH

SEQ ID NO: 451132 - protein, 9 aa, Influenza virus
NRIFQPNIG

SEQ ID NO: 451133 - protein, 9 aa, Influenza virus
NRIFRPNIG

SEQ ID NO: 451134 - protein, 9 aa, Influenza virus
NRIIEKTNQ

SEQ ID NO: 451135 - protein, 9 aa, Influenza virus
NRIKINPVT

SEQ ID NO: 451136 - protein, 9 aa, Influenza virus
NRIMINPVK

SEQ ID NO: 451137 - protein, 9 aa, Influenza virus
NRINMLADR

SEQ ID NO: 451138 - protein, 9 aa, Influenza virus
NRIQIDPVK

SEQ ID NO: 451139 - protein, 9 aa, Influenza virus
NRIQIDQVK

SEQ ID NO: 451140 - protein, 9 aa, Influenza virus
NRIQIDSVK

SEQ ID NO: 451141 - protein, 9 aa, Influenza virus
NRIQINPVK

SEQ ID NO: 451142 - protein, 9 aa, Influenza virus
NRIRIDPVK

SEQ ID NO: 451143 - protein, 9 aa, Influenza virus
NRITYGACP

SEQ ID NO: 451144 - protein, 9 aa, Influenza virus
NRITYGPCP

SEQ ID NO: 451145 - protein, 9 aa, Influenza virus
NRITYGVCP

SEQ ID NO: 451146 - protein, 9 aa, Influenza virus
NRKEPALIV

SEQ ID NO: 451147 - protein, 9 aa, Influenza virus
NRKEYEEEA

SEQ ID NO: 451148 - protein, 9 aa, Influenza virus
NRKMEDGFL

SEQ ID NO: 451149 - protein, 9 aa, Influenza virus
NRKVDDGFL

SEQ ID NO: 451150 - protein, 9 aa, Influenza virus
NRLIDKTNQ

SEQ ID NO: 451151 - protein, 9 aa, Influenza virus
NRLIDRTNH

SEQ ID NO: 451152 - protein, 9 aa, Influenza virus
NRLIEKTND

SEQ ID NO: 451153 - protein, 9 aa, Influenza virus
NRLIEKTNE

SEQ ID NO: 451154 - protein, 9 aa, Influenza virus
NRLIEKTNK

SEQ ID NO: 451155 - protein, 9 aa, Influenza virus
NRLIEKTNQ

SEQ ID NO: 451156 - protein, 9 aa, Influenza virus
NRLIEKTNT

SEQ ID NO: 451157 - protein, 9 aa, Influenza virus
NRLIERTNE

SEQ ID NO: 451158 - protein, 9 aa, Influenza virus
NRLIERTNQ

SEQ ID NO: 451159 - protein, 9 aa, Influenza virus
NRLIGKTNQ

SEQ ID NO: 451160 - protein, 9 aa, Influenza virus
NRLISKTNQ

SEQ ID NO: 451161 - protein, 9 aa, Influenza virus
NRLNINPVK

SEQ ID NO: 451162 - protein, 9 aa, Influenza virus
NRLNINPVR

SEQ ID NO: 451163 - protein, 9 aa, Influenza virus
NRLNINPVT

SEQ ID NO: 451164 - protein, 9 aa, Influenza virus
NRLNINSVK

SEQ ID NO: 451165 - protein, 9 aa, Influenza virus
NRLNNVIDK

SEQ ID NO: 451166 - protein, 9 aa, Influenza virus
NRLSINPVK

SEQ ID NO: 451167 - protein, 9 aa, Influenza virus
NRMQFSSLT

SEQ ID NO: 451168 - protein, 9 aa, Influenza virus
NRMQINPVK

SEQ ID NO: 451169 - protein, 9 aa, Influenza virus
NRMTICVQG

SEQ ID NO: 451170 - protein, 9 aa, Influenza virus
NRMVIASTT

SEQ ID NO: 451171 - protein, 9 aa, Influenza virus
NRMVLASTT

SEQ ID NO: 451172 - protein, 9 aa, Influenza virus
NRNEIKGVK

SEQ ID NO: 451173 - protein, 9 aa, Influenza virus
NRNFKPNIG

SEQ ID NO: 451174 - protein, 9 aa, Influenza virus
NRNFQPNIG

SEQ ID NO: 451175 - protein, 9 aa, Influenza virus
NRNQPAATA

SEQ ID NO: 451176 - protein, 9 aa, Influenza virus
NRNWSGYSG

SEQ ID NO: 451177 - protein, 9 aa, Influenza virus
NRPIIDINM

SEQ ID NO: 451178 - protein, 9 aa, Influenza virus
NRPIIEIDM

SEQ ID NO: 451179 - protein, 9 aa, Influenza virus
NRPIIEINM

SEQ ID NO: 451180 - protein, 9 aa, Influenza virus
NRPVIDINM

SEQ ID NO: 451181 - protein, 9 aa, Influenza virus
NRPVIDVNM

SEQ ID NO: 451182 - protein, 9 aa, Influenza virus
NRPVIEIDM

SEQ ID NO: 451183 - protein, 9 aa, Influenza virus
NRPVIEINM

SEQ ID NO: 451184 - protein, 9 aa, Influenza virus
NRPVIKIDM

SEQ ID NO: 451185 - protein, 9 aa, Influenza virus
NRPVIQIDP

SEQ ID NO: 451186 - protein, 9 aa, Influenza virus
NRPVIQINP

SEQ ID NO: 451187 - protein, 9 aa, Influenza virus
NRPVIRIDP

SEQ ID NO: 451188 - protein, 9 aa, Influenza virus
NRPWIRFNS

SEQ ID NO: 451189 - protein, 9 aa, Influenza virus
NRPWIRINN

SEQ ID NO: 451190 - protein, 9 aa, Influenza virus
NRPWISFDQ

SEQ ID NO: 451191 - protein, 9 aa, Influenza virus
NRPWISFNQ

SEQ ID NO: 451192 - protein, 9 aa, Influenza virus
NRPWLSFNQ

SEQ ID NO: 451193 - protein, 9 aa, Influenza virus
NRPWMRINN

SEQ ID NO: 451194 - protein, 9 aa, Influenza virus
NRPWMRISN

SEQ ID NO: 451195 - protein, 9 aa, Influenza virus
NRPWVRINN

SEQ ID NO: 451196 - protein, 9 aa, Influenza virus
NRPWVRMNN

SEQ ID NO: 451197 - protein, 9 aa, Influenza virus
NRPWVSFDQ

SEQ ID NO: 451198 - protein, 9 aa, Influenza virus
NRPWVSFNH

SEQ ID NO: 451199 - protein, 9 aa, Influenza virus
NRPWVSFNQ

SEQ ID NO: 451200 - protein, 9 aa, Influenza virus
NRPWVSFTQ

SEQ ID NO: 451201 - protein, 9 aa, Influenza virus
NRQEIEGAR

SEQ ID NO: 451202 - protein, 9 aa, Influenza virus
NRQEIEGVK

SEQ ID NO: 451203 - protein, 9 aa, Influenza virus
NRQEIEGVR

SEQ ID NO: 451204 - protein, 9 aa, Influenza virus
NRQEIGGVK

SEQ ID NO: 451205 - protein, 9 aa, Influenza virus
NRRLTTTIK

SEQ ID NO: 451206 - protein, 9 aa, Influenza virus
NRRPTTTIK

SEQ ID NO: 451207 - protein, 9 aa, Influenza virus
NRSFKPNIG

SEQ ID NO: 451208 - protein, 9 aa, Influenza virus
NRSFQPNIG

SEQ ID NO: 451209 - protein, 9 aa, Influenza virus
NRSFRPNIG

SEQ ID NO: 451210 - protein, 9 aa, Influenza virus
NRSGYSGIF

SEQ ID NO: 451211 - protein, 9 aa, Influenza virus
NRSGYSGSF

SEQ ID NO: 451212 - protein, 9 aa, Influenza virus
NRSILNTSQ

SEQ ID NO: 451213 - protein, 9 aa, Influenza virus
NRSPYRALM

SEQ ID NO: 451214 - protein, 9 aa, Influenza virus
NRTFQNIDK

SEQ ID NO: 451215 - protein, 9 aa, Influenza virus
NRTFQNIDR

SEQ ID NO: 451216 - protein, 9 aa, Influenza virus
NRTFQNVSP

SEQ ID NO: 451217 - protein, 9 aa, Influenza virus
NRTGTFEFT

SEQ ID NO: 451218 - protein, 9 aa, Influenza virus
NRTHQYSEK

SEQ ID NO: 451219 - protein, 9 aa, Influenza virus
NRTHQYSER

SEQ ID NO: 451220 - protein, 9 aa, Influenza virus
NRVKIDPVK

SEQ ID NO: 451221 - protein, 9 aa, Influenza virus
NRVWWTSNS

SEQ ID NO: 451222 - protein, 9 aa, Influenza virus
NRYLEEHPS

SEQ ID NO: 451223 - protein, 9 aa, Influenza virus
NRYLEENPS

SEQ ID NO: 451224 - protein, 9 aa, Influenza virus
NSAAFEDLR

SEQ ID NO: 451225 - protein, 9 aa, Influenza virus
NSADHRIYW

SEQ ID NO: 451226 - protein, 9 aa, Influenza virus
NSADHRVYW

SEQ ID NO: 451227 - protein, 9 aa, Influenza virus
NSALGSPGC

SEQ ID NO: 451228 - protein, 9 aa, Influenza virus
NSARLIHHT

SEQ ID NO: 451229 - protein, 9 aa, Influenza virus
NSCESKCFW

SEQ ID NO: 451230 - protein, 9 aa, Influenza virus
NSCIESIRN

SEQ ID NO: 451231 - protein, 9 aa, Influenza virus
NSCMETIRN

SEQ ID NO: 451232 - protein, 9 aa, Influenza virus
NSDFICVGW

SEQ ID NO: 451233 - protein, 9 aa, Influenza virus
NSDFLCVGW

SEQ ID NO: 451234 - protein, 9 aa, Influenza virus
NSDFMCVGW

SEQ ID NO: 451235 - protein, 9 aa, Influenza virus
NSDLDYQIG

SEQ ID NO: 451236 - protein, 9 aa, Influenza virus
NSDLEALME

SEQ ID NO: 451237 - protein, 9 aa, Influenza virus
NSDPDYQIG

SEQ ID NO: 451238 - protein, 9 aa, Influenza virus
NSDVLVTRE

SEQ ID NO: 451239 - protein, 9 aa, Influenza virus
NSDWSGYSG

SEQ ID NO: 451240 - protein, 9 aa, Influenza virus
NSEFICVGW

SEQ ID NO: 451241 - protein, 9 aa, Influenza virus
NSEFLCVGW

SEQ ID NO: 451242 - protein, 9 aa, Influenza virus
NSEGIGQAA

SEQ ID NO: 451243 - protein, 9 aa, Influenza virus
NSEGMGQAA

SEQ ID NO: 451244 - protein, 9 aa, Influenza virus
NSEGRGQAA

SEQ ID NO: 451245 - protein, 9 aa, Influenza virus
NSEGTGIAA

SEQ ID NO: 451246 - protein, 9 aa, Influenza virus
NSEGTGIVA

SEQ ID NO: 451247 - protein, 9 aa, Influenza virus
NSEGTGMAA

SEQ ID NO: 451248 - protein, 9 aa, Influenza virus
NSEGTGQAA

SEQ ID NO: 451249 - protein, 9 aa, Influenza virus
NSEMNKLYE

SEQ ID NO: 451250 - protein, 9 aa, Influenza virus
NSETGAPQL

SEQ ID NO: 451251 - protein, 9 aa, Influenza virus
NSFEQITFI

SEQ ID NO: 451252 - protein, 9 aa, Influenza virus
NSFEQITFL

SEQ ID NO: 451253 - protein, 9 aa, Influenza virus
NSFEQITFM

SEQ ID NO: 451254 - protein, 9 aa, Influenza virus
NSFFSRLNW

SEQ ID NO: 451255 - protein, 9 aa, Influenza virus
NSFSRTELI

SEQ ID NO: 451256 - protein, 9 aa, Influenza virus
NSFVPVVGA

SEQ ID NO: 451257 - protein, 9 aa, Influenza virus
NSFYAELKW

SEQ ID NO: 451258 - protein, 9 aa, Influenza virus
NSFYRNLIW

SEQ ID NO: 451259 - protein, 9 aa, Influenza virus
NSGDYARLY

SEQ ID NO: 451260 - protein, 9 aa, Influenza virus
NSGKVECVC

SEQ ID NO: 451261 - protein, 9 aa, Influenza virus
NSGVKGWAF

SEQ ID NO: 451262 - protein, 9 aa, Influenza virus
NSHYEECSC

SEQ ID NO: 451263 - protein, 9 aa, Influenza virus
NSIAVFCGT

SEQ ID NO: 451264 - protein, 9 aa, Influenza virus
NSIGNLIAP

SEQ ID NO: 451265 - protein, 9 aa, Influenza virus
NSIIAFCGT

SEQ ID NO: 451266 - protein, 9 aa, Influenza virus
NSIIDKMNI

SEQ ID NO: 451267 - protein, 9 aa, Influenza virus
NSIIDKMNT

SEQ ID NO: 451268 - protein, 9 aa, Influenza virus
NSIIDKVNT

SEQ ID NO: 451269 - protein, 9 aa, Influenza virus
NSIIEKMNT

SEQ ID NO: 451270 - protein, 9 aa, Influenza virus
NSIIGKMNT

SEQ ID NO: 451271 - protein, 9 aa, Influenza virus
NSIINKMNT

SEQ ID NO: 451272 - protein, 9 aa, Influenza virus
NSIIVFCGT

SEQ ID NO: 451273 - protein, 9 aa, Influenza virus
NSIQLSAGG

SEQ ID NO: 451274 - protein, 9 aa, Influenza virus
NSIRIGSKG

SEQ ID NO: 451275 - protein, 9 aa, Influenza virus
NSIRIGSRG

SEQ ID NO: 451276 - protein, 9 aa, Influenza virus
NSIRLAAGG

SEQ ID NO: 451277 - protein, 9 aa, Influenza virus
NSIRLSADG

SEQ ID NO: 451278 - protein, 9 aa, Influenza virus
NSIRLSAGG

SEQ ID NO: 451279 - protein, 9 aa, Influenza virus
NSIRLSASG

SEQ ID NO: 451280 - protein, 9 aa, Influenza virus
NSIVAFCGT

SEQ ID NO: 451281 - protein, 9 aa, Influenza virus
NSIVALCGS

SEQ ID NO: 451282 - protein, 9 aa, Influenza virus
NSIVEFCGT

SEQ ID NO: 451283 - protein, 9 aa, Influenza virus
NSIVSMCSS

SEQ ID NO: 451284 - protein, 9 aa, Influenza virus
NSIVTFCGL

SEQ ID NO: 451285 - protein, 9 aa, Influenza virus
NSIVVFCGT

SEQ ID NO: 451286 - protein, 9 aa, Influenza virus
NSIVVFCST

SEQ ID NO: 451287 - protein, 9 aa, Influenza virus
NSIVVFVAP

SEQ ID NO: 451288 - protein, 9 aa, Influenza virus
NSIWTSSSS

SEQ ID NO: 451289 - protein, 9 aa, Influenza virus
NSIYASPQL

SEQ ID NO: 451290 - protein, 9 aa, Influenza virus
NSKFESVAW

SEQ ID NO: 451291 - protein, 9 aa, Influenza virus
NSKKQIDTI

SEQ ID NO: 451292 - protein, 9 aa, Influenza virus
NSLIALCGS

SEQ ID NO: 451293 - protein, 9 aa, Influenza virus
NSLKLAIGL

SEQ ID NO: 451294 - protein, 9 aa, Influenza virus
NSLVALCGS

SEQ ID NO: 451295 - protein, 9 aa, Influenza virus
NSLYASPQL

SEQ ID NO: 451296 - protein, 9 aa, Influenza virus
NSLYASSQL

SEQ ID NO: 451297 - protein, 9 aa, Influenza virus
NSLYSSPQL

SEQ ID NO: 451298 - protein, 9 aa, Influenza virus
NSMVTFCGL

SEQ ID NO: 451299 - protein, 9 aa, Influenza virus
NSNAITRSG

SEQ ID NO: 451300 - protein, 9 aa, Influenza virus
NSNCKDPNN

SEQ ID NO: 451301 - protein, 9 aa, Influenza virus
NSNCRDPNN

SEQ ID NO: 451302 - protein, 9 aa, Influenza virus
NSNCRNPNN

SEQ ID NO: 451303 - protein, 9 aa, Influenza virus
NSNGVQDII

SEQ ID NO: 451304 - protein, 9 aa, Influenza virus
NSNLDYQIG

SEQ ID NO: 451305 - protein, 9 aa, Influenza virus
NSNNGVKGF

SEQ ID NO: 451306 - protein, 9 aa, Influenza virus
NSNWSGYSG

SEQ ID NO: 451307 - protein, 9 aa, Influenza virus
NSPAFNYNK

SEQ ID NO: 451308 - protein, 9 aa, Influenza virus
NSPGRVTVS

SEQ ID NO: 451309 - protein, 9 aa, Influenza virus
NSPIFNYNK

SEQ ID NO: 451310 - protein, 9 aa, Influenza virus
NSPLPFQNI

SEQ ID NO: 451311 - protein, 9 aa, Influenza virus
NSPVFNYNK

SEQ ID NO: 451312 - protein, 9 aa, Influenza virus
NSPVFNYNR

SEQ ID NO: 451313 - protein, 9 aa, Influenza virus
NSQASYKIF

SEQ ID NO: 451314 - protein, 9 aa, Influenza virus
NSQDTEISF

SEQ ID NO: 451315 - protein, 9 aa, Influenza virus
NSQDTELSF

SEQ ID NO: 451316 - protein, 9 aa, Influenza virus
NSQDTEVSF

SEQ ID NO: 451317 - protein, 9 aa, Influenza virus
NSQGEGTAA

SEQ ID NO: 451318 - protein, 9 aa, Influenza virus
NSQGSGYAA

SEQ ID NO: 451319 - protein, 9 aa, Influenza virus
NSRFESVAW

SEQ ID NO: 451320 - protein, 9 aa, Influenza virus
NSRFQIQGV

SEQ ID NO: 451321 - protein, 9 aa, Influenza virus
NSSCAAMDD

SEQ ID NO: 451322 - protein, 9 aa, Influenza virus
NSSDICYPG

SEQ ID NO: 451323 - protein, 9 aa, Influenza virus
NSSDKVDTL

SEQ ID NO: 451324 - protein, 9 aa, Influenza virus
NSSDTVDTL

SEQ ID NO: 451325 - protein, 9 aa, Influenza virus
NSSEKVDTL

SEQ ID NO: 451326 - protein, 9 aa, Influenza virus
NSSEKVNTL

SEQ ID NO: 451327 - protein, 9 aa, Influenza virus
NSSERVDTL

SEQ ID NO: 451328 - protein, 9 aa, Influenza virus
NSSILTDSQ

SEQ ID NO: 451329 - protein, 9 aa, Influenza virus
NSSKPFQNA

SEQ ID NO: 451330 - protein, 9 aa, Influenza virus
NSSKPFQNT

SEQ ID NO: 451331 - protein, 9 aa, Influenza virus
NSSKPLQNA

SEQ ID NO: 451332 - protein, 9 aa, Influenza virus
NSSMPFHNI

SEQ ID NO: 451333 - protein, 9 aa, Influenza virus
NSSMPFHNV

SEQ ID NO: 451334 - protein, 9 aa, Influenza virus
NSSMPLHNI

SEQ ID NO: 451335 - protein, 9 aa, Influenza virus
NSSRPFQNA

SEQ ID NO: 451336 - protein, 9 aa, Influenza virus
NSSVSRMST

SEQ ID NO: 451337 - protein, 9 aa, Influenza virus
NSSYVCSGL

SEQ ID NO: 451338 - protein, 9 aa, Influenza virus
NSTCVVVMT

SEQ ID NO: 451339 - protein, 9 aa, Influenza virus
NSTDKIDTL

SEQ ID NO: 451340 - protein, 9 aa, Influenza virus
NSTDKVDTI

SEQ ID NO: 451341 - protein, 9 aa, Influenza virus
NSTDKVDTL

SEQ ID NO: 451342 - protein, 9 aa, Influenza virus
NSTDKVNTI

SEQ ID NO: 451343 - protein, 9 aa, Influenza virus
NSTDTVDTI

SEQ ID NO: 451344 - protein, 9 aa, Influenza virus
NSTDTVDTL

SEQ ID NO: 451345 - protein, 9 aa, Influenza virus
NSTDTVDTV

SEQ ID NO: 451346 - protein, 9 aa, Influenza virus
NSTDTVNTL

SEQ ID NO: 451347 - protein, 9 aa, Influenza virus
NSTEHVDTI

SEQ ID NO: 451348 - protein, 9 aa, Influenza virus
NSTEKVDTI

SEQ ID NO: 451349 - protein, 9 aa, Influenza virus
NSTEKVDTL

SEQ ID NO: 451350 - protein, 9 aa, Influenza virus
NSTEQVDTI

SEQ ID NO: 451351 - protein, 9 aa, Influenza virus
NSTERVDTI

SEQ ID NO: 451352 - protein, 9 aa, Influenza virus
NSTETVNTL

SEQ ID NO: 451353 - protein, 9 aa, Influenza virus
NSTKQIDTI

SEQ ID NO: 451354 - protein, 9 aa, Influenza virus
NSTKQVDTI

SEQ ID NO: 451355 - protein, 9 aa, Influenza virus
NSTNTVNTL

SEQ ID NO: 451356 - protein, 9 aa, Influenza virus
NSTTHDRTA

SEQ ID NO: 451357 - protein, 9 aa, Influenza virus
NSTTKVDTI

SEQ ID NO: 451358 - protein, 9 aa, Influenza virus
NSTTQIDTI

SEQ ID NO: 451359 - protein, 9 aa, Influenza virus
NSTTQVDTI

SEQ ID NO: 451360 - protein, 9 aa, Influenza virus
NSTTQVDTL

SEQ ID NO: 451361 - protein, 9 aa, Influenza virus
NSTTQVNTI

SEQ ID NO: 451362 - protein, 9 aa, Influenza virus
NSTVQVDTI

SEQ ID NO: 451363 - protein, 9 aa, Influenza virus
NSTVVNNIT

SEQ ID NO: 451364 - protein, 9 aa, Influenza virus
NSTWVSQTY

SEQ ID NO: 451365 - protein, 9 aa, Influenza virus
NSTYKILSI

SEQ ID NO: 451366 - protein, 9 aa, Influenza virus
NSVIEKINT

SEQ ID NO: 451367 - protein, 9 aa, Influenza virus
NSVIEKMNI

SEQ ID NO: 451368 - protein, 9 aa, Influenza virus
NSVIEKMNT

SEQ ID NO: 451369 - protein, 9 aa, Influenza virus
NSVKLSSGY

SEQ ID NO: 451370 - protein, 9 aa, Influenza virus
NSVRIGSKG

SEQ ID NO: 451371 - protein, 9 aa, Influenza virus
NSVRLSAGG

SEQ ID NO: 451372 - protein, 9 aa, Influenza virus
NSVRLSASG

SEQ ID NO: 451373 - protein, 9 aa, Influenza virus
NSVVEKMNT

SEQ ID NO: 451374 - protein, 9 aa, Influenza virus
NSVVVFCGT

SEQ ID NO: 451375 - protein, 9 aa, Influenza virus
NSVWAGRTI

SEQ ID NO: 451376 - protein, 9 aa, Influenza virus
NSVWAGRTM

SEQ ID NO: 451377 - protein, 9 aa, Influenza virus
NSVWAGRTV

SEQ ID NO: 451378 - protein, 9 aa, Influenza virus
NSWHIFGKD

SEQ ID NO: 451379 - protein, 9 aa, Influenza virus
NSWHIFSKD

SEQ ID NO: 451380 - protein, 9 aa, Influenza virus
NSWHILSKD

SEQ ID NO: 451381 - protein, 9 aa, Influenza virus
NSWHIYGKD

SEQ ID NO: 451382 - protein, 9 aa, Influenza virus
NSWLGRTIS

SEQ ID NO: 451383 - protein, 9 aa, Influenza virus
NSWLGRTTS

SEQ ID NO: 451384 - protein, 9 aa, Influenza virus
NSWSGYSGI

SEQ ID NO: 451385 - protein, 9 aa, Influenza virus
NTALLNASC

SEQ ID NO: 451386 - protein, 9 aa, Influenza virus
NTALSTIAL

SEQ ID NO: 451387 - protein, 9 aa, Influenza virus
NTASRSGYE

SEQ ID NO: 451388 - protein, 9 aa, Influenza virus
NTCMETIRN

SEQ ID NO: 451389 - protein, 9 aa, Influenza virus
NTDLEALME

SEQ ID NO: 451390 - protein, 9 aa, Influenza virus
NTDLEVLME

SEQ ID NO: 451391 - protein, 9 aa, Influenza virus
NTDLGAPLE

SEQ ID NO: 451392 - protein, 9 aa, Influenza virus
NTDLGSPLE

SEQ ID NO: 451393 - protein, 9 aa, Influenza virus
NTDLGTPLE

SEQ ID NO: 451394 - protein, 9 aa, Influenza virus
NTDWSGYSG

SEQ ID NO: 451395 - protein, 9 aa, Influenza virus
NTEFESIES

SEQ ID NO: 451396 - protein, 9 aa, Influenza virus
NTEIGAPQL

SEQ ID NO: 451397 - protein, 9 aa, Influenza virus
NTELLVLME

SEQ ID NO: 451398 - protein, 9 aa, Influenza virus
NTEPLCDVS

SEQ ID NO: 451399 - protein, 9 aa, Influenza virus
NTEPLCEVS

SEQ ID NO: 451400 - protein, 9 aa, Influenza virus
NTEPLCNVS

SEQ ID NO: 451401 - protein, 9 aa, Influenza virus
NTETGALQL

SEQ ID NO: 451402 - protein, 9 aa, Influenza virus
NTETGAPQL

SEQ ID NO: 451403 - protein, 9 aa, Influenza virus
NTETKAPQL

SEQ ID NO: 451404 - protein, 9 aa, Influenza virus
NTFGDCPKY

SEQ ID NO: 451405 - protein, 9 aa, Influenza virus
NTGSYVRLY

SEQ ID NO: 451406 - protein, 9 aa, Influenza virus
NTHIHIFSF

SEQ ID NO: 451407 - protein, 9 aa, Influenza virus
NTIDLTDSE

SEQ ID NO: 451408 - protein, 9 aa, Influenza virus
NTIEIFRSN

SEQ ID NO: 451409 - protein, 9 aa, Influenza virus
NTIEVFKSN

SEQ ID NO: 451410 - protein, 9 aa, Influenza virus
NTIEVFRLN

SEQ ID NO: 451411 - protein, 9 aa, Influenza virus
NTIEVFRSN

SEQ ID NO: 451412 - protein, 9 aa, Influenza virus
NTIGDCPKY

SEQ ID NO: 451413 - protein, 9 aa, Influenza virus
NTIGNCPKY

SEQ ID NO: 451414 - protein, 9 aa, Influenza virus
NTIGNLIAP

SEQ ID NO: 451415 - protein, 9 aa, Influenza virus
NTIGNLVAP

SEQ ID NO: 451416 - protein, 9 aa, Influenza virus
NTIIENNVT

SEQ ID NO: 451417 - protein, 9 aa, Influenza virus
NTIIESNVT

SEQ ID NO: 451418 - protein, 9 aa, Influenza virus
NTILEKNVT

SEQ ID NO: 451419 - protein, 9 aa, Influenza virus
NTILSTKAL

SEQ ID NO: 451420 - protein, 9 aa, Influenza virus
NTINRIFQP

SEQ ID NO: 451421 - protein, 9 aa, Influenza virus
NTINRNFQP

SEQ ID NO: 451422 - protein, 9 aa, Influenza virus
NTINRSFQP

SEQ ID NO: 451423 - protein, 9 aa, Influenza virus
NTINRSFRP

SEQ ID NO: 451424 - protein, 9 aa, Influenza virus
NTINSKIDD

SEQ ID NO: 451425 - protein, 9 aa, Influenza virus
NTKCQTSLG

SEQ ID NO: 451426 - protein, 9 aa, Influenza virus
NTKCQTSMG

SEQ ID NO: 451427 - protein, 9 aa, Influenza virus
NTKCQTSVG

SEQ ID NO: 451428 - protein, 9 aa, Influenza virus
NTKCQTYAG

SEQ ID NO: 451429 - protein, 9 aa, Influenza virus
NTKLPFQNL

SEQ ID NO: 451430 - protein, 9 aa, Influenza virus
NTKWNENQN

SEQ ID NO: 451431 - protein, 9 aa, Influenza virus
NTLAERGVE

SEQ ID NO: 451432 - protein, 9 aa, Influenza virus
NTLIEQNIP

SEQ ID NO: 451433 - protein, 9 aa, Influenza virus
NTLIEQNVP

SEQ ID NO: 451434 - protein, 9 aa, Influenza virus
NTLKLATGM

SEQ ID NO: 451435 - protein, 9 aa, Influenza virus
NTLLENDVP

SEQ ID NO: 451436 - protein, 9 aa, Influenza virus
NTLRTQESE

SEQ ID NO: 451437 - protein, 9 aa, Influenza virus
NTLSEQNVP

SEQ ID NO: 451438 - protein, 9 aa, Influenza virus
NTLSSVNTN

SEQ ID NO: 451439 - protein, 9 aa, Influenza virus
NTLSSVTTN

SEQ ID NO: 451440 - protein, 9 aa, Influenza virus
NTLTEKGIE

SEQ ID NO: 451441 - protein, 9 aa, Influenza virus
NTLTEKGVE

SEQ ID NO: 451442 - protein, 9 aa, Influenza virus
NTLTEQNVP

SEQ ID NO: 451443 - protein, 9 aa, Influenza virus
NTLTEREVE

SEQ ID NO: 451444 - protein, 9 aa, Influenza virus
NTLTERGIE

SEQ ID NO: 451445 - protein, 9 aa, Influenza virus
NTLTERGVE

SEQ ID NO: 451446 - protein, 9 aa, Influenza virus
NTLTSVTTN

SEQ ID NO: 451447 - protein, 9 aa, Influenza virus
NTMHQLLRH

SEQ ID NO: 451448 - protein, 9 aa, Influenza virus
NTMTKDAER

SEQ ID NO: 451449 - protein, 9 aa, Influenza virus
NTNGEQILI

SEQ ID NO: 451450 - protein, 9 aa, Influenza virus
NTNKTFQNI

SEQ ID NO: 451451 - protein, 9 aa, Influenza virus
NTNRTFQNI

SEQ ID NO: 451452 - protein, 9 aa, Influenza virus
NTNTINRSF

SEQ ID NO: 451453 - protein, 9 aa, Influenza virus
NTNTLSSVT

SEQ ID NO: 451454 - protein, 9 aa, Influenza virus
NTPSIDPKG

SEQ ID NO: 451455 - protein, 9 aa, Influenza virus
NTPSIEPKG

SEQ ID NO: 451456 - protein, 9 aa, Influenza virus
NTPSIEPRG

SEQ ID NO: 451457 - protein, 9 aa, Influenza virus
NTPSVEPKG

SEQ ID NO: 451458 - protein, 9 aa, Influenza virus
NTPSVEPRG

SEQ ID NO: 451459 - protein, 9 aa, Influenza virus
NTQFEAIGR

SEQ ID NO: 451460 - protein, 9 aa, Influenza virus
NTQFEAVGK

SEQ ID NO: 451461 - protein, 9 aa, Influenza virus
NTQFEAVGR

SEQ ID NO: 451462 - protein, 9 aa, Influenza virus
NTQFELIDN

SEQ ID NO: 451463 - protein, 9 aa, Influenza virus
NTQFTAVGK

SEQ ID NO: 451464 - protein, 9 aa, Influenza virus
NTQFTSVGK

SEQ ID NO: 451465 - protein, 9 aa, Influenza virus
NTQGEGTAA

SEQ ID NO: 451466 - protein, 9 aa, Influenza virus
NTQIIVILV

SEQ ID NO: 451467 - protein, 9 aa, Influenza virus
NTRCQTSVG

SEQ ID NO: 451468 - protein, 9 aa, Influenza virus
NTRKEPALI

SEQ ID NO: 451469 - protein, 9 aa, Influenza virus
NTRLPFQNL

SEQ ID NO: 451470 - protein, 9 aa, Influenza virus
NTSGEQMLI

SEQ ID NO: 451471 - protein, 9 aa, Influenza virus
NTSGEQMLV

SEQ ID NO: 451472 - protein, 9 aa, Influenza virus
NTSGKQMLI

SEQ ID NO: 451473 - protein, 9 aa, Influenza virus
NTSKHYIGK

SEQ ID NO: 451474 - protein, 9 aa, Influenza virus
NTSKPFQNI

SEQ ID NO: 451475 - protein, 9 aa, Influenza virus
NTSKPFQNT

SEQ ID NO: 451476 - protein, 9 aa, Influenza virus
NTSKPLQNT

SEQ ID NO: 451477 - protein, 9 aa, Influenza virus
NTSQRGILE

SEQ ID NO: 451478 - protein, 9 aa, Influenza virus
NTSQRGVLE

SEQ ID NO: 451479 - protein, 9 aa, Influenza virus
NTSRHYIGK

SEQ ID NO: 451480 - protein, 9 aa, Influenza virus
NTSRHYMGE

SEQ ID NO: 451481 - protein, 9 aa, Influenza virus
NTSYKILSI

SEQ ID NO: 451482 - protein, 9 aa, Influenza virus
NTTGRDVLV

SEQ ID NO: 451483 - protein, 9 aa, Influenza virus
NTTGWSWPD

SEQ ID NO: 451484 - protein, 9 aa, Influenza virus
NTTLIENTY

SEQ ID NO: 451485 - protein, 9 aa, Influenza virus
NTTLPFHNI

SEQ ID NO: 451486 - protein, 9 aa, Influenza virus
NTTLPFHNV

SEQ ID NO: 451487 - protein, 9 aa, Influenza virus
NTTLSTIAL

SEQ ID NO: 451488 - protein, 9 aa, Influenza virus
NTTNYYNET

SEQ ID NO: 451489 - protein, 9 aa, Influenza virus
NTTVVENTY

SEQ ID NO: 451490 - protein, 9 aa, Influenza virus
NTTWVNQTY

SEQ ID NO: 451491 - protein, 9 aa, Influenza virus
NTTYKILSI

SEQ ID NO: 451492 - protein, 9 aa, Influenza virus
NTTYRILSI

SEQ ID NO: 451493 - protein, 9 aa, Influenza virus
NTVINNITT

SEQ ID NO: 451494 - protein, 9 aa, Influenza virus
NTVINNMTT

SEQ ID NO: 451495 - protein, 9 aa, Influenza virus
NTVKDRSPY

SEQ ID NO: 451496 - protein, 9 aa, Influenza virus
NTVNTLIEQ

SEQ ID NO: 451497 - protein, 9 aa, Influenza virus
NTVVNNITT

SEQ ID NO: 451498 - protein, 9 aa, Influenza virus
NTWARNILR

SEQ ID NO: 451499 - protein, 9 aa, Influenza virus
NTWLGGTIS

SEQ ID NO: 451500 - protein, 9 aa, Influenza virus
NTWLGRTIS

SEQ ID NO: 451501 - protein, 9 aa, Influenza virus
NTWLGRTTS

SEQ ID NO: 451502 - protein, 9 aa, Influenza virus
NTWVGRTIS

SEQ ID NO: 451503 - protein, 9 aa, Influenza virus
NTYDHAQYR

SEQ ID NO: 451504 - protein, 9 aa, Influenza virus
NTYDHKKYR

SEQ ID NO: 451505 - protein, 9 aa, Influenza virus
NTYDHRKYK

SEQ ID NO: 451506 - protein, 9 aa, Influenza virus
NTYDHSHYR

SEQ ID NO: 451507 - protein, 9 aa, Influenza virus
NTYDHSKYR

SEQ ID NO: 451508 - protein, 9 aa, Influenza virus
NTYDHSQYR

SEQ ID NO: 451509 - protein, 9 aa, Influenza virus
NTYDHSRYR

SEQ ID NO: 451510 - protein, 9 aa, Influenza virus
NTYDHSTYR

SEQ ID NO: 451511 - protein, 9 aa, Influenza virus
NTYDHTKYR

SEQ ID NO: 451512 - protein, 9 aa, Influenza virus
NTYDHTQYR

SEQ ID NO: 451513 - protein, 9 aa, Influenza virus
NTYINNATI

SEQ ID NO: 451514 - protein, 9 aa, Influenza virus
NTYINNTTI

SEQ ID NO: 451515 - protein, 9 aa, Influenza virus
NTYNHTEYR

SEQ ID NO: 451516 - protein, 9 aa, Influenza virus
NTYNHTQYR

SEQ ID NO: 451517 - protein, 9 aa, Influenza virus
NTYQWIIKN

SEQ ID NO: 451518 - protein, 9 aa, Influenza virus
NTYQWIIRN

SEQ ID NO: 451519 - protein, 9 aa, Influenza virus
NTYQWVIRN

SEQ ID NO: 451520 - protein, 9 aa, Influenza virus
NTYVNNTTI

SEQ ID NO: 451521 - protein, 9 aa, Influenza virus
NTYVNNTTV

SEQ ID NO: 451522 - protein, 9 aa, Influenza virus
NVECVCRDN

SEQ ID NO: 451523 - protein, 9 aa, Influenza virus
NVEGWVVIA

SEQ ID NO: 451524 - protein, 9 aa, Influenza virus
NVELLVLME

SEQ ID NO: 451525 - protein, 9 aa, Influenza virus
NVENLFDEV

SEQ ID NO: 451526 - protein, 9 aa, Influenza virus
NVESNGNLI

SEQ ID NO: 451527 - protein, 9 aa, Influenza virus
NVESNGNLV

SEQ ID NO: 451528 - protein, 9 aa, Influenza virus
NVGLKVSLH

SEQ ID NO: 451529 - protein, 9 aa, Influenza virus
NVGLNMSLH

SEQ ID NO: 451530 - protein, 9 aa, Influenza virus
NVGLNVSLH

SEQ ID NO: 451531 - protein, 9 aa, Influenza virus
NVGYLCAGI

SEQ ID NO: 451532 - protein, 9 aa, Influenza virus
NVHPLAIGE

SEQ ID NO: 451533 - protein, 9 aa, Influenza virus
NVHPLTIGE

SEQ ID NO: 451534 - protein, 9 aa, Influenza virus
NVHRNTIGD

SEQ ID NO: 451535 - protein, 9 aa, Influenza virus
NVHRNTIGN

SEQ ID NO: 451536 - protein, 9 aa, Influenza virus
NVHRSTIGD

SEQ ID NO: 451537 - protein, 9 aa, Influenza virus
NVIDKMNKQ

SEQ ID NO: 451538 - protein, 9 aa, Influenza virus
NVIDKMNNQ

SEQ ID NO: 451539 - protein, 9 aa, Influenza virus
NVIDKMYKQ

SEQ ID NO: 451540 - protein, 9 aa, Influenza virus
NVINDKIDD

SEQ ID NO: 451541 - protein, 9 aa, Influenza virus
NVINWTKDS

SEQ ID NO: 451542 - protein, 9 aa, Influenza virus
NVINWTQDA

SEQ ID NO: 451543 - protein, 9 aa, Influenza virus
NVINWTRDA

SEQ ID NO: 451544 - protein, 9 aa, Influenza virus
NVINWTRDS

SEQ ID NO: 451545 - protein, 9 aa, Influenza virus
NVIVTREPY

SEQ ID NO: 451546 - protein, 9 aa, Influenza virus
NVKELGNGC

SEQ ID NO: 451547 - protein, 9 aa, Influenza virus
NVKNLFDEV

SEQ ID NO: 451548 - protein, 9 aa, Influenza virus
NVKNLHDQI

SEQ ID NO: 451549 - protein, 9 aa, Influenza virus
NVKNLHEQV

SEQ ID NO: 451550 - protein, 9 aa, Influenza virus
NVKNLYDKV

SEQ ID NO: 451551 - protein, 9 aa, Influenza virus
NVKNLYDRV

SEQ ID NO: 451552 - protein, 9 aa, Influenza virus
NVKNLYEKV

SEQ ID NO: 451553 - protein, 9 aa, Influenza virus
NVKNLYNKV

SEQ ID NO: 451554 - protein, 9 aa, Influenza virus
NVKSLKLAS

SEQ ID NO: 451555 - protein, 9 aa, Influenza virus
NVKSLKLAT

SEQ ID NO: 451556 - protein, 9 aa, Influenza virus
NVKSLKLVT

SEQ ID NO: 451557 - protein, 9 aa, Influenza virus
NVLDGVTAS

SEQ ID NO: 451558 - protein, 9 aa, Influenza virus
NVLIGQGDI

SEQ ID NO: 451559 - protein, 9 aa, Influenza virus
NVLIGQGDV

SEQ ID NO: 451560 - protein, 9 aa, Influenza virus
NVLLKHRFE

SEQ ID NO: 451561 - protein, 9 aa, Influenza virus
NVLLSPEEV

SEQ ID NO: 451562 - protein, 9 aa, Influenza virus
NVLRTQESE

SEQ ID NO: 451563 - protein, 9 aa, Influenza virus
NVLSIAPIM

SEQ ID NO: 451564 - protein, 9 aa, Influenza virus
NVLSVAPIM

SEQ ID NO: 451565 - protein, 9 aa, Influenza virus
NVNKITYGA

SEQ ID NO: 451566 - protein, 9 aa, Influenza virus
NVNRITYGA

SEQ ID NO: 451567 - protein, 9 aa, Influenza virus
NVNRITYGP

SEQ ID NO: 451568 - protein, 9 aa, Influenza virus
NVNRITYGV

SEQ ID NO: 451569 - protein, 9 aa, Influenza virus
NVPEKIHTR

SEQ ID NO: 451570 - protein, 9 aa, Influenza virus
NVPEKIRTR

SEQ ID NO: 451571 - protein, 9 aa, Influenza virus
NVPEKIRVK

SEQ ID NO: 451572 - protein, 9 aa, Influenza virus
NVPEKQTRG

SEQ ID NO: 451573 - protein, 9 aa, Influenza virus
NVPERQTRG

SEQ ID NO: 451574 - protein, 9 aa, Influenza virus
NVPETQTRG

SEQ ID NO: 451575 - protein, 9 aa, Influenza virus
NVPEWSYIV

SEQ ID NO: 451576 - protein, 9 aa, Influenza virus
NVPQAQDRG

SEQ ID NO: 451577 - protein, 9 aa, Influenza virus
NVPQAQNRG

SEQ ID NO: 451578 - protein, 9 aa, Influenza virus
NVPQIEARG

SEQ ID NO: 451579 - protein, 9 aa, Influenza virus
NVPQIEPRG

SEQ ID NO: 451580 - protein, 9 aa, Influenza virus
NVPQIESRG

SEQ ID NO: 451581 - protein, 9 aa, Influenza virus
NVPQIQNRG

SEQ ID NO: 451582 - protein, 9 aa, Influenza virus
NVPQMESRG

SEQ ID NO: 451583 - protein, 9 aa, Influenza virus
NVPQVQDRG

SEQ ID NO: 451584 - protein, 9 aa, Influenza virus
NVPQVQNRG

SEQ ID NO: 451585 - protein, 9 aa, Influenza virus
NVPSIQSRG

SEQ ID NO: 451586 - protein, 9 aa, Influenza virus
NVPVTQAME

SEQ ID NO: 451587 - protein, 9 aa, Influenza virus
NVPVTQTME

SEQ ID NO: 451588 - protein, 9 aa, Influenza virus
NVPVTQVEE

SEQ ID NO: 451589 - protein, 9 aa, Influenza virus
NVQNDYTTV

SEQ ID NO: 451590 - protein, 9 aa, Influenza virus
NVQNNYTTI

SEQ ID NO: 451591 - protein, 9 aa, Influenza virus
NVQNNYTTV

SEQ ID NO: 451592 - protein, 9 aa, Influenza virus
NVRCVCRDN

SEQ ID NO: 451593 - protein, 9 aa, Influenza virus
NVRGSGLRI

SEQ ID NO: 451594 - protein, 9 aa, Influenza virus
NVRGSGMRI

SEQ ID NO: 451595 - protein, 9 aa, Influenza virus
NVRGTGMRI

SEQ ID NO: 451596 - protein, 9 aa, Influenza virus
NVRNLHDQI

SEQ ID NO: 451597 - protein, 9 aa, Influenza virus
NVRNLHDQV

SEQ ID NO: 451598 - protein, 9 aa, Influenza virus
NVRNLHDRI

SEQ ID NO: 451599 - protein, 9 aa, Influenza virus
NVRNLHDRT

SEQ ID NO: 451600 - protein, 9 aa, Influenza virus
NVRNLHDRV

SEQ ID NO: 451601 - protein, 9 aa, Influenza virus
NVRNLHEQI

SEQ ID NO: 451602 - protein, 9 aa, Influenza virus
NVRNLHEQV

SEQ ID NO: 451603 - protein, 9 aa, Influenza virus
NVRNLHERI

SEQ ID NO: 451604 - protein, 9 aa, Influenza virus
NVRNLYDKV

SEQ ID NO: 451605 - protein, 9 aa, Influenza virus
NVRSLKLAT

SEQ ID NO: 451606 - protein, 9 aa, Influenza virus
NVSEWSYIV

SEQ ID NO: 451607 - protein, 9 aa, Influenza virus
NVSRIAIGN

SEQ ID NO: 451608 - protein, 9 aa, Influenza virus
NVSSSGTSK

SEQ ID NO: 451609 - protein, 9 aa, Influenza virus
NVSWTSNSI

SEQ ID NO: 451610 - protein, 9 aa, Influenza virus
NVTETLYLN

SEQ ID NO: 451611 - protein, 9 aa, Influenza virus
NVTHTGTSK

SEQ ID NO: 451612 - protein, 9 aa, Influenza virus
NVTHVQNNY

SEQ ID NO: 451613 - protein, 9 aa, Influenza virus
NVTKENTGS

SEQ ID NO: 451614 - protein, 9 aa, Influenza virus
NVTNVQNDY

SEQ ID NO: 451615 - protein, 9 aa, Influenza virus
NVTNVQNNY

SEQ ID NO: 451616 - protein, 9 aa, Influenza virus
NVTRSGTSK

SEQ ID NO: 451617 - protein, 9 aa, Influenza virus
NVTSSGTSK

SEQ ID NO: 451618 - protein, 9 aa, Influenza virus
NVTVTHAKD

SEQ ID NO: 451619 - protein, 9 aa, Influenza virus
NVTVTHAKN

SEQ ID NO: 451620 - protein, 9 aa, Influenza virus
NVTVTHAQD

SEQ ID NO: 451621 - protein, 9 aa, Influenza virus
NVTVTHAQN

SEQ ID NO: 451622 - protein, 9 aa, Influenza virus
NVTVTHARD

SEQ ID NO: 451623 - protein, 9 aa, Influenza virus
NVTVTHSIE

SEQ ID NO: 451624 - protein, 9 aa, Influenza virus
NVTVTHSIN

SEQ ID NO: 451625 - protein, 9 aa, Influenza virus
NVTVTHSVD

SEQ ID NO: 451626 - protein, 9 aa, Influenza virus
NVTVTHSVE

SEQ ID NO: 451627 - protein, 9 aa, Influenza virus
NVTVTHSVN

SEQ ID NO: 451628 - protein, 9 aa, Influenza virus
NVTVTQAQD

SEQ ID NO: 451629 - protein, 9 aa, Influenza virus
NVTVTSSIE

SEQ ID NO: 451630 - protein, 9 aa, Influenza virus
NVTVTSSVE

SEQ ID NO: 451631 - protein, 9 aa, Influenza virus
NVTYTGISK

SEQ ID NO: 451632 - protein, 9 aa, Influenza virus
NVTYTGTSK

SEQ ID NO: 451633 - protein, 9 aa, Influenza virus
NVTYTGTSR

SEQ ID NO: 451634 - protein, 9 aa, Influenza virus
NVVLNVSLH

SEQ ID NO: 451635 - protein, 9 aa, Influenza virus
NVVRKMMTN

SEQ ID NO: 451636 - protein, 9 aa, Influenza virus
NVVRKMMTS

SEQ ID NO: 451637 - protein, 9 aa, Influenza virus
NVWAGRTVS

SEQ ID NO: 451638 - protein, 9 aa, Influenza virus
NVWTYNAEL

SEQ ID NO: 451639 - protein, 9 aa, Influenza virus
NVYKALSIY

SEQ ID NO: 451640 - protein, 9 aa, Influenza virus
NVYKILSIC

SEQ ID NO: 451641 - protein, 9 aa, Influenza virus
NVYKILSIY

SEQ ID NO: 451642 - protein, 9 aa, Influenza virus
NVYKVLAIY

SEQ ID NO: 451643 - protein, 9 aa, Influenza virus
NVYKVLSIY

SEQ ID NO: 451644 - protein, 9 aa, Influenza virus
NVYQAKFEA

SEQ ID NO: 451645 - protein, 9 aa, Influenza virus
NVYQAKFES

SEQ ID NO: 451646 - protein, 9 aa, Influenza virus
NVYQARFEA

SEQ ID NO: 451647 - protein, 9 aa, Influenza virus
NVYQARFES

SEQ ID NO: 451648 - protein, 9 aa, Influenza virus
NVYQSRFEA

SEQ ID NO: 451649 - protein, 9 aa, Influenza virus
NVYRALSIY

SEQ ID NO: 451650 - protein, 9 aa, Influenza virus
NWFGYFGIF

SEQ ID NO: 451651 - protein, 9 aa, Influenza virus
NWHASNRPW

SEQ ID NO: 451652 - protein, 9 aa, Influenza virus
NWHGSNRPW

SEQ ID NO: 451653 - protein, 9 aa, Influenza virus
NWILWISFA

SEQ ID NO: 451654 - protein, 9 aa, Influenza virus
NWKGANRPI

SEQ ID NO: 451655 - protein, 9 aa, Influenza virus
NWKGANRPV

SEQ ID NO: 451656 - protein, 9 aa, Influenza virus
NWKGSNRPI

SEQ ID NO: 451657 - protein, 9 aa, Influenza virus
NWKGSNRPV

SEQ ID NO: 451658 - protein, 9 aa, Influenza virus
NWKGSNRPW

SEQ ID NO: 451659 - protein, 9 aa, Influenza virus
NWKSSNRPV

SEQ ID NO: 451660 - protein, 9 aa, Influenza virus
NWLTIGISG

SEQ ID NO: 451661 - protein, 9 aa, Influenza virus
NWLTKATNG

SEQ ID NO: 451662 - protein, 9 aa, Influenza virus
NWLTKETNG

SEQ ID NO: 451663 - protein, 9 aa, Influenza virus
NWLTKKEPD

SEQ ID NO: 451664 - protein, 9 aa, Influenza virus
NWLTKKKNP

SEQ ID NO: 451665 - protein, 9 aa, Influenza virus
NWLTKKKPD

SEQ ID NO: 451666 - protein, 9 aa, Influenza virus
NWMGSNRPV

SEQ ID NO: 451667 - protein, 9 aa, Influenza virus
NWNGMNRPI

SEQ ID NO: 451668 - protein, 9 aa, Influenza virus
NWNGMNRPV

SEQ ID NO: 451669 - protein, 9 aa, Influenza virus
NWPDGAEIE

SEQ ID NO: 451670 - protein, 9 aa, Influenza virus
NWPDGAKIE

SEQ ID NO: 451671 - protein, 9 aa, Influenza virus
NWPDGANIG

SEQ ID NO: 451672 - protein, 9 aa, Influenza virus
NWPDGSNIG

SEQ ID NO: 451673 - protein, 9 aa, Influenza virus
NWPSSSGGL

SEQ ID NO: 451674 - protein, 9 aa, Influenza virus
NWQGANRPI

SEQ ID NO: 451675 - protein, 9 aa, Influenza virus
NWQGANRPV

SEQ ID NO: 451676 - protein, 9 aa, Influenza virus
NWQGSNRPV

SEQ ID NO: 451677 - protein, 9 aa, Influenza virus
NWRGANRPV

SEQ ID NO: 451678 - protein, 9 aa, Influenza virus
NWRGSNRPI

SEQ ID NO: 451679 - protein, 9 aa, Influenza virus
NWRGSNRPV

SEQ ID NO: 451680 - protein, 9 aa, Influenza virus
NWRGSNRPW

SEQ ID NO: 451681 - protein, 9 aa, Influenza virus
NWRQANNGE

SEQ ID NO: 451682 - protein, 9 aa, Influenza virus
NWSGYSGAF

SEQ ID NO: 451683 - protein, 9 aa, Influenza virus
NWSGYSGIF

SEQ ID NO: 451684 - protein, 9 aa, Influenza virus
NWSGYSGSF

SEQ ID NO: 451685 - protein, 9 aa, Influenza virus
NWSGYSGVF

SEQ ID NO: 451686 - protein, 9 aa, Influenza virus
NWSKPQCQI

SEQ ID NO: 451687 - protein, 9 aa, Influenza virus
NWSWHDGAI

SEQ ID NO: 451688 - protein, 9 aa, Influenza virus
NWSWPDGAE

SEQ ID NO: 451689 - protein, 9 aa, Influenza virus
NWTGTNRPI

SEQ ID NO: 451690 - protein, 9 aa, Influenza virus
NWTGTNRPV

SEQ ID NO: 451691 - protein, 9 aa, Influenza virus
NWTKDSITD

SEQ ID NO: 451692 - protein, 9 aa, Influenza virus
NWTQDAMTE

SEQ ID NO: 451693 - protein, 9 aa, Influenza virus
NWTRDAMTE

SEQ ID NO: 451694 - protein, 9 aa, Influenza virus
NWTRDSIIE

SEQ ID NO: 451695 - protein, 9 aa, Influenza virus
NWTRDSITE

SEQ ID NO: 451696 - protein, 9 aa, Influenza virus
NWTRDSLTE

SEQ ID NO: 451697 - protein, 9 aa, Influenza virus
NWTRDSMTE

SEQ ID NO: 451698 - protein, 9 aa, Influenza virus
NWTRDSVTE

SEQ ID NO: 451699 - protein, 9 aa, Influenza virus
NYARLYIWG

SEQ ID NO: 451700 - protein, 9 aa, Influenza virus
NYDSIRGEF

SEQ ID NO: 451701 - protein, 9 aa, Influenza virus
NYEELKHLL

SEQ ID NO: 451702 - protein, 9 aa, Influenza virus
NYEELREHL

SEQ ID NO: 451703 - protein, 9 aa, Influenza virus
NYEELREQL

SEQ ID NO: 451704 - protein, 9 aa, Influenza virus
NYGPINVTK

SEQ ID NO: 451705 - protein, 9 aa, Influenza virus
NYGVKGFGF

SEQ ID NO: 451706 - protein, 9 aa, Influenza virus
NYHQSFVPS

SEQ ID NO: 451707 - protein, 9 aa, Influenza virus
NYHYEECSC

SEQ ID NO: 451708 - protein, 9 aa, Influenza virus
NYKEICIAW

SEQ ID NO: 451709 - protein, 9 aa, Influenza virus
NYKEICVAW

SEQ ID NO: 451710 - protein, 9 aa, Influenza virus
NYKEIRIAW

SEQ ID NO: 451711 - protein, 9 aa, Influenza virus
NYLIRALTL

SEQ ID NO: 451712 - protein, 9 aa, Influenza virus
NYLLLNKSL

SEQ ID NO: 451713 - protein, 9 aa, Influenza virus
NYLMLNKSL

SEQ ID NO: 451714 - protein, 9 aa, Influenza virus
NYPKYEEES

SEQ ID NO: 451715 - protein, 9 aa, Influenza virus
NYPKYSEES

SEQ ID NO: 451716 - protein, 9 aa, Influenza virus
NYQQSFVPS

SEQ ID NO: 451717 - protein, 9 aa, Influenza virus
NYQSLRSIL

SEQ ID NO: 451718 - protein, 9 aa, Influenza virus
NYREICIAW

SEQ ID NO: 451719 - protein, 9 aa, Influenza virus
NYREVCIAW

SEQ ID NO: 451720 - protein, 9 aa, Influenza virus
NYSKYEEES

SEQ ID NO: 451721 - protein, 9 aa, Influenza virus
NYSLPPNFS

SEQ ID NO: 451722 - protein, 9 aa, Influenza virus
NYVCSGLVG

SEQ ID NO: 451723 - protein, 9 aa, Influenza virus
NYVSMEFSL

SEQ ID NO: 451724 - protein, 9 aa, Influenza virus
NYYNETFVN

SEQ ID NO: 451725 - protein, 9 aa, Influenza virus
NYYYEECSC

SEQ ID NO: 451726 - protein, 9 aa, Influenza virus
PAANNADHR

SEQ ID NO: 451727 - protein, 9 aa, Influenza virus
PAANSADHR

SEQ ID NO: 451728 - protein, 9 aa, Influenza virus
PAANSAHHR

SEQ ID NO: 451729 - protein, 9 aa, Influenza virus
PAAPHGLCY

SEQ ID NO: 451730 - protein, 9 aa, Influenza virus
PAATALANT

SEQ ID NO: 451731 - protein, 9 aa, Influenza virus
PACAYGPAV

SEQ ID NO: 451732 - protein, 9 aa, Influenza virus
PACDLHLTG

SEQ ID NO: 451733 - protein, 9 aa, Influenza virus
PACDLYLTG

SEQ ID NO: 451734 - protein, 9 aa, Influenza virus
PACIYGLVV

SEQ ID NO: 451735 - protein, 9 aa, Influenza virus
PACVYGLAV

SEQ ID NO: 451736 - protein, 9 aa, Influenza virus
PACVYGLVV

SEQ ID NO: 451737 - protein, 9 aa, Influenza virus
PACVYGPAV

SEQ ID NO: 451738 - protein, 9 aa, Influenza virus
PADTRIYYF

SEQ ID NO: 451739 - protein, 9 aa, Influenza virus
PADTRVYYF

SEQ ID NO: 451740 - protein, 9 aa, Influenza virus
PAECRTFFL

SEQ ID NO: 451741 - protein, 9 aa, Influenza virus
PAETRIYYF

SEQ ID NO: 451742 - protein, 9 aa, Influenza virus
PAETRVYYF

SEQ ID NO: 451743 - protein, 9 aa, Influenza virus
PAFSVQRNL

SEQ ID NO: 451744 - protein, 9 aa, Influenza virus
PAHKSQLIW

SEQ ID NO: 451745 - protein, 9 aa, Influenza virus
PAHKSQLVW

SEQ ID NO: 451746 - protein, 9 aa, Influenza virus
PAKLLKERG

SEQ ID NO: 451747 - protein, 9 aa, Influenza virus
PALIIWGIH

SEQ ID NO: 451748 - protein, 9 aa, Influenza virus
PALIIWGVH

SEQ ID NO: 451749 - protein, 9 aa, Influenza virus
PALITWGIH

SEQ ID NO: 451750 - protein, 9 aa, Influenza virus
PALIVWGIH

SEQ ID NO: 451751 - protein, 9 aa, Influenza virus
PALIVWGVH

SEQ ID NO: 451752 - protein, 9 aa, Influenza virus
PALRMKWMM

SEQ ID NO: 451753 - protein, 9 aa, Influenza virus
PALSINELG

SEQ ID NO: 451754 - protein, 9 aa, Influenza virus
PALSINELS

SEQ ID NO: 451755 - protein, 9 aa, Influenza virus
PALSISELS

SEQ ID NO: 451756 - protein, 9 aa, Influenza virus
PANGICYPG

SEQ ID NO: 451757 - protein, 9 aa, Influenza virus
PANKQASYK

SEQ ID NO: 451758 - protein, 9 aa, Influenza virus
PANNQASYK

SEQ ID NO: 451759 - protein, 9 aa, Influenza virus
PANNQASYR

SEQ ID NO: 451760 - protein, 9 aa, Influenza virus
PANSQASYK

SEQ ID NO: 451761 - protein, 9 aa, Influenza virus
PANSQAYTK

SEQ ID NO: 451762 - protein, 9 aa, Influenza virus
PAQNAISIT

SEQ ID NO: 451763 - protein, 9 aa, Influenza virus
PAQNAISTT

SEQ ID NO: 451764 - protein, 9 aa, Influenza virus
PASNQASYK

SEQ ID NO: 451765 - protein, 9 aa, Influenza virus
PASRYLIDM

SEQ ID NO: 451766 - protein, 9 aa, Influenza virus
PASRYLTDM

SEQ ID NO: 451767 - protein, 9 aa, Influenza virus
PASSQAYTK

SEQ ID NO: 451768 - protein, 9 aa, Influenza virus
PATAQMALQ

SEQ ID NO: 451769 - protein, 9 aa, Influenza virus
PATIGECPK

SEQ ID NO: 451770 - protein, 9 aa, Influenza virus
PAYCNTDLG

SEQ ID NO: 451771 - protein, 9 aa, Influenza virus
PCEPIIIEK

SEQ ID NO: 451772 - protein, 9 aa, Influenza virus
PCEPIIIER

SEQ ID NO: 451773 - protein, 9 aa, Influenza virus
PCEPIIVER

SEQ ID NO: 451774 - protein, 9 aa, Influenza virus
PCEPTIIER

SEQ ID NO: 451775 - protein, 9 aa, Influenza virus
PCFWLEMIR

SEQ ID NO: 451776 - protein, 9 aa, Influenza virus
PCFWVELIR

SEQ ID NO: 451777 - protein, 9 aa, Influenza virus
PCFWVELVR

SEQ ID NO: 451778 - protein, 9 aa, Influenza virus
PCFWVEMIR

SEQ ID NO: 451779 - protein, 9 aa, Influenza virus
PCFYIELIR

SEQ ID NO: 451780 - protein, 9 aa, Influenza virus
PCFYVELIR

SEQ ID NO: 451781 - protein, 9 aa, Influenza virus
PCFYVELTR

SEQ ID NO: 451782 - protein, 9 aa, Influenza virus
PCLTDKGSI

SEQ ID NO: 451783 - protein, 9 aa, Influenza virus
PDATAVAVL

SEQ ID NO: 451784 - protein, 9 aa, Influenza virus
PDATAVVVL

SEQ ID NO: 451785 - protein, 9 aa, Influenza virus
PDDGAVAVL

SEQ ID NO: 451786 - protein, 9 aa, Influenza virus
PDECRFYAL

SEQ ID NO: 451787 - protein, 9 aa, Influenza virus
PDGADINFM

SEQ ID NO: 451788 - protein, 9 aa, Influenza virus
PDGADLPFT

SEQ ID NO: 451789 - protein, 9 aa, Influenza virus
PDGAEIEYF

SEQ ID NO: 451790 - protein, 9 aa, Influenza virus
PDGAELPFA

SEQ ID NO: 451791 - protein, 9 aa, Influenza virus
PDGAELPFI

SEQ ID NO: 451792 - protein, 9 aa, Influenza virus
PDGAELPFT

SEQ ID NO: 451793 - protein, 9 aa, Influenza virus
PDGAKIEYF

SEQ ID NO: 451794 - protein, 9 aa, Influenza virus
PDGAKIEYS

SEQ ID NO: 451795 - protein, 9 aa, Influenza virus
PDGAKIKYF

SEQ ID NO: 451796 - protein, 9 aa, Influenza virus
PDGAKIQYF

SEQ ID NO: 451797 - protein, 9 aa, Influenza virus
PDGAKLPFT

SEQ ID NO: 451798 - protein, 9 aa, Influenza virus
PDGALLPFD

SEQ ID NO: 451799 - protein, 9 aa, Influenza virus
PDGALLPLT

SEQ ID NO: 451800 - protein, 9 aa, Influenza virus
PDGANIDFM

SEQ ID NO: 451801 - protein, 9 aa, Influenza virus
PDGANIDFV

SEQ ID NO: 451802 - protein, 9 aa, Influenza virus
PDGANIGFM

SEQ ID NO: 451803 - protein, 9 aa, Influenza virus
PDGANIGLC

SEQ ID NO: 451804 - protein, 9 aa, Influenza virus
PDGANINFM

SEQ ID NO: 451805 - protein, 9 aa, Influenza virus
PDGANINLM

SEQ ID NO: 451806 - protein, 9 aa, Influenza virus
PDGANISFM

SEQ ID NO: 451807 - protein, 9 aa, Influenza virus
PDGAQIKYF

SEQ ID NO: 451808 - protein, 9 aa, Influenza virus
PDGAQIQYF

SEQ ID NO: 451809 - protein, 9 aa, Influenza virus
PDGARIQYF

SEQ ID NO: 451810 - protein, 9 aa, Influenza virus
PDGCRFYAL

SEQ ID NO: 451811 - protein, 9 aa, Influenza virus
PDGPQIQYF

SEQ ID NO: 451812 - protein, 9 aa, Influenza virus
PDGSDIGFM

SEQ ID NO: 451813 - protein, 9 aa, Influenza virus
PDGSNIGFM

SEQ ID NO: 451814 - protein, 9 aa, Influenza virus
PDGSNIGFV

SEQ ID NO: 451815 - protein, 9 aa, Influenza virus
PDHEGEGIP

SEQ ID NO: 451816 - protein, 9 aa, Influenza virus
PDIYDFNEG

SEQ ID NO: 451817 - protein, 9 aa, Influenza virus
PDLYDYKED

SEQ ID NO: 451818 - protein, 9 aa, Influenza virus
PDLYDYKEN

SEQ ID NO: 451819 - protein, 9 aa, Influenza virus
PDLYDYKES

SEQ ID NO: 451820 - protein, 9 aa, Influenza virus
PDLYDYKKN

SEQ ID NO: 451821 - protein, 9 aa, Influenza virus
PDNEAVAVL

SEQ ID NO: 451822 - protein, 9 aa, Influenza virus
PDNGAVAVL

SEQ ID NO: 451823 - protein, 9 aa, Influenza virus
PDNGAVAVV

SEQ ID NO: 451824 - protein, 9 aa, Influenza virus
PDPFRLLQN

SEQ ID NO: 451825 - protein, 9 aa, Influenza virus
PDPGVKGFA

SEQ ID NO: 451826 - protein, 9 aa, Influenza virus
PDRASFFKG

SEQ ID NO: 451827 - protein, 9 aa, Influenza virus
PDRASFFRG

SEQ ID NO: 451828 - protein, 9 aa, Influenza virus
PDRASFLRG

SEQ ID NO: 451829 - protein, 9 aa, Influenza virus
PDRATFLRS

SEQ ID NO: 451830 - protein, 9 aa, Influenza virus
PDSGAVAVL

SEQ ID NO: 451831 - protein, 9 aa, Influenza virus
PDSSWLFGG

SEQ ID NO: 451832 - protein, 9 aa, Influenza virus
PDSTAVAVI

SEQ ID NO: 451833 - protein, 9 aa, Influenza virus
PDSVLVNTY

SEQ ID NO: 451834 - protein, 9 aa, Influenza virus
PDTTAVAVL

SEQ ID NO: 451835 - protein, 9 aa, Influenza virus
PDTYDFNEG

SEQ ID NO: 451836 - protein, 9 aa, Influenza virus
PDVRCICRD

SEQ ID NO: 451837 - protein, 9 aa, Influenza virus
PDVRCTCRD

SEQ ID NO: 451838 - protein, 9 aa, Influenza virus
PDVRCVCRD

SEQ ID NO: 451839 - protein, 9 aa, Influenza virus
PDWFRNVLS

SEQ ID NO: 451840 - protein, 9 aa, Influenza virus
PDYHYEECS

SEQ ID NO: 451841 - protein, 9 aa, Influenza virus
PDYQIGYVC

SEQ ID NO: 451842 - protein, 9 aa, Influenza virus
PDYQSIRSI

SEQ ID NO: 451843 - protein, 9 aa, Influenza virus
PDYQSLRSI

SEQ ID NO: 451844 - protein, 9 aa, Influenza virus
PEAGLKWEL

SEQ ID NO: 451845 - protein, 9 aa, Influenza virus
PEAYNFNEG

SEQ ID NO: 451846 - protein, 9 aa, Influenza virus
PEDLIVFNT

SEQ ID NO: 451847 - protein, 9 aa, Influenza virus
PEEAKYVEW

SEQ ID NO: 451848 - protein, 9 aa, Influenza virus
PEEAKYVWW

SEQ ID NO: 451849 - protein, 9 aa, Influenza virus
PEEGTSIWT

SEQ ID NO: 451850 - protein, 9 aa, Influenza virus
PEERNSIWT

SEQ ID NO: 451851 - protein, 9 aa, Influenza virus
PEERPSIWT

SEQ ID NO: 451852 - protein, 9 aa, Influenza virus
PEERTSIWT

SEQ ID NO: 451853 - protein, 9 aa, Influenza virus
PEEVKYVWW

SEQ ID NO: 451854 - protein, 9 aa, Influenza virus
PEEVSEAQG

SEQ ID NO: 451855 - protein, 9 aa, Influenza virus
PEEVSETQG

SEQ ID NO: 451856 - protein, 9 aa, Influenza virus
PEFGYLLKG

SEQ ID NO: 451857 - protein, 9 aa, Influenza virus
PEFGYLLRG

SEQ ID NO: 451858 - protein, 9 aa, Influenza virus
PEGMCYPGF

SEQ ID NO: 451859 - protein, 9 aa, Influenza virus
PEGMCYPGS

SEQ ID NO: 451860 - protein, 9 aa, Influenza virus
PEKIHTRGL

SEQ ID NO: 451861 - protein, 9 aa, Influenza virus
PEKIRTRGL

SEQ ID NO: 451862 - protein, 9 aa, Influenza virus
PEKIRVKRR

SEQ ID NO: 451863 - protein, 9 aa, Influenza virus
PEKQTRGIF

SEQ ID NO: 451864 - protein, 9 aa, Influenza virus
PEKQTRGLF

SEQ ID NO: 451865 - protein, 9 aa, Influenza virus
PELTGLDCI

SEQ ID NO: 451866 - protein, 9 aa, Influenza virus
PELTGLDCM

SEQ ID NO: 451867 - protein, 9 aa, Influenza virus
PELTGLNCI

SEQ ID NO: 451868 - protein, 9 aa, Influenza virus
PELTGMDCI

SEQ ID NO: 451869 - protein, 9 aa, Influenza virus
PELTGMNCI

SEQ ID NO: 451870 - protein, 9 aa, Influenza virus
PENAYKIVK

SEQ ID NO: 451871 - protein, 9 aa, Influenza virus
PEQSKMQFS

SEQ ID NO: 451872 - protein, 9 aa, Influenza virus
PEQSRMQFS

SEQ ID NO: 451873 - protein, 9 aa, Influenza virus
PERQTRGIF

SEQ ID NO: 451874 - protein, 9 aa, Influenza virus
PERQTRGLF

SEQ ID NO: 451875 - protein, 9 aa, Influenza virus
PESMREEYQ

SEQ ID NO: 451876 - protein, 9 aa, Influenza virus
PESMREEYR

SEQ ID NO: 451877 - protein, 9 aa, Influenza virus
PESVLINTY

SEQ ID NO: 451878 - protein, 9 aa, Influenza virus
PESVLVNTY

SEQ ID NO: 451879 - protein, 9 aa, Influenza virus
PETQTRGIF

SEQ ID NO: 451880 - protein, 9 aa, Influenza virus
PEVCLKWDL

SEQ ID NO: 451881 - protein, 9 aa, Influenza virus
PEVCLKWEL

SEQ ID NO: 451882 - protein, 9 aa, Influenza virus
PEWFRNILS

SEQ ID NO: 451883 - protein, 9 aa, Influenza virus
PEWFRNVLS

SEQ ID NO: 451884 - protein, 9 aa, Influenza virus
PEWSYIIEK

SEQ ID NO: 451885 - protein, 9 aa, Influenza virus
PEWSYIMEK

SEQ ID NO: 451886 - protein, 9 aa, Influenza virus
PEWSYIVEK

SEQ ID NO: 451887 - protein, 9 aa, Influenza virus
PEWSYIVER

SEQ ID NO: 451888 - protein, 9 aa, Influenza virus
PEYAFKIAK

SEQ ID NO: 451889 - protein, 9 aa, Influenza virus
PEYAYIVKK

SEQ ID NO: 451890 - protein, 9 aa, Influenza virus
PEYAYKIAK

SEQ ID NO: 451891 - protein, 9 aa, Influenza virus
PEYAYKIIK

SEQ ID NO: 451892 - protein, 9 aa, Influenza virus
PEYAYKIVK

SEQ ID NO: 451893 - protein, 9 aa, Influenza virus
PEYAYKVVK

SEQ ID NO: 451894 - protein, 9 aa, Influenza virus
PEYAYRIIK

SEQ ID NO: 451895 - protein, 9 aa, Influenza virus
PEYGFKISK

SEQ ID NO: 451896 - protein, 9 aa, Influenza virus
PEYGFKISR

SEQ ID NO: 451897 - protein, 9 aa, Influenza virus
PEYGFRISK

SEQ ID NO: 451898 - protein, 9 aa, Influenza virus
PEYGHLITG

SEQ ID NO: 451899 - protein, 9 aa, Influenza virus
PEYGHLTTG

SEQ ID NO: 451900 - protein, 9 aa, Influenza virus
PEYGHLVTG

SEQ ID NO: 451901 - protein, 9 aa, Influenza virus
PEYGYLITG

SEQ ID NO: 451902 - protein, 9 aa, Influenza virus
PEYQSLRSI

SEQ ID NO: 451903 - protein, 9 aa, Influenza virus
PFAAAPPEQ

SEQ ID NO: 451904 - protein, 9 aa, Influenza virus
PFAAAPPKQ

SEQ ID NO: 451905 - protein, 9 aa, Influenza virus
PFAAAPPVQ

SEQ ID NO: 451906 - protein, 9 aa, Influenza virus
PFAKDNSIR

SEQ ID NO: 451907 - protein, 9 aa, Influenza virus
PFDDRLRRD

SEQ ID NO: 451908 - protein, 9 aa, Influenza virus
PFDFDKISQ

SEQ ID NO: 451909 - protein, 9 aa, Influenza virus
PFDIDKIIT

SEQ ID NO: 451910 - protein, 9 aa, Influenza virus
PFDVPDYQS

SEQ ID NO: 451911 - protein, 9 aa, Influenza virus
PFDVPEYQS

SEQ ID NO: 451912 - protein, 9 aa, Influenza virus
PFDVPGYQS

SEQ ID NO: 451913 - protein, 9 aa, Influenza virus
PFDVPNYQS

SEQ ID NO: 451914 - protein, 9 aa, Influenza virus
PFHKDNAIR

SEQ ID NO: 451915 - protein, 9 aa, Influenza virus
PFHKDNALR

SEQ ID NO: 451916 - protein, 9 aa, Influenza virus
PFHKDNAVR

SEQ ID NO: 451917 - protein, 9 aa, Influenza virus
PFHKGNSAR

SEQ ID NO: 451918 - protein, 9 aa, Influenza virus
PFHLATKQV

SEQ ID NO: 451919 - protein, 9 aa, Influenza virus
PFHLGTKQV

SEQ ID NO: 451920 - protein, 9 aa, Influenza virus
PFHLGTRQV

SEQ ID NO: 451921 - protein, 9 aa, Influenza virus
PFHNIHPLA

SEQ ID NO: 451922 - protein, 9 aa, Influenza virus
PFHNIHPLT

SEQ ID NO: 451923 - protein, 9 aa, Influenza virus
PFHNVHPFT

SEQ ID NO: 451924 - protein, 9 aa, Influenza virus
PFHNVHPLT

SEQ ID NO: 451925 - protein, 9 aa, Influenza virus
PFILKDCSV

SEQ ID NO: 451926 - protein, 9 aa, Influenza virus
PFISCSHFE

SEQ ID NO: 451927 - protein, 9 aa, Influenza virus
PFISCSHLE

SEQ ID NO: 451928 - protein, 9 aa, Influenza virus
PFISCSHME

SEQ ID NO: 451929 - protein, 9 aa, Influenza virus
PFISCSHSE

SEQ ID NO: 451930 - protein, 9 aa, Influenza virus
PFISCSPLE

SEQ ID NO: 451931 - protein, 9 aa, Influenza virus
PFISCSQLE

SEQ ID NO: 451932 - protein, 9 aa, Influenza virus
PFISCSYLE

SEQ ID NO: 451933 - protein, 9 aa, Influenza virus
PFKGFFPFH

SEQ ID NO: 451934 - protein, 9 aa, Influenza virus
PFKLLQNSQ

SEQ ID NO: 451935 - protein, 9 aa, Influenza virus
PFKLLQTSQ

SEQ ID NO: 451936 - protein, 9 aa, Influenza virus
PFLDRIRRD

SEQ ID NO: 451937 - protein, 9 aa, Influenza virus
PFLDRLRRD

SEQ ID NO: 451938 - protein, 9 aa, Influenza virus
PFPVGSGSF

SEQ ID NO: 451939 - protein, 9 aa, Influenza virus
PFQGFFPFH

SEQ ID NO: 451940 - protein, 9 aa, Influenza virus
PFQNASRHH

SEQ ID NO: 451941 - protein, 9 aa, Influenza virus
PFQNASRHY

SEQ ID NO: 451942 - protein, 9 aa, Influenza virus
PFQNASRYY

SEQ ID NO: 451943 - protein, 9 aa, Influenza virus
PFQNICKPY

SEQ ID NO: 451944 - protein, 9 aa, Influenza virus
PFQNIDSRA

SEQ ID NO: 451945 - protein, 9 aa, Influenza virus
PFQNIDSWA

SEQ ID NO: 451946 - protein, 9 aa, Influenza virus
PFQNIHPAT

SEQ ID NO: 451947 - protein, 9 aa, Influenza virus
PFQNIHPIT

SEQ ID NO: 451948 - protein, 9 aa, Influenza virus
PFQNIHPVT

SEQ ID NO: 451949 - protein, 9 aa, Influenza virus
PFQNINPRT

SEQ ID NO: 451950 - protein, 9 aa, Influenza virus
PFQNINSRA

SEQ ID NO: 451951 - protein, 9 aa, Influenza virus
PFQNINSRT

SEQ ID NO: 451952 - protein, 9 aa, Influenza virus
PFQNINSRV

SEQ ID NO: 451953 - protein, 9 aa, Influenza virus
PFQNISRIA

SEQ ID NO: 451954 - protein, 9 aa, Influenza virus
PFQNISRIS

SEQ ID NO: 451955 - protein, 9 aa, Influenza virus
PFQNISRVS

SEQ ID NO: 451956 - protein, 9 aa, Influenza virus
PFQNLSPRT

SEQ ID NO: 451957 - protein, 9 aa, Influenza virus
PFQNTSKHY

SEQ ID NO: 451958 - protein, 9 aa, Influenza virus
PFQNTSRHY

SEQ ID NO: 451959 - protein, 9 aa, Influenza virus
PFQNVHPIT

SEQ ID NO: 451960 - protein, 9 aa, Influenza virus
PFQNVHPVT

SEQ ID NO: 451961 - protein, 9 aa, Influenza virus
PFQNVNKIT

SEQ ID NO: 451962 - protein, 9 aa, Influenza virus
PFQNVNKVT

SEQ ID NO: 451963 - protein, 9 aa, Influenza virus
PFQNVNRIT

SEQ ID NO: 451964 - protein, 9 aa, Influenza virus
PFQNVNSRA

SEQ ID NO: 451965 - protein, 9 aa, Influenza virus
PFQNVSRIA

SEQ ID NO: 451966 - protein, 9 aa, Influenza virus
PFQNVSRTA

SEQ ID NO: 451967 - protein, 9 aa, Influenza virus
PFQSLIPKA

SEQ ID NO: 451968 - protein, 9 aa, Influenza virus
PFQSLVPKA

SEQ ID NO: 451969 - protein, 9 aa, Influenza virus
PFQSLVPRA

SEQ ID NO: 451970 - protein, 9 aa, Influenza virus
PFRALISWE

SEQ ID NO: 451971 - protein, 9 aa, Influenza virus
PFRALISWG

SEQ ID NO: 451972 - protein, 9 aa, Influenza virus
PFRALVSWE

SEQ ID NO: 451973 - protein, 9 aa, Influenza virus
PFRGFFPFH

SEQ ID NO: 451974 - protein, 9 aa, Influenza virus
PFRLLQNSQ

SEQ ID NO: 451975 - protein, 9 aa, Influenza virus
PFRLLQSSQ

SEQ ID NO: 451976 - protein, 9 aa, Influenza virus
PFRTLMSCP

SEQ ID NO: 451977 - protein, 9 aa, Influenza virus
PFRTLMSVE

SEQ ID NO: 451978 - protein, 9 aa, Influenza virus
PFRTLMSVK

SEQ ID NO: 451979 - protein, 9 aa, Influenza virus
PFSKDNGIR

SEQ ID NO: 451980 - protein, 9 aa, Influenza virus
PFSKDNSIQ

SEQ ID NO: 451981 - protein, 9 aa, Influenza virus
PFSKDNSIR

SEQ ID NO: 451982 - protein, 9 aa, Influenza virus
PFSKDNSVR

SEQ ID NO: 451983 - protein, 9 aa, Influenza virus
PFTIGECPK

SEQ ID NO: 451984 - protein, 9 aa, Influenza virus
PFTIGECPR

SEQ ID NO: 451985 - protein, 9 aa, Influenza virus
PFTKDNSIR

SEQ ID NO: 451986 - protein, 9 aa, Influenza virus
PFVACGPAE

SEQ ID NO: 451987 - protein, 9 aa, Influenza virus
PFVACGPSE

SEQ ID NO: 451988 - protein, 9 aa, Influenza virus
PFVACGPTE

SEQ ID NO: 451989 - protein, 9 aa, Influenza virus
PFVACSPSE

SEQ ID NO: 451990 - protein, 9 aa, Influenza virus
PFVRGQQGR

SEQ ID NO: 451991 - protein, 9 aa, Influenza virus
PFVSCGPSE

SEQ ID NO: 451992 - protein, 9 aa, Influenza virus
PFVSCSHLE

SEQ ID NO: 451993 - protein, 9 aa, Influenza virus
PFYLGTKQV

SEQ ID NO: 451994 - protein, 9 aa, Influenza virus
PFYLGTRQV

SEQ ID NO: 451995 - protein, 9 aa, Influenza virus
PGAPGVKGF

SEQ ID NO: 451996 - protein, 9 aa, Influenza virus
PGAPHGLCY

SEQ ID NO: 451997 - protein, 9 aa, Influenza virus
PGARPKVNG

SEQ ID NO: 451998 - protein, 9 aa, Influenza virus
PGARPQVNG

SEQ ID NO: 451999 - protein, 9 aa, Influenza virus
PGARRIDFH

SEQ ID NO: 452000 - protein, 9 aa, Influenza virus
PGARRIDFN

SEQ ID NO: 452001 - protein, 9 aa, Influenza virus
PGATINEEA

SEQ ID NO: 452002 - protein, 9 aa, Influenza virus
PGATVNEEA

SEQ ID NO: 452003 - protein, 9 aa, Influenza virus
PGATVNEGA

SEQ ID NO: 452004 - protein, 9 aa, Influenza virus
PGCDRLQDT

SEQ ID NO: 452005 - protein, 9 aa, Influenza virus
PGDHITFSH

SEQ ID NO: 452006 - protein, 9 aa, Influenza virus
PGDIIVFNT

SEQ ID NO: 452007 - protein, 9 aa, Influenza virus
PGDLILFNT

SEQ ID NO: 452008 - protein, 9 aa, Influenza virus
PGDLIVFNT

SEQ ID NO: 452009 - protein, 9 aa, Influenza virus
PGDNIIFSH

SEQ ID NO: 452010 - protein, 9 aa, Influenza virus
PGDNITFSD

SEQ ID NO: 452011 - protein, 9 aa, Influenza virus
PGDNITFSH

SEQ ID NO: 452012 - protein, 9 aa, Influenza virus
PGDRPKVNG

SEQ ID NO: 452013 - protein, 9 aa, Influenza virus
PGDSIIFNS

SEQ ID NO: 452014 - protein, 9 aa, Influenza virus
PGDSITFSH

SEQ ID NO: 452015 - protein, 9 aa, Influenza virus
PGDTVTFTF

SEQ ID NO: 452016 - protein, 9 aa, Influenza virus
PGELDNNGE

SEQ ID NO: 452017 - protein, 9 aa, Influenza virus
PGELNNNGE

SEQ ID NO: 452018 - protein, 9 aa, Influenza virus
PGERIMFES

SEQ ID NO: 452019 - protein, 9 aa, Influenza virus
PGERITFES

SEQ ID NO: 452020 - protein, 9 aa, Influenza virus
PGERTTFES

SEQ ID NO: 452021 - protein, 9 aa, Influenza virus
PGETLKVES

SEQ ID NO: 452022 - protein, 9 aa, Influenza virus
PGETLNIES

SEQ ID NO: 452023 - protein, 9 aa, Influenza virus
PGETLNVES

SEQ ID NO: 452024 - protein, 9 aa, Influenza virus
PGEVDNNGE

SEQ ID NO: 452025 - protein, 9 aa, Influenza virus
PGFHFEECS

SEQ ID NO: 452026 - protein, 9 aa, Influenza virus
PGFVENLEE

SEQ ID NO: 452027 - protein, 9 aa, Influenza virus
PGIFENSCI

SEQ ID NO: 452028 - protein, 9 aa, Influenza virus
PGIFENSCL

SEQ ID NO: 452029 - protein, 9 aa, Influenza virus
PGIFESSCL

SEQ ID NO: 452030 - protein, 9 aa, Influenza virus
PGIFGNSCL

SEQ ID NO: 452031 - protein, 9 aa, Influenza virus
PGIKGFGFL

SEQ ID NO: 452032 - protein, 9 aa, Influenza virus
PGKFTNEEA

SEQ ID NO: 452033 - protein, 9 aa, Influenza virus
PGKQAKGLF

SEQ ID NO: 452034 - protein, 9 aa, Influenza virus
PGLFENSCL

SEQ ID NO: 452035 - protein, 9 aa, Influenza virus
PGLINGWYG

SEQ ID NO: 452036 - protein, 9 aa, Influenza virus
PGLVAGWYG

SEQ ID NO: 452037 - protein, 9 aa, Influenza virus
PGMMMGMFN

SEQ ID NO: 452038 - protein, 9 aa, Influenza virus
PGMQIRGFV

SEQ ID NO: 452039 - protein, 9 aa, Influenza virus
PGNAEIEDL

SEQ ID NO: 452040 - protein, 9 aa, Influenza virus
PGNFNDYEE

SEQ ID NO: 452041 - protein, 9 aa, Influenza virus
PGNNBNGVK

SEQ ID NO: 452042 - protein, 9 aa, Influenza virus
PGNNNGVKG

SEQ ID NO: 452043 - protein, 9 aa, Influenza virus
PGNNNNGVK

SEQ ID NO: 452044 - protein, 9 aa, Influenza virus
PGQTLRIRS

SEQ ID NO: 452045 - protein, 9 aa, Influenza virus
PGQTLRVKS

SEQ ID NO: 452046 - protein, 9 aa, Influenza virus
PGQTLRVRS

SEQ ID NO: 452047 - protein, 9 aa, Influenza virus
PGQTVKIKT

SEQ ID NO: 452048 - protein, 9 aa, Influenza virus
PGQTVKIQT

SEQ ID NO: 452049 - protein, 9 aa, Influenza virus
PGRFTNEEA

SEQ ID NO: 452050 - protein, 9 aa, Influenza virus
PGRVSVSTK

SEQ ID NO: 452051 - protein, 9 aa, Influenza virus
PGRVTVSTK

SEQ ID NO: 452052 - protein, 9 aa, Influenza virus
PGRVTVSTQ

SEQ ID NO: 452053 - protein, 9 aa, Influenza virus
PGRVTVSTR

SEQ ID NO: 452054 - protein, 9 aa, Influenza virus
PGSFNDYEE

SEQ ID NO: 452055 - protein, 9 aa, Influenza virus
PGSFNNYEE

SEQ ID NO: 452056 - protein, 9 aa, Influenza virus
PGSFPDGAQ

SEQ ID NO: 452057 - protein, 9 aa, Influenza virus
PGSGDWPDG

SEQ ID NO: 452058 - protein, 9 aa, Influenza virus
PGSGNWPDG

SEQ ID NO: 452059 - protein, 9 aa, Influenza virus
PGSIENLEE

SEQ ID NO: 452060 - protein, 9 aa, Influenza virus
PGSIENQEE

SEQ ID NO: 452061 - protein, 9 aa, Influenza virus
PGSIKNQEE

SEQ ID NO: 452062 - protein, 9 aa, Influenza virus
PGSLNDYEE

SEQ ID NO: 452063 - protein, 9 aa, Influenza virus
PGSNNNGVK

SEQ ID NO: 452064 - protein, 9 aa, Influenza virus
PGSTVNEEA

SEQ ID NO: 452065 - protein, 9 aa, Influenza virus
PGSVENLEE

SEQ ID NO: 452066 - protein, 9 aa, Influenza virus
PGSVENQEE

SEQ ID NO: 452067 - protein, 9 aa, Influenza virus
PGTFDIEGL

SEQ ID NO: 452068 - protein, 9 aa, Influenza virus
PGTFDIGGL

SEQ ID NO: 452069 - protein, 9 aa, Influenza virus
PGTFDLEGL

SEQ ID NO: 452070 - protein, 9 aa, Influenza virus
PGTFDLGGL

SEQ ID NO: 452071 - protein, 9 aa, Influenza virus
PGTKGFGFL

SEQ ID NO: 452072 - protein, 9 aa, Influenza virus
PGTRRIDFH

SEQ ID NO: 452073 - protein, 9 aa, Influenza virus
PGTTVNEEA

SEQ ID NO: 452074 - protein, 9 aa, Influenza virus
PGVKGFAFL

SEQ ID NO: 452075 - protein, 9 aa, Influenza virus
PGVKGFGFK

SEQ ID NO: 452076 - protein, 9 aa, Influenza virus
PGVKGFGFL

SEQ ID NO: 452077 - protein, 9 aa, Influenza virus
PGVKGFGFR

SEQ ID NO: 452078 - protein, 9 aa, Influenza virus
PGVKGWAFD

SEQ ID NO: 452079 - protein, 9 aa, Influenza virus
PGVKGWGFD

SEQ ID NO: 452080 - protein, 9 aa, Influenza virus
PGVRCICRD

SEQ ID NO: 452081 - protein, 9 aa, Influenza virus
PGWFRNVLS

SEQ ID NO: 452082 - protein, 9 aa, Influenza virus
PGWLTIGIT

SEQ ID NO: 452083 - protein, 9 aa, Influenza virus
PGWLTLGIT

SEQ ID NO: 452084 - protein, 9 aa, Influenza virus
PGWSWDDGA

SEQ ID NO: 452085 - protein, 9 aa, Influenza virus
PGWSWGDGA

SEQ ID NO: 452086 - protein, 9 aa, Influenza virus
PGYNGQKSW

SEQ ID NO: 452087 - protein, 9 aa, Influenza virus
PGYNGQRSW

SEQ ID NO: 452088 - protein, 9 aa, Influenza virus
PGYQSLRSI

SEQ ID NO: 452089 - protein, 9 aa, Influenza virus
PHGLCYPGE

SEQ ID NO: 452090 - protein, 9 aa, Influenza virus
PHKLCFPGE

SEQ ID NO: 452091 - protein, 9 aa, Influenza virus
PHKLCYPGE

SEQ ID NO: 452092 - protein, 9 aa, Influenza virus
PHLTGTWDT

SEQ ID NO: 452093 - protein, 9 aa, Influenza virus
PHRALMSCP

SEQ ID NO: 452094 - protein, 9 aa, Influenza virus
PHRLCYPGE

SEQ ID NO: 452095 - protein, 9 aa, Influenza virus
PHRSLMSCP

SEQ ID NO: 452096 - protein, 9 aa, Influenza virus
PHRTLLMNE

SEQ ID NO: 452097 - protein, 9 aa, Influenza virus
PHRTLLMSE

SEQ ID NO: 452098 - protein, 9 aa, Influenza virus
PHRTLMSCP

SEQ ID NO: 452099 - protein, 9 aa, Influenza virus
PIAFLTSSI

SEQ ID NO: 452100 - protein, 9 aa, Influenza virus
PIEHIASIR

SEQ ID NO: 452101 - protein, 9 aa, Influenza virus
PIEHIASMR

SEQ ID NO: 452102 - protein, 9 aa, Influenza virus
PIEHVASMR

SEQ ID NO: 452103 - protein, 9 aa, Influenza virus
PIEYIASMR

SEQ ID NO: 452104 - protein, 9 aa, Influenza virus
PIEYVASMR

SEQ ID NO: 452105 - protein, 9 aa, Influenza virus
PIFLYVRTN

SEQ ID NO: 452106 - protein, 9 aa, Influenza virus
PIGCKMYAL

SEQ ID NO: 452107 - protein, 9 aa, Influenza virus
PIGEAPSPY

SEQ ID NO: 452108 - protein, 9 aa, Influenza virus
PIGEVPSPY

SEQ ID NO: 452109 - protein, 9 aa, Influenza virus
PIGISSMVE

SEQ ID NO: 452110 - protein, 9 aa, Influenza virus
PIGSGFFPD

SEQ ID NO: 452111 - protein, 9 aa, Influenza virus
PIGTAPILG

SEQ ID NO: 452112 - protein, 9 aa, Influenza virus
PIGTAPVLG

SEQ ID NO: 452113 - protein, 9 aa, Influenza virus
PIGVAPSPS

SEQ ID NO: 452114 - protein, 9 aa, Influenza virus
PIGVAPVLG

SEQ ID NO: 452115 - protein, 9 aa, Influenza virus
PIGVVPSPS

SEQ ID NO: 452116 - protein, 9 aa, Influenza virus
PIHLGDCSF

SEQ ID NO: 452117 - protein, 9 aa, Influenza virus
PIICLGHHA

SEQ ID NO: 452118 - protein, 9 aa, Influenza virus
PIKGWAPLS

SEQ ID NO: 452119 - protein, 9 aa, Influenza virus
PILGNYKEI

SEQ ID NO: 452120 - protein, 9 aa, Influenza virus
PILNTSQRG

SEQ ID NO: 452121 - protein, 9 aa, Influenza virus
PILSFIMWA

SEQ ID NO: 452122 - protein, 9 aa, Influenza virus
PILSPLTKG

SEQ ID NO: 452123 - protein, 9 aa, Influenza virus
PILYFWGVH

SEQ ID NO: 452124 - protein, 9 aa, Influenza virus
PIMFSNKMA

SEQ ID NO: 452125 - protein, 9 aa, Influenza virus
PINGICYPG

SEQ ID NO: 452126 - protein, 9 aa, Influenza virus
PINNGKGRY

SEQ ID NO: 452127 - protein, 9 aa, Influenza virus
PINVTKENT

SEQ ID NO: 452128 - protein, 9 aa, Influenza virus
PIQNLTKVN

SEQ ID NO: 452129 - protein, 9 aa, Influenza virus
PIRGWAPLS

SEQ ID NO: 452130 - protein, 9 aa, Influenza virus
PISLGDCSF

SEQ ID NO: 452131 - protein, 9 aa, Influenza virus
PISVGSGSF

SEQ ID NO: 452132 - protein, 9 aa, Influenza virus
PITEINTWA

SEQ ID NO: 452133 - protein, 9 aa, Influenza virus
PITGSPCAP

SEQ ID NO: 452134 - protein, 9 aa, Influenza virus
PITGSPEAP

SEQ ID NO: 452135 - protein, 9 aa, Influenza virus
PITGSPGAP

SEQ ID NO: 452136 - protein, 9 aa, Influenza virus
PITGSPGSP

SEQ ID NO: 452137 - protein, 9 aa, Influenza virus
PITGSPGVP

SEQ ID NO: 452138 - protein, 9 aa, Influenza virus
PITGSPSAP

SEQ ID NO: 452139 - protein, 9 aa, Influenza virus
PITIGECPK

SEQ ID NO: 452140 - protein, 9 aa, Influenza virus
PITIGKCPK

SEQ ID NO: 452141 - protein, 9 aa, Influenza virus
PITIGKCSK

SEQ ID NO: 452142 - protein, 9 aa, Influenza virus
PIVPSFDMN

SEQ ID NO: 452143 - protein, 9 aa, Influenza virus
PIVPSFDMS

SEQ ID NO: 452144 - protein, 9 aa, Influenza virus
PIVPSFEMS

SEQ ID NO: 452145 - protein, 9 aa, Influenza virus
PKCDIHLKD

SEQ ID NO: 452146 - protein, 9 aa, Influenza virus
PKCDIHLRD

SEQ ID NO: 452147 - protein, 9 aa, Influenza virus
PKCDLYLNG

SEQ ID NO: 452148 - protein, 9 aa, Influenza virus
PKCDLYLSG

SEQ ID NO: 452149 - protein, 9 aa, Influenza virus
PKCDPYLNG

SEQ ID NO: 452150 - protein, 9 aa, Influenza virus
PKCDTHLKD

SEQ ID NO: 452151 - protein, 9 aa, Influenza virus
PKCDVHLKD

SEQ ID NO: 452152 - protein, 9 aa, Influenza virus
PKEDEVWWT

SEQ ID NO: 452153 - protein, 9 aa, Influenza virus
PKEDKVWWT

SEQ ID NO: 452154 - protein, 9 aa, Influenza virus
PKEDRVWWT

SEQ ID NO: 452155 - protein, 9 aa, Influenza virus
PKEEKVWWT

SEQ ID NO: 452156 - protein, 9 aa, Influenza virus
PKEIEGICY

SEQ ID NO: 452157 - protein, 9 aa, Influenza virus
PKEKAIWTS

SEQ ID NO: 452158 - protein, 9 aa, Influenza virus
PKEKTIWTS

SEQ ID NO: 452159 - protein, 9 aa, Influenza virus
PKEMEGICY

SEQ ID NO: 452160 - protein, 9 aa, Influenza virus
PKEMEGVCY

SEQ ID NO: 452161 - protein, 9 aa, Influenza virus
PKENPAHKS

SEQ ID NO: 452162 - protein, 9 aa, Influenza virus
PKERTIWTS

SEQ ID NO: 452163 - protein, 9 aa, Influenza virus
PKERTSIWT

SEQ ID NO: 452164 - protein, 9 aa, Influenza virus
PKETRVWWT

SEQ ID NO: 452165 - protein, 9 aa, Influenza virus
PKFLPDLYD

SEQ ID NO: 452166 - protein, 9 aa, Influenza virus
PKGLFGAIA

SEQ ID NO: 452167 - protein, 9 aa, Influenza virus
PKGRGLFGA

SEQ ID NO: 452168 - protein, 9 aa, Influenza virus
PKKRGLFGA

SEQ ID NO: 452169 - protein, 9 aa, Influenza virus
PKKTGGPIY

SEQ ID NO: 452170 - protein, 9 aa, Influenza virus
PKLRSGFEM

SEQ ID NO: 452171 - protein, 9 aa, Influenza virus
PKPRGLFGA

SEQ ID NO: 452172 - protein, 9 aa, Influenza virus
PKQSRMQFS

SEQ ID NO: 452173 - protein, 9 aa, Influenza virus
PKRNRSILN

SEQ ID NO: 452174 - protein, 9 aa, Influenza virus
PKSLPDLYD

SEQ ID NO: 452175 - protein, 9 aa, Influenza virus
PKSMREEYR

SEQ ID NO: 452176 - protein, 9 aa, Influenza virus
PKTRGLFGA

SEQ ID NO: 452177 - protein, 9 aa, Influenza virus
PKVNGQAGR

SEQ ID NO: 452178 - protein, 9 aa, Influenza virus
PKWFRNVLS

SEQ ID NO: 452179 - protein, 9 aa, Influenza virus
PKYEEESKL

SEQ ID NO: 452180 - protein, 9 aa, Influenza virus
PKYEEESRL

SEQ ID NO: 452181 - protein, 9 aa, Influenza virus
PKYGYIIEE

SEQ ID NO: 452182 - protein, 9 aa, Influenza virus
PKYIKQGSL

SEQ ID NO: 452183 - protein, 9 aa, Influenza virus
PKYIKSDQL

SEQ ID NO: 452184 - protein, 9 aa, Influenza virus
PKYIKSGQL

SEQ ID NO: 452185 - protein, 9 aa, Influenza virus
PKYIPSGSL

SEQ ID NO: 452186 - protein, 9 aa, Influenza virus
PKYIPSNSL

SEQ ID NO: 452187 - protein, 9 aa, Influenza virus
PKYIPSRSL

SEQ ID NO: 452188 - protein, 9 aa, Influenza virus
PKYISSGSL

SEQ ID NO: 452189 - protein, 9 aa, Influenza virus
PKYLPDLYD

SEQ ID NO: 452190 - protein, 9 aa, Influenza virus
PKYMNVKSL

SEQ ID NO: 452191 - protein, 9 aa, Influenza virus
PKYSEEAKL

SEQ ID NO: 452192 - protein, 9 aa, Influenza virus
PKYSEESKL

SEQ ID NO: 452193 - protein, 9 aa, Influenza virus
PKYSEESRL

SEQ ID NO: 452194 - protein, 9 aa, Influenza virus
PKYSKEAKL

SEQ ID NO: 452195 - protein, 9 aa, Influenza virus
PKYSKESKL

SEQ ID NO: 452196 - protein, 9 aa, Influenza virus
PKYVKQGSL

SEQ ID NO: 452197 - protein, 9 aa, Influenza virus
PKYVKSDRL

SEQ ID NO: 452198 - protein, 9 aa, Influenza virus
PKYVKSEKL

SEQ ID NO: 452199 - protein, 9 aa, Influenza virus
PKYVKSERL

SEQ ID NO: 452200 - protein, 9 aa, Influenza virus
PKYVNIKSL

SEQ ID NO: 452201 - protein, 9 aa, Influenza virus
PKYVNVKSL

SEQ ID NO: 452202 - protein, 9 aa, Influenza virus
PKYVNVRSL

SEQ ID NO: 452203 - protein, 9 aa, Influenza virus
PKYVRSEKL

SEQ ID NO: 452204 - protein, 9 aa, Influenza virus
PLAGSAQHV

SEQ ID NO: 452205 - protein, 9 aa, Influenza virus
PLAIGECPK

SEQ ID NO: 452206 - protein, 9 aa, Influenza virus
PLALGMKNV

SEQ ID NO: 452207 - protein, 9 aa, Influenza virus
PLASLLEMC

SEQ ID NO: 452208 - protein, 9 aa, Influenza virus
PLAVTWWNR

SEQ ID NO: 452209 - protein, 9 aa, Influenza virus
PLCAVNSWH

SEQ ID NO: 452210 - protein, 9 aa, Influenza virus
PLCDVSGFA

SEQ ID NO: 452211 - protein, 9 aa, Influenza virus
PLCEVNSWH

SEQ ID NO: 452212 - protein, 9 aa, Influenza virus
PLCEVSGFA

SEQ ID NO: 452213 - protein, 9 aa, Influenza virus
PLCEVSGFV

SEQ ID NO: 452214 - protein, 9 aa, Influenza virus
PLCEVSSWH

SEQ ID NO: 452215 - protein, 9 aa, Influenza virus
PLCNVSGFA

SEQ ID NO: 452216 - protein, 9 aa, Influenza virus
PLCPFKGFF

SEQ ID NO: 452217 - protein, 9 aa, Influenza virus
PLCPFQGFF

SEQ ID NO: 452218 - protein, 9 aa, Influenza virus
PLCPFRGFF

SEQ ID NO: 452219 - protein, 9 aa, Influenza virus
PLELGDCSI

SEQ ID NO: 452220 - protein, 9 aa, Influenza virus
PLELRDCKI

SEQ ID NO: 452221 - protein, 9 aa, Influenza virus
PLELRDCKV

SEQ ID NO: 452222 - protein, 9 aa, Influenza virus
PLELRDCSI

SEQ ID NO: 452223 - protein, 9 aa, Influenza virus
PLFLYVRTN

SEQ ID NO: 452224 - protein, 9 aa, Influenza virus
PLGAINTTL

SEQ ID NO: 452225 - protein, 9 aa, Influenza virus
PLGALNTTL

SEQ ID NO: 452226 - protein, 9 aa, Influenza virus
PLGCKMYAL

SEQ ID NO: 452227 - protein, 9 aa, Influenza virus
PLGCRMYAL

SEQ ID NO: 452228 - protein, 9 aa, Influenza virus
PLGEAPSPY

SEQ ID NO: 452229 - protein, 9 aa, Influenza virus
PLGSAQATE

SEQ ID NO: 452230 - protein, 9 aa, Influenza virus
PLGSPPIVS

SEQ ID NO: 452231 - protein, 9 aa, Influenza virus
PLGSPPMVS

SEQ ID NO: 452232 - protein, 9 aa, Influenza virus
PLGSPPVVS

SEQ ID NO: 452233 - protein, 9 aa, Influenza virus
PLGSSPNAY

SEQ ID NO: 452234 - protein, 9 aa, Influenza virus
PLGSSSNAY

SEQ ID NO: 452235 - protein, 9 aa, Influenza virus
PLGTPPTVS

SEQ ID NO: 452236 - protein, 9 aa, Influenza virus
PLHNIHPLT

SEQ ID NO: 452237 - protein, 9 aa, Influenza virus
PLIKHENRM

SEQ ID NO: 452238 - protein, 9 aa, Influenza virus
PLILGDCSV

SEQ ID NO: 452239 - protein, 9 aa, Influenza virus
PLILKDCSI

SEQ ID NO: 452240 - protein, 9 aa, Influenza virus
PLILKDCSV

SEQ ID NO: 452241 - protein, 9 aa, Influenza virus
PLILRDCSV

SEQ ID NO: 452242 - protein, 9 aa, Influenza virus
PLIRGQQGR

SEQ ID NO: 452243 - protein, 9 aa, Influenza virus
PLIRHENRM

SEQ ID NO: 452244 - protein, 9 aa, Influenza virus
PLKAEIAQK

SEQ ID NO: 452245 - protein, 9 aa, Influenza virus
PLKAEIAQR

SEQ ID NO: 452246 - protein, 9 aa, Influenza virus
PLKLVDGQD

SEQ ID NO: 452247 - protein, 9 aa, Influenza virus
PLLSLLEMC

SEQ ID NO: 452248 - protein, 9 aa, Influenza virus
PLMVAYMLE

SEQ ID NO: 452249 - protein, 9 aa, Influenza virus
PLPFQNIDS

SEQ ID NO: 452250 - protein, 9 aa, Influenza virus
PLPFQNINP

SEQ ID NO: 452251 - protein, 9 aa, Influenza virus
PLPLCPFKG

SEQ ID NO: 452252 - protein, 9 aa, Influenza virus
PLPLCPFRG

SEQ ID NO: 452253 - protein, 9 aa, Influenza virus
PLQNASRHY

SEQ ID NO: 452254 - protein, 9 aa, Influenza virus
PLQNLTKIN

SEQ ID NO: 452255 - protein, 9 aa, Influenza virus
PLQNLTKTN

SEQ ID NO: 452256 - protein, 9 aa, Influenza virus
PLQNLTKVN

SEQ ID NO: 452257 - protein, 9 aa, Influenza virus
PLQNTSKHY

SEQ ID NO: 452258 - protein, 9 aa, Influenza virus
PLSGSAQHI

SEQ ID NO: 452259 - protein, 9 aa, Influenza virus
PLSGSAQHV

SEQ ID NO: 452260 - protein, 9 aa, Influenza virus
PLSISVGSS

SEQ ID NO: 452261 - protein, 9 aa, Influenza virus
PLSKDNGIR

SEQ ID NO: 452262 - protein, 9 aa, Influenza virus
PLSKDNSIR

SEQ ID NO: 452263 - protein, 9 aa, Influenza virus
PLSSPPTVY

SEQ ID NO: 452264 - protein, 9 aa, Influenza virus
PLTGSAQHI

SEQ ID NO: 452265 - protein, 9 aa, Influenza virus
PLTIGECPK

SEQ ID NO: 452266 - protein, 9 aa, Influenza virus
PLTIGECPR

SEQ ID NO: 452267 - protein, 9 aa, Influenza virus
PLTIGKCPK

SEQ ID NO: 452268 - protein, 9 aa, Influenza virus
PLTKGILGF

SEQ ID NO: 452269 - protein, 9 aa, Influenza virus
PLTKGMLGF

SEQ ID NO: 452270 - protein, 9 aa, Influenza virus
PLTMGECPK

SEQ ID NO: 452271 - protein, 9 aa, Influenza virus
PLTTTPTKS

SEQ ID NO: 452272 - protein, 9 aa, Influenza virus
PLVLDDCSL

SEQ ID NO: 452273 - protein, 9 aa, Influenza virus
PLVLGDCSI

SEQ ID NO: 452274 - protein, 9 aa, Influenza virus
PLVMGQQGR

SEQ ID NO: 452275 - protein, 9 aa, Influenza virus
PLVNGQRGR

SEQ ID NO: 452276 - protein, 9 aa, Influenza virus
PLVPCEPII

SEQ ID NO: 452277 - protein, 9 aa, Influenza virus
PLVREQQGR

SEQ ID NO: 452278 - protein, 9 aa, Influenza virus
PLVRGQQGR

SEQ ID NO: 452279 - protein, 9 aa, Influenza virus
PLVRGQQGT

SEQ ID NO: 452280 - protein, 9 aa, Influenza virus
PLVRGQQGW

SEQ ID NO: 452281 - protein, 9 aa, Influenza virus
PLVRGQSGR

SEQ ID NO: 452282 - protein, 9 aa, Influenza virus
PLVRSQSGR

SEQ ID NO: 452283 - protein, 9 aa, Influenza virus
PMCDDLIGK

SEQ ID NO: 452284 - protein, 9 aa, Influenza virus
PMCDELIGK

SEQ ID NO: 452285 - protein, 9 aa, Influenza virus
PMCDNLIGK

SEQ ID NO: 452286 - protein, 9 aa, Influenza virus
PMCDYLIGK

SEQ ID NO: 452287 - protein, 9 aa, Influenza virus
PMFLYIRTN

SEQ ID NO: 452288 - protein, 9 aa, Influenza virus
PMFLYVRTN

SEQ ID NO: 452289 - protein, 9 aa, Influenza virus
PMGEAPSPY

SEQ ID NO: 452290 - protein, 9 aa, Influenza virus
PMGFRYSGI

SEQ ID NO: 452291 - protein, 9 aa, Influenza virus
PMGSSPNAY

SEQ ID NO: 452292 - protein, 9 aa, Influenza virus
PMGTAPVLG

SEQ ID NO: 452293 - protein, 9 aa, Influenza virus
PMGVAPSPS

SEQ ID NO: 452294 - protein, 9 aa, Influenza virus
PMHQLLRHF

SEQ ID NO: 452295 - protein, 9 aa, Influenza virus
PMIAELAEK

SEQ ID NO: 452296 - protein, 9 aa, Influenza virus
PMIIELAEK

SEQ ID NO: 452297 - protein, 9 aa, Influenza virus
PMISKCKTK

SEQ ID NO: 452298 - protein, 9 aa, Influenza virus
PMISKCRTK

SEQ ID NO: 452299 - protein, 9 aa, Influenza virus
PMISKCRTR

SEQ ID NO: 452300 - protein, 9 aa, Influenza virus
PMISKSRTK

SEQ ID NO: 452301 - protein, 9 aa, Influenza virus
PMIVELAEK

SEQ ID NO: 452302 - protein, 9 aa, Influenza virus
PMMWEINGP

SEQ ID NO: 452303 - protein, 9 aa, Influenza virus
PMRTPIAFL

SEQ ID NO: 452304 - protein, 9 aa, Influenza virus
PMTVELAEK

SEQ ID NO: 452305 - protein, 9 aa, Influenza virus
PMVVELAEK

SEQ ID NO: 452306 - protein, 9 aa, Influenza virus
PNAETDPNS

SEQ ID NO: 452307 - protein, 9 aa, Influenza virus
PNAETDPSS

SEQ ID NO: 452308 - protein, 9 aa, Influenza virus
PNAGIDPNS

SEQ ID NO: 452309 - protein, 9 aa, Influenza virus
PNAGKDPKK

SEQ ID NO: 452310 - protein, 9 aa, Influenza virus
PNAGTDPNS

SEQ ID NO: 452311 - protein, 9 aa, Influenza virus
PNALLKHRF

SEQ ID NO: 452312 - protein, 9 aa, Influenza virus
PNALTDDKS

SEQ ID NO: 452313 - protein, 9 aa, Influenza virus
PNALTDDRS

SEQ ID NO: 452314 - protein, 9 aa, Influenza virus
PNALTDERS

SEQ ID NO: 452315 - protein, 9 aa, Influenza virus
PNALTDNRS

SEQ ID NO: 452316 - protein, 9 aa, Influenza virus
PNAPHKLCF

SEQ ID NO: 452317 - protein, 9 aa, Influenza virus
PNAPHKLCY

SEQ ID NO: 452318 - protein, 9 aa, Influenza virus
PNAPNKFCY

SEQ ID NO: 452319 - protein, 9 aa, Influenza virus
PNAPNKLCF

SEQ ID NO: 452320 - protein, 9 aa, Influenza virus
PNAPNKLCY

SEQ ID NO: 452321 - protein, 9 aa, Influenza virus
PNAYQAKFE

SEQ ID NO: 452322 - protein, 9 aa, Influenza virus
PNAYQAQFE

SEQ ID NO: 452323 - protein, 9 aa, Influenza virus
PNAYQARFE

SEQ ID NO: 452324 - protein, 9 aa, Influenza virus
PNDERGNPG

SEQ ID NO: 452325 - protein, 9 aa, Influenza virus
PNDGKVECV

SEQ ID NO: 452326 - protein, 9 aa, Influenza virus
PNDGQVLYF

SEQ ID NO: 452327 - protein, 9 aa, Influenza virus
PNDKHSNGT

SEQ ID NO: 452328 - protein, 9 aa, Influenza virus
PNDKPFQNV

SEQ ID NO: 452329 - protein, 9 aa, Influenza virus
PNDNASAVV

SEQ ID NO: 452330 - protein, 9 aa, Influenza virus
PNECRFYAL

SEQ ID NO: 452331 - protein, 9 aa, Influenza virus
PNEERGNPG

SEQ ID NO: 452332 - protein, 9 aa, Influenza virus
PNEERGSPG

SEQ ID NO: 452333 - protein, 9 aa, Influenza virus
PNEGKVECI

SEQ ID NO: 452334 - protein, 9 aa, Influenza virus
PNEGKVECV

SEQ ID NO: 452335 - protein, 9 aa, Influenza virus
PNEKPFQNV

SEQ ID NO: 452336 - protein, 9 aa, Influenza virus
PNENPAHKS

SEQ ID NO: 452337 - protein, 9 aa, Influenza virus
PNENPVHKS

SEQ ID NO: 452338 - protein, 9 aa, Influenza virus
PNEVGAKIL

SEQ ID NO: 452339 - protein, 9 aa, Influenza virus
PNEVGARIL

SEQ ID NO: 452340 - protein, 9 aa, Influenza virus
PNFHYEECS

SEQ ID NO: 452341 - protein, 9 aa, Influenza virus
PNFYYEECS

SEQ ID NO: 452342 - protein, 9 aa, Influenza virus
PNGAQIQYF

SEQ ID NO: 452343 - protein, 9 aa, Influenza virus
PNGCIEGKL

SEQ ID NO: 452344 - protein, 9 aa, Influenza virus
PNGCIESKL

SEQ ID NO: 452345 - protein, 9 aa, Influenza virus
PNGKPFQNV

SEQ ID NO: 452346 - protein, 9 aa, Influenza virus
PNGSIPNDK

SEQ ID NO: 452347 - protein, 9 aa, Influenza virus
PNGSIPNEK

SEQ ID NO: 452348 - protein, 9 aa, Influenza virus
PNGSIPNGK

SEQ ID NO: 452349 - protein, 9 aa, Influenza virus
PNGSIPNNK

SEQ ID NO: 452350 - protein, 9 aa, Influenza virus
PNGSISNDK

SEQ ID NO: 452351 - protein, 9 aa, Influenza virus
PNGTIVKTI

SEQ ID NO: 452352 - protein, 9 aa, Influenza virus
PNGTIVKTL

SEQ ID NO: 452353 - protein, 9 aa, Influenza virus
PNGTIVRTI

SEQ ID NO: 452354 - protein, 9 aa, Influenza virus
PNGTKVNTL

SEQ ID NO: 452355 - protein, 9 aa, Influenza virus
PNGTLVKTI

SEQ ID NO: 452356 - protein, 9 aa, Influenza virus
PNGTMVKTI

SEQ ID NO: 452357 - protein, 9 aa, Influenza virus
PNGTVVKTI

SEQ ID NO: 452358 - protein, 9 aa, Influenza virus
PNGYIEGKL

SEQ ID NO: 452359 - protein, 9 aa, Influenza virus
PNHEGEGIP

SEQ ID NO: 452360 - protein, 9 aa, Influenza virus
PNIGPRALV

SEQ ID NO: 452361 - protein, 9 aa, Influenza virus
PNIGPRPFV

SEQ ID NO: 452362 - protein, 9 aa, Influenza virus
PNIGPRPLI

SEQ ID NO: 452363 - protein, 9 aa, Influenza virus
PNIGPRPLV

SEQ ID NO: 452364 - protein, 9 aa, Influenza virus
PNIGSRPRV

SEQ ID NO: 452365 - protein, 9 aa, Influenza virus
PNKFCYPGE

SEQ ID NO: 452366 - protein, 9 aa, Influenza virus
PNKLCFPGE

SEQ ID NO: 452367 - protein, 9 aa, Influenza virus
PNKLCYPGE

SEQ ID NO: 452368 - protein, 9 aa, Influenza virus
PNKWGDILD

SEQ ID NO: 452369 - protein, 9 aa, Influenza virus
PNKWGNVLD

SEQ ID NO: 452370 - protein, 9 aa, Influenza virus
PNLGIVECV

SEQ ID NO: 452371 - protein, 9 aa, Influenza virus
PNLGKVECV

SEQ ID NO: 452372 - protein, 9 aa, Influenza virus
PNLGQVECV

SEQ ID NO: 452373 - protein, 9 aa, Influenza virus
PNLYNIRNL

SEQ ID NO: 452374 - protein, 9 aa, Influenza virus
PNMGKVECV

SEQ ID NO: 452375 - protein, 9 aa, Influenza virus
PNNEKGNPG

SEQ ID NO: 452376 - protein, 9 aa, Influenza virus
PNNEKGNQG

SEQ ID NO: 452377 - protein, 9 aa, Influenza virus
PNNERGNPG

SEQ ID NO: 452378 - protein, 9 aa, Influenza virus
PNNERGNQG

SEQ ID NO: 452379 - protein, 9 aa, Influenza virus
PNNERGTQG

SEQ ID NO: 452380 - protein, 9 aa, Influenza virus
PNNERGYPG

SEQ ID NO: 452381 - protein, 9 aa, Influenza virus
PNNGKVECI

SEQ ID NO: 452382 - protein, 9 aa, Influenza virus
PNNKPFQNV

SEQ ID NO: 452383 - protein, 9 aa, Influenza virus
PNNMARAVK

SEQ ID NO: 452384 - protein, 9 aa, Influenza virus
PNNMDKAVK

SEQ ID NO: 452385 - protein, 9 aa, Influenza virus
PNNMDRAVK

SEQ ID NO: 452386 - protein, 9 aa, Influenza virus
PNNNASAII

SEQ ID NO: 452387 - protein, 9 aa, Influenza virus
PNNNASAIV

SEQ ID NO: 452388 - protein, 9 aa, Influenza virus
PNNNASAVI

SEQ ID NO: 452389 - protein, 9 aa, Influenza virus
PNNNASAVV

SEQ ID NO: 452390 - protein, 9 aa, Influenza virus
PNQKIICIS

SEQ ID NO: 452391 - protein, 9 aa, Influenza virus
PNQKIITIG

SEQ ID NO: 452392 - protein, 9 aa, Influenza virus
PNQKIITMG

SEQ ID NO: 452393 - protein, 9 aa, Influenza virus
PNQKILCAS

SEQ ID NO: 452394 - protein, 9 aa, Influenza virus
PNQKILCTS

SEQ ID NO: 452395 - protein, 9 aa, Influenza virus
PNQKILFAS

SEQ ID NO: 452396 - protein, 9 aa, Influenza virus
PNQKIMCIS

SEQ ID NO: 452397 - protein, 9 aa, Influenza virus
PNQKITCIS

SEQ ID NO: 452398 - protein, 9 aa, Influenza virus
PNQKLFALS

SEQ ID NO: 452399 - protein, 9 aa, Influenza virus
PNQKLFASS

SEQ ID NO: 452400 - protein, 9 aa, Influenza virus
PNQKLFTLS

SEQ ID NO: 452401 - protein, 9 aa, Influenza virus
PNQKTITIG

SEQ ID NO: 452402 - protein, 9 aa, Influenza virus
PNQMIITIG

SEQ ID NO: 452403 - protein, 9 aa, Influenza virus
PNQNLFTLS

SEQ ID NO: 452404 - protein, 9 aa, Influenza virus
PNQRILCTS

SEQ ID NO: 452405 - protein, 9 aa, Influenza virus
PNQSIITIG

SEQ ID NO: 452406 - protein, 9 aa, Influenza virus
PNRASFFRG

SEQ ID NO: 452407 - protein, 9 aa, Influenza virus
PNSGKVECV

SEQ ID NO: 452408 - protein, 9 aa, Influenza virus
PNSHYEECS

SEQ ID NO: 452409 - protein, 9 aa, Influenza virus
PNVLLKHRF

SEQ ID NO: 452410 - protein, 9 aa, Influenza virus
PNVRCVCRD

SEQ ID NO: 452411 - protein, 9 aa, Influenza virus
PNVYQAKFE

SEQ ID NO: 452412 - protein, 9 aa, Influenza virus
PNVYQARFE

SEQ ID NO: 452413 - protein, 9 aa, Influenza virus
PNVYQSRFE

SEQ ID NO: 452414 - protein, 9 aa, Influenza virus
PNWSGYSGS

SEQ ID NO: 452415 - protein, 9 aa, Influenza virus
PNYHYEECS

SEQ ID NO: 452416 - protein, 9 aa, Influenza virus
PNYQSLRSI

SEQ ID NO: 452417 - protein, 9 aa, Influenza virus
PNYYYEECS

SEQ ID NO: 452418 - protein, 9 aa, Influenza virus
PPEQSKMQF

SEQ ID NO: 452419 - protein, 9 aa, Influenza virus
PPEQSRMQF

SEQ ID NO: 452420 - protein, 9 aa, Influenza virus
PPHCDQFLE

SEQ ID NO: 452421 - protein, 9 aa, Influenza virus
PPIVSNSDF

SEQ ID NO: 452422 - protein, 9 aa, Influenza virus
PPIVSNSEF

SEQ ID NO: 452423 - protein, 9 aa, Influenza virus
PPKQSRMQF

SEQ ID NO: 452424 - protein, 9 aa, Influenza virus
PPLELGDCS

SEQ ID NO: 452425 - protein, 9 aa, Influenza virus
PPLELRDCS

SEQ ID NO: 452426 - protein, 9 aa, Influenza virus
PPLGSAQAT

SEQ ID NO: 452427 - protein, 9 aa, Influenza virus
PPLVLGDCS

SEQ ID NO: 452428 - protein, 9 aa, Influenza virus
PPMVSNSDF

SEQ ID NO: 452429 - protein, 9 aa, Influenza virus
PPQCDKFLE

SEQ ID NO: 452430 - protein, 9 aa, Influenza virus
PPQCDLFLE

SEQ ID NO: 452431 - protein, 9 aa, Influenza virus
PPQCDLHLE

SEQ ID NO: 452432 - protein, 9 aa, Influenza virus
PPQCDQFLE

SEQ ID NO: 452433 - protein, 9 aa, Influenza virus
PPQCDRFLE

SEQ ID NO: 452434 - protein, 9 aa, Influenza virus
PPQCDSHLK

SEQ ID NO: 452435 - protein, 9 aa, Influenza virus
PPTVSNSDF

SEQ ID NO: 452436 - protein, 9 aa, Influenza virus
PPVNGQSGR

SEQ ID NO: 452437 - protein, 9 aa, Influenza virus
PPVQSKMQF

SEQ ID NO: 452438 - protein, 9 aa, Influenza virus
PPVQSRMQF

SEQ ID NO: 452439 - protein, 9 aa, Influenza virus
PPVVSNSDF

SEQ ID NO: 452440 - protein, 9 aa, Influenza virus
PPYSHGTGT

SEQ ID NO: 452441 - protein, 9 aa, Influenza virus
PQAQDRGLF

SEQ ID NO: 452442 - protein, 9 aa, Influenza virus
PQAQNRGLF

SEQ ID NO: 452443 - protein, 9 aa, Influenza virus
PQCDKFLEF

SEQ ID NO: 452444 - protein, 9 aa, Influenza virus
PQCDLFLEF

SEQ ID NO: 452445 - protein, 9 aa, Influenza virus
PQCDLHLEF

SEQ ID NO: 452446 - protein, 9 aa, Influenza virus
PQCDQFLEF

SEQ ID NO: 452447 - protein, 9 aa, Influenza virus
PQCDRFLEF

SEQ ID NO: 452448 - protein, 9 aa, Influenza virus
PQCDSHLKF

SEQ ID NO: 452449 - protein, 9 aa, Influenza virus
PQCEITGFA

SEQ ID NO: 452450 - protein, 9 aa, Influenza virus
PQCHITGFA

SEQ ID NO: 452451 - protein, 9 aa, Influenza virus
PQCKITGFA

SEQ ID NO: 452452 - protein, 9 aa, Influenza virus
PQCLITGFA

SEQ ID NO: 452453 - protein, 9 aa, Influenza virus
PQCQIAGFA

SEQ ID NO: 452454 - protein, 9 aa, Influenza virus
PQCQITGFA

SEQ ID NO: 452455 - protein, 9 aa, Influenza virus
PQCQITGFV

SEQ ID NO: 452456 - protein, 9 aa, Influenza virus
PQCQITGSA

SEQ ID NO: 452457 - protein, 9 aa, Influenza virus
PQCQVTGFA

SEQ ID NO: 452458 - protein, 9 aa, Influenza virus
PQEARVWWT

SEQ ID NO: 452459 - protein, 9 aa, Influenza virus
PQEDRVWWT

SEQ ID NO: 452460 - protein, 9 aa, Influenza virus
PQENRVWWT

SEQ ID NO: 452461 - protein, 9 aa, Influenza virus
PQETRVWWT

SEQ ID NO: 452462 - protein, 9 aa, Influenza virus
PQIEARGLF

SEQ ID NO: 452463 - protein, 9 aa, Influenza virus
PQIEPRGLF

SEQ ID NO: 452464 - protein, 9 aa, Influenza virus
PQIESRGLF

SEQ ID NO: 452465 - protein, 9 aa, Influenza virus
PQINGQSGR

SEQ ID NO: 452466 - protein, 9 aa, Influenza virus
PQIQNRGLF

SEQ ID NO: 452467 - protein, 9 aa, Influenza virus
PQLEGFSAE

SEQ ID NO: 452468 - protein, 9 aa, Influenza virus
PQLNPIDGP

SEQ ID NO: 452469 - protein, 9 aa, Influenza virus
PQLNQTYRN

SEQ ID NO: 452470 - protein, 9 aa, Influenza virus
PQMESRGLF

SEQ ID NO: 452471 - protein, 9 aa, Influenza virus
PQMNGQSGR

SEQ ID NO: 452472 - protein, 9 aa, Influenza virus
PQMTKSYKN

SEQ ID NO: 452473 - protein, 9 aa, Influenza virus
PQMTKSYRN

SEQ ID NO: 452474 - protein, 9 aa, Influenza virus
PQMTRSYKN

SEQ ID NO: 452475 - protein, 9 aa, Influenza virus
PQRTLMSCP

SEQ ID NO: 452476 - protein, 9 aa, Influenza virus
PQSGRIVVD

SEQ ID NO: 452477 - protein, 9 aa, Influenza virus
PQSSPPTVY

SEQ ID NO: 452478 - protein, 9 aa, Influenza virus
PQTANTYRN

SEQ ID NO: 452479 - protein, 9 aa, Influenza virus
PQTESRGLF

SEQ ID NO: 452480 - protein, 9 aa, Influenza virus
PQTTKSYKN

SEQ ID NO: 452481 - protein, 9 aa, Influenza virus
PQTTNTYRN

SEQ ID NO: 452482 - protein, 9 aa, Influenza virus
PQVNGQFGR

SEQ ID NO: 452483 - protein, 9 aa, Influenza virus
PQVNGQRGR

SEQ ID NO: 452484 - protein, 9 aa, Influenza virus
PQVNGQSGR

SEQ ID NO: 452485 - protein, 9 aa, Influenza virus
PQVQDRGLF

SEQ ID NO: 452486 - protein, 9 aa, Influenza virus
PQVQNRGLF

SEQ ID NO: 452487 - protein, 9 aa, Influenza virus
PQYPNVRCV

SEQ ID NO: 452488 - protein, 9 aa, Influenza virus
PRALVRGQQ

SEQ ID NO: 452489 - protein, 9 aa, Influenza virus
PRCDDLIGK

SEQ ID NO: 452490 - protein, 9 aa, Influenza virus
PRFLPDLYD

SEQ ID NO: 452491 - protein, 9 aa, Influenza virus
PRGHYKISK

SEQ ID NO: 452492 - protein, 9 aa, Influenza virus
PRGKLSTRG

SEQ ID NO: 452493 - protein, 9 aa, Influenza virus
PRGLFGAIA

SEQ ID NO: 452494 - protein, 9 aa, Influenza virus
PRGLLEVGT

SEQ ID NO: 452495 - protein, 9 aa, Influenza virus
PRGQLATRG

SEQ ID NO: 452496 - protein, 9 aa, Influenza virus
PRGQLSTRG

SEQ ID NO: 452497 - protein, 9 aa, Influenza virus
PRGQLTTRG

SEQ ID NO: 452498 - protein, 9 aa, Influenza virus
PRGRLSTRG

SEQ ID NO: 452499 - protein, 9 aa, Influenza virus
PRIFLAMIT

SEQ ID NO: 452500 - protein, 9 aa, Influenza virus
PRLLQNSQV

SEQ ID NO: 452501 - protein, 9 aa, Influenza virus
PRLRSGFEM

SEQ ID NO: 452502 - protein, 9 aa, Influenza virus
PRMCSLMQG

SEQ ID NO: 452503 - protein, 9 aa, Influenza virus
PRMFLAMIT

SEQ ID NO: 452504 - protein, 9 aa, Influenza virus
PRNDDSSSN

SEQ ID NO: 452505 - protein, 9 aa, Influenza virus
PRNDDSSSS

SEQ ID NO: 452506 - protein, 9 aa, Influenza virus
PRNEDGSSS

SEQ ID NO: 452507 - protein, 9 aa, Influenza virus
PRNEDSSSN

SEQ ID NO: 452508 - protein, 9 aa, Influenza virus
PRNEDSSSS

SEQ ID NO: 452509 - protein, 9 aa, Influenza virus
PRPADGTGS

SEQ ID NO: 452510 - protein, 9 aa, Influenza virus
PRPFVRGQQ

SEQ ID NO: 452511 - protein, 9 aa, Influenza virus
PRPLIRGQQ

SEQ ID NO: 452512 - protein, 9 aa, Influenza virus
PRPLVMGQQ

SEQ ID NO: 452513 - protein, 9 aa, Influenza virus
PRPLVREQQ

SEQ ID NO: 452514 - protein, 9 aa, Influenza virus
PRPLVRGQQ

SEQ ID NO: 452515 - protein, 9 aa, Influenza virus
PRPMDGTGS

SEQ ID NO: 452516 - protein, 9 aa, Influenza virus
PRPMDSTGS

SEQ ID NO: 452517 - protein, 9 aa, Influenza virus
PRPRRGLFG

SEQ ID NO: 452518 - protein, 9 aa, Influenza virus
PRPVDGIGS

SEQ ID NO: 452519 - protein, 9 aa, Influenza virus
PRPVDGTGS

SEQ ID NO: 452520 - protein, 9 aa, Influenza virus
PRRGLFGAI

SEQ ID NO: 452521 - protein, 9 aa, Influenza virus
PRRSGAAGA

SEQ ID NO: 452522 - protein, 9 aa, Influenza virus
PRSRNGFEM

SEQ ID NO: 452523 - protein, 9 aa, Influenza virus
PRSRSGFEM

SEQ ID NO: 452524 - protein, 9 aa, Influenza virus
PRTTNTYRN

SEQ ID NO: 452525 - protein, 9 aa, Influenza virus
PRTVGQCPK

SEQ ID NO: 452526 - protein, 9 aa, Influenza virus
PRVFLAMIT

SEQ ID NO: 452527 - protein, 9 aa, Influenza virus
PRVFLTMIT

SEQ ID NO: 452528 - protein, 9 aa, Influenza virus
PRVRNQSGR

SEQ ID NO: 452529 - protein, 9 aa, Influenza virus
PRYAFEIVS

SEQ ID NO: 452530 - protein, 9 aa, Influenza virus
PRYAFELVF

SEQ ID NO: 452531 - protein, 9 aa, Influenza virus
PRYAFELVS

SEQ ID NO: 452532 - protein, 9 aa, Influenza virus
PRYALELVS

SEQ ID NO: 452533 - protein, 9 aa, Influenza virus
PRYGYIIEE

SEQ ID NO: 452534 - protein, 9 aa, Influenza virus
PRYGYIIEK

SEQ ID NO: 452535 - protein, 9 aa, Influenza virus
PRYIPSGSL

SEQ ID NO: 452536 - protein, 9 aa, Influenza virus
PRYLPDLYD

SEQ ID NO: 452537 - protein, 9 aa, Influenza virus
PRYNGQRSW

SEQ ID NO: 452538 - protein, 9 aa, Influenza virus
PRYPDVRCV

SEQ ID NO: 452539 - protein, 9 aa, Influenza virus
PRYPNVRCV

SEQ ID NO: 452540 - protein, 9 aa, Influenza virus
PRYSFELVS

SEQ ID NO: 452541 - protein, 9 aa, Influenza virus
PRYVKQGSL

SEQ ID NO: 452542 - protein, 9 aa, Influenza virus
PRYVKQSSL

SEQ ID NO: 452543 - protein, 9 aa, Influenza virus
PRYVKSEKL

SEQ ID NO: 452544 - protein, 9 aa, Influenza virus
PSAGKDPKK

SEQ ID NO: 452545 - protein, 9 aa, Influenza virus
PSAGRDPKK

SEQ ID NO: 452546 - protein, 9 aa, Influenza virus
PSAIDQITG

SEQ ID NO: 452547 - protein, 9 aa, Influenza virus
PSAPEGMCY

SEQ ID NO: 452548 - protein, 9 aa, Influenza virus
PSAPGVKGF

SEQ ID NO: 452549 - protein, 9 aa, Influenza virus
PSAPHGLCY

SEQ ID NO: 452550 - protein, 9 aa, Influenza virus
PSAPHRLCY

SEQ ID NO: 452551 - protein, 9 aa, Influenza virus
PSCASNINI

SEQ ID NO: 452552 - protein, 9 aa, Influenza virus
PSCATNINI

SEQ ID NO: 452553 - protein, 9 aa, Influenza virus
PSCDLHLTG

SEQ ID NO: 452554 - protein, 9 aa, Influenza virus
PSDAQAFYK

SEQ ID NO: 452555 - protein, 9 aa, Influenza virus
PSDTPRGED

SEQ ID NO: 452556 - protein, 9 aa, Influenza virus
PSECRTFFL

SEQ ID NO: 452557 - protein, 9 aa, Influenza virus
PSERGLQRR

SEQ ID NO: 452558 - protein, 9 aa, Influenza virus
PSFDMNNEG

SEQ ID NO: 452559 - protein, 9 aa, Influenza virus
PSFDMSKEG

SEQ ID NO: 452560 - protein, 9 aa, Influenza virus
PSFDMSNDG

SEQ ID NO: 452561 - protein, 9 aa, Influenza virus
PSFDMSNEG

SEQ ID NO: 452562 - protein, 9 aa, Influenza virus
PSFEMSNEG

SEQ ID NO: 452563 - protein, 9 aa, Influenza virus
PSFFRNMIW

SEQ ID NO: 452564 - protein, 9 aa, Influenza virus
PSFFRNMVW

SEQ ID NO: 452565 - protein, 9 aa, Influenza virus
PSFFRNVVW

SEQ ID NO: 452566 - protein, 9 aa, Influenza virus
PSFGVSGIN

SEQ ID NO: 452567 - protein, 9 aa, Influenza virus
PSFGVSGVN

SEQ ID NO: 452568 - protein, 9 aa, Influenza virus
PSFYAEMKW

SEQ ID NO: 452569 - protein, 9 aa, Influenza virus
PSFYRNLLW

SEQ ID NO: 452570 - protein, 9 aa, Influenza virus
PSGCKMYAL

SEQ ID NO: 452571 - protein, 9 aa, Influenza virus
PSGIEYNGK

SEQ ID NO: 452572 - protein, 9 aa, Influenza virus
PSGPLKAEI

SEQ ID NO: 452573 - protein, 9 aa, Influenza virus
PSGSLKLAI

SEQ ID NO: 452574 - protein, 9 aa, Influenza virus
PSGVEYNGK

SEQ ID NO: 452575 - protein, 9 aa, Influenza virus
PSGYAQTDC

SEQ ID NO: 452576 - protein, 9 aa, Influenza virus
PSHEGEGIP

SEQ ID NO: 452577 - protein, 9 aa, Influenza virus
PSIDPKGLF

SEQ ID NO: 452578 - protein, 9 aa, Influenza virus
PSIEPKGLF

SEQ ID NO: 452579 - protein, 9 aa, Influenza virus
PSIEPRGLF

SEQ ID NO: 452580 - protein, 9 aa, Influenza virus
PSIMSCDSP

SEQ ID NO: 452581 - protein, 9 aa, Influenza virus
PSIQSRGLF

SEQ ID NO: 452582 - protein, 9 aa, Influenza virus
PSKWGDILE

SEQ ID NO: 452583 - protein, 9 aa, Influenza virus
PSKWGDVLD

SEQ ID NO: 452584 - protein, 9 aa, Influenza virus
PSKWGNVLD

SEQ ID NO: 452585 - protein, 9 aa, Influenza virus
PSLRMKWMM

SEQ ID NO: 452586 - protein, 9 aa, Influenza virus
PSNAQAFYK

SEQ ID NO: 452587 - protein, 9 aa, Influenza virus
PSNMDRAVK

SEQ ID NO: 452588 - protein, 9 aa, Influenza virus
PSNSLKLAI

SEQ ID NO: 452589 - protein, 9 aa, Influenza virus
PSNSRFESV

SEQ ID NO: 452590 - protein, 9 aa, Influenza virus
PSPGARPKV

SEQ ID NO: 452591 - protein, 9 aa, Influenza virus
PSPGDRPKV

SEQ ID NO: 452592 - protein, 9 aa, Influenza virus
PSPLKLVDG

SEQ ID NO: 452593 - protein, 9 aa, Influenza virus
PSPSNSRFE

SEQ ID NO: 452594 - protein, 9 aa, Influenza virus
PSPYNSKFE

SEQ ID NO: 452595 - protein, 9 aa, Influenza virus
PSPYNSRFE

SEQ ID NO: 452596 - protein, 9 aa, Influenza virus
PSQKLFALS

SEQ ID NO: 452597 - protein, 9 aa, Influenza virus
PSRSLKLAI

SEQ ID NO: 452598 - protein, 9 aa, Influenza virus
PSRVSKLIG

SEQ ID NO: 452599 - protein, 9 aa, Influenza virus
PSRVSKLKG

SEQ ID NO: 452600 - protein, 9 aa, Influenza virus
PSRVSKLRG

SEQ ID NO: 452601 - protein, 9 aa, Influenza virus
PSRVSKLTG

SEQ ID NO: 452602 - protein, 9 aa, Influenza virus
PSRVTKLKG

SEQ ID NO: 452603 - protein, 9 aa, Influenza virus
PSSAQEKND

SEQ ID NO: 452604 - protein, 9 aa, Influenza virus
PSSDNEQTD

SEQ ID NO: 452605 - protein, 9 aa, Influenza virus
PSSSYRRPI

SEQ ID NO: 452606 - protein, 9 aa, Influenza virus
PSSSYRRPV

SEQ ID NO: 452607 - protein, 9 aa, Influenza virus
PSSTKEKND

SEQ ID NO: 452608 - protein, 9 aa, Influenza virus
PSSTKEKNE

SEQ ID NO: 452609 - protein, 9 aa, Influenza virus
PSSTQEKNA

SEQ ID NO: 452610 - protein, 9 aa, Influenza virus
PSSTQEKND

SEQ ID NO: 452611 - protein, 9 aa, Influenza virus
PSTGKDPKK

SEQ ID NO: 452612 - protein, 9 aa, Influenza virus
PSTGNHGSL

SEQ ID NO: 452613 - protein, 9 aa, Influenza virus
PSTISCDSP

SEQ ID NO: 452614 - protein, 9 aa, Influenza virus
PSTMSCDSP

SEQ ID NO: 452615 - protein, 9 aa, Influenza virus
PSTVSCDSP

SEQ ID NO: 452616 - protein, 9 aa, Influenza virus
PSVEPKGLF

SEQ ID NO: 452617 - protein, 9 aa, Influenza virus
PSVEPRGLF

SEQ ID NO: 452618 - protein, 9 aa, Influenza virus
PSVKLPMGA

SEQ ID NO: 452619 - protein, 9 aa, Influenza virus
PSVQSRGLF

SEQ ID NO: 452620 - protein, 9 aa, Influenza virus
PSVVSCDSP

SEQ ID NO: 452621 - protein, 9 aa, Influenza virus
PSWAGNILR

SEQ ID NO: 452622 - protein, 9 aa, Influenza virus
PSWAGNVLR

SEQ ID NO: 452623 - protein, 9 aa, Influenza virus
PSWEGNILR

SEQ ID NO: 452624 - protein, 9 aa, Influenza virus
PTAPHGLCY

SEQ ID NO: 452625 - protein, 9 aa, Influenza virus
PTAVDTCYP

SEQ ID NO: 452626 - protein, 9 aa, Influenza virus
PTDTPRGED

SEQ ID NO: 452627 - protein, 9 aa, Influenza virus
PTDTPRIQD

SEQ ID NO: 452628 - protein, 9 aa, Influenza virus
PTDTPRVQD

SEQ ID NO: 452629 - protein, 9 aa, Influenza virus
PTDVIRSWR

SEQ ID NO: 452630 - protein, 9 aa, Influenza virus
PTDVVRSWK

SEQ ID NO: 452631 - protein, 9 aa, Influenza virus
PTDVVRSWR

SEQ ID NO: 452632 - protein, 9 aa, Influenza virus
PTECRTFFL

SEQ ID NO: 452633 - protein, 9 aa, Influenza virus
PTEEQAVDI

SEQ ID NO: 452634 - protein, 9 aa, Influenza virus
PTEEQAVGI

SEQ ID NO: 452635 - protein, 9 aa, Influenza virus
PTEEQAVNI

SEQ ID NO: 452636 - protein, 9 aa, Influenza virus
PTFDSLNIT

SEQ ID NO: 452637 - protein, 9 aa, Influenza virus
PTFSVQRNL

SEQ ID NO: 452638 - protein, 9 aa, Influenza virus
PTFSVQRSL

SEQ ID NO: 452639 - protein, 9 aa, Influenza virus
PTGCKMYAL

SEQ ID NO: 452640 - protein, 9 aa, Influenza virus
PTGYAQTDC

SEQ ID NO: 452641 - protein, 9 aa, Influenza virus
PTKSYFANL

SEQ ID NO: 452642 - protein, 9 aa, Influenza virus
PTLLFLEVP

SEQ ID NO: 452643 - protein, 9 aa, Influenza virus
PTLLFLKIP

SEQ ID NO: 452644 - protein, 9 aa, Influenza virus
PTLLFLKMP

SEQ ID NO: 452645 - protein, 9 aa, Influenza virus
PTLLFLKVP

SEQ ID NO: 452646 - protein, 9 aa, Influenza virus
PTNGICYPG

SEQ ID NO: 452647 - protein, 9 aa, Influenza virus
PTTEINTWA

SEQ ID NO: 452648 - protein, 9 aa, Influenza virus
PVAEINTWA

SEQ ID NO: 452649 - protein, 9 aa, Influenza virus
PVAKAGFIE

SEQ ID NO: 452650 - protein, 9 aa, Influenza virus
PVCDPHLTG

SEQ ID NO: 452651 - protein, 9 aa, Influenza virus
PVELSSGYK

SEQ ID NO: 452652 - protein, 9 aa, Influenza virus
PVGEAPSPY

SEQ ID NO: 452653 - protein, 9 aa, Influenza virus
PVGEVPSPY

SEQ ID NO: 452654 - protein, 9 aa, Influenza virus
PVGGNEKKA

SEQ ID NO: 452655 - protein, 9 aa, Influenza virus
PVGISSMGE

SEQ ID NO: 452656 - protein, 9 aa, Influenza virus
PVGISSMME

SEQ ID NO: 452657 - protein, 9 aa, Influenza virus
PVGISSMVE

SEQ ID NO: 452658 - protein, 9 aa, Influenza virus
PVGPGSFPD

SEQ ID NO: 452659 - protein, 9 aa, Influenza virus
PVGSGSFPD

SEQ ID NO: 452660 - protein, 9 aa, Influenza virus
PVGTAPVLG

SEQ ID NO: 452661 - protein, 9 aa, Influenza virus
PVGVAPSPS

SEQ ID NO: 452662 - protein, 9 aa, Influenza virus
PVGVAPSPY

SEQ ID NO: 452663 - protein, 9 aa, Influenza virus
PVHFQNQVK

SEQ ID NO: 452664 - protein, 9 aa, Influenza virus
PVHFRNQIK

SEQ ID NO: 452665 - protein, 9 aa, Influenza virus
PVHFRNQVK

SEQ ID NO: 452666 - protein, 9 aa, Influenza virus
PVHFRSQVK

SEQ ID NO: 452667 - protein, 9 aa, Influenza virus
PVHKSQLIW

SEQ ID NO: 452668 - protein, 9 aa, Influenza virus
PVHLGDCNF

SEQ ID NO: 452669 - protein, 9 aa, Influenza virus
PVHLGDCRF

SEQ ID NO: 452670 - protein, 9 aa, Influenza virus
PVHLGDCSF

SEQ ID NO: 452671 - protein, 9 aa, Influenza virus
PVICLGHHA

SEQ ID NO: 452672 - protein, 9 aa, Influenza virus
PVICLGHHS

SEQ ID NO: 452673 - protein, 9 aa, Influenza virus
PVICMGHHA

SEQ ID NO: 452674 - protein, 9 aa, Influenza virus
PVIGARPQV

SEQ ID NO: 452675 - protein, 9 aa, Influenza virus
PVKGWAPLS

SEQ ID NO: 452676 - protein, 9 aa, Influenza virus
PVKLNSGYK

SEQ ID NO: 452677 - protein, 9 aa, Influenza virus
PVKLSGGYK

SEQ ID NO: 452678 - protein, 9 aa, Influenza virus
PVKLSNGYK

SEQ ID NO: 452679 - protein, 9 aa, Influenza virus
PVKLSSGYK

SEQ ID NO: 452680 - protein, 9 aa, Influenza virus
PVKLSSSYK

SEQ ID NO: 452681 - protein, 9 aa, Influenza virus
PVLGNYKEI

SEQ ID NO: 452682 - protein, 9 aa, Influenza virus
PVLGNYREI

SEQ ID NO: 452683 - protein, 9 aa, Influenza virus
PVLGNYREV

SEQ ID NO: 452684 - protein, 9 aa, Influenza virus
PVLKPGQTL

SEQ ID NO: 452685 - protein, 9 aa, Influenza virus
PVLTDNPRP

SEQ ID NO: 452686 - protein, 9 aa, Influenza virus
PVLYFWGVH

SEQ ID NO: 452687 - protein, 9 aa, Influenza virus
PVMGARPQV

SEQ ID NO: 452688 - protein, 9 aa, Influenza virus
PVNGICYPG

SEQ ID NO: 452689 - protein, 9 aa, Influenza virus
PVNGQSGRI

SEQ ID NO: 452690 - protein, 9 aa, Influenza virus
PVNNGKGRY

SEQ ID NO: 452691 - protein, 9 aa, Influenza virus
PVPVGSGSF

SEQ ID NO: 452692 - protein, 9 aa, Influenza virus
PVQNAISTT

SEQ ID NO: 452693 - protein, 9 aa, Influenza virus
PVQSKMQFS

SEQ ID NO: 452694 - protein, 9 aa, Influenza virus
PVQSRMQFS

SEQ ID NO: 452695 - protein, 9 aa, Influenza virus
PVQTDEYKN

SEQ ID NO: 452696 - protein, 9 aa, Influenza virus
PVSVGSGSF

SEQ ID NO: 452697 - protein, 9 aa, Influenza virus
PVTEINTWA

SEQ ID NO: 452698 - protein, 9 aa, Influenza virus
PVTIGECPK

SEQ ID NO: 452699 - protein, 9 aa, Influenza virus
PVTIGKCPK

SEQ ID NO: 452700 - protein, 9 aa, Influenza virus
PVTLSSGYK

SEQ ID NO: 452701 - protein, 9 aa, Influenza virus
PVTLTMGYK

SEQ ID NO: 452702 - protein, 9 aa, Influenza virus
PVTQAMELV

SEQ ID NO: 452703 - protein, 9 aa, Influenza virus
PVTQTMELV

SEQ ID NO: 452704 - protein, 9 aa, Influenza virus
PVTQVEELV

SEQ ID NO: 452705 - protein, 9 aa, Influenza virus
PVTSSIDLI

SEQ ID NO: 452706 - protein, 9 aa, Influenza virus
PVTSSIDLV

SEQ ID NO: 452707 - protein, 9 aa, Influenza virus
PVTSSVDLI

SEQ ID NO: 452708 - protein, 9 aa, Influenza virus
PVTSSVDLV

SEQ ID NO: 452709 - protein, 9 aa, Influenza virus
PVTSTIDLI

SEQ ID NO: 452710 - protein, 9 aa, Influenza virus
PVVFTDGSA

SEQ ID NO: 452711 - protein, 9 aa, Influenza virus
PVVGARPKV

SEQ ID NO: 452712 - protein, 9 aa, Influenza virus
PVVGARPQV

SEQ ID NO: 452713 - protein, 9 aa, Influenza virus
PVVMTDGPA

SEQ ID NO: 452714 - protein, 9 aa, Influenza virus
PVVPSFDMS

SEQ ID NO: 452715 - protein, 9 aa, Influenza virus
PVVRARPQV

SEQ ID NO: 452716 - protein, 9 aa, Influenza virus
PWARNILRT

SEQ ID NO: 452717 - protein, 9 aa, Influenza virus
PWIRFNSDL

SEQ ID NO: 452718 - protein, 9 aa, Influenza virus
PWIRFNSDP

SEQ ID NO: 452719 - protein, 9 aa, Influenza virus
PWIRFNSNL

SEQ ID NO: 452720 - protein, 9 aa, Influenza virus
PWIRINNET

SEQ ID NO: 452721 - protein, 9 aa, Influenza virus
PWISFDQNL

SEQ ID NO: 452722 - protein, 9 aa, Influenza virus
PWMRINNET

SEQ ID NO: 452723 - protein, 9 aa, Influenza virus
PWMRISNET

SEQ ID NO: 452724 - protein, 9 aa, Influenza virus
PWVLLNASW

SEQ ID NO: 452725 - protein, 9 aa, Influenza virus
PWVRGQSGR

SEQ ID NO: 452726 - protein, 9 aa, Influenza virus
PWVRINNET

SEQ ID NO: 452727 - protein, 9 aa, Influenza virus
PWVRMNNET

SEQ ID NO: 452728 - protein, 9 aa, Influenza virus
PWVSFDQNL

SEQ ID NO: 452729 - protein, 9 aa, Influenza virus
PWVSFNHNL

SEQ ID NO: 452730 - protein, 9 aa, Influenza virus
PWVSFNQDL

SEQ ID NO: 452731 - protein, 9 aa, Influenza virus
PWVSFNQNL

SEQ ID NO: 452732 - protein, 9 aa, Influenza virus
PYIGKCPKY

SEQ ID NO: 452733 - protein, 9 aa, Influenza virus
PYLNGREWS

SEQ ID NO: 452734 - protein, 9 aa, Influenza virus
PYNSKFESV

SEQ ID NO: 452735 - protein, 9 aa, Influenza virus
PYNSRFESV

SEQ ID NO: 452736 - protein, 9 aa, Influenza virus
PYPGNNBNG

SEQ ID NO: 452737 - protein, 9 aa, Influenza virus
PYPGNNNKG

SEQ ID NO: 452738 - protein, 9 aa, Influenza virus
PYPGNNNNG

SEQ ID NO: 452739 - protein, 9 aa, Influenza virus
PYPGNSNNG

SEQ ID NO: 452740 - protein, 9 aa, Influenza virus
PYRALISWE

SEQ ID NO: 452741 - protein, 9 aa, Influenza virus
PYRALMSCP

SEQ ID NO: 452742 - protein, 9 aa, Influenza virus
PYRALMSVP

SEQ ID NO: 452743 - protein, 9 aa, Influenza virus
PYRSLIKFP

SEQ ID NO: 452744 - protein, 9 aa, Influenza virus
PYRSLIQFP

SEQ ID NO: 452745 - protein, 9 aa, Influenza virus
PYRSLIRFP

SEQ ID NO: 452746 - protein, 9 aa, Influenza virus
PYRTLLMNE

SEQ ID NO: 452747 - protein, 9 aa, Influenza virus
PYRTLLMSE

SEQ ID NO: 452748 - protein, 9 aa, Influenza virus
PYRTLMSCP

SEQ ID NO: 452749 - protein, 9 aa, Influenza virus
PYRTLMSVE

SEQ ID NO: 452750 - protein, 9 aa, Influenza virus
PYRTLMSVK

SEQ ID NO: 452751 - protein, 9 aa, Influenza virus
PYSHGTGTG

SEQ ID NO: 452752 - protein, 9 aa, Influenza virus
PYTGDPPYS

SEQ ID NO: 452753 - protein, 9 aa, Influenza virus
PYTLVSTGS

SEQ ID NO: 452754 - protein, 9 aa, Influenza virus
PYTLVSTKE

SEQ ID NO: 452755 - protein, 9 aa, Influenza virus
PYTLVSTKS

SEQ ID NO: 452756 - protein, 9 aa, Influenza virus
PYTLVSTRS

SEQ ID NO: 452757 - protein, 9 aa, Influenza virus
PYTLVSTSS

SEQ ID NO: 452758 - protein, 9 aa, Influenza virus
PYTLVTTSS

SEQ ID NO: 452759 - protein, 9 aa, Influenza virus
PYVSCDPDE

SEQ ID NO: 452760 - protein, 9 aa, Influenza virus
PYVSCDPDG

SEQ ID NO: 452761 - protein, 9 aa, Influenza virus
PYVSCDPLG

SEQ ID NO: 452762 - protein, 9 aa, Influenza virus
PYVSCDPNE

SEQ ID NO: 452763 - protein, 9 aa, Influenza virus
PYVSCDPSG

SEQ ID NO: 452764 - protein, 9 aa, Influenza virus
PYVSCDPTG

SEQ ID NO: 452765 - protein, 9 aa, Influenza virus
PYVSCEPDE

SEQ ID NO: 452766 - protein, 9 aa, Influenza virus
QAADLKSTQ

SEQ ID NO: 452767 - protein, 9 aa, Influenza virus
QAADYESTQ

SEQ ID NO: 452768 - protein, 9 aa, Influenza virus
QAADYKSTQ

SEQ ID NO: 452769 - protein, 9 aa, Influenza virus
QAAEAIEVA

SEQ ID NO: 452770 - protein, 9 aa, Influenza virus
QAAEAMEIA

SEQ ID NO: 452771 - protein, 9 aa, Influenza virus
QAAEAMEVA

SEQ ID NO: 452772 - protein, 9 aa, Influenza virus
QAAIDKING

SEQ ID NO: 452773 - protein, 9 aa, Influenza virus
QAAIDQING

SEQ ID NO: 452774 - protein, 9 aa, Influenza virus
QAAIDQITG

SEQ ID NO: 452775 - protein, 9 aa, Influenza virus
QAAIDQVNG

SEQ ID NO: 452776 - protein, 9 aa, Influenza virus
QAAVDQITG

SEQ ID NO: 452777 - protein, 9 aa, Influenza virus
QADEICIGY

SEQ ID NO: 452778 - protein, 9 aa, Influenza virus
QADSEMNKL

SEQ ID NO: 452779 - protein, 9 aa, Influenza virus
QAELLVAME

SEQ ID NO: 452780 - protein, 9 aa, Influenza virus
QAFRDNLEP

SEQ ID NO: 452781 - protein, 9 aa, Influenza virus
QAFYKILKI

SEQ ID NO: 452782 - protein, 9 aa, Influenza virus
QAFYRSINW

SEQ ID NO: 452783 - protein, 9 aa, Influenza virus
QAGRIDFHW

SEQ ID NO: 452784 - protein, 9 aa, Influenza virus
QAGRMTFYW

SEQ ID NO: 452785 - protein, 9 aa, Influenza virus
QAGVDRFYR

SEQ ID NO: 452786 - protein, 9 aa, Influenza virus
QAGVNRFYR

SEQ ID NO: 452787 - protein, 9 aa, Influenza virus
QAHTKVLYF

SEQ ID NO: 452788 - protein, 9 aa, Influenza virus
QAKFEAVAW

SEQ ID NO: 452789 - protein, 9 aa, Influenza virus
QAKFESVAW

SEQ ID NO: 452790 - protein, 9 aa, Influenza virus
QAKGLFGAI

SEQ ID NO: 452791 - protein, 9 aa, Influenza virus
QALKDNLEP

SEQ ID NO: 452792 - protein, 9 aa, Influenza virus
QALQLLFEV

SEQ ID NO: 452793 - protein, 9 aa, Influenza virus
QALQLLLEV

SEQ ID NO: 452794 - protein, 9 aa, Influenza virus
QALRDNLEP

SEQ ID NO: 452795 - protein, 9 aa, Influenza virus
QALRDSLEP

SEQ ID NO: 452796 - protein, 9 aa, Influenza virus
QAMELVEAE

SEQ ID NO: 452797 - protein, 9 aa, Influenza virus
QANLCRFLE

SEQ ID NO: 452798 - protein, 9 aa, Influenza virus
QAQDRGLFG

SEQ ID NO: 452799 - protein, 9 aa, Influenza virus
QAQNRGLFG

SEQ ID NO: 452800 - protein, 9 aa, Influenza virus
QARFEAVAW

SEQ ID NO: 452801 - protein, 9 aa, Influenza virus
QARFESVAW

SEQ ID NO: 452802 - protein, 9 aa, Influenza virus
QASPSCLVV

SEQ ID NO: 452803 - protein, 9 aa, Influenza virus
QASYKIFKS

SEQ ID NO: 452804 - protein, 9 aa, Influenza virus
QASYRIFKS

SEQ ID NO: 452805 - protein, 9 aa, Influenza virus
QATIDQITG

SEQ ID NO: 452806 - protein, 9 aa, Influenza virus
QAVDICKAA

SEQ ID NO: 452807 - protein, 9 aa, Influenza virus
QAVGICKAA

SEQ ID NO: 452808 - protein, 9 aa, Influenza virus
QAVNICKAA

SEQ ID NO: 452809 - protein, 9 aa, Influenza virus
QAWSYIVER

SEQ ID NO: 452810 - protein, 9 aa, Influenza virus
QAYQKRMGL

SEQ ID NO: 452811 - protein, 9 aa, Influenza virus
QAYQKRMGV

SEQ ID NO: 452812 - protein, 9 aa, Influenza virus
QAYTKILYF

SEQ ID NO: 452813 - protein, 9 aa, Influenza virus
QAYTKIMYF

SEQ ID NO: 452814 - protein, 9 aa, Influenza virus
QAYTKVLYF

SEQ ID NO: 452815 - protein, 9 aa, Influenza virus
QAYTKVMYF

SEQ ID NO: 452816 - protein, 9 aa, Influenza virus
QCDLHLEFK

SEQ ID NO: 452817 - protein, 9 aa, Influenza virus
QCDNNCIES

SEQ ID NO: 452818 - protein, 9 aa, Influenza virus
QCDSHLKFK

SEQ ID NO: 452819 - protein, 9 aa, Influenza virus
QCEITGFAP

SEQ ID NO: 452820 - protein, 9 aa, Influenza virus
QCFNPMIAE

SEQ ID NO: 452821 - protein, 9 aa, Influenza virus
QCFNPMIIE

SEQ ID NO: 452822 - protein, 9 aa, Influenza virus
QCFNPMIVE

SEQ ID NO: 452823 - protein, 9 aa, Influenza virus
QCFNPMTVE

SEQ ID NO: 452824 - protein, 9 aa, Influenza virus
QCFNPMVVE

SEQ ID NO: 452825 - protein, 9 aa, Influenza virus
QCHITGFAP

SEQ ID NO: 452826 - protein, 9 aa, Influenza virus
QCKITGFAP

SEQ ID NO: 452827 - protein, 9 aa, Influenza virus
QCLITGFAP

SEQ ID NO: 452828 - protein, 9 aa, Influenza virus
QCMESIRNN

SEQ ID NO: 452829 - protein, 9 aa, Influenza virus
QCQIAGFAP

SEQ ID NO: 452830 - protein, 9 aa, Influenza virus
QCQIIGFAP

SEQ ID NO: 452831 - protein, 9 aa, Influenza virus
QCQIRGFAP

SEQ ID NO: 452832 - protein, 9 aa, Influenza virus
QCQISGFAP

SEQ ID NO: 452833 - protein, 9 aa, Influenza virus
QCQITGFAP

SEQ ID NO: 452834 - protein, 9 aa, Influenza virus
QCQITGFVP

SEQ ID NO: 452835 - protein, 9 aa, Influenza virus
QCQITGSAP

SEQ ID NO: 452836 - protein, 9 aa, Influenza virus
QCQTPLGAI

SEQ ID NO: 452837 - protein, 9 aa, Influenza virus
QCQVTGFAP

SEQ ID NO: 452838 - protein, 9 aa, Influenza virus
QCRICIDFR

SEQ ID NO: 452839 - protein, 9 aa, Influenza virus
QCRICILDQ

SEQ ID NO: 452840 - protein, 9 aa, Influenza virus
QCRICIRAD

SEQ ID NO: 452841 - protein, 9 aa, Influenza virus
QCRITGFAP

SEQ ID NO: 452842 - protein, 9 aa, Influenza virus
QDAMTEVWS

SEQ ID NO: 452843 - protein, 9 aa, Influenza virus
QDCDLINGA

SEQ ID NO: 452844 - protein, 9 aa, Influenza virus
QDEFCYTLI

SEQ ID NO: 452845 - protein, 9 aa, Influenza virus
QDEFCYTLM

SEQ ID NO: 452846 - protein, 9 aa, Influenza virus
QDEFCYTLV

SEQ ID NO: 452847 - protein, 9 aa, Influenza virus
QDGKSSACK

SEQ ID NO: 452848 - protein, 9 aa, Influenza virus
QDIIDNDNW

SEQ ID NO: 452849 - protein, 9 aa, Influenza virus
QDIIDNNNW

SEQ ID NO: 452850 - protein, 9 aa, Influenza virus
QDILEKTHN

SEQ ID NO: 452851 - protein, 9 aa, Influenza virus
QDIWAYNAE

SEQ ID NO: 452852 - protein, 9 aa, Influenza virus
QDLEKYVED

SEQ ID NO: 452853 - protein, 9 aa, Influenza virus
QDLENYVED

SEQ ID NO: 452854 - protein, 9 aa, Influenza virus
QDLERYVED

SEQ ID NO: 452855 - protein, 9 aa, Influenza virus
QDLWAYNAE

SEQ ID NO: 452856 - protein, 9 aa, Influenza virus
QDNAIRFGE

SEQ ID NO: 452857 - protein, 9 aa, Influenza virus
QDNAKDEGN

SEQ ID NO: 452858 - protein, 9 aa, Influenza virus
QDRGLFGAI

SEQ ID NO: 452859 - protein, 9 aa, Influenza virus
QDRGLFGAK

SEQ ID NO: 452860 - protein, 9 aa, Influenza virus
QDSECVSHN

SEQ ID NO: 452861 - protein, 9 aa, Influenza virus
QDSFYRSMK

SEQ ID NO: 452862 - protein, 9 aa, Influenza virus
QDTEISFTI

SEQ ID NO: 452863 - protein, 9 aa, Influenza virus
QDTELSFTI

SEQ ID NO: 452864 - protein, 9 aa, Influenza virus
QDTELSFTV

SEQ ID NO: 452865 - protein, 9 aa, Influenza virus
QDTEVSFTI

SEQ ID NO: 452866 - protein, 9 aa, Influenza virus
QDTTWDVFI

SEQ ID NO: 452867 - protein, 9 aa, Influenza virus
QDVIMEVVF

SEQ ID NO: 452868 - protein, 9 aa, Influenza virus
QDVWAYNAE

SEQ ID NO: 452869 - protein, 9 aa, Influenza virus
QDWSGYSGA

SEQ ID NO: 452870 - protein, 9 aa, Influenza virus
QDWSYIVER

SEQ ID NO: 452871 - protein, 9 aa, Influenza virus
QEAIDKITN

SEQ ID NO: 452872 - protein, 9 aa, Influenza virus
QEAIEKITN

SEQ ID NO: 452873 - protein, 9 aa, Influenza virus
QEAIGKITN

SEQ ID NO: 452874 - protein, 9 aa, Influenza virus
QEAINKITN

SEQ ID NO: 452875 - protein, 9 aa, Influenza virus
QEALQNRIM

SEQ ID NO: 452876 - protein, 9 aa, Influenza virus
QEARVWWTS

SEQ ID NO: 452877 - protein, 9 aa, Influenza virus
QEDCMIKAV

SEQ ID NO: 452878 - protein, 9 aa, Influenza virus
QEDCMMKAV

SEQ ID NO: 452879 - protein, 9 aa, Influenza virus
QEDCMVKAV

SEQ ID NO: 452880 - protein, 9 aa, Influenza virus
QEDRMIKAV

SEQ ID NO: 452881 - protein, 9 aa, Influenza virus
QEECMIKAV

SEQ ID NO: 452882 - protein, 9 aa, Influenza virus
QEELKSLFS

SEQ ID NO: 452883 - protein, 9 aa, Influenza virus
QEELRFLFS

SEQ ID NO: 452884 - protein, 9 aa, Influenza virus
QEELRSLFS

SEQ ID NO: 452885 - protein, 9 aa, Influenza virus
QEEVTNATE

SEQ ID NO: 452886 - protein, 9 aa, Influenza virus
QEFKMNPNK

SEQ ID NO: 452887 - protein, 9 aa, Influenza virus
QEFKMNPNQ

SEQ ID NO: 452888 - protein, 9 aa, Influenza virus
QEGRLIQNS

SEQ ID NO: 452889 - protein, 9 aa, Influenza virus
QEIDGIKLK

SEQ ID NO: 452890 - protein, 9 aa, Influenza virus
QEIEGARLD

SEQ ID NO: 452891 - protein, 9 aa, Influenza virus
QEIEGIKLE

SEQ ID NO: 452892 - protein, 9 aa, Influenza virus
QEIEGIKLK

SEQ ID NO: 452893 - protein, 9 aa, Influenza virus
QEIEGIRLK

SEQ ID NO: 452894 - protein, 9 aa, Influenza virus
QEIEGVKLD

SEQ ID NO: 452895 - protein, 9 aa, Influenza virus
QEIEGVKLN

SEQ ID NO: 452896 - protein, 9 aa, Influenza virus
QEIEGVRLD

SEQ ID NO: 452897 - protein, 9 aa, Influenza virus
QEIGGVKLD

SEQ ID NO: 452898 - protein, 9 aa, Influenza virus
QEIGNGCFE

SEQ ID NO: 452899 - protein, 9 aa, Influenza virus
QEIKMNPNQ

SEQ ID NO: 452900 - protein, 9 aa, Influenza virus
QEINGIKLK

SEQ ID NO: 452901 - protein, 9 aa, Influenza virus
QEIVDNKNW

SEQ ID NO: 452902 - protein, 9 aa, Influenza virus
QEIVDNNNW

SEQ ID NO: 452903 - protein, 9 aa, Influenza virus
QEIVDNSNW

SEQ ID NO: 452904 - protein, 9 aa, Influenza virus
QEIVGNDNW

SEQ ID NO: 452905 - protein, 9 aa, Influenza virus
QEIVSNDNW

SEQ ID NO: 452906 - protein, 9 aa, Influenza virus
QEKNDLYGA

SEQ ID NO: 452907 - protein, 9 aa, Influenza virus
QEKNDLYGT

SEQ ID NO: 452908 - protein, 9 aa, Influenza virus
QEKNPALRM

SEQ ID NO: 452909 - protein, 9 aa, Influenza virus
QEKNPSLRM

SEQ ID NO: 452910 - protein, 9 aa, Influenza virus
QELGDAPFL

SEQ ID NO: 452911 - protein, 9 aa, Influenza virus
QENRVWWTS

SEQ ID NO: 452912 - protein, 9 aa, Influenza virus
QERGLFGAI

SEQ ID NO: 452913 - protein, 9 aa, Influenza virus
QERNDLYGT

SEQ ID NO: 452914 - protein, 9 aa, Influenza virus
QESECACAN

SEQ ID NO: 452915 - protein, 9 aa, Influenza virus
QESECACIN

SEQ ID NO: 452916 - protein, 9 aa, Influenza virus
QESECACVN

SEQ ID NO: 452917 - protein, 9 aa, Influenza virus
QESECICIN

SEQ ID NO: 452918 - protein, 9 aa, Influenza virus
QESECQCID

SEQ ID NO: 452919 - protein, 9 aa, Influenza virus
QESECQCIG

SEQ ID NO: 452920 - protein, 9 aa, Influenza virus
QESECQCIS

SEQ ID NO: 452921 - protein, 9 aa, Influenza virus
QESECQCLY

SEQ ID NO: 452922 - protein, 9 aa, Influenza virus
QESECQRID

SEQ ID NO: 452923 - protein, 9 aa, Influenza virus
QESECVCHK

SEQ ID NO: 452924 - protein, 9 aa, Influenza virus
QESECVCHN

SEQ ID NO: 452925 - protein, 9 aa, Influenza virus
QESECVCHS

SEQ ID NO: 452926 - protein, 9 aa, Influenza virus
QESECVCID

SEQ ID NO: 452927 - protein, 9 aa, Influenza virus
QESECVCIN

SEQ ID NO: 452928 - protein, 9 aa, Influenza virus
QESECVCIS

SEQ ID NO: 452929 - protein, 9 aa, Influenza virus
QESECVCMN

SEQ ID NO: 452930 - protein, 9 aa, Influenza virus
QESECVCQD

SEQ ID NO: 452931 - protein, 9 aa, Influenza virus
QESECVCVN

SEQ ID NO: 452932 - protein, 9 aa, Influenza virus
QESECVRHN

SEQ ID NO: 452933 - protein, 9 aa, Influenza virus
QESLLLATG

SEQ ID NO: 452934 - protein, 9 aa, Influenza virus
QESLMLATG

SEQ ID NO: 452935 - protein, 9 aa, Influenza virus
QESSCTCIK

SEQ ID NO: 452936 - protein, 9 aa, Influenza virus
QESSCTCIL

SEQ ID NO: 452937 - protein, 9 aa, Influenza virus
QESSCTCIQ

SEQ ID NO: 452938 - protein, 9 aa, Influenza virus
QESSCTCIR

SEQ ID NO: 452939 - protein, 9 aa, Influenza virus
QESSCVCIK

SEQ ID NO: 452940 - protein, 9 aa, Influenza virus
QESSCVCMK

SEQ ID NO: 452941 - protein, 9 aa, Influenza virus
QESSCVCMN

SEQ ID NO: 452942 - protein, 9 aa, Influenza virus
QESSCVCVK

SEQ ID NO: 452943 - protein, 9 aa, Influenza virus
QETKVWWTS

SEQ ID NO: 452944 - protein, 9 aa, Influenza virus
QETRVWWTS

SEQ ID NO: 452945 - protein, 9 aa, Influenza virus
QFALGHGTT

SEQ ID NO: 452946 - protein, 9 aa, Influenza virus
QFALGQGAT

SEQ ID NO: 452947 - protein, 9 aa, Influenza virus
QFALGQGTT

SEQ ID NO: 452948 - protein, 9 aa, Influenza virus
QFEAIGREF

SEQ ID NO: 452949 - protein, 9 aa, Influenza virus
QFEAVGKEF

SEQ ID NO: 452950 - protein, 9 aa, Influenza virus
QFEAVGREF

SEQ ID NO: 452951 - protein, 9 aa, Influenza virus
QFELIDHEF

SEQ ID NO: 452952 - protein, 9 aa, Influenza virus
QFELIDNEF

SEQ ID NO: 452953 - protein, 9 aa, Influenza virus
QFELIDNKF

SEQ ID NO: 452954 - protein, 9 aa, Influenza virus
QFELINNEF

SEQ ID NO: 452955 - protein, 9 aa, Influenza virus
QFEMIDNEF

SEQ ID NO: 452956 - protein, 9 aa, Influenza virus
QFGLIDNEF

SEQ ID NO: 452957 - protein, 9 aa, Influenza virus
QFGRIDFHW

SEQ ID NO: 452958 - protein, 9 aa, Influenza virus
QFGRINFHW

SEQ ID NO: 452959 - protein, 9 aa, Influenza virus
QFKLIDNEF

SEQ ID NO: 452960 - protein, 9 aa, Influenza virus
QFPVQTDEY

SEQ ID NO: 452961 - protein, 9 aa, Influenza virus
QFRALISWE

SEQ ID NO: 452962 - protein, 9 aa, Influenza virus
QFSSLAVNV

SEQ ID NO: 452963 - protein, 9 aa, Influenza virus
QFSSLTVNV

SEQ ID NO: 452964 - protein, 9 aa, Influenza virus
QFSSLTVSV

SEQ ID NO: 452965 - protein, 9 aa, Influenza virus
QFTAVGKEF

SEQ ID NO: 452966 - protein, 9 aa, Influenza virus
QFTSVGKEF

SEQ ID NO: 452967 - protein, 9 aa, Influenza virus
QFTWNGVKV

SEQ ID NO: 452968 - protein, 9 aa, Influenza virus
QGACWEQLY

SEQ ID NO: 452969 - protein, 9 aa, Influenza virus
QGAGYAADK

SEQ ID NO: 452970 - protein, 9 aa, Influenza virus
QGALLGTKH

SEQ ID NO: 452971 - protein, 9 aa, Influenza virus
QGALLGTNH

SEQ ID NO: 452972 - protein, 9 aa, Influenza virus
QGALLGTRH

SEQ ID NO: 452973 - protein, 9 aa, Influenza virus
QGALLNDKH

SEQ ID NO: 452974 - protein, 9 aa, Influenza virus
QGALLNDRH

SEQ ID NO: 452975 - protein, 9 aa, Influenza virus
QGALVGTKH

SEQ ID NO: 452976 - protein, 9 aa, Influenza virus
QGANRPIIE

SEQ ID NO: 452977 - protein, 9 aa, Influenza virus
QGANRPVIE

SEQ ID NO: 452978 - protein, 9 aa, Influenza virus
QGANRPVIK

SEQ ID NO: 452979 - protein, 9 aa, Influenza virus
QGDIVLVMK

SEQ ID NO: 452980 - protein, 9 aa, Influenza virus
QGDNENATA

SEQ ID NO: 452981 - protein, 9 aa, Influenza virus
QGDVVLVMK

SEQ ID NO: 452982 - protein, 9 aa, Influenza virus
QGEGIAADY

SEQ ID NO: 452983 - protein, 9 aa, Influenza virus
QGEGTAADY

SEQ ID NO: 452984 - protein, 9 aa, Influenza virus
QGFAPFSKD

SEQ ID NO: 452985 - protein, 9 aa, Influenza virus
QGFFPFHKD

SEQ ID NO: 452986 - protein, 9 aa, Influenza virus
QGGHIEECS

SEQ ID NO: 452987 - protein, 9 aa, Influenza virus
QGIGQAADY

SEQ ID NO: 452988 - protein, 9 aa, Influenza virus
QGKTKATKM

SEQ ID NO: 452989 - protein, 9 aa, Influenza virus
QGLIDGWYG

SEQ ID NO: 452990 - protein, 9 aa, Influenza virus
QGLVDGWYG

SEQ ID NO: 452991 - protein, 9 aa, Influenza virus
QGMGMAADK

SEQ ID NO: 452992 - protein, 9 aa, Influenza virus
QGMIDGWYG

SEQ ID NO: 452993 - protein, 9 aa, Influenza virus
QGMVDGWYG

SEQ ID NO: 452994 - protein, 9 aa, Influenza virus
QGNGCFEIF

SEQ ID NO: 452995 - protein, 9 aa, Influenza virus
QGNILLSPE

SEQ ID NO: 452996 - protein, 9 aa, Influenza virus
QGNNDNATA

SEQ ID NO: 452997 - protein, 9 aa, Influenza virus
QGNNENATA

SEQ ID NO: 452998 - protein, 9 aa, Influenza virus
QGNNKNATA

SEQ ID NO: 452999 - protein, 9 aa, Influenza virus
QGNNNNATA

SEQ ID NO: 453000 - protein, 9 aa, Influenza virus
QGNSVWAGR

SEQ ID NO: 453001 - protein, 9 aa, Influenza virus
QGNVLLSPE

SEQ ID NO: 453002 - protein, 9 aa, Influenza virus
QGQGTAADY

SEQ ID NO: 453003 - protein, 9 aa, Influenza virus
QGQIIVLNT

SEQ ID NO: 453004 - protein, 9 aa, Influenza virus
QGQTIVLNT

SEQ ID NO: 453005 - protein, 9 aa, Influenza virus
QGQTIVSNT

SEQ ID NO: 453006 - protein, 9 aa, Influenza virus
QGQTVVLNT

SEQ ID NO: 453007 - protein, 9 aa, Influenza virus
QGRGLFGAI

SEQ ID NO: 453008 - protein, 9 aa, Influenza virus
QGRGLFGAK

SEQ ID NO: 453009 - protein, 9 aa, Influenza virus
QGRGVFEFS

SEQ ID NO: 453010 - protein, 9 aa, Influenza virus
QGRGVFELS

SEQ ID NO: 453011 - protein, 9 aa, Influenza virus
QGRLCNPLN

SEQ ID NO: 453012 - protein, 9 aa, Influenza virus
QGRLCNPMN

SEQ ID NO: 453013 - protein, 9 aa, Influenza virus
QGRMDYYWA

SEQ ID NO: 453014 - protein, 9 aa, Influenza virus
QGRMDYYWG

SEQ ID NO: 453015 - protein, 9 aa, Influenza virus
QGRQTFDWT

SEQ ID NO: 453016 - protein, 9 aa, Influenza virus
QGRQTYDWT

SEQ ID NO: 453017 - protein, 9 aa, Influenza virus
QGSARHIEE

SEQ ID NO: 453018 - protein, 9 aa, Influenza virus
QGSFYRNMR

SEQ ID NO: 453019 - protein, 9 aa, Influenza virus
QGSFYRSIR

SEQ ID NO: 453020 - protein, 9 aa, Influenza virus
QGSFYRSMR

SEQ ID NO: 453021 - protein, 9 aa, Influenza virus
QGSGYAADK

SEQ ID NO: 453022 - protein, 9 aa, Influenza virus
QGSGYAADL

SEQ ID NO: 453023 - protein, 9 aa, Influenza virus
QGSGYAADQ

SEQ ID NO: 453024 - protein, 9 aa, Influenza virus
QGSGYAADR

SEQ ID NO: 453025 - protein, 9 aa, Influenza virus
QGSLKLATG

SEQ ID NO: 453026 - protein, 9 aa, Influenza virus
QGSLLNDKH

SEQ ID NO: 453027 - protein, 9 aa, Influenza virus
QGSLLNDRH

SEQ ID NO: 453028 - protein, 9 aa, Influenza virus
QGSLMLATG

SEQ ID NO: 453029 - protein, 9 aa, Influenza virus
QGSLRLATG

SEQ ID NO: 453030 - protein, 9 aa, Influenza virus
QGSNRPVIQ

SEQ ID NO: 453031 - protein, 9 aa, Influenza virus
QGSNRPVIR

SEQ ID NO: 453032 - protein, 9 aa, Influenza virus
QGSNRPWIR

SEQ ID NO: 453033 - protein, 9 aa, Influenza virus
QGSTLPRRS

SEQ ID NO: 453034 - protein, 9 aa, Influenza virus
QGSYNNTSG

SEQ ID NO: 453035 - protein, 9 aa, Influenza virus
QGTAADYKS

SEQ ID NO: 453036 - protein, 9 aa, Influenza virus
QGTCWEQLY

SEQ ID NO: 453037 - protein, 9 aa, Influenza virus
QGTCWEQMY

SEQ ID NO: 453038 - protein, 9 aa, Influenza virus
QGTGIAADK

SEQ ID NO: 453039 - protein, 9 aa, Influenza virus
QGTGIAAEK

SEQ ID NO: 453040 - protein, 9 aa, Influenza virus
QGTGQAADY

SEQ ID NO: 453041 - protein, 9 aa, Influenza virus
QGTKRSHEQ

SEQ ID NO: 453042 - protein, 9 aa, Influenza virus
QGTKRSYEQ

SEQ ID NO: 453043 - protein, 9 aa, Influenza virus
QGTMDYYWG

SEQ ID NO: 453044 - protein, 9 aa, Influenza virus
QGTSVWAGR

SEQ ID NO: 453045 - protein, 9 aa, Influenza virus
QGTTIRGKH

SEQ ID NO: 453046 - protein, 9 aa, Influenza virus
QGTTIRGRH

SEQ ID NO: 453047 - protein, 9 aa, Influenza virus
QGTTIRNKH

SEQ ID NO: 453048 - protein, 9 aa, Influenza virus
QGTTIRNRH

SEQ ID NO: 453049 - protein, 9 aa, Influenza virus
QGTTLDNEH

SEQ ID NO: 453050 - protein, 9 aa, Influenza virus
QGTTLDNKH

SEQ ID NO: 453051 - protein, 9 aa, Influenza virus
QGTTLENKH

SEQ ID NO: 453052 - protein, 9 aa, Influenza virus
QGTTLKGRH

SEQ ID NO: 453053 - protein, 9 aa, Influenza virus
QGTTLNNKH

SEQ ID NO: 453054 - protein, 9 aa, Influenza virus
QGTTLRGQH

SEQ ID NO: 453055 - protein, 9 aa, Influenza virus
QGTTLRGRH

SEQ ID NO: 453056 - protein, 9 aa, Influenza virus
QGTTLYNKH

SEQ ID NO: 453057 - protein, 9 aa, Influenza virus
QGVGIAADK

SEQ ID NO: 453058 - protein, 9 aa, Influenza virus
QGVGMAADK

SEQ ID NO: 453059 - protein, 9 aa, Influenza virus
QGVKGWAFD

SEQ ID NO: 453060 - protein, 9 aa, Influenza virus
QGVKLAQGY

SEQ ID NO: 453061 - protein, 9 aa, Influenza virus
QGVKLIQGY

SEQ ID NO: 453062 - protein, 9 aa, Influenza virus
QGVKLTQGY

SEQ ID NO: 453063 - protein, 9 aa, Influenza virus
QGVLLGTKH

SEQ ID NO: 453064 - protein, 9 aa, Influenza virus
QGVRLTQGY

SEQ ID NO: 453065 - protein, 9 aa, Influenza virus
QGWMDYYWG

SEQ ID NO: 453066 - protein, 9 aa, Influenza virus
QGWSYIVER

SEQ ID NO: 453067 - protein, 9 aa, Influenza virus
QGYGVKGFG

SEQ ID NO: 453068 - protein, 9 aa, Influenza virus
QGYKDIILW

SEQ ID NO: 453069 - protein, 9 aa, Influenza virus
QHANGTIHD

SEQ ID NO: 453070 - protein, 9 aa, Influenza virus
QHIEECSCY

SEQ ID NO: 453071 - protein, 9 aa, Influenza virus
QHIIDLADS

SEQ ID NO: 453072 - protein, 9 aa, Influenza virus
QHIIDVTDS

SEQ ID NO: 453073 - protein, 9 aa, Influenza virus
QHKSHRQMV

SEQ ID NO: 453074 - protein, 9 aa, Influenza virus
QHLEECSCY

SEQ ID NO: 453075 - protein, 9 aa, Influenza virus
QHPELTGLD

SEQ ID NO: 453076 - protein, 9 aa, Influenza virus
QHPELTGLN

SEQ ID NO: 453077 - protein, 9 aa, Influenza virus
QHPELTGMD

SEQ ID NO: 453078 - protein, 9 aa, Influenza virus
QHPELTGMN

SEQ ID NO: 453079 - protein, 9 aa, Influenza virus
QHPELTGVD

SEQ ID NO: 453080 - protein, 9 aa, Influenza virus
QHPEMTGLD

SEQ ID NO: 453081 - protein, 9 aa, Influenza virus
QHQNAEGIG

SEQ ID NO: 453082 - protein, 9 aa, Influenza virus
QHQNAEGTG

SEQ ID NO: 453083 - protein, 9 aa, Influenza virus
QHQNEQGMG

SEQ ID NO: 453084 - protein, 9 aa, Influenza virus
QHQNEQGTG

SEQ ID NO: 453085 - protein, 9 aa, Influenza virus
QHQNEQGVG

SEQ ID NO: 453086 - protein, 9 aa, Influenza virus
QHQNSEGTG

SEQ ID NO: 453087 - protein, 9 aa, Influenza virus
QHRNDEGTG

SEQ ID NO: 453088 - protein, 9 aa, Influenza virus
QHRNEEGTG

SEQ ID NO: 453089 - protein, 9 aa, Influenza virus
QHRSHRQMA

SEQ ID NO: 453090 - protein, 9 aa, Influenza virus
QHRSHRQMV

SEQ ID NO: 453091 - protein, 9 aa, Influenza virus
QHTIDLADS

SEQ ID NO: 453092 - protein, 9 aa, Influenza virus
QHTIDLAES

SEQ ID NO: 453093 - protein, 9 aa, Influenza virus
QHTIDLTDA

SEQ ID NO: 453094 - protein, 9 aa, Influenza virus
QHTIDLTDS

SEQ ID NO: 453095 - protein, 9 aa, Influenza virus
QHTIDLTNS

SEQ ID NO: 453096 - protein, 9 aa, Influenza virus
QHTIDMADS

SEQ ID NO: 453097 - protein, 9 aa, Influenza virus
QHTIDMTDS

SEQ ID NO: 453098 - protein, 9 aa, Influenza virus
QHTIDSTDS

SEQ ID NO: 453099 - protein, 9 aa, Influenza virus
QHTIDVTDS

SEQ ID NO: 453100 - protein, 9 aa, Influenza virus
QHTIHLTDS

SEQ ID NO: 453101 - protein, 9 aa, Influenza virus
QHVEECSCY

SEQ ID NO: 453102 - protein, 9 aa, Influenza virus
QIADAQHRS

SEQ ID NO: 453103 - protein, 9 aa, Influenza virus
QIADSHHRS

SEQ ID NO: 453104 - protein, 9 aa, Influenza virus
QIADSQHKS

SEQ ID NO: 453105 - protein, 9 aa, Influenza virus
QIADSQHRS

SEQ ID NO: 453106 - protein, 9 aa, Influenza virus
QIAILAATV

SEQ ID NO: 453107 - protein, 9 aa, Influenza virus
QIAILATTI

SEQ ID NO: 453108 - protein, 9 aa, Influenza virus
QIAILATTV

SEQ ID NO: 453109 - protein, 9 aa, Influenza virus
QIAILVTTV

SEQ ID NO: 453110 - protein, 9 aa, Influenza virus
QICIGHHAN

SEQ ID NO: 453111 - protein, 9 aa, Influenza virus
QICIGYHAN

SEQ ID NO: 453112 - protein, 9 aa, Influenza virus
QICIGYHSN

SEQ ID NO: 453113 - protein, 9 aa, Influenza virus
QICVGYHAN

SEQ ID NO: 453114 - protein, 9 aa, Influenza virus
QICVGYHSN

SEQ ID NO: 453115 - protein, 9 aa, Influenza virus
QIDESCEGE

SEQ ID NO: 453116 - protein, 9 aa, Influenza virus
QIDPVKLSG

SEQ ID NO: 453117 - protein, 9 aa, Influenza virus
QIDPVKLSS

SEQ ID NO: 453118 - protein, 9 aa, Influenza virus
QIDQVKLSS

SEQ ID NO: 453119 - protein, 9 aa, Influenza virus
QIDSVKLSS

SEQ ID NO: 453120 - protein, 9 aa, Influenza virus
QIDTIMEKN

SEQ ID NO: 453121 - protein, 9 aa, Influenza virus
QIEARGLFG

SEQ ID NO: 453122 - protein, 9 aa, Influenza virus
QIEDLWAYN

SEQ ID NO: 453123 - protein, 9 aa, Influenza virus
QIEELWAYN

SEQ ID NO: 453124 - protein, 9 aa, Influenza virus
QIEGLWAYN

SEQ ID NO: 453125 - protein, 9 aa, Influenza virus
QIEKEFEQV

SEQ ID NO: 453126 - protein, 9 aa, Influenza virus
QIEKEFGQV

SEQ ID NO: 453127 - protein, 9 aa, Influenza virus
QIEKEFSEI

SEQ ID NO: 453128 - protein, 9 aa, Influenza virus
QIEKEFSEV

SEQ ID NO: 453129 - protein, 9 aa, Influenza virus
QIENLWAYN

SEQ ID NO: 453130 - protein, 9 aa, Influenza virus
QIEPRGLFG

SEQ ID NO: 453131 - protein, 9 aa, Influenza virus
QIESIIEAE

SEQ ID NO: 453132 - protein, 9 aa, Influenza virus
QIESMIEAE

SEQ ID NO: 453133 - protein, 9 aa, Influenza virus
QIESMVEAE

SEQ ID NO: 453134 - protein, 9 aa, Influenza virus
QIESRGLFG

SEQ ID NO: 453135 - protein, 9 aa, Influenza virus
QIEVTNATE

SEQ ID NO: 453136 - protein, 9 aa, Influenza virus
QIGNVINWT

SEQ ID NO: 453137 - protein, 9 aa, Influenza virus
QIGYICSGV

SEQ ID NO: 453138 - protein, 9 aa, Influenza virus
QIGYVCSGI

SEQ ID NO: 453139 - protein, 9 aa, Influenza virus
QIGYVCSGV

SEQ ID NO: 453140 - protein, 9 aa, Influenza virus
QIIDIWAYN

SEQ ID NO: 453141 - protein, 9 aa, Influenza virus
QIIKLLPFA

SEQ ID NO: 453142 - protein, 9 aa, Influenza virus
QIIRESGGI

SEQ ID NO: 453143 - protein, 9 aa, Influenza virus
QIIRRSGGI

SEQ ID NO: 453144 - protein, 9 aa, Influenza virus
QIISLCSIW

SEQ ID NO: 453145 - protein, 9 aa, Influenza virus
QIIVDNNNW

SEQ ID NO: 453146 - protein, 9 aa, Influenza virus
QIIVILVLG

SEQ ID NO: 453147 - protein, 9 aa, Influenza virus
QIIVLNTDW

SEQ ID NO: 453148 - protein, 9 aa, Influenza virus
QIIVTREPY

SEQ ID NO: 453149 - protein, 9 aa, Influenza virus
QIKIRRRVD

SEQ ID NO: 453150 - protein, 9 aa, Influenza virus
QILAIYATV

SEQ ID NO: 453151 - protein, 9 aa, Influenza virus
QILAIYSTA

SEQ ID NO: 453152 - protein, 9 aa, Influenza virus
QILAIYSTV

SEQ ID NO: 453153 - protein, 9 aa, Influenza virus
QILRESGGI

SEQ ID NO: 453154 - protein, 9 aa, Influenza virus
QILRGSGGI

SEQ ID NO: 453155 - protein, 9 aa, Influenza virus
QILRGSGGV

SEQ ID NO: 453156 - protein, 9 aa, Influenza virus
QILRKSGGI

SEQ ID NO: 453157 - protein, 9 aa, Influenza virus
QILRRSGGI

SEQ ID NO: 453158 - protein, 9 aa, Influenza virus
QILRTQESE

SEQ ID NO: 453159 - protein, 9 aa, Influenza virus
QILRTQESS

SEQ ID NO: 453160 - protein, 9 aa, Influenza virus
QILSIYSTA

SEQ ID NO: 453161 - protein, 9 aa, Influenza virus
QILSIYSTV

SEQ ID NO: 453162 - protein, 9 aa, Influenza virus
QILSLYSTV

SEQ ID NO: 453163 - protein, 9 aa, Influenza virus
QINGKLNRL

SEQ ID NO: 453164 - protein, 9 aa, Influenza virus
QINGQSGRI

SEQ ID NO: 453165 - protein, 9 aa, Influenza virus
QIQDIWAYN

SEQ ID NO: 453166 - protein, 9 aa, Influenza virus
QIQDLWAYN

SEQ ID NO: 453167 - protein, 9 aa, Influenza virus
QIQDVWAYN

SEQ ID NO: 453168 - protein, 9 aa, Influenza virus
QIQGIKLTQ

SEQ ID NO: 453169 - protein, 9 aa, Influenza virus
QIQGVKLAQ

SEQ ID NO: 453170 - protein, 9 aa, Influenza virus
QIQGVKLIQ

SEQ ID NO: 453171 - protein, 9 aa, Influenza virus
QIQGVKLTQ

SEQ ID NO: 453172 - protein, 9 aa, Influenza virus
QIQGVRLTQ

SEQ ID NO: 453173 - protein, 9 aa, Influenza virus
QIQNIWAYN

SEQ ID NO: 453174 - protein, 9 aa, Influenza virus
QIQNRGLFG

SEQ ID NO: 453175 - protein, 9 aa, Influenza virus
QIQTKRSFE

SEQ ID NO: 453176 - protein, 9 aa, Influenza virus
QIQTRRAFE

SEQ ID NO: 453177 - protein, 9 aa, Influenza virus
QIQTRRSFE

SEQ ID NO: 453178 - protein, 9 aa, Influenza virus
QIRGFVHFV

SEQ ID NO: 453179 - protein, 9 aa, Influenza virus
QIRGFVYFV

SEQ ID NO: 453180 - protein, 9 aa, Influenza virus
QISIVPNIG

SEQ ID NO: 453181 - protein, 9 aa, Influenza virus
QITDIWAYN

SEQ ID NO: 453182 - protein, 9 aa, Influenza virus
QITFLQALQ

SEQ ID NO: 453183 - protein, 9 aa, Influenza virus
QITFMQALQ

SEQ ID NO: 453184 - protein, 9 aa, Influenza virus
QITGFAPFS

SEQ ID NO: 453185 - protein, 9 aa, Influenza virus
QITGKLNHL

SEQ ID NO: 453186 - protein, 9 aa, Influenza virus
QITGKLNRI

SEQ ID NO: 453187 - protein, 9 aa, Influenza virus
QITGKLNRL

SEQ ID NO: 453188 - protein, 9 aa, Influenza virus
QITNGTTGN

SEQ ID NO: 453189 - protein, 9 aa, Influenza virus
QITRKLNRL

SEQ ID NO: 453190 - protein, 9 aa, Influenza virus
QITSLCSIW

SEQ ID NO: 453191 - protein, 9 aa, Influenza virus
QITTKINNI

SEQ ID NO: 453192 - protein, 9 aa, Influenza virus
QIVVTREPY

SEQ ID NO: 453193 - protein, 9 aa, Influenza virus
QKAIDEITT

SEQ ID NO: 453194 - protein, 9 aa, Influenza virus
QKAIDGITN

SEQ ID NO: 453195 - protein, 9 aa, Influenza virus
QKAIDGVTN

SEQ ID NO: 453196 - protein, 9 aa, Influenza virus
QKAIDIMQN

SEQ ID NO: 453197 - protein, 9 aa, Influenza virus
QKAIDNMQN

SEQ ID NO: 453198 - protein, 9 aa, Influenza virus
QKAIDQITT

SEQ ID NO: 453199 - protein, 9 aa, Influenza virus
QKAIDRITT

SEQ ID NO: 453200 - protein, 9 aa, Influenza virus
QKAINEITT

SEQ ID NO: 453201 - protein, 9 aa, Influenza virus
QKAINGVTN

SEQ ID NO: 453202 - protein, 9 aa, Influenza virus
QKALNEITT

SEQ ID NO: 453203 - protein, 9 aa, Influenza virus
QKAMMDQVR

SEQ ID NO: 453204 - protein, 9 aa, Influenza virus
QKAQGEGTA

SEQ ID NO: 453205 - protein, 9 aa, Influenza virus
QKCCNLFEK

SEQ ID NO: 453206 - protein, 9 aa, Influenza virus
QKCCSLFEK

SEQ ID NO: 453207 - protein, 9 aa, Influenza virus
QKCCTLFEK

SEQ ID NO: 453208 - protein, 9 aa, Influenza virus
QKFEEIKWL

SEQ ID NO: 453209 - protein, 9 aa, Influenza virus
QKFEEIRWL

SEQ ID NO: 453210 - protein, 9 aa, Influenza virus
QKFEEIRWM

SEQ ID NO: 453211 - protein, 9 aa, Influenza virus
QKFEEMRWL

SEQ ID NO: 453212 - protein, 9 aa, Influenza virus
QKFEEVRWL

SEQ ID NO: 453213 - protein, 9 aa, Influenza virus
QKGNIKCNI

SEQ ID NO: 453214 - protein, 9 aa, Influenza virus
QKGNIRCDI

SEQ ID NO: 453215 - protein, 9 aa, Influenza virus
QKGNIRCNI

SEQ ID NO: 453216 - protein, 9 aa, Influenza virus
QKIITIDSV

SEQ ID NO: 453217 - protein, 9 aa, Influenza virus
QKIITIGSA

SEQ ID NO: 453218 - protein, 9 aa, Influenza virus
QKIITIGSI

SEQ ID NO: 453219 - protein, 9 aa, Influenza virus
QKIITIGSM

SEQ ID NO: 453220 - protein, 9 aa, Influenza virus
QKIITIGSV

SEQ ID NO: 453221 - protein, 9 aa, Influenza virus
QKIITMGSV

SEQ ID NO: 453222 - protein, 9 aa, Influenza virus
QKILCASAT

SEQ ID NO: 453223 - protein, 9 aa, Influenza virus
QKILCTSAI

SEQ ID NO: 453224 - protein, 9 aa, Influenza virus
QKILCTSAT

SEQ ID NO: 453225 - protein, 9 aa, Influenza virus
QKILDEHDS

SEQ ID NO: 453226 - protein, 9 aa, Influenza virus
QKILFASAT

SEQ ID NO: 453227 - protein, 9 aa, Influenza virus
QKIMESGEI

SEQ ID NO: 453228 - protein, 9 aa, Influenza virus
QKIMESGGI

SEQ ID NO: 453229 - protein, 9 aa, Influenza virus
QKIMESGGV

SEQ ID NO: 453230 - protein, 9 aa, Influenza virus
QKINGVKLE

SEQ ID NO: 453231 - protein, 9 aa, Influenza virus
QKISGVKLE

SEQ ID NO: 453232 - protein, 9 aa, Influenza virus
QKITCVCRD

SEQ ID NO: 453233 - protein, 9 aa, Influenza virus
QKKDKRYGP

SEQ ID NO: 453234 - protein, 9 aa, Influenza virus
QKLEDVFAG

SEQ ID NO: 453235 - protein, 9 aa, Influenza virus
QKLFALSGV

SEQ ID NO: 453236 - protein, 9 aa, Influenza virus
QKLFASSGI

SEQ ID NO: 453237 - protein, 9 aa, Influenza virus
QKLFTLSGV

SEQ ID NO: 453238 - protein, 9 aa, Influenza virus
QKQEFKMNP

SEQ ID NO: 453239 - protein, 9 aa, Influenza virus
QKQEIKMNP

SEQ ID NO: 453240 - protein, 9 aa, Influenza virus
QKQMTRGLF

SEQ ID NO: 453241 - protein, 9 aa, Influenza virus
QKRGLFGAI

SEQ ID NO: 453242 - protein, 9 aa, Influenza virus
QKRMGLQMQ

SEQ ID NO: 453243 - protein, 9 aa, Influenza virus
QKRMGVQIQ

SEQ ID NO: 453244 - protein, 9 aa, Influenza virus
QKRMGVQLQ

SEQ ID NO: 453245 - protein, 9 aa, Influenza virus
QKRMGVQMH

SEQ ID NO: 453246 - protein, 9 aa, Influenza virus
QKRMGVQMQ

SEQ ID NO: 453247 - protein, 9 aa, Influenza virus
QKRMTRGLF

SEQ ID NO: 453248 - protein, 9 aa, Influenza virus
QKSLIWLWL

SEQ ID NO: 453249 - protein, 9 aa, Influenza virus
QKSLLLATG

SEQ ID NO: 453250 - protein, 9 aa, Influenza virus
QKSLRGRGS

SEQ ID NO: 453251 - protein, 9 aa, Influenza virus
QKSTQEAID

SEQ ID NO: 453252 - protein, 9 aa, Influenza virus
QKSTQEAIE

SEQ ID NO: 453253 - protein, 9 aa, Influenza virus
QKSTQEAIG

SEQ ID NO: 453254 - protein, 9 aa, Influenza virus
QKSTQEAIN

SEQ ID NO: 453255 - protein, 9 aa, Influenza virus
QKSWMKIYW

SEQ ID NO: 453256 - protein, 9 aa, Influenza virus
QKSWTKIYW

SEQ ID NO: 453257 - protein, 9 aa, Influenza virus
QKTIDQVTG

SEQ ID NO: 453258 - protein, 9 aa, Influenza virus
QKTITIGSV

SEQ ID NO: 453259 - protein, 9 aa, Influenza virus
QKTLDEHDA

SEQ ID NO: 453260 - protein, 9 aa, Influenza virus
QKTLDEHDS

SEQ ID NO: 453261 - protein, 9 aa, Influenza virus
QKTLDEHDT

SEQ ID NO: 453262 - protein, 9 aa, Influenza virus
QKTLDEHEA

SEQ ID NO: 453263 - protein, 9 aa, Influenza virus
QKTLDEHVA

SEQ ID NO: 453264 - protein, 9 aa, Influenza virus
QKTLDKHDS

SEQ ID NO: 453265 - protein, 9 aa, Influenza virus
QKTLKLATG

SEQ ID NO: 453266 - protein, 9 aa, Influenza virus
QKVNGVKLE

SEQ ID NO: 453267 - protein, 9 aa, Influenza virus
QKVPVTQTM

SEQ ID NO: 453268 - protein, 9 aa, Influenza virus
QKVTCVCRD

SEQ ID NO: 453269 - protein, 9 aa, Influenza virus
QKWSGYSGA

SEQ ID NO: 453270 - protein, 9 aa, Influenza virus
QKWWVWLWL

SEQ ID NO: 453271 - protein, 9 aa, Influenza virus
QLEGFSAES

SEQ ID NO: 453272 - protein, 9 aa, Influenza virus
QLFIKDYRY

SEQ ID NO: 453273 - protein, 9 aa, Influenza virus
QLFLVCVSL

SEQ ID NO: 453274 - protein, 9 aa, Influenza virus
QLGNVINWT

SEQ ID NO: 453275 - protein, 9 aa, Influenza virus
QLGSWSWHD

SEQ ID NO: 453276 - protein, 9 aa, Influenza virus
QLIPMISKC

SEQ ID NO: 453277 - protein, 9 aa, Influenza virus
QLIWMACHS

SEQ ID NO: 453278 - protein, 9 aa, Influenza virus
QLKDNAKEL

SEQ ID NO: 453279 - protein, 9 aa, Influenza virus
QLKDNAKEV

SEQ ID NO: 453280 - protein, 9 aa, Influenza virus
QLKDNAREL

SEQ ID NO: 453281 - protein, 9 aa, Influenza virus
QLKKQEIEG

SEQ ID NO: 453282 - protein, 9 aa, Influenza virus
QLKLATGLK

SEQ ID NO: 453283 - protein, 9 aa, Influenza virus
QLKLATGLR

SEQ ID NO: 453284 - protein, 9 aa, Influenza virus
QLKRQEIEG

SEQ ID NO: 453285 - protein, 9 aa, Influenza virus
QLLFEVEQE

SEQ ID NO: 453286 - protein, 9 aa, Influenza virus
QLLLEVENE

SEQ ID NO: 453287 - protein, 9 aa, Influenza virus
QLLLEVEQE

SEQ ID NO: 453288 - protein, 9 aa, Influenza virus
QLLLEVESE

SEQ ID NO: 453289 - protein, 9 aa, Influenza virus
QLLRHFQKD

SEQ ID NO: 453290 - protein, 9 aa, Influenza virus
QLLVLLENE

SEQ ID NO: 453291 - protein, 9 aa, Influenza virus
QLLVWLENE

SEQ ID NO: 453292 - protein, 9 aa, Influenza virus
QLNEGIMNT

SEQ ID NO: 453293 - protein, 9 aa, Influenza virus
QLNEGVINT

SEQ ID NO: 453294 - protein, 9 aa, Influenza virus
QLNEGVMNT

SEQ ID NO: 453295 - protein, 9 aa, Influenza virus
QLNPIDGPL

SEQ ID NO: 453296 - protein, 9 aa, Influenza virus
QLNQTYRNN

SEQ ID NO: 453297 - protein, 9 aa, Influenza virus
QLNQTYRNT

SEQ ID NO: 453298 - protein, 9 aa, Influenza virus
QLRDNAKEI

SEQ ID NO: 453299 - protein, 9 aa, Influenza virus
QLRDNAKEL

SEQ ID NO: 453300 - protein, 9 aa, Influenza virus
QLRDNAKET

SEQ ID NO: 453301 - protein, 9 aa, Influenza virus
QLRDNVKEL

SEQ ID NO: 453302 - protein, 9 aa, Influenza virus
QLRENAEDI

SEQ ID NO: 453303 - protein, 9 aa, Influenza virus
QLRENAEDK

SEQ ID NO: 453304 - protein, 9 aa, Influenza virus
QLRENAEDM

SEQ ID NO: 453305 - protein, 9 aa, Influenza virus
QLRENAEDQ

SEQ ID NO: 453306 - protein, 9 aa, Influenza virus
QLRENAEDR

SEQ ID NO: 453307 - protein, 9 aa, Influenza virus
QLRENAEED

SEQ ID NO: 453308 - protein, 9 aa, Influenza virus
QLRENAEEM

SEQ ID NO: 453309 - protein, 9 aa, Influenza virus
QLRMATGLR

SEQ ID NO: 453310 - protein, 9 aa, Influenza virus
QLRQNAEED

SEQ ID NO: 453311 - protein, 9 aa, Influenza virus
QLSAGGDIW

SEQ ID NO: 453312 - protein, 9 aa, Influenza virus
QLSQKFEEI

SEQ ID NO: 453313 - protein, 9 aa, Influenza virus
QLSSVSSFE

SEQ ID NO: 453314 - protein, 9 aa, Influenza virus
QLSSVSSFK

SEQ ID NO: 453315 - protein, 9 aa, Influenza virus
QLSTVSSFE

SEQ ID NO: 453316 - protein, 9 aa, Influenza virus
QLTHHMRKK

SEQ ID NO: 453317 - protein, 9 aa, Influenza virus
QLVWMACHS

SEQ ID NO: 453318 - protein, 9 aa, Influenza virus
QLVWMACNS

SEQ ID NO: 453319 - protein, 9 aa, Influenza virus
QLYTPGGEV

SEQ ID NO: 453320 - protein, 9 aa, Influenza virus
QMAGSSEQA

SEQ ID NO: 453321 - protein, 9 aa, Influenza virus
QMAIDNMQN

SEQ ID NO: 453322 - protein, 9 aa, Influenza virus
QMALQLFIK

SEQ ID NO: 453323 - protein, 9 aa, Influenza virus
QMCTELKLN

SEQ ID NO: 453324 - protein, 9 aa, Influenza virus
QMCTELKLS

SEQ ID NO: 453325 - protein, 9 aa, Influenza virus
QMCTELQLS

SEQ ID NO: 453326 - protein, 9 aa, Influenza virus
QMEKIVLLF

SEQ ID NO: 453327 - protein, 9 aa, Influenza virus
QMESRGLFG

SEQ ID NO: 453328 - protein, 9 aa, Influenza virus
QMETDGDRQ

SEQ ID NO: 453329 - protein, 9 aa, Influenza virus
QMETDGERQ

SEQ ID NO: 453330 - protein, 9 aa, Influenza virus
QMETGERQN

SEQ ID NO: 453331 - protein, 9 aa, Influenza virus
QMETGGERQ

SEQ ID NO: 453332 - protein, 9 aa, Influenza virus
QMETSGERQ

SEQ ID NO: 453333 - protein, 9 aa, Influenza virus
QMNGQSGRI

SEQ ID NO: 453334 - protein, 9 aa, Influenza virus
QMQRFRRPD

SEQ ID NO: 453335 - protein, 9 aa, Influenza virus
QMRDILGTF

SEQ ID NO: 453336 - protein, 9 aa, Influenza virus
QMRDVLGTF

SEQ ID NO: 453337 - protein, 9 aa, Influenza virus
QMTRGLFGA

SEQ ID NO: 453338 - protein, 9 aa, Influenza virus
QMYQKCCNL

SEQ ID NO: 453339 - protein, 9 aa, Influenza virus
QMYQKCCSL

SEQ ID NO: 453340 - protein, 9 aa, Influenza virus
QMYQKCCTL

SEQ ID NO: 453341 - protein, 9 aa, Influenza virus
QMYQRCCNL

SEQ ID NO: 453342 - protein, 9 aa, Influenza virus
QMYTPGGEV

SEQ ID NO: 453343 - protein, 9 aa, Influenza virus
QMYTPGGGV

SEQ ID NO: 453344 - protein, 9 aa, Influenza virus
QMYTPGGKV

SEQ ID NO: 453345 - protein, 9 aa, Influenza virus
QNAEEDGKG

SEQ ID NO: 453346 - protein, 9 aa, Influenza virus
QNAEEDGRG

SEQ ID NO: 453347 - protein, 9 aa, Influenza virus
QNAEGIGIA

SEQ ID NO: 453348 - protein, 9 aa, Influenza virus
QNAEGTGIA

SEQ ID NO: 453349 - protein, 9 aa, Influenza virus
QNAEGTGMA

SEQ ID NO: 453350 - protein, 9 aa, Influenza virus
QNAEGTGTA

SEQ ID NO: 453351 - protein, 9 aa, Influenza virus
QNAISTTFP

SEQ ID NO: 453352 - protein, 9 aa, Influenza virus
QNALNGNGD

SEQ ID NO: 453353 - protein, 9 aa, Influenza virus
QNALSGNGD

SEQ ID NO: 453354 - protein, 9 aa, Influenza virus
QNAQGEGIA

SEQ ID NO: 453355 - protein, 9 aa, Influenza virus
QNAQGEGTA

SEQ ID NO: 453356 - protein, 9 aa, Influenza virus
QNAQGIGQA

SEQ ID NO: 453357 - protein, 9 aa, Influenza virus
QNAQGQGTA

SEQ ID NO: 453358 - protein, 9 aa, Influenza virus
QNAQGSGYA

SEQ ID NO: 453359 - protein, 9 aa, Influenza virus
QNAQGTGLA

SEQ ID NO: 453360 - protein, 9 aa, Influenza virus
QNAQGTGQA

SEQ ID NO: 453361 - protein, 9 aa, Influenza virus
QNASRHHMG

SEQ ID NO: 453362 - protein, 9 aa, Influenza virus
QNASRHYMG

SEQ ID NO: 453363 - protein, 9 aa, Influenza virus
QNASRYYMG

SEQ ID NO: 453364 - protein, 9 aa, Influenza virus
QNDVWLGRT

SEQ ID NO: 453365 - protein, 9 aa, Influenza virus
QNEDIPIEN

SEQ ID NO: 453366 - protein, 9 aa, Influenza virus
QNEDIPIGN

SEQ ID NO: 453367 - protein, 9 aa, Influenza virus
QNEDIPIGS

SEQ ID NO: 453368 - protein, 9 aa, Influenza virus
QNEFNKACE

SEQ ID NO: 453369 - protein, 9 aa, Influenza virus
QNEQGMGMA

SEQ ID NO: 453370 - protein, 9 aa, Influenza virus
QNEQGSGYA

SEQ ID NO: 453371 - protein, 9 aa, Influenza virus
QNEQGTGIA

SEQ ID NO: 453372 - protein, 9 aa, Influenza virus
QNEQGVGIA

SEQ ID NO: 453373 - protein, 9 aa, Influenza virus
QNEQGVGMA

SEQ ID NO: 453374 - protein, 9 aa, Influenza virus
QNFPQTANT

SEQ ID NO: 453375 - protein, 9 aa, Influenza virus
QNFPQTTNT

SEQ ID NO: 453376 - protein, 9 aa, Influenza virus
QNFPRTTNT

SEQ ID NO: 453377 - protein, 9 aa, Influenza virus
QNGKSGACK

SEQ ID NO: 453378 - protein, 9 aa, Influenza virus
QNGKSSACK

SEQ ID NO: 453379 - protein, 9 aa, Influenza virus
QNGNIRCQI

SEQ ID NO: 453380 - protein, 9 aa, Influenza virus
QNGNIRCTF

SEQ ID NO: 453381 - protein, 9 aa, Influenza virus
QNGNIRWPD

SEQ ID NO: 453382 - protein, 9 aa, Influenza virus
QNGNLRCQI

SEQ ID NO: 453383 - protein, 9 aa, Influenza virus
QNGNVRCQI

SEQ ID NO: 453384 - protein, 9 aa, Influenza virus
QNGNVRCTF

SEQ ID NO: 453385 - protein, 9 aa, Influenza virus
QNGQGSGYA

SEQ ID NO: 453386 - protein, 9 aa, Influenza virus
QNGSCRCMF

SEQ ID NO: 453387 - protein, 9 aa, Influenza virus
QNGSYRCMF

SEQ ID NO: 453388 - protein, 9 aa, Influenza virus
QNHGICAVA

SEQ ID NO: 453389 - protein, 9 aa, Influenza virus
QNICKPYIG

SEQ ID NO: 453390 - protein, 9 aa, Influenza virus
QNIDKNALG

SEQ ID NO: 453391 - protein, 9 aa, Influenza virus
QNIDRNAIG

SEQ ID NO: 453392 - protein, 9 aa, Influenza virus
QNIDRNALG

SEQ ID NO: 453393 - protein, 9 aa, Influenza virus
QNIDSRAVG

SEQ ID NO: 453394 - protein, 9 aa, Influenza virus
QNIDSWAVG

SEQ ID NO: 453395 - protein, 9 aa, Influenza virus
QNIEKNALG

SEQ ID NO: 453396 - protein, 9 aa, Influenza virus
QNIERNALG

SEQ ID NO: 453397 - protein, 9 aa, Influenza virus
QNIHPATIG

SEQ ID NO: 453398 - protein, 9 aa, Influenza virus
QNIHPITIG

SEQ ID NO: 453399 - protein, 9 aa, Influenza virus
QNIHPVTIG

SEQ ID NO: 453400 - protein, 9 aa, Influenza virus
QNIIQIDPV

SEQ ID NO: 453401 - protein, 9 aa, Influenza virus
QNILEKTHN

SEQ ID NO: 453402 - protein, 9 aa, Influenza virus
QNILRTQES

SEQ ID NO: 453403 - protein, 9 aa, Influenza virus
QNIPVTQTM

SEQ ID NO: 453404 - protein, 9 aa, Influenza virus
QNIPVTQVE

SEQ ID NO: 453405 - protein, 9 aa, Influenza virus
QNISKYAFG

SEQ ID NO: 453406 - protein, 9 aa, Influenza virus
QNISPVWIG

SEQ ID NO: 453407 - protein, 9 aa, Influenza virus
QNIWAYNAE

SEQ ID NO: 453408 - protein, 9 aa, Influenza virus
QNKLNNVID

SEQ ID NO: 453409 - protein, 9 aa, Influenza virus
QNKLYGAGN

SEQ ID NO: 453410 - protein, 9 aa, Influenza virus
QNKLYGTGN

SEQ ID NO: 453411 - protein, 9 aa, Influenza virus
QNLFTLSGV

SEQ ID NO: 453412 - protein, 9 aa, Influenza virus
QNLSPRTVG

SEQ ID NO: 453413 - protein, 9 aa, Influenza virus
QNLTKINNG

SEQ ID NO: 453414 - protein, 9 aa, Influenza virus
QNLTKTNNG

SEQ ID NO: 453415 - protein, 9 aa, Influenza virus
QNLTKVNNG

SEQ ID NO: 453416 - protein, 9 aa, Influenza virus
QNLTKVNSG

SEQ ID NO: 453417 - protein, 9 aa, Influenza virus
QNNAIDEGD

SEQ ID NO: 453418 - protein, 9 aa, Influenza virus
QNNFVPVIG

SEQ ID NO: 453419 - protein, 9 aa, Influenza virus
QNNFVPVMG

SEQ ID NO: 453420 - protein, 9 aa, Influenza virus
QNNFVPVVG

SEQ ID NO: 453421 - protein, 9 aa, Influenza virus
QNNFVPVVR

SEQ ID NO: 453422 - protein, 9 aa, Influenza virus
QNNTTLIEN

SEQ ID NO: 453423 - protein, 9 aa, Influenza virus
QNNTTVVEN

SEQ ID NO: 453424 - protein, 9 aa, Influenza virus
QNPRIFLAM

SEQ ID NO: 453425 - protein, 9 aa, Influenza virus
QNPRMFLAM

SEQ ID NO: 453426 - protein, 9 aa, Influenza virus
QNPRVFLAM

SEQ ID NO: 453427 - protein, 9 aa, Influenza virus
QNPRVFLTM

SEQ ID NO: 453428 - protein, 9 aa, Influenza virus
QNPTEEQAV

SEQ ID NO: 453429 - protein, 9 aa, Influenza virus
QNQNPRMFL

SEQ ID NO: 453430 - protein, 9 aa, Influenza virus
QNQVKIRRR

SEQ ID NO: 453431 - protein, 9 aa, Influenza virus
QNRGLFGAI

SEQ ID NO: 453432 - protein, 9 aa, Influenza virus
QNRGLFGAK

SEQ ID NO: 453433 - protein, 9 aa, Influenza virus
QNRIMINPV

SEQ ID NO: 453434 - protein, 9 aa, Influenza virus
QNRIQIDAV

SEQ ID NO: 453435 - protein, 9 aa, Influenza virus
QNRIQIDPV

SEQ ID NO: 453436 - protein, 9 aa, Influenza virus
QNRIQIDQV

SEQ ID NO: 453437 - protein, 9 aa, Influenza virus
QNRIQIDSV

SEQ ID NO: 453438 - protein, 9 aa, Influenza virus
QNRIQINPV

SEQ ID NO: 453439 - protein, 9 aa, Influenza virus
QNRIRIDPV

SEQ ID NO: 453440 - protein, 9 aa, Influenza virus
QNRLNNVID

SEQ ID NO: 453441 - protein, 9 aa, Influenza virus
QNRMQFSSL

SEQ ID NO: 453442 - protein, 9 aa, Influenza virus
QNRMQINPV

SEQ ID NO: 453443 - protein, 9 aa, Influenza virus
QNRVKIDPV

SEQ ID NO: 453444 - protein, 9 aa, Influenza virus
QNSEGTGIA

SEQ ID NO: 453445 - protein, 9 aa, Influenza virus
QNSEGTGIV

SEQ ID NO: 453446 - protein, 9 aa, Influenza virus
QNSEGTGTA

SEQ ID NO: 453447 - protein, 9 aa, Influenza virus
QNSFVPVVG

SEQ ID NO: 453448 - protein, 9 aa, Influenza virus
QNSITIERM

SEQ ID NO: 453449 - protein, 9 aa, Influenza virus
QNSLTIEKM

SEQ ID NO: 453450 - protein, 9 aa, Influenza virus
QNSLTIERM

SEQ ID NO: 453451 - protein, 9 aa, Influenza virus
QNSMTIERM

SEQ ID NO: 453452 - protein, 9 aa, Influenza virus
QNSQGEGTA

SEQ ID NO: 453453 - protein, 9 aa, Influenza virus
QNSTWVSQT

SEQ ID NO: 453454 - protein, 9 aa, Influenza virus
QNTIDLTDS

SEQ ID NO: 453455 - protein, 9 aa, Influenza virus
QNTLKLATG

SEQ ID NO: 453456 - protein, 9 aa, Influenza virus
QNTQGEGTA

SEQ ID NO: 453457 - protein, 9 aa, Influenza virus
QNTSKHYIG

SEQ ID NO: 453458 - protein, 9 aa, Influenza virus
QNTSRHYIG

SEQ ID NO: 453459 - protein, 9 aa, Influenza virus
QNTSRHYMG

SEQ ID NO: 453460 - protein, 9 aa, Influenza virus
QNVHPITIG

SEQ ID NO: 453461 - protein, 9 aa, Influenza virus
QNVHPVTIG

SEQ ID NO: 453462 - protein, 9 aa, Influenza virus
QNVNKITYG

SEQ ID NO: 453463 - protein, 9 aa, Influenza virus
QNVNKVTYG

SEQ ID NO: 453464 - protein, 9 aa, Influenza virus
QNVNRITYG

SEQ ID NO: 453465 - protein, 9 aa, Influenza virus
QNVPVTQAM

SEQ ID NO: 453466 - protein, 9 aa, Influenza virus
QNVPVTQTM

SEQ ID NO: 453467 - protein, 9 aa, Influenza virus
QNVPVTQVE

SEQ ID NO: 453468 - protein, 9 aa, Influenza virus
QNVSKYAFG

SEQ ID NO: 453469 - protein, 9 aa, Influenza virus
QNVSPIWIG

SEQ ID NO: 453470 - protein, 9 aa, Influenza virus
QNVSPLWIG

SEQ ID NO: 453471 - protein, 9 aa, Influenza virus
QNVSPLWVG

SEQ ID NO: 453472 - protein, 9 aa, Influenza virus
QNVSPVWIG

SEQ ID NO: 453473 - protein, 9 aa, Influenza virus
QNVSRIAIG

SEQ ID NO: 453474 - protein, 9 aa, Influenza virus
QNVSRYAFG

SEQ ID NO: 453475 - protein, 9 aa, Influenza virus
QNVTVTHAK

SEQ ID NO: 453476 - protein, 9 aa, Influenza virus
QNWSGYSGA

SEQ ID NO: 453477 - protein, 9 aa, Influenza virus
QNWSGYSGS

SEQ ID NO: 453478 - protein, 9 aa, Influenza virus
QPAATALAN

SEQ ID NO: 453479 - protein, 9 aa, Influenza virus
QPAFSVQRN

SEQ ID NO: 453480 - protein, 9 aa, Influenza virus
QPCFYIELI

SEQ ID NO: 453481 - protein, 9 aa, Influenza virus
QPCFYVELI

SEQ ID NO: 453482 - protein, 9 aa, Influenza virus
QPCFYVELT

SEQ ID NO: 453483 - protein, 9 aa, Influenza virus
QPEWFRNIL

SEQ ID NO: 453484 - protein, 9 aa, Influenza virus
QPEWFRNVL

SEQ ID NO: 453485 - protein, 9 aa, Influenza virus
QPGDNIIFS

SEQ ID NO: 453486 - protein, 9 aa, Influenza virus
QPGDNITFS

SEQ ID NO: 453487 - protein, 9 aa, Influenza virus
QPGWFRNVL

SEQ ID NO: 453488 - protein, 9 aa, Influenza virus
QPISLGDCS

SEQ ID NO: 453489 - protein, 9 aa, Influenza virus
QPKEKAIWT

SEQ ID NO: 453490 - protein, 9 aa, Influenza virus
QPKEKTIWT

SEQ ID NO: 453491 - protein, 9 aa, Influenza virus
QPKWFRNVL

SEQ ID NO: 453492 - protein, 9 aa, Influenza virus
QPLSISVGS

SEQ ID NO: 453493 - protein, 9 aa, Influenza virus
QPNDGQVLY

SEQ ID NO: 453494 - protein, 9 aa, Influenza virus
QPNERTIWT

SEQ ID NO: 453495 - protein, 9 aa, Influenza virus
QPNIGPRAL

SEQ ID NO: 453496 - protein, 9 aa, Influenza virus
QPNIGPRPL

SEQ ID NO: 453497 - protein, 9 aa, Influenza virus
QPTFSVQRN

SEQ ID NO: 453498 - protein, 9 aa, Influenza virus
QPTFSVQRS

SEQ ID NO: 453499 - protein, 9 aa, Influenza virus
QQETRVWWT

SEQ ID NO: 453500 - protein, 9 aa, Influenza virus
QQFELIDNE

SEQ ID NO: 453501 - protein, 9 aa, Influenza virus
QQFELIDNK

SEQ ID NO: 453502 - protein, 9 aa, Influenza virus
QQFELIDSE

SEQ ID NO: 453503 - protein, 9 aa, Influenza virus
QQFELINNE

SEQ ID NO: 453504 - protein, 9 aa, Influenza virus
QQFEMIDNE

SEQ ID NO: 453505 - protein, 9 aa, Influenza virus
QQFKLIDNE

SEQ ID NO: 453506 - protein, 9 aa, Influenza virus
QQGRMDYYW

SEQ ID NO: 453507 - protein, 9 aa, Influenza virus
QQGTMDYYW

SEQ ID NO: 453508 - protein, 9 aa, Influenza virus
QQGWMDYYW

SEQ ID NO: 453509 - protein, 9 aa, Influenza virus
QQIESIIEA

SEQ ID NO: 453510 - protein, 9 aa, Influenza virus
QQIESMIEA

SEQ ID NO: 453511 - protein, 9 aa, Influenza virus
QQIESMVEA

SEQ ID NO: 453512 - protein, 9 aa, Influenza virus
QQIGNVINC

SEQ ID NO: 453513 - protein, 9 aa, Influenza virus
QQIGNVINW

SEQ ID NO: 453514 - protein, 9 aa, Influenza virus
QQMRDILGT

SEQ ID NO: 453515 - protein, 9 aa, Influenza virus
QQMRDVLGT

SEQ ID NO: 453516 - protein, 9 aa, Influenza virus
QQSFSPSPG

SEQ ID NO: 453517 - protein, 9 aa, Influenza virus
QQSFTPSPG

SEQ ID NO: 453518 - protein, 9 aa, Influenza virus
QQSFVPSPG

SEQ ID NO: 453519 - protein, 9 aa, Influenza virus
QQTRVDKLT

SEQ ID NO: 453520 - protein, 9 aa, Influenza virus
QQTRVDRLT

SEQ ID NO: 453521 - protein, 9 aa, Influenza virus
QQVCIAWSS

SEQ ID NO: 453522 - protein, 9 aa, Influenza virus
QRAIDGVTN

SEQ ID NO: 453523 - protein, 9 aa, Influenza virus
QRAIDNMQN

SEQ ID NO: 453524 - protein, 9 aa, Influenza virus
QRAMMDQVR

SEQ ID NO: 453525 - protein, 9 aa, Influenza virus
QRAMVDQVR

SEQ ID NO: 453526 - protein, 9 aa, Influenza virus
QRCCNLFEK

SEQ ID NO: 453527 - protein, 9 aa, Influenza virus
QRFRRPDSS

SEQ ID NO: 453528 - protein, 9 aa, Influenza virus
QRGILEDEQ

SEQ ID NO: 453529 - protein, 9 aa, Influenza virus
QRGNIRCNI

SEQ ID NO: 453530 - protein, 9 aa, Influenza virus
QRGRIDFHW

SEQ ID NO: 453531 - protein, 9 aa, Influenza virus
QRGVLEDEQ

SEQ ID NO: 453532 - protein, 9 aa, Influenza virus
QRINGVKLE

SEQ ID NO: 453533 - protein, 9 aa, Influenza virus
QRINMLADR

SEQ ID NO: 453534 - protein, 9 aa, Influenza virus
QRKRRIRDN

SEQ ID NO: 453535 - protein, 9 aa, Influenza virus
QRKRRVRDN

SEQ ID NO: 453536 - protein, 9 aa, Influenza virus
QRLEDVFAG

SEQ ID NO: 453537 - protein, 9 aa, Influenza virus
QRLEGVFAG

SEQ ID NO: 453538 - protein, 9 aa, Influenza virus
QRLENVFAG

SEQ ID NO: 453539 - protein, 9 aa, Influenza virus
QRLESVFAG

SEQ ID NO: 453540 - protein, 9 aa, Influenza virus
QRLNPMHQL

SEQ ID NO: 453541 - protein, 9 aa, Influenza virus
QRLNTMHQL

SEQ ID NO: 453542 - protein, 9 aa, Influenza virus
QRRRFIQNA

SEQ ID NO: 453543 - protein, 9 aa, Influenza virus
QRRRFVQNA

SEQ ID NO: 453544 - protein, 9 aa, Influenza virus
QRSKFLLMD

SEQ ID NO: 453545 - protein, 9 aa, Influenza virus
QRSWMKIYW

SEQ ID NO: 453546 - protein, 9 aa, Influenza virus
QRSWMKLYW

SEQ ID NO: 453547 - protein, 9 aa, Influenza virus
QRTIGKKKH

SEQ ID NO: 453548 - protein, 9 aa, Influenza virus
QRTIGKKKQ

SEQ ID NO: 453549 - protein, 9 aa, Influenza virus
QRTIGKRKQ

SEQ ID NO: 453550 - protein, 9 aa, Influenza virus
QRTMGKKKQ

SEQ ID NO: 453551 - protein, 9 aa, Influenza virus
QRTRALVRS

SEQ ID NO: 453552 - protein, 9 aa, Influenza virus
QRTRALVRT

SEQ ID NO: 453553 - protein, 9 aa, Influenza virus
QRTVGKKKQ

SEQ ID NO: 453554 - protein, 9 aa, Influenza virus
QRWSYIVER

SEQ ID NO: 453555 - protein, 9 aa, Influenza virus
QSAIDQITG

SEQ ID NO: 453556 - protein, 9 aa, Influenza virus
QSAIDQITR

SEQ ID NO: 453557 - protein, 9 aa, Influenza virus
QSAIDQVTG

SEQ ID NO: 453558 - protein, 9 aa, Influenza virus
QSAINQITG

SEQ ID NO: 453559 - protein, 9 aa, Influenza virus
QSAVDQITG

SEQ ID NO: 453560 - protein, 9 aa, Influenza virus
QSCFYVELI

SEQ ID NO: 453561 - protein, 9 aa, Influenza virus
QSDAQIDES

SEQ ID NO: 453562 - protein, 9 aa, Influenza virus
QSDKPFQNV

SEQ ID NO: 453563 - protein, 9 aa, Influenza virus
QSEFNKACE

SEQ ID NO: 453564 - protein, 9 aa, Influenza virus
QSEIGGINT

SEQ ID NO: 453565 - protein, 9 aa, Influenza virus
QSEIGGIST

SEQ ID NO: 453566 - protein, 9 aa, Influenza virus
QSEIGWINT

SEQ ID NO: 453567 - protein, 9 aa, Influenza virus
QSERGEDTI

SEQ ID NO: 453568 - protein, 9 aa, Influenza virus
QSERGEETI

SEQ ID NO: 453569 - protein, 9 aa, Influenza virus
QSERGEETV

SEQ ID NO: 453570 - protein, 9 aa, Influenza virus
QSFPQTTNT

SEQ ID NO: 453571 - protein, 9 aa, Influenza virus
QSFSPSPGA

SEQ ID NO: 453572 - protein, 9 aa, Influenza virus
QSFSPSPGD

SEQ ID NO: 453573 - protein, 9 aa, Influenza virus
QSFTPSPGA

SEQ ID NO: 453574 - protein, 9 aa, Influenza virus
QSFTPSPGT

SEQ ID NO: 453575 - protein, 9 aa, Influenza virus
QSFVPSPGA

SEQ ID NO: 453576 - protein, 9 aa, Influenza virus
QSFVPSPGS

SEQ ID NO: 453577 - protein, 9 aa, Influenza virus
QSFVPSPGV

SEQ ID NO: 453578 - protein, 9 aa, Influenza virus
QSFYRSINW

SEQ ID NO: 453579 - protein, 9 aa, Influenza virus
QSGHIEECS

SEQ ID NO: 453580 - protein, 9 aa, Influenza virus
QSGLPVGGN

SEQ ID NO: 453581 - protein, 9 aa, Influenza virus
QSGRIDFHW

SEQ ID NO: 453582 - protein, 9 aa, Influenza virus
QSGRIDFYW

SEQ ID NO: 453583 - protein, 9 aa, Influenza virus
QSGRIEFHW

SEQ ID NO: 453584 - protein, 9 aa, Influenza virus
QSGRINFHW

SEQ ID NO: 453585 - protein, 9 aa, Influenza virus
QSGRISFYW

SEQ ID NO: 453586 - protein, 9 aa, Influenza virus
QSGRISIYW

SEQ ID NO: 453587 - protein, 9 aa, Influenza virus
QSGRIVFHW

SEQ ID NO: 453588 - protein, 9 aa, Influenza virus
QSGRVSFYW

SEQ ID NO: 453589 - protein, 9 aa, Influenza virus
QSKGLFGAI

SEQ ID NO: 453590 - protein, 9 aa, Influenza virus
QSKMQFSSL

SEQ ID NO: 453591 - protein, 9 aa, Influenza virus
QSLIIAARN

SEQ ID NO: 453592 - protein, 9 aa, Influenza virus
QSLIIAARS

SEQ ID NO: 453593 - protein, 9 aa, Influenza virus
QSLPPNFPS

SEQ ID NO: 453594 - protein, 9 aa, Influenza virus
QSLPPNFSC

SEQ ID NO: 453595 - protein, 9 aa, Influenza virus
QSLPPNFSS

SEQ ID NO: 453596 - protein, 9 aa, Influenza virus
QSLQQIESI

SEQ ID NO: 453597 - protein, 9 aa, Influenza virus
QSLQQIESM

SEQ ID NO: 453598 - protein, 9 aa, Influenza virus
QSLRSILAN

SEQ ID NO: 453599 - protein, 9 aa, Influenza virus
QSLRSILAS

SEQ ID NO: 453600 - protein, 9 aa, Influenza virus
QSLSISIGS

SEQ ID NO: 453601 - protein, 9 aa, Influenza virus
QSLSISVES

SEQ ID NO: 453602 - protein, 9 aa, Influenza virus
QSLSISVGS

SEQ ID NO: 453603 - protein, 9 aa, Influenza virus
QSLVIAARN

SEQ ID NO: 453604 - protein, 9 aa, Influenza virus
QSNNSTDTV

SEQ ID NO: 453605 - protein, 9 aa, Influenza virus
QSNNSTNTV

SEQ ID NO: 453606 - protein, 9 aa, Influenza virus
QSPLGAINT

SEQ ID NO: 453607 - protein, 9 aa, Influenza virus
QSPNVYQAK

SEQ ID NO: 453608 - protein, 9 aa, Influenza virus
QSPNVYQAR

SEQ ID NO: 453609 - protein, 9 aa, Influenza virus
QSPNVYQSR

SEQ ID NO: 453610 - protein, 9 aa, Influenza virus
QSPRMFLAM

SEQ ID NO: 453611 - protein, 9 aa, Influenza virus
QSRFEAVAW

SEQ ID NO: 453612 - protein, 9 aa, Influenza virus
QSRGLFGAI

SEQ ID NO: 453613 - protein, 9 aa, Influenza virus
QSRMQFSSL

SEQ ID NO: 453614 - protein, 9 aa, Influenza virus
QSRTREILT

SEQ ID NO: 453615 - protein, 9 aa, Influenza virus
QSRTRGILT

SEQ ID NO: 453616 - protein, 9 aa, Influenza virus
QSSDDFALI

SEQ ID NO: 453617 - protein, 9 aa, Influenza virus
QSSLPLALG

SEQ ID NO: 453618 - protein, 9 aa, Influenza virus
QSSPPTVYN

SEQ ID NO: 453619 - protein, 9 aa, Influenza virus
QSTLKLATG

SEQ ID NO: 453620 - protein, 9 aa, Influenza virus
QSTNSTEAV

SEQ ID NO: 453621 - protein, 9 aa, Influenza virus
QSTNSTETV

SEQ ID NO: 453622 - protein, 9 aa, Influenza virus
QSWSCIVER

SEQ ID NO: 453623 - protein, 9 aa, Influenza virus
QSWSYIVER

SEQ ID NO: 453624 - protein, 9 aa, Influenza virus
QSWSYVVER

SEQ ID NO: 453625 - protein, 9 aa, Influenza virus
QSYFQLFLV

SEQ ID NO: 453626 - protein, 9 aa, Influenza virus
QTAAQKAMM

SEQ ID NO: 453627 - protein, 9 aa, Influenza virus
QTAAQRAMM

SEQ ID NO: 453628 - protein, 9 aa, Influenza virus
QTAAQRAMV

SEQ ID NO: 453629 - protein, 9 aa, Influenza virus
QTAIDQING

SEQ ID NO: 453630 - protein, 9 aa, Influenza virus
QTAIDQITG

SEQ ID NO: 453631 - protein, 9 aa, Influenza virus
QTALYKNAN

SEQ ID NO: 453632 - protein, 9 aa, Influenza virus
QTANTYRNT

SEQ ID NO: 453633 - protein, 9 aa, Influenza virus
QTATKRIRM

SEQ ID NO: 453634 - protein, 9 aa, Influenza virus
QTATKRLRM

SEQ ID NO: 453635 - protein, 9 aa, Influenza virus
QTDCVLEAM

SEQ ID NO: 453636 - protein, 9 aa, Influenza virus
QTDEYKNTG

SEQ ID NO: 453637 - protein, 9 aa, Influenza virus
QTDEYKNTR

SEQ ID NO: 453638 - protein, 9 aa, Influenza virus
QTDLYKVAT

SEQ ID NO: 453639 - protein, 9 aa, Influenza virus
QTEIGGINT

SEQ ID NO: 453640 - protein, 9 aa, Influenza virus
QTESRGLFG

SEQ ID NO: 453641 - protein, 9 aa, Influenza virus
QTEVGGINT

SEQ ID NO: 453642 - protein, 9 aa, Influenza virus
QTFDWTLNR

SEQ ID NO: 453643 - protein, 9 aa, Influenza virus
QTGRIDFHW

SEQ ID NO: 453644 - protein, 9 aa, Influenza virus
QTIINNYHN

SEQ ID NO: 453645 - protein, 9 aa, Influenza virus
QTIINNYYN

SEQ ID NO: 453646 - protein, 9 aa, Influenza virus
QTIVLNTDW

SEQ ID NO: 453647 - protein, 9 aa, Influenza virus
QTIVSNTDW

SEQ ID NO: 453648 - protein, 9 aa, Influenza virus
QTKKMTITF

SEQ ID NO: 453649 - protein, 9 aa, Influenza virus
QTKLYGNGN

SEQ ID NO: 453650 - protein, 9 aa, Influenza virus
QTKLYGSGN

SEQ ID NO: 453651 - protein, 9 aa, Influenza virus
QTKLYGSGS

SEQ ID NO: 453652 - protein, 9 aa, Influenza virus
QTKLYKNTN

SEQ ID NO: 453653 - protein, 9 aa, Influenza virus
QTKRSFELK

SEQ ID NO: 453654 - protein, 9 aa, Influenza virus
QTKTMTITF

SEQ ID NO: 453655 - protein, 9 aa, Influenza virus
QTLRIRSNE

SEQ ID NO: 453656 - protein, 9 aa, Influenza virus
QTLRIRSNG

SEQ ID NO: 453657 - protein, 9 aa, Influenza virus
QTLRVKSNG

SEQ ID NO: 453658 - protein, 9 aa, Influenza virus
QTLRVRSDG

SEQ ID NO: 453659 - protein, 9 aa, Influenza virus
QTLRVRSNG

SEQ ID NO: 453660 - protein, 9 aa, Influenza virus
QTLVANNDW

SEQ ID NO: 453661 - protein, 9 aa, Influenza virus
QTLVSNDDW

SEQ ID NO: 453662 - protein, 9 aa, Influenza virus
QTLVSNNDW

SEQ ID NO: 453663 - protein, 9 aa, Influenza virus
QTLVSNSDW

SEQ ID NO: 453664 - protein, 9 aa, Influenza virus
QTMELVEAE

SEQ ID NO: 453665 - protein, 9 aa, Influenza virus
QTMELVETE

SEQ ID NO: 453666 - protein, 9 aa, Influenza virus
QTMELVETK

SEQ ID NO: 453667 - protein, 9 aa, Influenza virus
QTNGNLIAP

SEQ ID NO: 453668 - protein, 9 aa, Influenza virus
QTNNSTDTV

SEQ ID NO: 453669 - protein, 9 aa, Influenza virus
QTNNSTETV

SEQ ID NO: 453670 - protein, 9 aa, Influenza virus
QTPIGAINS

SEQ ID NO: 453671 - protein, 9 aa, Influenza virus
QTPLGAINS

SEQ ID NO: 453672 - protein, 9 aa, Influenza virus
QTPLGAINT

SEQ ID NO: 453673 - protein, 9 aa, Influenza virus
QTPLGALNT

SEQ ID NO: 453674 - protein, 9 aa, Influenza virus
QTPMGAINS

SEQ ID NO: 453675 - protein, 9 aa, Influenza virus
QTPMGAVNS

SEQ ID NO: 453676 - protein, 9 aa, Influenza virus
QTPVGAINS

SEQ ID NO: 453677 - protein, 9 aa, Influenza virus
QTRGIFGAI

SEQ ID NO: 453678 - protein, 9 aa, Influenza virus
QTRGLFGAI

SEQ ID NO: 453679 - protein, 9 aa, Influenza virus
QTRRAFELK

SEQ ID NO: 453680 - protein, 9 aa, Influenza virus
QTRRSFEIK

SEQ ID NO: 453681 - protein, 9 aa, Influenza virus
QTRRSFELK

SEQ ID NO: 453682 - protein, 9 aa, Influenza virus
QTRRSFELR

SEQ ID NO: 453683 - protein, 9 aa, Influenza virus
QTRVDKLTQ

SEQ ID NO: 453684 - protein, 9 aa, Influenza virus
QTRVDRLTQ

SEQ ID NO: 453685 - protein, 9 aa, Influenza virus
QTSGNLIAP

SEQ ID NO: 453686 - protein, 9 aa, Influenza virus
QTSIVPNIG

SEQ ID NO: 453687 - protein, 9 aa, Influenza virus
QTSLLLATG

SEQ ID NO: 453688 - protein, 9 aa, Influenza virus
QTSVGGIDT

SEQ ID NO: 453689 - protein, 9 aa, Influenza virus
QTSVGGINT

SEQ ID NO: 453690 - protein, 9 aa, Influenza virus
QTSVIPNIG

SEQ ID NO: 453691 - protein, 9 aa, Influenza virus
QTSVVPDIG

SEQ ID NO: 453692 - protein, 9 aa, Influenza virus
QTSVVPNID

SEQ ID NO: 453693 - protein, 9 aa, Influenza virus
QTSVVPNIG

SEQ ID NO: 453694 - protein, 9 aa, Influenza virus
QTTLYKNAN

SEQ ID NO: 453695 - protein, 9 aa, Influenza virus
QTTNTYRNT

SEQ ID NO: 453696 - protein, 9 aa, Influenza virus
QTVINNYYN

SEQ ID NO: 453697 - protein, 9 aa, Influenza virus
QTVKIKTNG

SEQ ID NO: 453698 - protein, 9 aa, Influenza virus
QTVKIQTNG

SEQ ID NO: 453699 - protein, 9 aa, Influenza virus
QTVKIQTSG

SEQ ID NO: 453700 - protein, 9 aa, Influenza virus
QTVVLNTDW

SEQ ID NO: 453701 - protein, 9 aa, Influenza virus
QTYAGAINS

SEQ ID NO: 453702 - protein, 9 aa, Influenza virus
QTYAGAVNS

SEQ ID NO: 453703 - protein, 9 aa, Influenza virus
QTYDWTLNR

SEQ ID NO: 453704 - protein, 9 aa, Influenza virus
QTYQKRMGV

SEQ ID NO: 453705 - protein, 9 aa, Influenza virus
QTYRNNRKE

SEQ ID NO: 453706 - protein, 9 aa, Influenza virus
QTYRNTRKE

SEQ ID NO: 453707 - protein, 9 aa, Influenza virus
QTYTGAINS

SEQ ID NO: 453708 - protein, 9 aa, Influenza virus
QVAGSSEQA

SEQ ID NO: 453709 - protein, 9 aa, Influenza virus
QVCAAWSSS

SEQ ID NO: 453710 - protein, 9 aa, Influenza virus
QVCIAWSSA

SEQ ID NO: 453711 - protein, 9 aa, Influenza virus
QVCIAWSSS

SEQ ID NO: 453712 - protein, 9 aa, Influenza virus
QVCMAWSSS

SEQ ID NO: 453713 - protein, 9 aa, Influenza virus
QVCVAWSSS

SEQ ID NO: 453714 - protein, 9 aa, Influenza virus
QVDCFIWHI

SEQ ID NO: 453715 - protein, 9 aa, Influenza virus
QVDCFLWHI

SEQ ID NO: 453716 - protein, 9 aa, Influenza virus
QVDCFLWHV

SEQ ID NO: 453717 - protein, 9 aa, Influenza virus
QVDCFLWYV

SEQ ID NO: 453718 - protein, 9 aa, Influenza virus
QVDCYLWHI

SEQ ID NO: 453719 - protein, 9 aa, Influenza virus
QVDGQSGRI

SEQ ID NO: 453720 - protein, 9 aa, Influenza virus
QVDTIMEKI

SEQ ID NO: 453721 - protein, 9 aa, Influenza virus
QVDTIMEKN

SEQ ID NO: 453722 - protein, 9 aa, Influenza virus
QVDTIMERN

SEQ ID NO: 453723 - protein, 9 aa, Influenza virus
QVDTIVEKN

SEQ ID NO: 453724 - protein, 9 aa, Influenza virus
QVECVCRDN

SEQ ID NO: 453725 - protein, 9 aa, Influenza virus
QVEELVHGG

SEQ ID NO: 453726 - protein, 9 aa, Influenza virus
QVEELVHGQ

SEQ ID NO: 453727 - protein, 9 aa, Influenza virus
QVEELVHRG

SEQ ID NO: 453728 - protein, 9 aa, Influenza virus
QVEGRIQDL

SEQ ID NO: 453729 - protein, 9 aa, Influenza virus
QVEGRIQYL

SEQ ID NO: 453730 - protein, 9 aa, Influenza virus
QVEGRTQDL

SEQ ID NO: 453731 - protein, 9 aa, Influenza virus
QVEKRINMI

SEQ ID NO: 453732 - protein, 9 aa, Influenza virus
QVEKRINML

SEQ ID NO: 453733 - protein, 9 aa, Influenza virus
QVENRINML

SEQ ID NO: 453734 - protein, 9 aa, Influenza virus
QVEQRINML

SEQ ID NO: 453735 - protein, 9 aa, Influenza virus
QVERRINML

SEQ ID NO: 453736 - protein, 9 aa, Influenza virus
QVESMIEAE

SEQ ID NO: 453737 - protein, 9 aa, Influenza virus
QVEVTNATE

SEQ ID NO: 453738 - protein, 9 aa, Influenza virus
QVFPQLNQT

SEQ ID NO: 453739 - protein, 9 aa, Influenza virus
QVIKLLPFA

SEQ ID NO: 453740 - protein, 9 aa, Influenza virus
QVIVDNNNW

SEQ ID NO: 453741 - protein, 9 aa, Influenza virus
QVIVDNNSW

SEQ ID NO: 453742 - protein, 9 aa, Influenza virus
QVIVDNSNW

SEQ ID NO: 453743 - protein, 9 aa, Influenza virus
QVIVTREPY

SEQ ID NO: 453744 - protein, 9 aa, Influenza virus
QVKIRRRVD

SEQ ID NO: 453745 - protein, 9 aa, Influenza virus
QVKLSSGYK

SEQ ID NO: 453746 - protein, 9 aa, Influenza virus
QVLAIYATV

SEQ ID NO: 453747 - protein, 9 aa, Influenza virus
QVLRESGGI

SEQ ID NO: 453748 - protein, 9 aa, Influenza virus
QVMVDNNNW

SEQ ID NO: 453749 - protein, 9 aa, Influenza virus
QVNGQFGRI

SEQ ID NO: 453750 - protein, 9 aa, Influenza virus
QVNGQSGRI

SEQ ID NO: 453751 - protein, 9 aa, Influenza virus
QVNGQSGRV

SEQ ID NO: 453752 - protein, 9 aa, Influenza virus
QVNGQTGRI

SEQ ID NO: 453753 - protein, 9 aa, Influenza virus
QVQDRGLFG

SEQ ID NO: 453754 - protein, 9 aa, Influenza virus
QVQNRGLFG

SEQ ID NO: 453755 - protein, 9 aa, Influenza virus
QVREGRNPG

SEQ ID NO: 453756 - protein, 9 aa, Influenza virus
QVRESRNPG

SEQ ID NO: 453757 - protein, 9 aa, Influenza virus
QVTDIWAYN

SEQ ID NO: 453758 - protein, 9 aa, Influenza virus
QVTGKLNRL

SEQ ID NO: 453759 - protein, 9 aa, Influenza virus
QWDWPDGAK

SEQ ID NO: 453760 - protein, 9 aa, Influenza virus
QWNWPDGAE

SEQ ID NO: 453761 - protein, 9 aa, Influenza virus
QWNWPDGAK

SEQ ID NO: 453762 - protein, 9 aa, Influenza virus
QYICSPVLT

SEQ ID NO: 453763 - protein, 9 aa, Influenza virus
QYLCTGILT

SEQ ID NO: 453764 - protein, 9 aa, Influenza virus
QYLCTGVLT

SEQ ID NO: 453765 - protein, 9 aa, Influenza virus
QYLEKYVED

SEQ ID NO: 453766 - protein, 9 aa, Influenza virus
QYLLFQDIL

SEQ ID NO: 453767 - protein, 9 aa, Influenza virus
QYPNVRCVC

SEQ ID NO: 453768 - protein, 9 aa, Influenza virus
QYRAESLQN

SEQ ID NO: 453769 - protein, 9 aa, Influenza virus
QYRALISWP

SEQ ID NO: 453770 - protein, 9 aa, Influenza virus
QYRALVSWP

SEQ ID NO: 453771 - protein, 9 aa, Influenza virus
QYREEALLN

SEQ ID NO: 453772 - protein, 9 aa, Influenza virus
QYREESLLN

SEQ ID NO: 453773 - protein, 9 aa, Influenza virus
QYRSLISWP

SEQ ID NO: 453774 - protein, 9 aa, Influenza virus
QYRTESLQN

SEQ ID NO: 453775 - protein, 9 aa, Influenza virus
QYRTGSLQN

SEQ ID NO: 453776 - protein, 9 aa, Influenza virus
QYSGFVRTL

SEQ ID NO: 453777 - protein, 9 aa, Influenza virus
RAAFRGLIS

SEQ ID NO: 453778 - protein, 9 aa, Influenza virus
RAAVSADPL

SEQ ID NO: 453779 - protein, 9 aa, Influenza virus
RACFYVELI

SEQ ID NO: 453780 - protein, 9 aa, Influenza virus
RADEICIGY

SEQ ID NO: 453781 - protein, 9 aa, Influenza virus
RADKICIGY

SEQ ID NO: 453782 - protein, 9 aa, Influenza virus
RADTKILFI

SEQ ID NO: 453783 - protein, 9 aa, Influenza virus
RADTRILFI

SEQ ID NO: 453784 - protein, 9 aa, Influenza virus
RAESLQNRI

SEQ ID NO: 453785 - protein, 9 aa, Influenza virus
RAGYEMLKV

SEQ ID NO: 453786 - protein, 9 aa, Influenza virus
RAGYETFKV

SEQ ID NO: 453787 - protein, 9 aa, Influenza virus
RAGYETFRV

SEQ ID NO: 453788 - protein, 9 aa, Influenza virus
RAIATPGMQ

SEQ ID NO: 453789 - protein, 9 aa, Influenza virus
RAIDGVTNK

SEQ ID NO: 453790 - protein, 9 aa, Influenza virus
RAIDNMQNK

SEQ ID NO: 453791 - protein, 9 aa, Influenza virus
RAIVSADPL

SEQ ID NO: 453792 - protein, 9 aa, Influenza virus
RALISWEMG

SEQ ID NO: 453793 - protein, 9 aa, Influenza virus
RALISWGMG

SEQ ID NO: 453794 - protein, 9 aa, Influenza virus
RALISWPLS

SEQ ID NO: 453795 - protein, 9 aa, Influenza virus
RALISWPQS

SEQ ID NO: 453796 - protein, 9 aa, Influenza virus
RALMSCPIG

SEQ ID NO: 453797 - protein, 9 aa, Influenza virus
RALMSCPLG

SEQ ID NO: 453798 - protein, 9 aa, Influenza virus
RALMSCPVG

SEQ ID NO: 453799 - protein, 9 aa, Influenza virus
RALMSVPLG

SEQ ID NO: 453800 - protein, 9 aa, Influenza virus
RALMSVPMG

SEQ ID NO: 453801 - protein, 9 aa, Influenza virus
RALSIYSCI

SEQ ID NO: 453802 - protein, 9 aa, Influenza virus
RALTLNTMT

SEQ ID NO: 453803 - protein, 9 aa, Influenza virus
RALVRGQQG

SEQ ID NO: 453804 - protein, 9 aa, Influenza virus
RALVRSGMD

SEQ ID NO: 453805 - protein, 9 aa, Influenza virus
RALVRTGMD

SEQ ID NO: 453806 - protein, 9 aa, Influenza virus
RALVSWEMG

SEQ ID NO: 453807 - protein, 9 aa, Influenza virus
RALVSWPLS

SEQ ID NO: 453808 - protein, 9 aa, Influenza virus
RAMMDQVRE

SEQ ID NO: 453809 - protein, 9 aa, Influenza virus
RAMVDQVRE

SEQ ID NO: 453810 - protein, 9 aa, Influenza virus
RANQRLNPM

SEQ ID NO: 453811 - protein, 9 aa, Influenza virus
RANQRLNTM

SEQ ID NO: 453812 - protein, 9 aa, Influenza virus
RAPISLGDC

SEQ ID NO: 453813 - protein, 9 aa, Influenza virus
RAPYRSLIR

SEQ ID NO: 453814 - protein, 9 aa, Influenza virus
RARIDARID

SEQ ID NO: 453815 - protein, 9 aa, Influenza virus
RARIDARVD

SEQ ID NO: 453816 - protein, 9 aa, Influenza virus
RARIKTRLF

SEQ ID NO: 453817 - protein, 9 aa, Influenza virus
RARPQVNGQ

SEQ ID NO: 453818 - protein, 9 aa, Influenza virus
RATAIFRKA

SEQ ID NO: 453819 - protein, 9 aa, Influenza virus
RATAIIRKA

SEQ ID NO: 453820 - protein, 9 aa, Influenza virus
RATAILKKA

SEQ ID NO: 453821 - protein, 9 aa, Influenza virus
RATAILRKA

SEQ ID NO: 453822 - protein, 9 aa, Influenza virus
RATEYIMKG

SEQ ID NO: 453823 - protein, 9 aa, Influenza virus
RATEYMMKG

SEQ ID NO: 453824 - protein, 9 aa, Influenza virus
RATFLRSNA

SEQ ID NO: 453825 - protein, 9 aa, Influenza virus
RATVSADPL

SEQ ID NO: 453826 - protein, 9 aa, Influenza virus
RAVDGTIAG

SEQ ID NO: 453827 - protein, 9 aa, Influenza virus
RAVGKCPRY

SEQ ID NO: 453828 - protein, 9 aa, Influenza virus
RAVKLYKKL

SEQ ID NO: 453829 - protein, 9 aa, Influenza virus
RAVKLYRKL

SEQ ID NO: 453830 - protein, 9 aa, Influenza virus
RAWLHVCVT

SEQ ID NO: 453831 - protein, 9 aa, Influenza virus
RAYVDGFEP

SEQ ID NO: 453832 - protein, 9 aa, Influenza virus
RAYVDGFKP

SEQ ID NO: 453833 - protein, 9 aa, Influenza virus
RCCNLFEKF

SEQ ID NO: 453834 - protein, 9 aa, Influenza virus
RCDDQCMES

SEQ ID NO: 453835 - protein, 9 aa, Influenza virus
RCFYVELIR

SEQ ID NO: 453836 - protein, 9 aa, Influenza virus
RCFYVELVR

SEQ ID NO: 453837 - protein, 9 aa, Influenza virus
RCHKGDTQI

SEQ ID NO: 453838 - protein, 9 aa, Influenza virus
RCHRGDAQI

SEQ ID NO: 453839 - protein, 9 aa, Influenza virus
RCHRGDMQI

SEQ ID NO: 453840 - protein, 9 aa, Influenza virus
RCHRGDTHI

SEQ ID NO: 453841 - protein, 9 aa, Influenza virus
RCHRGDTQI

SEQ ID NO: 453842 - protein, 9 aa, Influenza virus
RCICEKLEQ

SEQ ID NO: 453843 - protein, 9 aa, Influenza virus
RCICRDNWK

SEQ ID NO: 453844 - protein, 9 aa, Influenza virus
RCINRCFYV

SEQ ID NO: 453845 - protein, 9 aa, Influenza virus
RCLLQSLQQ

SEQ ID NO: 453846 - protein, 9 aa, Influenza virus
RCMKTFFGW

SEQ ID NO: 453847 - protein, 9 aa, Influenza virus
RCNTKCQTS

SEQ ID NO: 453848 - protein, 9 aa, Influenza virus
RCNTRCQTS

SEQ ID NO: 453849 - protein, 9 aa, Influenza virus
RCPRYVKQS

SEQ ID NO: 453850 - protein, 9 aa, Influenza virus
RCQSEIGGI

SEQ ID NO: 453851 - protein, 9 aa, Influenza virus
RCQTPLGAI

SEQ ID NO: 453852 - protein, 9 aa, Influenza virus
RCQTSVGGI

SEQ ID NO: 453853 - protein, 9 aa, Influenza virus
RCQYSGFVR

SEQ ID NO: 453854 - protein, 9 aa, Influenza virus
RCRETRGLF

SEQ ID NO: 453855 - protein, 9 aa, Influenza virus
RCRKTRGLF

SEQ ID NO: 453856 - protein, 9 aa, Influenza virus
RCTCRDNWK

SEQ ID NO: 453857 - protein, 9 aa, Influenza virus
RCTISLVKT

SEQ ID NO: 453858 - protein, 9 aa, Influenza virus
RCVCRDNWK

SEQ ID NO: 453859 - protein, 9 aa, Influenza virus
RCVCRDNWM

SEQ ID NO: 453860 - protein, 9 aa, Influenza virus
RCVCRDNWR

SEQ ID NO: 453861 - protein, 9 aa, Influenza virus
RCYQFALGQ

SEQ ID NO: 453862 - protein, 9 aa, Influenza virus
RDAMTEIWS

SEQ ID NO: 453863 - protein, 9 aa, Influenza virus
RDAMTEVWS

SEQ ID NO: 453864 - protein, 9 aa, Influenza virus
RDCKIEAVI

SEQ ID NO: 453865 - protein, 9 aa, Influenza virus
RDCKVEAVI

SEQ ID NO: 453866 - protein, 9 aa, Influenza virus
RDCSIAGWL

SEQ ID NO: 453867 - protein, 9 aa, Influenza virus
RDCSVAGWL

SEQ ID NO: 453868 - protein, 9 aa, Influenza virus
RDEAINNRF

SEQ ID NO: 453869 - protein, 9 aa, Influenza virus
RDEAINNRI

SEQ ID NO: 453870 - protein, 9 aa, Influenza virus
RDEAINSRF

SEQ ID NO: 453871 - protein, 9 aa, Influenza virus
RDEAISNRF

SEQ ID NO: 453872 - protein, 9 aa, Influenza virus
RDEALNNRF

SEQ ID NO: 453873 - protein, 9 aa, Influenza virus
RDEALNNRS

SEQ ID NO: 453874 - protein, 9 aa, Influenza virus
RDEAVNNRF

SEQ ID NO: 453875 - protein, 9 aa, Influenza virus
RDEEGTGIA

SEQ ID NO: 453876 - protein, 9 aa, Influenza virus
RDEGNGCFT

SEQ ID NO: 453877 - protein, 9 aa, Influenza virus
RDILGTFDT

SEQ ID NO: 453878 - protein, 9 aa, Influenza virus
RDILRTQES

SEQ ID NO: 453879 - protein, 9 aa, Influenza virus
RDITIGSIC

SEQ ID NO: 453880 - protein, 9 aa, Influenza virus
RDLGNCHPI

SEQ ID NO: 453881 - protein, 9 aa, Influenza virus
RDNAKDEGN

SEQ ID NO: 453882 - protein, 9 aa, Influenza virus
RDNAKDLGN

SEQ ID NO: 453883 - protein, 9 aa, Influenza virus
RDNAKEIGN

SEQ ID NO: 453884 - protein, 9 aa, Influenza virus
RDNAKELGN

SEQ ID NO: 453885 - protein, 9 aa, Influenza virus
RDNAMILGN

SEQ ID NO: 453886 - protein, 9 aa, Influenza virus
RDNANDLGN

SEQ ID NO: 453887 - protein, 9 aa, Influenza virus
RDNLEPGTF

SEQ ID NO: 453888 - protein, 9 aa, Influenza virus
RDNVKELGN

SEQ ID NO: 453889 - protein, 9 aa, Influenza virus
RDNWHASNR

SEQ ID NO: 453890 - protein, 9 aa, Influenza virus
RDNWHGSNR

SEQ ID NO: 453891 - protein, 9 aa, Influenza virus
RDNWKGANR

SEQ ID NO: 453892 - protein, 9 aa, Influenza virus
RDNWKGSNR

SEQ ID NO: 453893 - protein, 9 aa, Influenza virus
RDNWMGSNR

SEQ ID NO: 453894 - protein, 9 aa, Influenza virus
RDNWNGMNR

SEQ ID NO: 453895 - protein, 9 aa, Influenza virus
RDNWQGANR

SEQ ID NO: 453896 - protein, 9 aa, Influenza virus
RDNWQGSNR

SEQ ID NO: 453897 - protein, 9 aa, Influenza virus
RDNWRGANR

SEQ ID NO: 453898 - protein, 9 aa, Influenza virus
RDNWRGSNR

SEQ ID NO: 453899 - protein, 9 aa, Influenza virus
RDNWTGTNR

SEQ ID NO: 453900 - protein, 9 aa, Influenza virus
RDQGWSYIV

SEQ ID NO: 453901 - protein, 9 aa, Influenza virus
RDQKALKGR

SEQ ID NO: 453902 - protein, 9 aa, Influenza virus
RDQKSLKGR

SEQ ID NO: 453903 - protein, 9 aa, Influenza virus
RDQKSLRGR

SEQ ID NO: 453904 - protein, 9 aa, Influenza virus
RDQMAHCRM

SEQ ID NO: 453905 - protein, 9 aa, Influenza virus
RDQRALKGR

SEQ ID NO: 453906 - protein, 9 aa, Influenza virus
RDQRSLRGR

SEQ ID NO: 453907 - protein, 9 aa, Influenza virus
RDRTPYRSL

SEQ ID NO: 453908 - protein, 9 aa, Influenza virus
RDSIKSWRN

SEQ ID NO: 453909 - protein, 9 aa, Influenza virus
RDSITEVWS

SEQ ID NO: 453910 - protein, 9 aa, Influenza virus
RDSLEPGTF

SEQ ID NO: 453911 - protein, 9 aa, Influenza virus
RDSLTEIWS

SEQ ID NO: 453912 - protein, 9 aa, Influenza virus
RDSMTEIWS

SEQ ID NO: 453913 - protein, 9 aa, Influenza virus
RDSMTEVMV

SEQ ID NO: 453914 - protein, 9 aa, Influenza virus
RDSMTEVWS

SEQ ID NO: 453915 - protein, 9 aa, Influenza virus
RDSRSGYET

SEQ ID NO: 453916 - protein, 9 aa, Influenza virus
RDSSILTDS

SEQ ID NO: 453917 - protein, 9 aa, Influenza virus
RDSTQKAID

SEQ ID NO: 453918 - protein, 9 aa, Influenza virus
RDSTQMAID

SEQ ID NO: 453919 - protein, 9 aa, Influenza virus
RDSTQRAID

SEQ ID NO: 453920 - protein, 9 aa, Influenza virus
RDSVTELWS

SEQ ID NO: 453921 - protein, 9 aa, Influenza virus
RDVIGTFDT

SEQ ID NO: 453922 - protein, 9 aa, Influenza virus
RDVLGTFDT

SEQ ID NO: 453923 - protein, 9 aa, Influenza virus
RDVLVIWGI

SEQ ID NO: 453924 - protein, 9 aa, Influenza virus
RDVLVLWGI

SEQ ID NO: 453925 - protein, 9 aa, Influenza virus
RDVLVMWGI

SEQ ID NO: 453926 - protein, 9 aa, Influenza virus
RDVLVMWGL

SEQ ID NO: 453927 - protein, 9 aa, Influenza virus
RDVWTYNAE

SEQ ID NO: 453928 - protein, 9 aa, Influenza virus
RDWSKPQCQ

SEQ ID NO: 453929 - protein, 9 aa, Influenza virus
RDYFTAEVS

SEQ ID NO: 453930 - protein, 9 aa, Influenza virus
RECFNPCFY

SEQ ID NO: 453931 - protein, 9 aa, Influenza virus
REDKRYGPA

SEQ ID NO: 453932 - protein, 9 aa, Influenza virus
REEALLNRI

SEQ ID NO: 453933 - protein, 9 aa, Influenza virus
REEALLNRL

SEQ ID NO: 453934 - protein, 9 aa, Influenza virus
REEAMQNRI

SEQ ID NO: 453935 - protein, 9 aa, Influenza virus
REEAMQNRM

SEQ ID NO: 453936 - protein, 9 aa, Influenza virus
REEAMQNRV

SEQ ID NO: 453937 - protein, 9 aa, Influenza virus
REESLLNRL

SEQ ID NO: 453938 - protein, 9 aa, Influenza virus
REESQLKKQ

SEQ ID NO: 453939 - protein, 9 aa, Influenza virus
REESQLKRQ

SEQ ID NO: 453940 - protein, 9 aa, Influenza virus
REEVTNATE

SEQ ID NO: 453941 - protein, 9 aa, Influenza virus
REFEVMNHE

SEQ ID NO: 453942 - protein, 9 aa, Influenza virus
REFEVVDHE

SEQ ID NO: 453943 - protein, 9 aa, Influenza virus
REFEVVNHE

SEQ ID NO: 453944 - protein, 9 aa, Influenza virus
REFGVVNHE

SEQ ID NO: 453945 - protein, 9 aa, Influenza virus
REGKHIVER

SEQ ID NO: 453946 - protein, 9 aa, Influenza virus
REGLILEYY

SEQ ID NO: 453947 - protein, 9 aa, Influenza virus
REGRNPGNA

SEQ ID NO: 453948 - protein, 9 aa, Influenza virus
REGRRKTNL

SEQ ID NO: 453949 - protein, 9 aa, Influenza virus
REGYSLVGI

SEQ ID NO: 453950 - protein, 9 aa, Influenza virus
REHLSSVSS

SEQ ID NO: 453951 - protein, 9 aa, Influenza virus
REICIAWSS

SEQ ID NO: 453952 - protein, 9 aa, Influenza virus
REIHIYYLE

SEQ ID NO: 453953 - protein, 9 aa, Influenza virus
REILTKITV

SEQ ID NO: 453954 - protein, 9 aa, Influenza virus
REILTKTTV

SEQ ID NO: 453955 - protein, 9 aa, Influenza virus
REILTRTTV

SEQ ID NO: 453956 - protein, 9 aa, Influenza virus
REITFHGAK

SEQ ID NO: 453957 - protein, 9 aa, Influenza virus
REKDMTKEF

SEQ ID NO: 453958 - protein, 9 aa, Influenza virus
RELCTINSW

SEQ ID NO: 453959 - protein, 9 aa, Influenza virus
RELGNGCFE

SEQ ID NO: 453960 - protein, 9 aa, Influenza virus
RELVRKTRF

SEQ ID NO: 453961 - protein, 9 aa, Influenza virus
RELWQCYYL

SEQ ID NO: 453962 - protein, 9 aa, Influenza virus
REMTFHGAK

SEQ ID NO: 453963 - protein, 9 aa, Influenza virus
RENAEDIGN

SEQ ID NO: 453964 - protein, 9 aa, Influenza virus
RENAEDKGN

SEQ ID NO: 453965 - protein, 9 aa, Influenza virus
RENAEDLGN

SEQ ID NO: 453966 - protein, 9 aa, Influenza virus
RENAEDMGD

SEQ ID NO: 453967 - protein, 9 aa, Influenza virus
RENAEDMGG

SEQ ID NO: 453968 - protein, 9 aa, Influenza virus
RENAEDMGN

SEQ ID NO: 453969 - protein, 9 aa, Influenza virus
RENAEDQGN

SEQ ID NO: 453970 - protein, 9 aa, Influenza virus
RENAEDRGN

SEQ ID NO: 453971 - protein, 9 aa, Influenza virus
RENAEEDCT

SEQ ID NO: 453972 - protein, 9 aa, Influenza virus
RENAEEDGN

SEQ ID NO: 453973 - protein, 9 aa, Influenza virus
RENAEEDGT

SEQ ID NO: 453974 - protein, 9 aa, Influenza virus
REPFISCSH

SEQ ID NO: 453975 - protein, 9 aa, Influenza virus
REPFISCSI

SEQ ID NO: 453976 - protein, 9 aa, Influenza virus
REPFISCSP

SEQ ID NO: 453977 - protein, 9 aa, Influenza virus
REPFISCSQ

SEQ ID NO: 453978 - protein, 9 aa, Influenza virus
REPFISCSV

SEQ ID NO: 453979 - protein, 9 aa, Influenza virus
REPFVACGP

SEQ ID NO: 453980 - protein, 9 aa, Influenza virus
REPFVACSP

SEQ ID NO: 453981 - protein, 9 aa, Influenza virus
REPFVSCGP

SEQ ID NO: 453982 - protein, 9 aa, Influenza virus
REPFVSCSH

SEQ ID NO: 453983 - protein, 9 aa, Influenza virus
REPFVSCSI

SEQ ID NO: 453984 - protein, 9 aa, Influenza virus
REPFVSCSP

SEQ ID NO: 453985 - protein, 9 aa, Influenza virus
REPYISCDN

SEQ ID NO: 453986 - protein, 9 aa, Influenza virus
REPYLSCDP

SEQ ID NO: 453987 - protein, 9 aa, Influenza virus
REPYLSCGP

SEQ ID NO: 453988 - protein, 9 aa, Influenza virus
REPYVSCDN

SEQ ID NO: 453989 - protein, 9 aa, Influenza virus
REPYVSCDP

SEQ ID NO: 453990 - protein, 9 aa, Influenza virus
REPYVSCDS

SEQ ID NO: 453991 - protein, 9 aa, Influenza virus
REPYVSCDT

SEQ ID NO: 453992 - protein, 9 aa, Influenza virus
REPYVSCDY

SEQ ID NO: 453993 - protein, 9 aa, Influenza virus
REPYVSCEP

SEQ ID NO: 453994 - protein, 9 aa, Influenza virus
REPYVSCGP

SEQ ID NO: 453995 - protein, 9 aa, Influenza virus
REPYVSCNP

SEQ ID NO: 453996 - protein, 9 aa, Influenza virus
REPYVSCSL

SEQ ID NO: 453997 - protein, 9 aa, Influenza virus
REPYVSCSP

SEQ ID NO: 453998 - protein, 9 aa, Influenza virus
REQKQEFKM

SEQ ID NO: 453999 - protein, 9 aa, Influenza virus
REQLSQKFE

SEQ ID NO: 454000 - protein, 9 aa, Influenza virus
REQLSSVSS

SEQ ID NO: 454001 - protein, 9 aa, Influenza virus
REQLSTVSS

SEQ ID NO: 454002 - protein, 9 aa, Influenza virus
REQQGRMDY

SEQ ID NO: 454003 - protein, 9 aa, Influenza virus
REREGGRRR

SEQ ID NO: 454004 - protein, 9 aa, Influenza virus
RERLGSWSW

SEQ ID NO: 454005 - protein, 9 aa, Influenza virus
RESGGIDKE

SEQ ID NO: 454006 - protein, 9 aa, Influenza virus
RESRNPGNA

SEQ ID NO: 454007 - protein, 9 aa, Influenza virus
RETRGLFGA

SEQ ID NO: 454008 - protein, 9 aa, Influenza virus
REVCIAWSS

SEQ ID NO: 454009 - protein, 9 aa, Influenza virus
REVEVVNAT

SEQ ID NO: 454010 - protein, 9 aa, Influenza virus
REVHIYYLE

SEQ ID NO: 454011 - protein, 9 aa, Influenza virus
REVHMYYLE

SEQ ID NO: 454012 - protein, 9 aa, Influenza virus
REVHTYYLE

SEQ ID NO: 454013 - protein, 9 aa, Influenza virus
REVHVYYLE

SEQ ID NO: 454014 - protein, 9 aa, Influenza virus
REWSYIVER

SEQ ID NO: 454015 - protein, 9 aa, Influenza virus
REWSYLIED

SEQ ID NO: 454016 - protein, 9 aa, Influenza virus
RFADQELGD

SEQ ID NO: 454017 - protein, 9 aa, Influenza virus
RFEAVAWSA

SEQ ID NO: 454018 - protein, 9 aa, Influenza virus
RFEFIAEEF

SEQ ID NO: 454019 - protein, 9 aa, Influenza virus
RFEGWIVGN

SEQ ID NO: 454020 - protein, 9 aa, Influenza virus
RFEIIEGRD

SEQ ID NO: 454021 - protein, 9 aa, Influenza virus
RFESVAWSA

SEQ ID NO: 454022 - protein, 9 aa, Influenza virus
RFGEGEQII

SEQ ID NO: 454023 - protein, 9 aa, Influenza virus
RFGESEQII

SEQ ID NO: 454024 - protein, 9 aa, Influenza virus
RFGESEQIV

SEQ ID NO: 454025 - protein, 9 aa, Influenza virus
RFGESEQVI

SEQ ID NO: 454026 - protein, 9 aa, Influenza virus
RFIEIGVTR

SEQ ID NO: 454027 - protein, 9 aa, Influenza virus
RFIEKTNQQ

SEQ ID NO: 454028 - protein, 9 aa, Influenza virus
RFIQNALNG

SEQ ID NO: 454029 - protein, 9 aa, Influenza virus
RFLEIGVTR

SEQ ID NO: 454030 - protein, 9 aa, Influenza virus
RFLFSSIKK

SEQ ID NO: 454031 - protein, 9 aa, Influenza virus
RFLPDLYDY

SEQ ID NO: 454032 - protein, 9 aa, Influenza virus
RFLPVAGGT

SEQ ID NO: 454033 - protein, 9 aa, Influenza virus
RFLPVSGGT

SEQ ID NO: 454034 - protein, 9 aa, Influenza virus
RFLPVTGGT

SEQ ID NO: 454035 - protein, 9 aa, Influenza virus
RFLRVKDQQ

SEQ ID NO: 454036 - protein, 9 aa, Influenza virus
RFLRVRDQL

SEQ ID NO: 454037 - protein, 9 aa, Influenza virus
RFLRVRDQM

SEQ ID NO: 454038 - protein, 9 aa, Influenza virus
RFLRVRDQQ

SEQ ID NO: 454039 - protein, 9 aa, Influenza virus
RFLRVRDQR

SEQ ID NO: 454040 - protein, 9 aa, Influenza virus
RFNSDLDYQ

SEQ ID NO: 454041 - protein, 9 aa, Influenza virus
RFNSDPDYQ

SEQ ID NO: 454042 - protein, 9 aa, Influenza virus
RFNSNLDYQ

SEQ ID NO: 454043 - protein, 9 aa, Influenza virus
RFQIQGIKL

SEQ ID NO: 454044 - protein, 9 aa, Influenza virus
RFQIQGVKL

SEQ ID NO: 454045 - protein, 9 aa, Influenza virus
RFQIQGVRL

SEQ ID NO: 454046 - protein, 9 aa, Influenza virus
RFRRPDSSW

SEQ ID NO: 454047 - protein, 9 aa, Influenza virus
RFSYVFCLA

SEQ ID NO: 454048 - protein, 9 aa, Influenza virus
RFTEIGVTR

SEQ ID NO: 454049 - protein, 9 aa, Influenza virus
RFTNEEALR

SEQ ID NO: 454050 - protein, 9 aa, Influenza virus
RFTYSGIRT

SEQ ID NO: 454051 - protein, 9 aa, Influenza virus
RFVEIGVTR

SEQ ID NO: 454052 - protein, 9 aa, Influenza virus
RFVFSIAAS

SEQ ID NO: 454053 - protein, 9 aa, Influenza virus
RFVFSNAAS

SEQ ID NO: 454054 - protein, 9 aa, Influenza virus
RFVFSSAAS

SEQ ID NO: 454055 - protein, 9 aa, Influenza virus
RFVNSDCSK

SEQ ID NO: 454056 - protein, 9 aa, Influenza virus
RFVQNALNG

SEQ ID NO: 454057 - protein, 9 aa, Influenza virus
RFVQNALSG

SEQ ID NO: 454058 - protein, 9 aa, Influenza virus
RFYALSQGT

SEQ ID NO: 454059 - protein, 9 aa, Influenza virus
RFYIQMCTE

SEQ ID NO: 454060 - protein, 9 aa, Influenza virus
RFYRICKLV

SEQ ID NO: 454061 - protein, 9 aa, Influenza virus
RFYRTCKLL

SEQ ID NO: 454062 - protein, 9 aa, Influenza virus
RFYRTCKLV

SEQ ID NO: 454063 - protein, 9 aa, Influenza virus
RFYVQMCTE

SEQ ID NO: 454064 - protein, 9 aa, Influenza virus
RGANRPVIT

SEQ ID NO: 454065 - protein, 9 aa, Influenza virus
RGAYERMCN

SEQ ID NO: 454066 - protein, 9 aa, Influenza virus
RGCFEIYHK

SEQ ID NO: 454067 - protein, 9 aa, Influenza virus
RGDKICLGH

SEQ ID NO: 454068 - protein, 9 aa, Influenza virus
RGDLNFVNR

SEQ ID NO: 454069 - protein, 9 aa, Influenza virus
RGDNGRRTR

SEQ ID NO: 454070 - protein, 9 aa, Influenza virus
RGDQICIGY

SEQ ID NO: 454071 - protein, 9 aa, Influenza virus
RGDQICVGY

SEQ ID NO: 454072 - protein, 9 aa, Influenza virus
RGDYNNTTG

SEQ ID NO: 454073 - protein, 9 aa, Influenza virus
RGEDTIEER

SEQ ID NO: 454074 - protein, 9 aa, Influenza virus
RGEETIEEK

SEQ ID NO: 454075 - protein, 9 aa, Influenza virus
RGEETIEER

SEQ ID NO: 454076 - protein, 9 aa, Influenza virus
RGEETVEER

SEQ ID NO: 454077 - protein, 9 aa, Influenza virus
RGEFNQVEK

SEQ ID NO: 454078 - protein, 9 aa, Influenza virus
RGEFNQVEN

SEQ ID NO: 454079 - protein, 9 aa, Influenza virus
RGEFNQVEQ

SEQ ID NO: 454080 - protein, 9 aa, Influenza virus
RGEFSQVEQ

SEQ ID NO: 454081 - protein, 9 aa, Influenza virus
RGEFSQVER

SEQ ID NO: 454082 - protein, 9 aa, Influenza virus
RGENGRKTR

SEQ ID NO: 454083 - protein, 9 aa, Influenza virus
RGENGRRTR

SEQ ID NO: 454084 - protein, 9 aa, Influenza virus
RGETLKIRT

SEQ ID NO: 454085 - protein, 9 aa, Influenza virus
RGETTGRNC

SEQ ID NO: 454086 - protein, 9 aa, Influenza virus
RGEVFVIRE

SEQ ID NO: 454087 - protein, 9 aa, Influenza virus
RGFAPFSKD

SEQ ID NO: 454088 - protein, 9 aa, Influenza virus
RGFEMVWDA

SEQ ID NO: 454089 - protein, 9 aa, Influenza virus
RGFFGAIAG

SEQ ID NO: 454090 - protein, 9 aa, Influenza virus
RGFFPFHKD

SEQ ID NO: 454091 - protein, 9 aa, Influenza virus
RGFLIIGKE

SEQ ID NO: 454092 - protein, 9 aa, Influenza virus
RGFLILGKE

SEQ ID NO: 454093 - protein, 9 aa, Influenza virus
RGFLILGRE

SEQ ID NO: 454094 - protein, 9 aa, Influenza virus
RGFVHFVEA

SEQ ID NO: 454095 - protein, 9 aa, Influenza virus
RGFVYFVEA

SEQ ID NO: 454096 - protein, 9 aa, Influenza virus
RGFVYFVEI

SEQ ID NO: 454097 - protein, 9 aa, Influenza virus
RGFVYFVET

SEQ ID NO: 454098 - protein, 9 aa, Influenza virus
RGGRNSFFS

SEQ ID NO: 454099 - protein, 9 aa, Influenza virus
RGGSGIMKT

SEQ ID NO: 454100 - protein, 9 aa, Influenza virus
RGGSINTKL

SEQ ID NO: 454101 - protein, 9 aa, Influenza virus
RGGSINTRL

SEQ ID NO: 454102 - protein, 9 aa, Influenza virus
RGHIFVIRE

SEQ ID NO: 454103 - protein, 9 aa, Influenza virus
RGHVFVIRE

SEQ ID NO: 454104 - protein, 9 aa, Influenza virus
RGHYKISKS

SEQ ID NO: 454105 - protein, 9 aa, Influenza virus
RGIEVVNAT

SEQ ID NO: 454106 - protein, 9 aa, Influenza virus
RGIFGAIAG

SEQ ID NO: 454107 - protein, 9 aa, Influenza virus
RGILEDEQM

SEQ ID NO: 454108 - protein, 9 aa, Influenza virus
RGINDRNFW

SEQ ID NO: 454109 - protein, 9 aa, Influenza virus
RGIPPLELG

SEQ ID NO: 454110 - protein, 9 aa, Influenza virus
RGIQIASNE

SEQ ID NO: 454111 - protein, 9 aa, Influenza virus
RGKHSNGTI

SEQ ID NO: 454112 - protein, 9 aa, Influenza virus
RGKLKRRAI

SEQ ID NO: 454113 - protein, 9 aa, Influenza virus
RGLCTINSW

SEQ ID NO: 454114 - protein, 9 aa, Influenza virus
RGLFGAIAG

SEQ ID NO: 454115 - protein, 9 aa, Influenza virus
RGLFGAKAG

SEQ ID NO: 454116 - protein, 9 aa, Influenza virus
RGLISTHLG

SEQ ID NO: 454117 - protein, 9 aa, Influenza virus
RGLISTPLG

SEQ ID NO: 454118 - protein, 9 aa, Influenza virus
RGLISTQLG

SEQ ID NO: 454119 - protein, 9 aa, Influenza virus
RGLLEVGTR

SEQ ID NO: 454120 - protein, 9 aa, Influenza virus
RGLLGAIAG

SEQ ID NO: 454121 - protein, 9 aa, Influenza virus
RGLLSTPLG

SEQ ID NO: 454122 - protein, 9 aa, Influenza virus
RGLMSTPLG

SEQ ID NO: 454123 - protein, 9 aa, Influenza virus
RGLQRRRFI

SEQ ID NO: 454124 - protein, 9 aa, Influenza virus
RGLQRRRFV

SEQ ID NO: 454125 - protein, 9 aa, Influenza virus
RGLSSRISF

SEQ ID NO: 454126 - protein, 9 aa, Influenza virus
RGLWDPFRQ

SEQ ID NO: 454127 - protein, 9 aa, Influenza virus
RGLWDSFRQ

SEQ ID NO: 454128 - protein, 9 aa, Influenza virus
RGNGCFEIF

SEQ ID NO: 454129 - protein, 9 aa, Influenza virus
RGNILLSPE

SEQ ID NO: 454130 - protein, 9 aa, Influenza virus
RGNIRCNIC

SEQ ID NO: 454131 - protein, 9 aa, Influenza virus
RGNPGVKGW

SEQ ID NO: 454132 - protein, 9 aa, Influenza virus
RGNQGVKGW

SEQ ID NO: 454133 - protein, 9 aa, Influenza virus
RGNSGIMKT

SEQ ID NO: 454134 - protein, 9 aa, Influenza virus
RGNSPAFNY

SEQ ID NO: 454135 - protein, 9 aa, Influenza virus
RGNSPIFNY

SEQ ID NO: 454136 - protein, 9 aa, Influenza virus
RGNSPVFNY

SEQ ID NO: 454137 - protein, 9 aa, Influenza virus
RGNVLLSPE

SEQ ID NO: 454138 - protein, 9 aa, Influenza virus
RGQAADLKS

SEQ ID NO: 454139 - protein, 9 aa, Influenza virus
RGQHANGTI

SEQ ID NO: 454140 - protein, 9 aa, Influenza virus
RGQPKEKAI

SEQ ID NO: 454141 - protein, 9 aa, Influenza virus
RGQPKEKTI

SEQ ID NO: 454142 - protein, 9 aa, Influenza virus
RGQPKERTI

SEQ ID NO: 454143 - protein, 9 aa, Influenza virus
RGQQGRMDY

SEQ ID NO: 454144 - protein, 9 aa, Influenza virus
RGQQGTMDY

SEQ ID NO: 454145 - protein, 9 aa, Influenza virus
RGQQGWMDY

SEQ ID NO: 454146 - protein, 9 aa, Influenza virus
RGQSGRISF

SEQ ID NO: 454147 - protein, 9 aa, Influenza virus
RGQSGRVSF

SEQ ID NO: 454148 - protein, 9 aa, Influenza virus
RGQYSGFVR

SEQ ID NO: 454149 - protein, 9 aa, Influenza virus
RGRGSTLGL

SEQ ID NO: 454150 - protein, 9 aa, Influenza virus
RGRGVFELS

SEQ ID NO: 454151 - protein, 9 aa, Influenza virus
RGRHANGTI

SEQ ID NO: 454152 - protein, 9 aa, Influenza virus
RGRHANGTM

SEQ ID NO: 454153 - protein, 9 aa, Influenza virus
RGRHSNGTI

SEQ ID NO: 454154 - protein, 9 aa, Influenza virus
RGRIDYFWS

SEQ ID NO: 454155 - protein, 9 aa, Influenza virus
RGRIDYYWS

SEQ ID NO: 454156 - protein, 9 aa, Influenza virus
RGRIFQSRI

SEQ ID NO: 454157 - protein, 9 aa, Influenza virus
RGRLCNPLN

SEQ ID NO: 454158 - protein, 9 aa, Influenza virus
RGRPEEAKY

SEQ ID NO: 454159 - protein, 9 aa, Influenza virus
RGRPEEVKY

SEQ ID NO: 454160 - protein, 9 aa, Influenza virus
RGRPKEDEV

SEQ ID NO: 454161 - protein, 9 aa, Influenza virus
RGRPKEDKV

SEQ ID NO: 454162 - protein, 9 aa, Influenza virus
RGRPKEDRV

SEQ ID NO: 454163 - protein, 9 aa, Influenza virus
RGRPKEEKV

SEQ ID NO: 454164 - protein, 9 aa, Influenza virus
RGSARHIEE

SEQ ID NO: 454165 - protein, 9 aa, Influenza virus
RGSFYRSMR

SEQ ID NO: 454166 - protein, 9 aa, Influenza virus
RGSGGIDKE

SEQ ID NO: 454167 - protein, 9 aa, Influenza virus
RGSGLRILI

SEQ ID NO: 454168 - protein, 9 aa, Influenza virus
RGSGLRILV

SEQ ID NO: 454169 - protein, 9 aa, Influenza virus
RGSGMRILI

SEQ ID NO: 454170 - protein, 9 aa, Influenza virus
RGSGMRILV

SEQ ID NO: 454171 - protein, 9 aa, Influenza virus
RGSIAHKSC

SEQ ID NO: 454172 - protein, 9 aa, Influenza virus
RGSNRPIVD

SEQ ID NO: 454173 - protein, 9 aa, Influenza virus
RGSNRPWIR

SEQ ID NO: 454174 - protein, 9 aa, Influenza virus
RGSPGVKGW

SEQ ID NO: 454175 - protein, 9 aa, Influenza virus
RGSSGIMKT

SEQ ID NO: 454176 - protein, 9 aa, Influenza virus
RGSSGIVKT

SEQ ID NO: 454177 - protein, 9 aa, Influenza virus
RGSSGVMKT

SEQ ID NO: 454178 - protein, 9 aa, Influenza virus
RGSTLGLDI

SEQ ID NO: 454179 - protein, 9 aa, Influenza virus
RGSTQKAID

SEQ ID NO: 454180 - protein, 9 aa, Influenza virus
RGSVAHKSC

SEQ ID NO: 454181 - protein, 9 aa, Influenza virus
RGSYNNTSG

SEQ ID NO: 454182 - protein, 9 aa, Influenza virus
RGTGMRILV

SEQ ID NO: 454183 - protein, 9 aa, Influenza virus
RGTNSFYRN

SEQ ID NO: 454184 - protein, 9 aa, Influenza virus
RGTQGVKGW

SEQ ID NO: 454185 - protein, 9 aa, Influenza virus
RGVEVVDAT

SEQ ID NO: 454186 - protein, 9 aa, Influenza virus
RGVEVVNAT

SEQ ID NO: 454187 - protein, 9 aa, Influenza virus
RGVFEFSDE

SEQ ID NO: 454188 - protein, 9 aa, Influenza virus
RGVFELSDE

SEQ ID NO: 454189 - protein, 9 aa, Influenza virus
RGVKGFGFK

SEQ ID NO: 454190 - protein, 9 aa, Influenza virus
RGVLEDEQM

SEQ ID NO: 454191 - protein, 9 aa, Influenza virus
RGVNDRNFW

SEQ ID NO: 454192 - protein, 9 aa, Influenza virus
RGVQIASNE

SEQ ID NO: 454193 - protein, 9 aa, Influenza virus
RGVQVASNE

SEQ ID NO: 454194 - protein, 9 aa, Influenza virus
RGWAPLSKD

SEQ ID NO: 454195 - protein, 9 aa, Influenza virus
RGYKMNIQI

SEQ ID NO: 454196 - protein, 9 aa, Influenza virus
RGYKMNNQI

SEQ ID NO: 454197 - protein, 9 aa, Influenza virus
RGYKMNTKI

SEQ ID NO: 454198 - protein, 9 aa, Influenza virus
RGYKMNTQI

SEQ ID NO: 454199 - protein, 9 aa, Influenza virus
RGYKMNTRI

SEQ ID NO: 454200 - protein, 9 aa, Influenza virus
RGYPGVKGW

SEQ ID NO: 454201 - protein, 9 aa, Influenza virus
RHANGTIHD

SEQ ID NO: 454202 - protein, 9 aa, Influenza virus
RHANGTIND

SEQ ID NO: 454203 - protein, 9 aa, Influenza virus
RHANGTMHD

SEQ ID NO: 454204 - protein, 9 aa, Influenza virus
RHCSKYHWN

SEQ ID NO: 454205 - protein, 9 aa, Influenza virus
RHENRMVIA

SEQ ID NO: 454206 - protein, 9 aa, Influenza virus
RHENRMVLA

SEQ ID NO: 454207 - protein, 9 aa, Influenza virus
RHFEKVKIL

SEQ ID NO: 454208 - protein, 9 aa, Influenza virus
RHFQKDAKI

SEQ ID NO: 454209 - protein, 9 aa, Influenza virus
RHFQKDAKM

SEQ ID NO: 454210 - protein, 9 aa, Influenza virus
RHFQKDAKV

SEQ ID NO: 454211 - protein, 9 aa, Influenza virus
RHFQKDARV

SEQ ID NO: 454212 - protein, 9 aa, Influenza virus
RHFQKNAKV

SEQ ID NO: 454213 - protein, 9 aa, Influenza virus
RHHMGECPK

SEQ ID NO: 454214 - protein, 9 aa, Influenza virus
RHHNSEGTG

SEQ ID NO: 454215 - protein, 9 aa, Influenza virus
RHIEECPCY

SEQ ID NO: 454216 - protein, 9 aa, Influenza virus
RHIEECSCY

SEQ ID NO: 454217 - protein, 9 aa, Influenza virus
RHIEEWSCY

SEQ ID NO: 454218 - protein, 9 aa, Influenza virus
RHLEECSCY

SEQ ID NO: 454219 - protein, 9 aa, Influenza virus
RHLFSGIKS

SEQ ID NO: 454220 - protein, 9 aa, Influenza virus
RHLFSGIRS

SEQ ID NO: 454221 - protein, 9 aa, Influenza virus
RHLFSGVNS

SEQ ID NO: 454222 - protein, 9 aa, Influenza virus
RHQLRENAE

SEQ ID NO: 454223 - protein, 9 aa, Influenza virus
RHQNAEGTG

SEQ ID NO: 454224 - protein, 9 aa, Influenza virus
RHQNAQGEG

SEQ ID NO: 454225 - protein, 9 aa, Influenza virus
RHQNAQGIG

SEQ ID NO: 454226 - protein, 9 aa, Influenza virus
RHQNAQGQG

SEQ ID NO: 454227 - protein, 9 aa, Influenza virus
RHQNAQGTG

SEQ ID NO: 454228 - protein, 9 aa, Influenza virus
RHQNSEGIG

SEQ ID NO: 454229 - protein, 9 aa, Influenza virus
RHQNSEGMG

SEQ ID NO: 454230 - protein, 9 aa, Influenza virus
RHQNSEGRG

SEQ ID NO: 454231 - protein, 9 aa, Influenza virus
RHQNSEGTG

SEQ ID NO: 454232 - protein, 9 aa, Influenza virus
RHQNSQGEG

SEQ ID NO: 454233 - protein, 9 aa, Influenza virus
RHRLKITEN

SEQ ID NO: 454234 - protein, 9 aa, Influenza virus
RHSNEQGSG

SEQ ID NO: 454235 - protein, 9 aa, Influenza virus
RHSNGTIHD

SEQ ID NO: 454236 - protein, 9 aa, Influenza virus
RHSNGTVKD

SEQ ID NO: 454237 - protein, 9 aa, Influenza virus
RHYIGKCPK

SEQ ID NO: 454238 - protein, 9 aa, Influenza virus
RHYMGECPE

SEQ ID NO: 454239 - protein, 9 aa, Influenza virus
RHYMGECPK

SEQ ID NO: 454240 - protein, 9 aa, Influenza virus
RHYMGECPN

SEQ ID NO: 454241 - protein, 9 aa, Influenza virus
RIAIGNCPK

SEQ ID NO: 454242 - protein, 9 aa, Influenza virus
RIAWSSSSC

SEQ ID NO: 454243 - protein, 9 aa, Influenza virus
RIAYERMCN

SEQ ID NO: 454244 - protein, 9 aa, Influenza virus
RICEKLEQS

SEQ ID NO: 454245 - protein, 9 aa, Influenza virus
RICIDFRDM

SEQ ID NO: 454246 - protein, 9 aa, Influenza virus
RICIGYHAN

SEQ ID NO: 454247 - protein, 9 aa, Influenza virus
RICIGYLST

SEQ ID NO: 454248 - protein, 9 aa, Influenza virus
RICIGYQSN

SEQ ID NO: 454249 - protein, 9 aa, Influenza virus
RICILDQNF

SEQ ID NO: 454250 - protein, 9 aa, Influenza virus
RICKLVGIN

SEQ ID NO: 454251 - protein, 9 aa, Influenza virus
RICLGHHAV

SEQ ID NO: 454252 - protein, 9 aa, Influenza virus
RICVGYHAN

SEQ ID NO: 454253 - protein, 9 aa, Influenza virus
RICVGYLST

SEQ ID NO: 454254 - protein, 9 aa, Influenza virus
RIDARIDFE

SEQ ID NO: 454255 - protein, 9 aa, Influenza virus
RIDARVDFE

SEQ ID NO: 454256 - protein, 9 aa, Influenza virus
RIDDAVTDI

SEQ ID NO: 454257 - protein, 9 aa, Influenza virus
RIDDAVTDV

SEQ ID NO: 454258 - protein, 9 aa, Influenza virus
RIDFESGRI

SEQ ID NO: 454259 - protein, 9 aa, Influenza virus
RIDFESGRM

SEQ ID NO: 454260 - protein, 9 aa, Influenza virus
RIDFESGRV

SEQ ID NO: 454261 - protein, 9 aa, Influenza virus
RIDFHWLFL

SEQ ID NO: 454262 - protein, 9 aa, Influenza virus
RIDFHWLIL

SEQ ID NO: 454263 - protein, 9 aa, Influenza virus
RIDFHWLLL

SEQ ID NO: 454264 - protein, 9 aa, Influenza virus
RIDFHWLML

SEQ ID NO: 454265 - protein, 9 aa, Influenza virus
RIDFHWMLL

SEQ ID NO: 454266 - protein, 9 aa, Influenza virus
RIDFNWLLL

SEQ ID NO: 454267 - protein, 9 aa, Influenza virus
RIDYFWSIL

SEQ ID NO: 454268 - protein, 9 aa, Influenza virus
RIDYYWSFL

SEQ ID NO: 454269 - protein, 9 aa, Influenza virus
RIDYYWSIL

SEQ ID NO: 454270 - protein, 9 aa, Influenza virus
RIDYYWSML

SEQ ID NO: 454271 - protein, 9 aa, Influenza virus
RIDYYWSVL

SEQ ID NO: 454272 - protein, 9 aa, Influenza virus
RIECIGWSS

SEQ ID NO: 454273 - protein, 9 aa, Influenza virus
RIENLNKKI

SEQ ID NO: 454274 - protein, 9 aa, Influenza virus
RIENLNKKM

SEQ ID NO: 454275 - protein, 9 aa, Influenza virus
RIENLNKKV

SEQ ID NO: 454276 - protein, 9 aa, Influenza virus
RIENLNRKM

SEQ ID NO: 454277 - protein, 9 aa, Influenza virus
RIENLNRKV

SEQ ID NO: 454278 - protein, 9 aa, Influenza virus
RIESLNKKM

SEQ ID NO: 454279 - protein, 9 aa, Influenza virus
RIFLAMITY

SEQ ID NO: 454280 - protein, 9 aa, Influenza virus
RIFQPNIGP

SEQ ID NO: 454281 - protein, 9 aa, Influenza virus
RIFQSGIRM

SEQ ID NO: 454282 - protein, 9 aa, Influenza virus
RIFQSGVRL

SEQ ID NO: 454283 - protein, 9 aa, Influenza virus
RIFQSGVRM

SEQ ID NO: 454284 - protein, 9 aa, Influenza virus
RIFQSGVRV

SEQ ID NO: 454285 - protein, 9 aa, Influenza virus
RIFQSRIRM

SEQ ID NO: 454286 - protein, 9 aa, Influenza virus
RIFRPNIGP

SEQ ID NO: 454287 - protein, 9 aa, Influenza virus
RIGDGQRSW

SEQ ID NO: 454288 - protein, 9 aa, Influenza virus
RIGEDAHIL

SEQ ID NO: 454289 - protein, 9 aa, Influenza virus
RIGEDAHVL

SEQ ID NO: 454290 - protein, 9 aa, Influenza virus
RIGEDSDIL

SEQ ID NO: 454291 - protein, 9 aa, Influenza virus
RIGEDSDVL

SEQ ID NO: 454292 - protein, 9 aa, Influenza virus
RIGEEAHIL

SEQ ID NO: 454293 - protein, 9 aa, Influenza virus
RIGEGAHIL

SEQ ID NO: 454294 - protein, 9 aa, Influenza virus
RIGEGQRSW

SEQ ID NO: 454295 - protein, 9 aa, Influenza virus
RIGENAHIL

SEQ ID NO: 454296 - protein, 9 aa, Influenza virus
RIGENSDVL

SEQ ID NO: 454297 - protein, 9 aa, Influenza virus
RIGENSGVL

SEQ ID NO: 454298 - protein, 9 aa, Influenza virus
RIGGNSDVL

SEQ ID NO: 454299 - protein, 9 aa, Influenza virus
RIGSCTSPC

SEQ ID NO: 454300 - protein, 9 aa, Influenza virus
RIGSKGDIF

SEQ ID NO: 454301 - protein, 9 aa, Influenza virus
RIGSKGDVF

SEQ ID NO: 454302 - protein, 9 aa, Influenza virus
RIGSKGHVF

SEQ ID NO: 454303 - protein, 9 aa, Influenza virus
RIGSRGDVF

SEQ ID NO: 454304 - protein, 9 aa, Influenza virus
RIGSRGEVF

SEQ ID NO: 454305 - protein, 9 aa, Influenza virus
RIGSRGHIF

SEQ ID NO: 454306 - protein, 9 aa, Influenza virus
RIGSRGHVF

SEQ ID NO: 454307 - protein, 9 aa, Influenza virus
RIIEKTNQQ

SEQ ID NO: 454308 - protein, 9 aa, Influenza virus
RIIQNEDIP

SEQ ID NO: 454309 - protein, 9 aa, Influenza virus
RIITSESQL

SEQ ID NO: 454310 - protein, 9 aa, Influenza virus
RIKINPVTL

SEQ ID NO: 454311 - protein, 9 aa, Influenza virus
RIKTRLFTI

SEQ ID NO: 454312 - protein, 9 aa, Influenza virus
RILASESQL

SEQ ID NO: 454313 - protein, 9 aa, Influenza virus
RILCTSATA

SEQ ID NO: 454314 - protein, 9 aa, Influenza virus
RILEEESDE

SEQ ID NO: 454315 - protein, 9 aa, Influenza virus
RILFIEEGK

SEQ ID NO: 454316 - protein, 9 aa, Influenza virus
RILFIKEGK

SEQ ID NO: 454317 - protein, 9 aa, Influenza virus
RILFIREGK

SEQ ID NO: 454318 - protein, 9 aa, Influenza virus
RILFVKEGK

SEQ ID NO: 454319 - protein, 9 aa, Influenza virus
RILIRGNSP

SEQ ID NO: 454320 - protein, 9 aa, Influenza virus
RILKENAID

SEQ ID NO: 454321 - protein, 9 aa, Influenza virus
RILKENALD

SEQ ID NO: 454322 - protein, 9 aa, Influenza virus
RILRTQESE

SEQ ID NO: 454323 - protein, 9 aa, Influenza virus
RILSIYSTV

SEQ ID NO: 454324 - protein, 9 aa, Influenza virus
RILTDTSRP

SEQ ID NO: 454325 - protein, 9 aa, Influenza virus
RILTSESQL

SEQ ID NO: 454326 - protein, 9 aa, Influenza virus
RILTSESQM

SEQ ID NO: 454327 - protein, 9 aa, Influenza virus
RILVRGNSP

SEQ ID NO: 454328 - protein, 9 aa, Influenza virus
RIMFESNGG

SEQ ID NO: 454329 - protein, 9 aa, Influenza virus
RIMINPVKL

SEQ ID NO: 454330 - protein, 9 aa, Influenza virus
RINGVKLEE

SEQ ID NO: 454331 - protein, 9 aa, Influenza virus
RINMIADRV

SEQ ID NO: 454332 - protein, 9 aa, Influenza virus
RINMINDKI

SEQ ID NO: 454333 - protein, 9 aa, Influenza virus
RINMINSKI

SEQ ID NO: 454334 - protein, 9 aa, Influenza virus
RINMINSQI

SEQ ID NO: 454335 - protein, 9 aa, Influenza virus
RINMISDKI

SEQ ID NO: 454336 - protein, 9 aa, Influenza virus
RINMLADRI

SEQ ID NO: 454337 - protein, 9 aa, Influenza virus
RINMLADRV

SEQ ID NO: 454338 - protein, 9 aa, Influenza virus
RINMLADWV

SEQ ID NO: 454339 - protein, 9 aa, Influenza virus
RINNETILE

SEQ ID NO: 454340 - protein, 9 aa, Influenza virus
RINNETIVE

SEQ ID NO: 454341 - protein, 9 aa, Influenza virus
RINRQEIEG

SEQ ID NO: 454342 - protein, 9 aa, Influenza virus
RINTINSKI

SEQ ID NO: 454343 - protein, 9 aa, Influenza virus
RINVINDKI

SEQ ID NO: 454344 - protein, 9 aa, Influenza virus
RIPHRTLLM

SEQ ID NO: 454345 - protein, 9 aa, Influenza virus
RIPNAGIDP

SEQ ID NO: 454346 - protein, 9 aa, Influenza virus
RIQDIWAYN

SEQ ID NO: 454347 - protein, 9 aa, Influenza virus
RIQDLEKYV

SEQ ID NO: 454348 - protein, 9 aa, Influenza virus
RIQDLERYV

SEQ ID NO: 454349 - protein, 9 aa, Influenza virus
RIQHLEECS

SEQ ID NO: 454350 - protein, 9 aa, Influenza virus
RIQIDPVKL

SEQ ID NO: 454351 - protein, 9 aa, Influenza virus
RIQIDQVKL

SEQ ID NO: 454352 - protein, 9 aa, Influenza virus
RIQIDSVKL

SEQ ID NO: 454353 - protein, 9 aa, Influenza virus
RIQINPVKL

SEQ ID NO: 454354 - protein, 9 aa, Influenza virus
RIRIDPVKL

SEQ ID NO: 454355 - protein, 9 aa, Influenza virus
RIRLFDYSG

SEQ ID NO: 454356 - protein, 9 aa, Influenza virus
RIRLFDYSK

SEQ ID NO: 454357 - protein, 9 aa, Influenza virus
RIRLFDYSR

SEQ ID NO: 454358 - protein, 9 aa, Influenza virus
RIRMAINLV

SEQ ID NO: 454359 - protein, 9 aa, Influenza virus
RIRMAINQC

SEQ ID NO: 454360 - protein, 9 aa, Influenza virus
RIRMAINWG

SEQ ID NO: 454361 - protein, 9 aa, Influenza virus
RIRMAINYS

SEQ ID NO: 454362 - protein, 9 aa, Influenza virus
RIRMATNEC

SEQ ID NO: 454363 - protein, 9 aa, Influenza virus
RIRNNTYDH

SEQ ID NO: 454364 - protein, 9 aa, Influenza virus
RIRRDQKSL

SEQ ID NO: 454365 - protein, 9 aa, Influenza virus
RISFYWTIV

SEQ ID NO: 454366 - protein, 9 aa, Influenza virus
RISHRTLLM

SEQ ID NO: 454367 - protein, 9 aa, Influenza virus
RISIYWTLV

SEQ ID NO: 454368 - protein, 9 aa, Influenza virus
RISKMGVDE

SEQ ID NO: 454369 - protein, 9 aa, Influenza virus
RISKRGSSG

SEQ ID NO: 454370 - protein, 9 aa, Influenza virus
RISNETILE

SEQ ID NO: 454371 - protein, 9 aa, Influenza virus
RISSSFSFG

SEQ ID NO: 454372 - protein, 9 aa, Influenza virus
RITFESNGG

SEQ ID NO: 454373 - protein, 9 aa, Influenza virus
RITFESSGG

SEQ ID NO: 454374 - protein, 9 aa, Influenza virus
RITTKINNI

SEQ ID NO: 454375 - protein, 9 aa, Influenza virus
RIWRQANNG

SEQ ID NO: 454376 - protein, 9 aa, Influenza virus
RIWSKPQCQ

SEQ ID NO: 454377 - protein, 9 aa, Influenza virus
RIYWIREGK

SEQ ID NO: 454378 - protein, 9 aa, Influenza virus
RIYWIREGR

SEQ ID NO: 454379 - protein, 9 aa, Influenza virus
RIYWIRKGR

SEQ ID NO: 454380 - protein, 9 aa, Influenza virus
RKASLRLAV

SEQ ID NO: 454381 - protein, 9 aa, Influenza virus
RKATKRLIQ

SEQ ID NO: 454382 - protein, 9 aa, Influenza virus
RKATRRLIQ

SEQ ID NO: 454383 - protein, 9 aa, Influenza virus
RKATRRLVQ

SEQ ID NO: 454384 - protein, 9 aa, Influenza virus
RKATRRMIQ

SEQ ID NO: 454385 - protein, 9 aa, Influenza virus
RKDILRTQE

SEQ ID NO: 454386 - protein, 9 aa, Influenza virus
RKEAMQNRI

SEQ ID NO: 454387 - protein, 9 aa, Influenza virus
RKEPALIVW

SEQ ID NO: 454388 - protein, 9 aa, Influenza virus
RKEYEEEAK

SEQ ID NO: 454389 - protein, 9 aa, Influenza virus
RKGLILEYY

SEQ ID NO: 454390 - protein, 9 aa, Influenza virus
RKILRKSGG

SEQ ID NO: 454391 - protein, 9 aa, Influenza virus
RKKILRTQE

SEQ ID NO: 454392 - protein, 9 aa, Influenza virus
RKKRGLFGA

SEQ ID NO: 454393 - protein, 9 aa, Influenza virus
RKLKREITF

SEQ ID NO: 454394 - protein, 9 aa, Influenza virus
RKLLLIAQA

SEQ ID NO: 454395 - protein, 9 aa, Influenza virus
RKLLLITQA

SEQ ID NO: 454396 - protein, 9 aa, Influenza virus
RKLLLIVQA

SEQ ID NO: 454397 - protein, 9 aa, Influenza virus
RKLLLVVQA

SEQ ID NO: 454398 - protein, 9 aa, Influenza virus
RKMEDGFLD

SEQ ID NO: 454399 - protein, 9 aa, Influenza virus
RKMLLIVQA

SEQ ID NO: 454400 - protein, 9 aa, Influenza virus
RKMMTNSQD

SEQ ID NO: 454401 - protein, 9 aa, Influenza virus
RKMMTSSQD

SEQ ID NO: 454402 - protein, 9 aa, Influenza virus
RKQILRTQE

SEQ ID NO: 454403 - protein, 9 aa, Influenza virus
RKQLRENAE

SEQ ID NO: 454404 - protein, 9 aa, Influenza virus
RKQLRQNAE

SEQ ID NO: 454405 - protein, 9 aa, Influenza virus
RKRDSSILT

SEQ ID NO: 454406 - protein, 9 aa, Influenza virus
RKRFADQEL

SEQ ID NO: 454407 - protein, 9 aa, Influenza virus
RKRGLFGAI

SEQ ID NO: 454408 - protein, 9 aa, Influenza virus
RKRKRKTRG

SEQ ID NO: 454409 - protein, 9 aa, Influenza virus
RKRKTRGLF

SEQ ID NO: 454410 - protein, 9 aa, Influenza virus
RKRMTRGLF

SEQ ID NO: 454411 - protein, 9 aa, Influenza virus
RKRNSSILT

SEQ ID NO: 454412 - protein, 9 aa, Influenza virus
RKRRIRDNM

SEQ ID NO: 454413 - protein, 9 aa, Influenza virus
RKRRVRDNI

SEQ ID NO: 454414 - protein, 9 aa, Influenza virus
RKRRVRDNM

SEQ ID NO: 454415 - protein, 9 aa, Influenza virus
RKRRVRDNV

SEQ ID NO: 454416 - protein, 9 aa, Influenza virus
RKRRVRDSM

SEQ ID NO: 454417 - protein, 9 aa, Influenza virus
RKSGGIGKE

SEQ ID NO: 454418 - protein, 9 aa, Influenza virus
RKTNLYGFI

SEQ ID NO: 454419 - protein, 9 aa, Influenza virus
RKTRFLPVA

SEQ ID NO: 454420 - protein, 9 aa, Influenza virus
RKTRFLPVS

SEQ ID NO: 454421 - protein, 9 aa, Influenza virus
RKTRFLPVT

SEQ ID NO: 454422 - protein, 9 aa, Influenza virus
RKTRGLFGA

SEQ ID NO: 454423 - protein, 9 aa, Influenza virus
RKVDDGFLD

SEQ ID NO: 454424 - protein, 9 aa, Influenza virus
RLAAAGDIW

SEQ ID NO: 454425 - protein, 9 aa, Influenza virus
RLAAGGDIW

SEQ ID NO: 454426 - protein, 9 aa, Influenza virus
RLAIGLRNT

SEQ ID NO: 454427 - protein, 9 aa, Influenza virus
RLAKCNTKC

SEQ ID NO: 454428 - protein, 9 aa, Influenza virus
RLALGLRNT

SEQ ID NO: 454429 - protein, 9 aa, Influenza virus
RLATGLRNI

SEQ ID NO: 454430 - protein, 9 aa, Influenza virus
RLATGLRNV

SEQ ID NO: 454431 - protein, 9 aa, Influenza virus
RLATGMRNI

SEQ ID NO: 454432 - protein, 9 aa, Influenza virus
RLAVGLRNT

SEQ ID NO: 454433 - protein, 9 aa, Influenza virus
RLCNPLNPF

SEQ ID NO: 454434 - protein, 9 aa, Influenza virus
RLCTINSWH

SEQ ID NO: 454435 - protein, 9 aa, Influenza virus
RLCYPGELD

SEQ ID NO: 454436 - protein, 9 aa, Influenza virus
RLEDVFAGK

SEQ ID NO: 454437 - protein, 9 aa, Influenza virus
RLEENTTYK

SEQ ID NO: 454438 - protein, 9 aa, Influenza virus
RLEGVFAGK

SEQ ID NO: 454439 - protein, 9 aa, Influenza virus
RLENLDKKM

SEQ ID NO: 454440 - protein, 9 aa, Influenza virus
RLENLNKKM

SEQ ID NO: 454441 - protein, 9 aa, Influenza virus
RLENLNKKV

SEQ ID NO: 454442 - protein, 9 aa, Influenza virus
RLENLNKRM

SEQ ID NO: 454443 - protein, 9 aa, Influenza virus
RLENVFAGK

SEQ ID NO: 454444 - protein, 9 aa, Influenza virus
RLESVFAGK

SEQ ID NO: 454445 - protein, 9 aa, Influenza virus
RLFDYSGWN

SEQ ID NO: 454446 - protein, 9 aa, Influenza virus
RLFDYSKWN

SEQ ID NO: 454447 - protein, 9 aa, Influenza virus
RLFDYSRWN

SEQ ID NO: 454448 - protein, 9 aa, Influenza virus
RLFERVRRQ

SEQ ID NO: 454449 - protein, 9 aa, Influenza virus
RLFTIRQEL

SEQ ID NO: 454450 - protein, 9 aa, Influenza virus
RLFTIRQEM

SEQ ID NO: 454451 - protein, 9 aa, Influenza virus
RLGKGYMFE

SEQ ID NO: 454452 - protein, 9 aa, Influenza virus
RLGNLNKKM

SEQ ID NO: 454453 - protein, 9 aa, Influenza virus
RLGRGYMFE

SEQ ID NO: 454454 - protein, 9 aa, Influenza virus
RLGSSFYAE

SEQ ID NO: 454455 - protein, 9 aa, Influenza virus
RLGSWSWHD

SEQ ID NO: 454456 - protein, 9 aa, Influenza virus
RLGYETFKV

SEQ ID NO: 454457 - protein, 9 aa, Influenza virus
RLIDFLKDV

SEQ ID NO: 454458 - protein, 9 aa, Influenza virus
RLIDKTNQQ

SEQ ID NO: 454459 - protein, 9 aa, Influenza virus
RLIDRTNHQ

SEQ ID NO: 454460 - protein, 9 aa, Influenza virus
RLIEKTNDK

SEQ ID NO: 454461 - protein, 9 aa, Influenza virus
RLIEKTNEK

SEQ ID NO: 454462 - protein, 9 aa, Influenza virus
RLIEKTNKQ

SEQ ID NO: 454463 - protein, 9 aa, Influenza virus
RLIEKTNQQ

SEQ ID NO: 454464 - protein, 9 aa, Influenza virus
RLIEKTNTE

SEQ ID NO: 454465 - protein, 9 aa, Influenza virus
RLIEKTNTQ

SEQ ID NO: 454466 - protein, 9 aa, Influenza virus
RLIERTNEK

SEQ ID NO: 454467 - protein, 9 aa, Influenza virus
RLIERTNQQ

SEQ ID NO: 454468 - protein, 9 aa, Influenza virus
RLIGKTNQQ

SEQ ID NO: 454469 - protein, 9 aa, Influenza virus
RLILATGLR

SEQ ID NO: 454470 - protein, 9 aa, Influenza virus
RLIQLIVSG

SEQ ID NO: 454471 - protein, 9 aa, Influenza virus
RLIQNSITI

SEQ ID NO: 454472 - protein, 9 aa, Influenza virus
RLIQNSLTI

SEQ ID NO: 454473 - protein, 9 aa, Influenza virus
RLIQNSMTI

SEQ ID NO: 454474 - protein, 9 aa, Influenza virus
RLISKTNQQ

SEQ ID NO: 454475 - protein, 9 aa, Influenza virus
RLKITENSF

SEQ ID NO: 454476 - protein, 9 aa, Influenza virus
RLKVNGQSG

SEQ ID NO: 454477 - protein, 9 aa, Influenza virus
RLLRENAEE

SEQ ID NO: 454478 - protein, 9 aa, Influenza virus
RLLVLLEND

SEQ ID NO: 454479 - protein, 9 aa, Influenza virus
RLMDFLKDV

SEQ ID NO: 454480 - protein, 9 aa, Influenza virus
RLNINPVKL

SEQ ID NO: 454481 - protein, 9 aa, Influenza virus
RLNINPVTL

SEQ ID NO: 454482 - protein, 9 aa, Influenza virus
RLNINSVKL

SEQ ID NO: 454483 - protein, 9 aa, Influenza virus
RLNNVIDKM

SEQ ID NO: 454484 - protein, 9 aa, Influenza virus
RLNPMHQLL

SEQ ID NO: 454485 - protein, 9 aa, Influenza virus
RLNRNEIKG

SEQ ID NO: 454486 - protein, 9 aa, Influenza virus
RLNRQEIEG

SEQ ID NO: 454487 - protein, 9 aa, Influenza virus
RLNTMHQLL

SEQ ID NO: 454488 - protein, 9 aa, Influenza virus
RLNWLTKAT

SEQ ID NO: 454489 - protein, 9 aa, Influenza virus
RLNWLTKET

SEQ ID NO: 454490 - protein, 9 aa, Influenza virus
RLPFQNLSP

SEQ ID NO: 454491 - protein, 9 aa, Influenza virus
RLPLPLCPF

SEQ ID NO: 454492 - protein, 9 aa, Influenza virus
RLQDTTWDV

SEQ ID NO: 454493 - protein, 9 aa, Influenza virus
RLQLKDNAK

SEQ ID NO: 454494 - protein, 9 aa, Influenza virus
RLQLKDNAR

SEQ ID NO: 454495 - protein, 9 aa, Influenza virus
RLQLRDNAK

SEQ ID NO: 454496 - protein, 9 aa, Influenza virus
RLQLRDNAR

SEQ ID NO: 454497 - protein, 9 aa, Influenza virus
RLRGIPPLE

SEQ ID NO: 454498 - protein, 9 aa, Influenza virus
RLRMATGLR

SEQ ID NO: 454499 - protein, 9 aa, Influenza virus
RLRRDQKAL

SEQ ID NO: 454500 - protein, 9 aa, Influenza virus
RLRRDQKSL

SEQ ID NO: 454501 - protein, 9 aa, Influenza virus
RLRRDQRAL

SEQ ID NO: 454502 - protein, 9 aa, Influenza virus
RLRRDQRSL

SEQ ID NO: 454503 - protein, 9 aa, Influenza virus
RLRSGFEML

SEQ ID NO: 454504 - protein, 9 aa, Influenza virus
RLSADGDIW

SEQ ID NO: 454505 - protein, 9 aa, Influenza virus
RLSAGGAIW

SEQ ID NO: 454506 - protein, 9 aa, Influenza virus
RLSAGGDIW

SEQ ID NO: 454507 - protein, 9 aa, Influenza virus
RLSAGGGIW

SEQ ID NO: 454508 - protein, 9 aa, Influenza virus
RLSAGGHIW

SEQ ID NO: 454509 - protein, 9 aa, Influenza virus
RLSAGGNIW

SEQ ID NO: 454510 - protein, 9 aa, Influenza virus
RLSAGGSIW

SEQ ID NO: 454511 - protein, 9 aa, Influenza virus
RLSASGDIW

SEQ ID NO: 454512 - protein, 9 aa, Influenza virus
RLSGGGDIW

SEQ ID NO: 454513 - protein, 9 aa, Influenza virus
RLSGIPPLE

SEQ ID NO: 454514 - protein, 9 aa, Influenza virus
RLSINPVKL

SEQ ID NO: 454515 - protein, 9 aa, Influenza virus
RLSSGYKDI

SEQ ID NO: 454516 - protein, 9 aa, Influenza virus
RLTIIGKDA

SEQ ID NO: 454517 - protein, 9 aa, Influenza virus
RLTILGKDA

SEQ ID NO: 454518 - protein, 9 aa, Influenza virus
RLTITYSSS

SEQ ID NO: 454519 - protein, 9 aa, Influenza virus
RLTQGRQTY

SEQ ID NO: 454520 - protein, 9 aa, Influenza virus
RLTQGYKDI

SEQ ID NO: 454521 - protein, 9 aa, Influenza virus
RLTTTIKPW

SEQ ID NO: 454522 - protein, 9 aa, Influenza virus
RLTTTIKTW

SEQ ID NO: 454523 - protein, 9 aa, Influenza virus
RLTTTIRTW

SEQ ID NO: 454524 - protein, 9 aa, Influenza virus
RLTTTVKTW

SEQ ID NO: 454525 - protein, 9 aa, Influenza virus
RLTVLGKDA

SEQ ID NO: 454526 - protein, 9 aa, Influenza virus
RLVLATGLR

SEQ ID NO: 454527 - protein, 9 aa, Influenza virus
RLVQLIVSG

SEQ ID NO: 454528 - protein, 9 aa, Influenza virus
RLVQNSITI

SEQ ID NO: 454529 - protein, 9 aa, Influenza virus
RLVRFRHQN

SEQ ID NO: 454530 - protein, 9 aa, Influenza virus
RLYGSENKL

SEQ ID NO: 454531 - protein, 9 aa, Influenza virus
RLYGSGNKL

SEQ ID NO: 454532 - protein, 9 aa, Influenza virus
RLYIWGVHH

SEQ ID NO: 454533 - protein, 9 aa, Influenza virus
RLYLWGVHH

SEQ ID NO: 454534 - protein, 9 aa, Influenza virus
RLYVNKNPY

SEQ ID NO: 454535 - protein, 9 aa, Influenza virus
RMADSIKSW

SEQ ID NO: 454536 - protein, 9 aa, Influenza virus
RMAINWGRI

SEQ ID NO: 454537 - protein, 9 aa, Influenza virus
RMAKCNTKC

SEQ ID NO: 454538 - protein, 9 aa, Influenza virus
RMARCNTKC

SEQ ID NO: 454539 - protein, 9 aa, Influenza virus
RMATGLRNI

SEQ ID NO: 454540 - protein, 9 aa, Influenza virus
RMATGLRNV

SEQ ID NO: 454541 - protein, 9 aa, Influenza virus
RMATNECRI

SEQ ID NO: 454542 - protein, 9 aa, Influenza virus
RMCNILKGK

SEQ ID NO: 454543 - protein, 9 aa, Influenza virus
RMCSLMQGS

SEQ ID NO: 454544 - protein, 9 aa, Influenza virus
RMDYYWAIL

SEQ ID NO: 454545 - protein, 9 aa, Influenza virus
RMDYYWAVL

SEQ ID NO: 454546 - protein, 9 aa, Influenza virus
RMDYYWGIL

SEQ ID NO: 454547 - protein, 9 aa, Influenza virus
RMEFFWTLL

SEQ ID NO: 454548 - protein, 9 aa, Influenza virus
RMEFSWILL

SEQ ID NO: 454549 - protein, 9 aa, Influenza virus
RMEFSWTIL

SEQ ID NO: 454550 - protein, 9 aa, Influenza virus
RMEFSWTLL

SEQ ID NO: 454551 - protein, 9 aa, Influenza virus
RMENLNKKV

SEQ ID NO: 454552 - protein, 9 aa, Influenza virus
RMFALSQGT

SEQ ID NO: 454553 - protein, 9 aa, Influenza virus
RMFLAMITY

SEQ ID NO: 454554 - protein, 9 aa, Influenza virus
RMGKCNTKC

SEQ ID NO: 454555 - protein, 9 aa, Influenza virus
RMGLQMQRF

SEQ ID NO: 454556 - protein, 9 aa, Influenza virus
RMGVDEYSS

SEQ ID NO: 454557 - protein, 9 aa, Influenza virus
RMGVQIQRF

SEQ ID NO: 454558 - protein, 9 aa, Influenza virus
RMGVQLQRF

SEQ ID NO: 454559 - protein, 9 aa, Influenza virus
RMGVQMQRF

SEQ ID NO: 454560 - protein, 9 aa, Influenza virus
RMIKAVRGD

SEQ ID NO: 454561 - protein, 9 aa, Influenza virus
RMIKRGIND

SEQ ID NO: 454562 - protein, 9 aa, Influenza virus
RMIKRGVND

SEQ ID NO: 454563 - protein, 9 aa, Influenza virus
RMIQLIVSG

SEQ ID NO: 454564 - protein, 9 aa, Influenza virus
RMITQRTIG

SEQ ID NO: 454565 - protein, 9 aa, Influenza virus
RMKWMMAMK

SEQ ID NO: 454566 - protein, 9 aa, Influenza virus
RMKWMMAMR

SEQ ID NO: 454567 - protein, 9 aa, Influenza virus
RMQFSSLAV

SEQ ID NO: 454568 - protein, 9 aa, Influenza virus
RMQFSSLTV

SEQ ID NO: 454569 - protein, 9 aa, Influenza virus
RMQINPVKL

SEQ ID NO: 454570 - protein, 9 aa, Influenza virus
RMQLKDNAK

SEQ ID NO: 454571 - protein, 9 aa, Influenza virus
RMQLRDNAK

SEQ ID NO: 454572 - protein, 9 aa, Influenza virus
RMQLRDNVK

SEQ ID NO: 454573 - protein, 9 aa, Influenza virus
RMSDSIKSW

SEQ ID NO: 454574 - protein, 9 aa, Influenza virus
RMSICISGP

SEQ ID NO: 454575 - protein, 9 aa, Influenza virus
RMSICMSGP

SEQ ID NO: 454576 - protein, 9 aa, Influenza virus
RMSICVSGP

SEQ ID NO: 454577 - protein, 9 aa, Influenza virus
RMSVCISGP

SEQ ID NO: 454578 - protein, 9 aa, Influenza virus
RMSVCMSGP

SEQ ID NO: 454579 - protein, 9 aa, Influenza virus
RMTDSIKSW

SEQ ID NO: 454580 - protein, 9 aa, Influenza virus
RMTFYWAIV

SEQ ID NO: 454581 - protein, 9 aa, Influenza virus
RMTFYWKIV

SEQ ID NO: 454582 - protein, 9 aa, Influenza virus
RMTFYWTII

SEQ ID NO: 454583 - protein, 9 aa, Influenza virus
RMTFYWTIV

SEQ ID NO: 454584 - protein, 9 aa, Influenza virus
RMTFYWTMV

SEQ ID NO: 454585 - protein, 9 aa, Influenza virus
RMTICIQGN

SEQ ID NO: 454586 - protein, 9 aa, Influenza virus
RMTICVQGD

SEQ ID NO: 454587 - protein, 9 aa, Influenza virus
RMTICVQGK

SEQ ID NO: 454588 - protein, 9 aa, Influenza virus
RMTICVQGN

SEQ ID NO: 454589 - protein, 9 aa, Influenza virus
RMTRGLFGA

SEQ ID NO: 454590 - protein, 9 aa, Influenza virus
RMVIASTTA

SEQ ID NO: 454591 - protein, 9 aa, Influenza virus
RMVKRGIND

SEQ ID NO: 454592 - protein, 9 aa, Influenza virus
RMVLASTTA

SEQ ID NO: 454593 - protein, 9 aa, Influenza virus
RMVLSAFDE

SEQ ID NO: 454594 - protein, 9 aa, Influenza virus
RMVTGLRNI

SEQ ID NO: 454595 - protein, 9 aa, Influenza virus
RMVTQRTIG

SEQ ID NO: 454596 - protein, 9 aa, Influenza virus
RMYALHQGT

SEQ ID NO: 454597 - protein, 9 aa, Influenza virus
RMYQKCCNL

SEQ ID NO: 454598 - protein, 9 aa, Influenza virus
RNAFRGLIS

SEQ ID NO: 454599 - protein, 9 aa, Influenza virus
RNAHKMESR

SEQ ID NO: 454600 - protein, 9 aa, Influenza virus
RNAIGDCPK

SEQ ID NO: 454601 - protein, 9 aa, Influenza virus
RNALGDCPK

SEQ ID NO: 454602 - protein, 9 aa, Influenza virus
RNALGNCPK

SEQ ID NO: 454603 - protein, 9 aa, Influenza virus
RNALSIAPI

SEQ ID NO: 454604 - protein, 9 aa, Influenza virus
RNATASFIY

SEQ ID NO: 454605 - protein, 9 aa, Influenza virus
RNATASFVY

SEQ ID NO: 454606 - protein, 9 aa, Influenza virus
RNATASLIY

SEQ ID NO: 454607 - protein, 9 aa, Influenza virus
RNCTIPCFW

SEQ ID NO: 454608 - protein, 9 aa, Influenza virus
RNCTVPCFW

SEQ ID NO: 454609 - protein, 9 aa, Influenza virus
RNDDIDQSL

SEQ ID NO: 454610 - protein, 9 aa, Influenza virus
RNDDSSSNS

SEQ ID NO: 454611 - protein, 9 aa, Influenza virus
RNDDSSSSS

SEQ ID NO: 454612 - protein, 9 aa, Influenza virus
RNDDVDQSL

SEQ ID NO: 454613 - protein, 9 aa, Influenza virus
RNDEGTGIA

SEQ ID NO: 454614 - protein, 9 aa, Influenza virus
RNDLYGTQS

SEQ ID NO: 454615 - protein, 9 aa, Influenza virus
RNDTDVVNF

SEQ ID NO: 454616 - protein, 9 aa, Influenza virus
RNDTDVVNY

SEQ ID NO: 454617 - protein, 9 aa, Influenza virus
RNEAINNRF

SEQ ID NO: 454618 - protein, 9 aa, Influenza virus
RNEALNNRF

SEQ ID NO: 454619 - protein, 9 aa, Influenza virus
RNEDGSSSS

SEQ ID NO: 454620 - protein, 9 aa, Influenza virus
RNEDSSSNS

SEQ ID NO: 454621 - protein, 9 aa, Influenza virus
RNEDSSSSS

SEQ ID NO: 454622 - protein, 9 aa, Influenza virus
RNEEGTGIA

SEQ ID NO: 454623 - protein, 9 aa, Influenza virus
RNEHGQTLW

SEQ ID NO: 454624 - protein, 9 aa, Influenza virus
RNEIKGVEL

SEQ ID NO: 454625 - protein, 9 aa, Influenza virus
RNEIKGVKL

SEQ ID NO: 454626 - protein, 9 aa, Influenza virus
RNEQGQALW

SEQ ID NO: 454627 - protein, 9 aa, Influenza virus
RNEQGQILW

SEQ ID NO: 454628 - protein, 9 aa, Influenza virus
RNEQGQMLW

SEQ ID NO: 454629 - protein, 9 aa, Influenza virus
RNEQGQTLW

SEQ ID NO: 454630 - protein, 9 aa, Influenza virus
RNFKPNIGP

SEQ ID NO: 454631 - protein, 9 aa, Influenza virus
RNFPQTTNT

SEQ ID NO: 454632 - protein, 9 aa, Influenza virus
RNFQPNIGP

SEQ ID NO: 454633 - protein, 9 aa, Influenza virus
RNFWRGDNG

SEQ ID NO: 454634 - protein, 9 aa, Influenza virus
RNFWRGENG

SEQ ID NO: 454635 - protein, 9 aa, Influenza virus
RNGFEMLKI

SEQ ID NO: 454636 - protein, 9 aa, Influenza virus
RNGKWREQL

SEQ ID NO: 454637 - protein, 9 aa, Influenza virus
RNGNMRCTI

SEQ ID NO: 454638 - protein, 9 aa, Influenza virus
RNGTYDHKE

SEQ ID NO: 454639 - protein, 9 aa, Influenza virus
RNGTYDHNI

SEQ ID NO: 454640 - protein, 9 aa, Influenza virus
RNGTYDYPK

SEQ ID NO: 454641 - protein, 9 aa, Influenza virus
RNGTYNHED

SEQ ID NO: 454642 - protein, 9 aa, Influenza virus
RNGTYNYPK

SEQ ID NO: 454643 - protein, 9 aa, Influenza virus
RNICEKLEQ

SEQ ID NO: 454644 - protein, 9 aa, Influenza virus
RNILRTQDS

SEQ ID NO: 454645 - protein, 9 aa, Influenza virus
RNILRTQES

SEQ ID NO: 454646 - protein, 9 aa, Influenza virus
RNILSIAPI

SEQ ID NO: 454647 - protein, 9 aa, Influenza virus
RNILSMAPI

SEQ ID NO: 454648 - protein, 9 aa, Influenza virus
RNIPEKQTR

SEQ ID NO: 454649 - protein, 9 aa, Influenza virus
RNIPERQTR

SEQ ID NO: 454650 - protein, 9 aa, Influenza virus
RNIPGKQAK

SEQ ID NO: 454651 - protein, 9 aa, Influenza virus
RNIPQIESR

SEQ ID NO: 454652 - protein, 9 aa, Influenza virus
RNIPSIQSR

SEQ ID NO: 454653 - protein, 9 aa, Influenza virus
RNIPSVQSR

SEQ ID NO: 454654 - protein, 9 aa, Influenza virus
RNITEIVYL

SEQ ID NO: 454655 - protein, 9 aa, Influenza virus
RNIVRRAAV

SEQ ID NO: 454656 - protein, 9 aa, Influenza virus
RNIVRRAIV

SEQ ID NO: 454657 - protein, 9 aa, Influenza virus
RNIVRRATV

SEQ ID NO: 454658 - protein, 9 aa, Influenza virus
RNKHSNGTI

SEQ ID NO: 454659 - protein, 9 aa, Influenza virus
RNKHSNGTT

SEQ ID NO: 454660 - protein, 9 aa, Influenza virus
RNKHSNSTT

SEQ ID NO: 454661 - protein, 9 aa, Influenza virus
RNKYLEEHP

SEQ ID NO: 454662 - protein, 9 aa, Influenza virus
RNLHDQIKR

SEQ ID NO: 454663 - protein, 9 aa, Influenza virus
RNLHDQVKR

SEQ ID NO: 454664 - protein, 9 aa, Influenza virus
RNLHDRIRR

SEQ ID NO: 454665 - protein, 9 aa, Influenza virus
RNLHDRTRR

SEQ ID NO: 454666 - protein, 9 aa, Influenza virus
RNLHDRVKR

SEQ ID NO: 454667 - protein, 9 aa, Influenza virus
RNLHDRVRR

SEQ ID NO: 454668 - protein, 9 aa, Influenza virus
RNLHEQIKR

SEQ ID NO: 454669 - protein, 9 aa, Influenza virus
RNLHERIRR

SEQ ID NO: 454670 - protein, 9 aa, Influenza virus
RNLHIPEVC

SEQ ID NO: 454671 - protein, 9 aa, Influenza virus
RNLYDKVRL

SEQ ID NO: 454672 - protein, 9 aa, Influenza virus
RNLYDKVRM

SEQ ID NO: 454673 - protein, 9 aa, Influenza virus
RNMRWLTLK

SEQ ID NO: 454674 - protein, 9 aa, Influenza virus
RNNMINNDL

SEQ ID NO: 454675 - protein, 9 aa, Influenza virus
RNNRKEPAL

SEQ ID NO: 454676 - protein, 9 aa, Influenza virus
RNNSYDHSK

SEQ ID NO: 454677 - protein, 9 aa, Influenza virus
RNNTYDHAQ

SEQ ID NO: 454678 - protein, 9 aa, Influenza virus
RNNTYDHKK

SEQ ID NO: 454679 - protein, 9 aa, Influenza virus
RNNTYDHSH

SEQ ID NO: 454680 - protein, 9 aa, Influenza virus
RNNTYDHSK

SEQ ID NO: 454681 - protein, 9 aa, Influenza virus
RNNTYDHSQ

SEQ ID NO: 454682 - protein, 9 aa, Influenza virus
RNNTYDHSR

SEQ ID NO: 454683 - protein, 9 aa, Influenza virus
RNNTYDHST

SEQ ID NO: 454684 - protein, 9 aa, Influenza virus
RNNTYDHTK

SEQ ID NO: 454685 - protein, 9 aa, Influenza virus
RNNTYDHTQ

SEQ ID NO: 454686 - protein, 9 aa, Influenza virus
RNNTYNHTE

SEQ ID NO: 454687 - protein, 9 aa, Influenza virus
RNNTYNHTQ

SEQ ID NO: 454688 - protein, 9 aa, Influenza virus
RNPGNAEIE

SEQ ID NO: 454689 - protein, 9 aa, Influenza virus
RNQIKIRRR

SEQ ID NO: 454690 - protein, 9 aa, Influenza virus
RNQPAATAL

SEQ ID NO: 454691 - protein, 9 aa, Influenza virus
RNQSGRISI

SEQ ID NO: 454692 - protein, 9 aa, Influenza virus
RNQVKIRRR

SEQ ID NO: 454693 - protein, 9 aa, Influenza virus
RNRHSNGTI

SEQ ID NO: 454694 - protein, 9 aa, Influenza virus
RNRSILNTS

SEQ ID NO: 454695 - protein, 9 aa, Influenza virus
RNRYLEEHP

SEQ ID NO: 454696 - protein, 9 aa, Influenza virus
RNSFFSRLN

SEQ ID NO: 454697 - protein, 9 aa, Influenza virus
RNSFYAELK

SEQ ID NO: 454698 - protein, 9 aa, Influenza virus
RNSIWTSSS

SEQ ID NO: 454699 - protein, 9 aa, Influenza virus
RNSSDICYP

SEQ ID NO: 454700 - protein, 9 aa, Influenza virus
RNSSILTDS

SEQ ID NO: 454701 - protein, 9 aa, Influenza virus
RNTFGDCPK

SEQ ID NO: 454702 - protein, 9 aa, Influenza virus
RNTIGDCPK

SEQ ID NO: 454703 - protein, 9 aa, Influenza virus
RNTIGNCPK

SEQ ID NO: 454704 - protein, 9 aa, Influenza virus
RNTPSIDPK

SEQ ID NO: 454705 - protein, 9 aa, Influenza virus
RNTPSIEPK

SEQ ID NO: 454706 - protein, 9 aa, Influenza virus
RNTPSIEPR

SEQ ID NO: 454707 - protein, 9 aa, Influenza virus
RNTPSVEPK

SEQ ID NO: 454708 - protein, 9 aa, Influenza virus
RNTPSVEPR

SEQ ID NO: 454709 - protein, 9 aa, Influenza virus
RNTRKEPAL

SEQ ID NO: 454710 - protein, 9 aa, Influenza virus
RNVLSIAPI

SEQ ID NO: 454711 - protein, 9 aa, Influenza virus
RNVLSVAPI

SEQ ID NO: 454712 - protein, 9 aa, Influenza virus
RNVPEKQTR

SEQ ID NO: 454713 - protein, 9 aa, Influenza virus
RNVPERQTR

SEQ ID NO: 454714 - protein, 9 aa, Influenza virus
RNVPETQTR

SEQ ID NO: 454715 - protein, 9 aa, Influenza virus
RNVPQAQDR

SEQ ID NO: 454716 - protein, 9 aa, Influenza virus
RNVPQAQNR

SEQ ID NO: 454717 - protein, 9 aa, Influenza virus
RNVPQIEAR

SEQ ID NO: 454718 - protein, 9 aa, Influenza virus
RNVPQIESR

SEQ ID NO: 454719 - protein, 9 aa, Influenza virus
RNVPQIQNR

SEQ ID NO: 454720 - protein, 9 aa, Influenza virus
RNVPQMESR

SEQ ID NO: 454721 - protein, 9 aa, Influenza virus
RNVPQVQDR

SEQ ID NO: 454722 - protein, 9 aa, Influenza virus
RNVPQVQNR

SEQ ID NO: 454723 - protein, 9 aa, Influenza virus
RNVPSIQSR

SEQ ID NO: 454724 - protein, 9 aa, Influenza virus
RNVTETLYL

SEQ ID NO: 454725 - protein, 9 aa, Influenza virus
RNVTVTHAK

SEQ ID NO: 454726 - protein, 9 aa, Influenza virus
RNVTVTHAQ

SEQ ID NO: 454727 - protein, 9 aa, Influenza virus
RNVTVTHSV

SEQ ID NO: 454728 - protein, 9 aa, Influenza virus
RNVVWLIKK

SEQ ID NO: 454729 - protein, 9 aa, Influenza virus
RNVVWLTKK

SEQ ID NO: 454730 - protein, 9 aa, Influenza virus
RNVVWLVKK

SEQ ID NO: 454731 - protein, 9 aa, Influenza virus
RNWRQANNG

SEQ ID NO: 454732 - protein, 9 aa, Influenza virus
RNWSGYSGS

SEQ ID NO: 454733 - protein, 9 aa, Influenza virus
RNWSKPQCQ

SEQ ID NO: 454734 - protein, 9 aa, Influenza virus
RNYFTAEIS

SEQ ID NO: 454735 - protein, 9 aa, Influenza virus
RNYFTAEVS

SEQ ID NO: 454736 - protein, 9 aa, Influenza virus
RNYFTTEVS

SEQ ID NO: 454737 - protein, 9 aa, Influenza virus
RPADGTGSC

SEQ ID NO: 454738 - protein, 9 aa, Influenza virus
RPCFWVELI

SEQ ID NO: 454739 - protein, 9 aa, Influenza virus
RPCFWVELV

SEQ ID NO: 454740 - protein, 9 aa, Influenza virus
RPDSSWLFG

SEQ ID NO: 454741 - protein, 9 aa, Influenza virus
RPEEAKYVE

SEQ ID NO: 454742 - protein, 9 aa, Influenza virus
RPEEAKYVW

SEQ ID NO: 454743 - protein, 9 aa, Influenza virus
RPEEVKYVW

SEQ ID NO: 454744 - protein, 9 aa, Influenza virus
RPFQNASRH

SEQ ID NO: 454745 - protein, 9 aa, Influenza virus
RPFVRGQQG

SEQ ID NO: 454746 - protein, 9 aa, Influenza virus
RPGDNITFS

SEQ ID NO: 454747 - protein, 9 aa, Influenza virus
RPGETLNVE

SEQ ID NO: 454748 - protein, 9 aa, Influenza virus
RPGQTLRVR

SEQ ID NO: 454749 - protein, 9 aa, Influenza virus
RPGVKGFGF

SEQ ID NO: 454750 - protein, 9 aa, Influenza virus
RPGYNGQKS

SEQ ID NO: 454751 - protein, 9 aa, Influenza virus
RPGYNGQRS

SEQ ID NO: 454752 - protein, 9 aa, Influenza virus
RPHPEDLNG

SEQ ID NO: 454753 - protein, 9 aa, Influenza virus
RPIGISSMV

SEQ ID NO: 454754 - protein, 9 aa, Influenza virus
RPIIEIDMN

SEQ ID NO: 454755 - protein, 9 aa, Influenza virus
RPIIEIDMS

SEQ ID NO: 454756 - protein, 9 aa, Influenza virus
RPIIEIDMT

SEQ ID NO: 454757 - protein, 9 aa, Influenza virus
RPILSPLTK

SEQ ID NO: 454758 - protein, 9 aa, Influenza virus
RPITEINTW

SEQ ID NO: 454759 - protein, 9 aa, Influenza virus
RPKEDEVWW

SEQ ID NO: 454760 - protein, 9 aa, Influenza virus
RPKEDKVWW

SEQ ID NO: 454761 - protein, 9 aa, Influenza virus
RPKEDRVWW

SEQ ID NO: 454762 - protein, 9 aa, Influenza virus
RPKEEKVWW

SEQ ID NO: 454763 - protein, 9 aa, Influenza virus
RPKEIEGIC

SEQ ID NO: 454764 - protein, 9 aa, Influenza virus
RPKEMEGIC

SEQ ID NO: 454765 - protein, 9 aa, Influenza virus
RPKEMEGVC

SEQ ID NO: 454766 - protein, 9 aa, Influenza virus
RPKENPAHK

SEQ ID NO: 454767 - protein, 9 aa, Influenza virus
RPKVNGQAG

SEQ ID NO: 454768 - protein, 9 aa, Influenza virus
RPKVNGQSG

SEQ ID NO: 454769 - protein, 9 aa, Influenza virus
RPLILKDCS

SEQ ID NO: 454770 - protein, 9 aa, Influenza virus
RPLILRDCS

SEQ ID NO: 454771 - protein, 9 aa, Influenza virus
RPLIRGQQG

SEQ ID NO: 454772 - protein, 9 aa, Influenza virus
RPLVMGQQG

SEQ ID NO: 454773 - protein, 9 aa, Influenza virus
RPLVNGQRG

SEQ ID NO: 454774 - protein, 9 aa, Influenza virus
RPLVNGQSG

SEQ ID NO: 454775 - protein, 9 aa, Influenza virus
RPLVREQQG

SEQ ID NO: 454776 - protein, 9 aa, Influenza virus
RPLVRGQQG

SEQ ID NO: 454777 - protein, 9 aa, Influenza virus
RPLVRGQSG

SEQ ID NO: 454778 - protein, 9 aa, Influenza virus
RPLVRSQSG

SEQ ID NO: 454779 - protein, 9 aa, Influenza virus
RPMDGTGSC

SEQ ID NO: 454780 - protein, 9 aa, Influenza virus
RPMDSTGSC

SEQ ID NO: 454781 - protein, 9 aa, Influenza virus
RPNENPAHK

SEQ ID NO: 454782 - protein, 9 aa, Influenza virus
RPNENPVHK

SEQ ID NO: 454783 - protein, 9 aa, Influenza virus
RPNIGPRPL

SEQ ID NO: 454784 - protein, 9 aa, Influenza virus
RPPVNGQSG

SEQ ID NO: 454785 - protein, 9 aa, Influenza virus
RPQINGQSG

SEQ ID NO: 454786 - protein, 9 aa, Influenza virus
RPQMNGQSG

SEQ ID NO: 454787 - protein, 9 aa, Influenza virus
RPQVNGQRG

SEQ ID NO: 454788 - protein, 9 aa, Influenza virus
RPQVNGQSG

SEQ ID NO: 454789 - protein, 9 aa, Influenza virus
RPRRGLFGA

SEQ ID NO: 454790 - protein, 9 aa, Influenza virus
RPRVNGQSG

SEQ ID NO: 454791 - protein, 9 aa, Influenza virus
RPRVRNQSG

SEQ ID NO: 454792 - protein, 9 aa, Influenza virus
RPRYNGQRS

SEQ ID NO: 454793 - protein, 9 aa, Influenza virus
RPSAPEGMC

SEQ ID NO: 454794 - protein, 9 aa, Influenza virus
RPTAVDTCY

SEQ ID NO: 454795 - protein, 9 aa, Influenza virus
RPTRNGWGC

SEQ ID NO: 454796 - protein, 9 aa, Influenza virus
RPTTEINTW

SEQ ID NO: 454797 - protein, 9 aa, Influenza virus
RPTTTIKTW

SEQ ID NO: 454798 - protein, 9 aa, Influenza virus
RPVAEINTW

SEQ ID NO: 454799 - protein, 9 aa, Influenza virus
RPVAKAGFI

SEQ ID NO: 454800 - protein, 9 aa, Influenza virus
RPVDGIGSC

SEQ ID NO: 454801 - protein, 9 aa, Influenza virus
RPVDGTGSC

SEQ ID NO: 454802 - protein, 9 aa, Influenza virus
RPVGISSMG

SEQ ID NO: 454803 - protein, 9 aa, Influenza virus
RPVGISSMM

SEQ ID NO: 454804 - protein, 9 aa, Influenza virus
RPVGISSMV

SEQ ID NO: 454805 - protein, 9 aa, Influenza virus
RPVIEIDMN

SEQ ID NO: 454806 - protein, 9 aa, Influenza virus
RPVIEIDMS

SEQ ID NO: 454807 - protein, 9 aa, Influenza virus
RPVTEINTW

SEQ ID NO: 454808 - protein, 9 aa, Influenza virus
RPWIRFNSD

SEQ ID NO: 454809 - protein, 9 aa, Influenza virus
RPWIRFNSN

SEQ ID NO: 454810 - protein, 9 aa, Influenza virus
RPWIRINNE

SEQ ID NO: 454811 - protein, 9 aa, Influenza virus
RPWISFDQN

SEQ ID NO: 454812 - protein, 9 aa, Influenza virus
RPWMRINNE

SEQ ID NO: 454813 - protein, 9 aa, Influenza virus
RPWMRISNE

SEQ ID NO: 454814 - protein, 9 aa, Influenza virus
RPWVRGLSS

SEQ ID NO: 454815 - protein, 9 aa, Influenza virus
RPWVRGQSG

SEQ ID NO: 454816 - protein, 9 aa, Influenza virus
RPWVRINNE

SEQ ID NO: 454817 - protein, 9 aa, Influenza virus
RPWVRMNNE

SEQ ID NO: 454818 - protein, 9 aa, Influenza virus
RPWVSFDQN

SEQ ID NO: 454819 - protein, 9 aa, Influenza virus
RPWVSFNHN

SEQ ID NO: 454820 - protein, 9 aa, Influenza virus
RPWVSFNQD

SEQ ID NO: 454821 - protein, 9 aa, Influenza virus
RPWVSFNQN

SEQ ID NO: 454822 - protein, 9 aa, Influenza virus
RQANNGDDA

SEQ ID NO: 454823 - protein, 9 aa, Influenza virus
RQANNGEDA

SEQ ID NO: 454824 - protein, 9 aa, Influenza virus
RQANNGEDS

SEQ ID NO: 454825 - protein, 9 aa, Influenza virus
RQANNGEEA

SEQ ID NO: 454826 - protein, 9 aa, Influenza virus
RQANSGEDA

SEQ ID NO: 454827 - protein, 9 aa, Influenza virus
RQASPSCLV

SEQ ID NO: 454828 - protein, 9 aa, Influenza virus
RQCFNPMII

SEQ ID NO: 454829 - protein, 9 aa, Influenza virus
RQCFNPMIV

SEQ ID NO: 454830 - protein, 9 aa, Influenza virus
RQCFNPMTV

SEQ ID NO: 454831 - protein, 9 aa, Influenza virus
RQCFNPMVV

SEQ ID NO: 454832 - protein, 9 aa, Influenza virus
RQEALQNRI

SEQ ID NO: 454833 - protein, 9 aa, Influenza virus
RQEIDGIKL

SEQ ID NO: 454834 - protein, 9 aa, Influenza virus
RQEIEGARL

SEQ ID NO: 454835 - protein, 9 aa, Influenza virus
RQEIEGIKL

SEQ ID NO: 454836 - protein, 9 aa, Influenza virus
RQEIEGIRL

SEQ ID NO: 454837 - protein, 9 aa, Influenza virus
RQEIEGVKL

SEQ ID NO: 454838 - protein, 9 aa, Influenza virus
RQEIEGVRL

SEQ ID NO: 454839 - protein, 9 aa, Influenza virus
RQEIGGVKL

SEQ ID NO: 454840 - protein, 9 aa, Influenza virus
RQEINGIKL

SEQ ID NO: 454841 - protein, 9 aa, Influenza virus
RQEIVDNKN

SEQ ID NO: 454842 - protein, 9 aa, Influenza virus
RQEIVDNNN

SEQ ID NO: 454843 - protein, 9 aa, Influenza virus
RQEIVDNSN

SEQ ID NO: 454844 - protein, 9 aa, Influenza virus
RQEIVGNDN

SEQ ID NO: 454845 - protein, 9 aa, Influenza virus
RQEIVSNDN

SEQ ID NO: 454846 - protein, 9 aa, Influenza virus
RQEKNPALR

SEQ ID NO: 454847 - protein, 9 aa, Influenza virus
RQEKNPSLR

SEQ ID NO: 454848 - protein, 9 aa, Influenza virus
RQGNSVWAG

SEQ ID NO: 454849 - protein, 9 aa, Influenza virus
RQGTSVWAG

SEQ ID NO: 454850 - protein, 9 aa, Influenza virus
RQIGNVINW

SEQ ID NO: 454851 - protein, 9 aa, Influenza virus
RQIIRESGG

SEQ ID NO: 454852 - protein, 9 aa, Influenza virus
RQIIVDNNN

SEQ ID NO: 454853 - protein, 9 aa, Influenza virus
RQILRESGG

SEQ ID NO: 454854 - protein, 9 aa, Influenza virus
RQILRGSGG

SEQ ID NO: 454855 - protein, 9 aa, Influenza virus
RQILRKSGG

SEQ ID NO: 454856 - protein, 9 aa, Influenza virus
RQILRRSGG

SEQ ID NO: 454857 - protein, 9 aa, Influenza virus
RQILRTQES

SEQ ID NO: 454858 - protein, 9 aa, Influenza virus
RQKIMESGG

SEQ ID NO: 454859 - protein, 9 aa, Influenza virus
RQKINGVKL

SEQ ID NO: 454860 - protein, 9 aa, Influenza virus
RQKISGVKL

SEQ ID NO: 454861 - protein, 9 aa, Influenza virus
RQKRGLFGA

SEQ ID NO: 454862 - protein, 9 aa, Influenza virus
RQKSLIWLW

SEQ ID NO: 454863 - protein, 9 aa, Influenza virus
RQKVMESGG

SEQ ID NO: 454864 - protein, 9 aa, Influenza virus
RQKVNGVKL

SEQ ID NO: 454865 - protein, 9 aa, Influenza virus
RQKWWVWLW

SEQ ID NO: 454866 - protein, 9 aa, Influenza virus
RQLRENAED

SEQ ID NO: 454867 - protein, 9 aa, Influenza virus
RQLRENAEE

SEQ ID NO: 454868 - protein, 9 aa, Influenza virus
RQMVHAMRT

SEQ ID NO: 454869 - protein, 9 aa, Influenza virus
RQMVQAMRA

SEQ ID NO: 454870 - protein, 9 aa, Influenza virus
RQMVQAMRT

SEQ ID NO: 454871 - protein, 9 aa, Influenza virus
RQNAEEDGK

SEQ ID NO: 454872 - protein, 9 aa, Influenza virus
RQNAEEDGR

SEQ ID NO: 454873 - protein, 9 aa, Influenza virus
RQNPTEEQA

SEQ ID NO: 454874 - protein, 9 aa, Influenza virus
RQRINGVKL

SEQ ID NO: 454875 - protein, 9 aa, Influenza virus
RQSERGEDT

SEQ ID NO: 454876 - protein, 9 aa, Influenza virus
RQSERGEET

SEQ ID NO: 454877 - protein, 9 aa, Influenza virus
RQSFSPSPG

SEQ ID NO: 454878 - protein, 9 aa, Influenza virus
RQTFDWTLN

SEQ ID NO: 454879 - protein, 9 aa, Influenza virus
RQTRGIFGA

SEQ ID NO: 454880 - protein, 9 aa, Influenza virus
RQTRGLFGA

SEQ ID NO: 454881 - protein, 9 aa, Influenza virus
RQTYDWTLN

SEQ ID NO: 454882 - protein, 9 aa, Influenza virus
RQVCIAWSS

SEQ ID NO: 454883 - protein, 9 aa, Influenza virus
RQVCMAWSS

SEQ ID NO: 454884 - protein, 9 aa, Influenza virus
RQVCVAWSS

SEQ ID NO: 454885 - protein, 9 aa, Influenza virus
RQVIVDNNN

SEQ ID NO: 454886 - protein, 9 aa, Influenza virus
RQVIVDNNS

SEQ ID NO: 454887 - protein, 9 aa, Influenza virus
RQVIVDNSN

SEQ ID NO: 454888 - protein, 9 aa, Influenza virus
RQVLRESGG

SEQ ID NO: 454889 - protein, 9 aa, Influenza virus
RRAAVSADP

SEQ ID NO: 454890 - protein, 9 aa, Influenza virus
RRAEIIKME

SEQ ID NO: 454891 - protein, 9 aa, Influenza virus
RRAIATPGM

SEQ ID NO: 454892 - protein, 9 aa, Influenza virus
RRAIVSADP

SEQ ID NO: 454893 - protein, 9 aa, Influenza virus
RRATVSADP

SEQ ID NO: 454894 - protein, 9 aa, Influenza virus
RRCLLQSLQ

SEQ ID NO: 454895 - protein, 9 aa, Influenza virus
RRDILRTQE

SEQ ID NO: 454896 - protein, 9 aa, Influenza virus
RRDQKALKG

SEQ ID NO: 454897 - protein, 9 aa, Influenza virus
RRDQKSLKG

SEQ ID NO: 454898 - protein, 9 aa, Influenza virus
RRDQKSLRG

SEQ ID NO: 454899 - protein, 9 aa, Influenza virus
RRDQMAHCR

SEQ ID NO: 454900 - protein, 9 aa, Influenza virus
RRDQRALKG

SEQ ID NO: 454901 - protein, 9 aa, Influenza virus
RRDQRSLRG

SEQ ID NO: 454902 - protein, 9 aa, Influenza virus
RRDYFTAEV

SEQ ID NO: 454903 - protein, 9 aa, Influenza virus
RREIHIYYL

SEQ ID NO: 454904 - protein, 9 aa, Influenza virus
RREVHIYYL

SEQ ID NO: 454905 - protein, 9 aa, Influenza virus
RREVHMYYL

SEQ ID NO: 454906 - protein, 9 aa, Influenza virus
RREVHTYYL

SEQ ID NO: 454907 - protein, 9 aa, Influenza virus
RREVHVYYL

SEQ ID NO: 454908 - protein, 9 aa, Influenza virus
RRFIQNALN

SEQ ID NO: 454909 - protein, 9 aa, Influenza virus
RRFVQNALN

SEQ ID NO: 454910 - protein, 9 aa, Influenza virus
RRFVQNALS

SEQ ID NO: 454911 - protein, 9 aa, Influenza virus
RRGLFGAIA

SEQ ID NO: 454912 - protein, 9 aa, Influenza virus
RRGQGHLDE

SEQ ID NO: 454913 - protein, 9 aa, Influenza virus
RRGVKGFGF

SEQ ID NO: 454914 - protein, 9 aa, Influenza virus
RRICEKLEQ

SEQ ID NO: 454915 - protein, 9 aa, Influenza virus
RRIDFHWLF

SEQ ID NO: 454916 - protein, 9 aa, Influenza virus
RRIDFHWLL

SEQ ID NO: 454917 - protein, 9 aa, Influenza virus
RRIDFNWLL

SEQ ID NO: 454918 - protein, 9 aa, Influenza virus
RRIENLNKK

SEQ ID NO: 454919 - protein, 9 aa, Influenza virus
RRIENLNRK

SEQ ID NO: 454920 - protein, 9 aa, Influenza virus
RRIESLNKK

SEQ ID NO: 454921 - protein, 9 aa, Influenza virus
RRINMLADR

SEQ ID NO: 454922 - protein, 9 aa, Influenza virus
RRIWRQANN

SEQ ID NO: 454923 - protein, 9 aa, Influenza virus
RRKKRGLFG

SEQ ID NO: 454924 - protein, 9 aa, Influenza virus
RRKRGLFGA

SEQ ID NO: 454925 - protein, 9 aa, Influenza virus
RRKRRGLFG

SEQ ID NO: 454926 - protein, 9 aa, Influenza virus
RRKTNLYGF

SEQ ID NO: 454927 - protein, 9 aa, Influenza virus
RRLENLNKK

SEQ ID NO: 454928 - protein, 9 aa, Influenza virus
RRLENLNKR

SEQ ID NO: 454929 - protein, 9 aa, Influenza virus
RRLENLSKR

SEQ ID NO: 454930 - protein, 9 aa, Influenza virus
RRLSANAID

SEQ ID NO: 454931 - protein, 9 aa, Influenza virus
RRLSANAVD

SEQ ID NO: 454932 - protein, 9 aa, Influenza virus
RRLSTNAID

SEQ ID NO: 454933 - protein, 9 aa, Influenza virus
RRLSTNAMD

SEQ ID NO: 454934 - protein, 9 aa, Influenza virus
RRLSVNAID

SEQ ID NO: 454935 - protein, 9 aa, Influenza virus
RRLTTTIKP

SEQ ID NO: 454936 - protein, 9 aa, Influenza virus
RRLTTTIKT

SEQ ID NO: 454937 - protein, 9 aa, Influenza virus
RRLTTTIRT

SEQ ID NO: 454938 - protein, 9 aa, Influenza virus
RRLTTTVKT

SEQ ID NO: 454939 - protein, 9 aa, Influenza virus
RRLTVLGKD

SEQ ID NO: 454940 - protein, 9 aa, Influenza virus
RRMVQAMRA

SEQ ID NO: 454941 - protein, 9 aa, Influenza virus
RRNKYLEEH

SEQ ID NO: 454942 - protein, 9 aa, Influenza virus
RRNRYLEEH

SEQ ID NO: 454943 - protein, 9 aa, Influenza virus
RRNSSDICY

SEQ ID NO: 454944 - protein, 9 aa, Influenza virus
RRNWRQANN

SEQ ID NO: 454945 - protein, 9 aa, Influenza virus
RRNYFTAEI

SEQ ID NO: 454946 - protein, 9 aa, Influenza virus
RRNYFTAEV

SEQ ID NO: 454947 - protein, 9 aa, Influenza virus
RRNYFTTEV

SEQ ID NO: 454948 - protein, 9 aa, Influenza virus
RRPDSSWLF

SEQ ID NO: 454949 - protein, 9 aa, Influenza virus
RRPIGISSM

SEQ ID NO: 454950 - protein, 9 aa, Influenza virus
RRPVAEINT

SEQ ID NO: 454951 - protein, 9 aa, Influenza virus
RRPVAKAGF

SEQ ID NO: 454952 - protein, 9 aa, Influenza virus
RRPVGISSM

SEQ ID NO: 454953 - protein, 9 aa, Influenza virus
RRPVTEINT

SEQ ID NO: 454954 - protein, 9 aa, Influenza virus
RRQILRTQE

SEQ ID NO: 454955 - protein, 9 aa, Influenza virus
RRQKRGLFG

SEQ ID NO: 454956 - protein, 9 aa, Influenza virus
RRQKSLIWL

SEQ ID NO: 454957 - protein, 9 aa, Influenza virus
RRQKWWVWL

SEQ ID NO: 454958 - protein, 9 aa, Influenza virus
RRQLRENAE

SEQ ID NO: 454959 - protein, 9 aa, Influenza virus
RRRFIQNAL

SEQ ID NO: 454960 - protein, 9 aa, Influenza virus
RRRFVQNAL

SEQ ID NO: 454961 - protein, 9 aa, Influenza virus
RRRGLFGAI

SEQ ID NO: 454962 - protein, 9 aa, Influenza virus
RRRKKRGLF

SEQ ID NO: 454963 - protein, 9 aa, Influenza virus
RRRKRGLFG

SEQ ID NO: 454964 - protein, 9 aa, Influenza virus
RRRTNLYGF

SEQ ID NO: 454965 - protein, 9 aa, Influenza virus
RRRVDINPG

SEQ ID NO: 454966 - protein, 9 aa, Influenza virus
RRRVDMNPG

SEQ ID NO: 454967 - protein, 9 aa, Influenza virus
RRRVDTNPG

SEQ ID NO: 454968 - protein, 9 aa, Influenza virus
RRRVDVNPG

SEQ ID NO: 454969 - protein, 9 aa, Influenza virus
RRSGAAGAA

SEQ ID NO: 454970 - protein, 9 aa, Influenza virus
RRSGGIGKE

SEQ ID NO: 454971 - protein, 9 aa, Influenza virus
RRSGGISKE

SEQ ID NO: 454972 - protein, 9 aa, Influenza virus
RRSYFTAEV

SEQ ID NO: 454973 - protein, 9 aa, Influenza virus
RRTNLYGFI

SEQ ID NO: 454974 - protein, 9 aa, Influenza virus
RRVDINPGH

SEQ ID NO: 454975 - protein, 9 aa, Influenza virus
RRVDMNPGH

SEQ ID NO: 454976 - protein, 9 aa, Influenza virus
RRVDTNPGH

SEQ ID NO: 454977 - protein, 9 aa, Influenza virus
RRVDVNPGH

SEQ ID NO: 454978 - protein, 9 aa, Influenza virus
RRVWRQANN

SEQ ID NO: 454979 - protein, 9 aa, Influenza virus
RRYELEIGT

SEQ ID NO: 454980 - protein, 9 aa, Influenza virus
RRYGPALSI

SEQ ID NO: 454981 - protein, 9 aa, Influenza virus
RSALILRGA

SEQ ID NO: 454982 - protein, 9 aa, Influenza virus
RSALILRGS

SEQ ID NO: 454983 - protein, 9 aa, Influenza virus
RSAYERMCN

SEQ ID NO: 454984 - protein, 9 aa, Influenza virus
RSDGNLIAP

SEQ ID NO: 454985 - protein, 9 aa, Influenza virus
RSDKICIGY

SEQ ID NO: 454986 - protein, 9 aa, Influenza virus
RSDKICLGH

SEQ ID NO: 454987 - protein, 9 aa, Influenza virus
RSDQISIVP

SEQ ID NO: 454988 - protein, 9 aa, Influenza virus
RSEKLVLAT

SEQ ID NO: 454989 - protein, 9 aa, Influenza virus
RSESSFYAE

SEQ ID NO: 454990 - protein, 9 aa, Influenza virus
RSFKPNIGP

SEQ ID NO: 454991 - protein, 9 aa, Influenza virus
RSFQPNIGP

SEQ ID NO: 454992 - protein, 9 aa, Influenza virus
RSFRPNIGP

SEQ ID NO: 454993 - protein, 9 aa, Influenza virus
RSFSRTELI

SEQ ID NO: 454994 - protein, 9 aa, Influenza virus
RSGAAGAAI

SEQ ID NO: 454995 - protein, 9 aa, Influenza virus
RSGAAGAAV

SEQ ID NO: 454996 - protein, 9 aa, Influenza virus
RSGFEIIKV

SEQ ID NO: 454997 - protein, 9 aa, Influenza virus
RSGFEIIRV

SEQ ID NO: 454998 - protein, 9 aa, Influenza virus
RSGFEIIWD

SEQ ID NO: 454999 - protein, 9 aa, Influenza virus
RSGFEILLI

SEQ ID NO: 455000 - protein, 9 aa, Influenza virus
RSGFEMIWD

SEQ ID NO: 455001 - protein, 9 aa, Influenza virus
RSGFEMLKI

SEQ ID NO: 455002 - protein, 9 aa, Influenza virus
RSGFEMLKV

SEQ ID NO: 455003 - protein, 9 aa, Influenza virus
RSGFEMLRI

SEQ ID NO: 455004 - protein, 9 aa, Influenza virus
RSGFEMVWD

SEQ ID NO: 455005 - protein, 9 aa, Influenza virus
RSGFEVIKV

SEQ ID NO: 455006 - protein, 9 aa, Influenza virus
RSGFEVIRV

SEQ ID NO: 455007 - protein, 9 aa, Influenza virus
RSGFEVLFI

SEQ ID NO: 455008 - protein, 9 aa, Influenza virus
RSGFEVLKV

SEQ ID NO: 455009 - protein, 9 aa, Influenza virus
RSGFEVLLI

SEQ ID NO: 455010 - protein, 9 aa, Influenza virus
RSGMDPRMC

SEQ ID NO: 455011 - protein, 9 aa, Influenza virus
RSGPSFYAE

SEQ ID NO: 455012 - protein, 9 aa, Influenza virus
RSGQNHGIC

SEQ ID NO: 455013 - protein, 9 aa, Influenza virus
RSGSSFYAE

SEQ ID NO: 455014 - protein, 9 aa, Influenza virus
RSGTSKACN

SEQ ID NO: 455015 - protein, 9 aa, Influenza virus
RSGYEILKV

SEQ ID NO: 455016 - protein, 9 aa, Influenza virus
RSGYEMLKV

SEQ ID NO: 455017 - protein, 9 aa, Influenza virus
RSGYETFKV

SEQ ID NO: 455018 - protein, 9 aa, Influenza virus
RSGYETFRV

SEQ ID NO: 455019 - protein, 9 aa, Influenza virus
RSGYEVLKV

SEQ ID NO: 455020 - protein, 9 aa, Influenza virus
RSGYSGIFS

SEQ ID NO: 455021 - protein, 9 aa, Influenza virus
RSGYSGSFI

SEQ ID NO: 455022 - protein, 9 aa, Influenza virus
RSGYSGVFS

SEQ ID NO: 455023 - protein, 9 aa, Influenza virus
RSGYWAIRT

SEQ ID NO: 455024 - protein, 9 aa, Influenza virus
RSHEQMETG

SEQ ID NO: 455025 - protein, 9 aa, Influenza virus
RSHKICIGY

SEQ ID NO: 455026 - protein, 9 aa, Influenza virus
RSHLRNDTD

SEQ ID NO: 455027 - protein, 9 aa, Influenza virus
RSICEKLEQ

SEQ ID NO: 455028 - protein, 9 aa, Influenza virus
RSIEEKFEI

SEQ ID NO: 455029 - protein, 9 aa, Influenza virus
RSIIFNMER

SEQ ID NO: 455030 - protein, 9 aa, Influenza virus
RSILANNGK

SEQ ID NO: 455031 - protein, 9 aa, Influenza virus
RSILANNGR

SEQ ID NO: 455032 - protein, 9 aa, Influenza virus
RSILASSGS

SEQ ID NO: 455033 - protein, 9 aa, Influenza virus
RSILNTSQR

SEQ ID NO: 455034 - protein, 9 aa, Influenza virus
RSINWLTKK

SEQ ID NO: 455035 - protein, 9 aa, Influenza virus
RSIRWLTLK

SEQ ID NO: 455036 - protein, 9 aa, Influenza virus
RSIVASSGT

SEQ ID NO: 455037 - protein, 9 aa, Influenza virus
RSIVRRATV

SEQ ID NO: 455038 - protein, 9 aa, Influenza virus
RSKFLLMDA

SEQ ID NO: 455039 - protein, 9 aa, Influenza virus
RSKFLLMDS

SEQ ID NO: 455040 - protein, 9 aa, Influenza virus
RSKIITIGS

SEQ ID NO: 455041 - protein, 9 aa, Influenza virus
RSKINEVKL

SEQ ID NO: 455042 - protein, 9 aa, Influenza virus
RSKINGVIL

SEQ ID NO: 455043 - protein, 9 aa, Influenza virus
RSKINGVKL

SEQ ID NO: 455044 - protein, 9 aa, Influenza virus
RSKINGVRL

SEQ ID NO: 455045 - protein, 9 aa, Influenza virus
RSKVNGQSG

SEQ ID NO: 455046 - protein, 9 aa, Influenza virus
RSKYWAIRT

SEQ ID NO: 455047 - protein, 9 aa, Influenza virus
RSLFSSIKK

SEQ ID NO: 455048 - protein, 9 aa, Influenza virus
RSLFSSIKR

SEQ ID NO: 455049 - protein, 9 aa, Influenza virus
RSLIASSGT

SEQ ID NO: 455050 - protein, 9 aa, Influenza virus
RSLIQFPIG

SEQ ID NO: 455051 - protein, 9 aa, Influenza virus
RSLIQFPMG

SEQ ID NO: 455052 - protein, 9 aa, Influenza virus
RSLIRFPIG

SEQ ID NO: 455053 - protein, 9 aa, Influenza virus
RSLIRFPVG

SEQ ID NO: 455054 - protein, 9 aa, Influenza virus
RSLISWPLS

SEQ ID NO: 455055 - protein, 9 aa, Influenza virus
RSLKLAIGL

SEQ ID NO: 455056 - protein, 9 aa, Influenza virus
RSLKLATGL

SEQ ID NO: 455057 - protein, 9 aa, Influenza virus
RSLLLATGM

SEQ ID NO: 455058 - protein, 9 aa, Influenza virus
RSLMLATGM

SEQ ID NO: 455059 - protein, 9 aa, Influenza virus
RSLMSCPVG

SEQ ID NO: 455060 - protein, 9 aa, Influenza virus
RSLVASSGN

SEQ ID NO: 455061 - protein, 9 aa, Influenza virus
RSLVASSGT

SEQ ID NO: 455062 - protein, 9 aa, Influenza virus
RSLWDSFRQ

SEQ ID NO: 455063 - protein, 9 aa, Influenza virus
RSLYSGFVR

SEQ ID NO: 455064 - protein, 9 aa, Influenza virus
RSMKWLTLK

SEQ ID NO: 455065 - protein, 9 aa, Influenza virus
RSMRWLTLK

SEQ ID NO: 455066 - protein, 9 aa, Influenza virus
RSNAPSGIE

SEQ ID NO: 455067 - protein, 9 aa, Influenza virus
RSNAPSGVE

SEQ ID NO: 455068 - protein, 9 aa, Influenza virus
RSNENLIAP

SEQ ID NO: 455069 - protein, 9 aa, Influenza virus
RSNENPAHK

SEQ ID NO: 455070 - protein, 9 aa, Influenza virus
RSNGNLIAP

SEQ ID NO: 455071 - protein, 9 aa, Influenza virus
RSNGNLVAP

SEQ ID NO: 455072 - protein, 9 aa, Influenza virus
RSNIFNMER

SEQ ID NO: 455073 - protein, 9 aa, Influenza virus
RSPFRALIS

SEQ ID NO: 455074 - protein, 9 aa, Influenza virus
RSPFRALVS

SEQ ID NO: 455075 - protein, 9 aa, Influenza virus
RSPFRTLMS

SEQ ID NO: 455076 - protein, 9 aa, Influenza virus
RSPGNAEIE

SEQ ID NO: 455077 - protein, 9 aa, Influenza virus
RSPHRALMS

SEQ ID NO: 455078 - protein, 9 aa, Influenza virus
RSPHRTLLM

SEQ ID NO: 455079 - protein, 9 aa, Influenza virus
RSPHRTLMS

SEQ ID NO: 455080 - protein, 9 aa, Influenza virus
RSPQRTLMS

SEQ ID NO: 455081 - protein, 9 aa, Influenza virus
RSPYRALIS

SEQ ID NO: 455082 - protein, 9 aa, Influenza virus
RSPYRALMS

SEQ ID NO: 455083 - protein, 9 aa, Influenza virus
RSPYRTLLM

SEQ ID NO: 455084 - protein, 9 aa, Influenza virus
RSPYRTLMS

SEQ ID NO: 455085 - protein, 9 aa, Influenza virus
RSQFRALIS

SEQ ID NO: 455086 - protein, 9 aa, Influenza virus
RSQSGRISF

SEQ ID NO: 455087 - protein, 9 aa, Influenza virus
RSQYRALIS

SEQ ID NO: 455088 - protein, 9 aa, Influenza virus
RSQYRALVS

SEQ ID NO: 455089 - protein, 9 aa, Influenza virus
RSQYRSLIS

SEQ ID NO: 455090 - protein, 9 aa, Influenza virus
RSQYSGFVR

SEQ ID NO: 455091 - protein, 9 aa, Influenza virus
RSRIDYYWS

SEQ ID NO: 455092 - protein, 9 aa, Influenza virus
RSRNGFEML

SEQ ID NO: 455093 - protein, 9 aa, Influenza virus
RSRSGFEML

SEQ ID NO: 455094 - protein, 9 aa, Influenza virus
RSRSGFEVL

SEQ ID NO: 455095 - protein, 9 aa, Influenza virus
RSRSSFYAE

SEQ ID NO: 455096 - protein, 9 aa, Influenza virus
RSRYSGFVR

SEQ ID NO: 455097 - protein, 9 aa, Influenza virus
RSRYWAIRT

SEQ ID NO: 455098 - protein, 9 aa, Influenza virus
RSSCHDGKA

SEQ ID NO: 455099 - protein, 9 aa, Influenza virus
RSSFEIIKV

SEQ ID NO: 455100 - protein, 9 aa, Influenza virus
RSSFYAEMK

SEQ ID NO: 455101 - protein, 9 aa, Influenza virus
RSSSSFYAE

SEQ ID NO: 455102 - protein, 9 aa, Influenza virus
RSTIGDCPK

SEQ ID NO: 455103 - protein, 9 aa, Influenza virus
RSWKKQILR

SEQ ID NO: 455104 - protein, 9 aa, Influenza virus
RSWMKIYWH

SEQ ID NO: 455105 - protein, 9 aa, Influenza virus
RSWMKLYWH

SEQ ID NO: 455106 - protein, 9 aa, Influenza virus
RSWRKKILR

SEQ ID NO: 455107 - protein, 9 aa, Influenza virus
RSWRKQILR

SEQ ID NO: 455108 - protein, 9 aa, Influenza virus
RSWRRQILR

SEQ ID NO: 455109 - protein, 9 aa, Influenza virus
RSWSKPQCQ

SEQ ID NO: 455110 - protein, 9 aa, Influenza virus
RSWSYIVER

SEQ ID NO: 455111 - protein, 9 aa, Influenza virus
RSYEQMETD

SEQ ID NO: 455112 - protein, 9 aa, Influenza virus
RSYEQMETG

SEQ ID NO: 455113 - protein, 9 aa, Influenza virus
RSYEQMETS

SEQ ID NO: 455114 - protein, 9 aa, Influenza virus
RSYFTAEVS

SEQ ID NO: 455115 - protein, 9 aa, Influenza virus
RSYNNTSGE

SEQ ID NO: 455116 - protein, 9 aa, Influenza virus
RSYNNTSGG

SEQ ID NO: 455117 - protein, 9 aa, Influenza virus
RSYNNTSGK

SEQ ID NO: 455118 - protein, 9 aa, Influenza virus
RTAFRGLIS

SEQ ID NO: 455119 - protein, 9 aa, Influenza virus
RTAFRGLMS

SEQ ID NO: 455120 - protein, 9 aa, Influenza virus
RTATREGKH

SEQ ID NO: 455121 - protein, 9 aa, Influenza virus
RTAYERMCN

SEQ ID NO: 455122 - protein, 9 aa, Influenza virus
RTCKLLGIN

SEQ ID NO: 455123 - protein, 9 aa, Influenza virus
RTCKLVGIN

SEQ ID NO: 455124 - protein, 9 aa, Influenza virus
RTDGATSAC

SEQ ID NO: 455125 - protein, 9 aa, Influenza virus
RTELINPNK

SEQ ID NO: 455126 - protein, 9 aa, Influenza virus
RTELINPSK

SEQ ID NO: 455127 - protein, 9 aa, Influenza virus
RTELIPPSK

SEQ ID NO: 455128 - protein, 9 aa, Influenza virus
RTELISPNK

SEQ ID NO: 455129 - protein, 9 aa, Influenza virus
RTELISPSK

SEQ ID NO: 455130 - protein, 9 aa, Influenza virus
RTESLQNRI

SEQ ID NO: 455131 - protein, 9 aa, Influenza virus
RTFFGWKEP

SEQ ID NO: 455132 - protein, 9 aa, Influenza virus
RTFFLTHGA

SEQ ID NO: 455133 - protein, 9 aa, Influenza virus
RTFFLTHGS

SEQ ID NO: 455134 - protein, 9 aa, Influenza virus
RTFFLTQGA

SEQ ID NO: 455135 - protein, 9 aa, Influenza virus
RTFFLTQGS

SEQ ID NO: 455136 - protein, 9 aa, Influenza virus
RTFQNIDKN

SEQ ID NO: 455137 - protein, 9 aa, Influenza virus
RTFQNIDRN

SEQ ID NO: 455138 - protein, 9 aa, Influenza virus
RTFQNVSPL

SEQ ID NO: 455139 - protein, 9 aa, Influenza virus
RTFSFQLIL

SEQ ID NO: 455140 - protein, 9 aa, Influenza virus
RTFSFQLIN

SEQ ID NO: 455141 - protein, 9 aa, Influenza virus
RTFSPRSRS

SEQ ID NO: 455142 - protein, 9 aa, Influenza virus
RTGMDPRMC

SEQ ID NO: 455143 - protein, 9 aa, Influenza virus
RTGTFEFTS

SEQ ID NO: 455144 - protein, 9 aa, Influenza virus
RTHESECVC

SEQ ID NO: 455145 - protein, 9 aa, Influenza virus
RTHIHIFSF

SEQ ID NO: 455146 - protein, 9 aa, Influenza virus
RTHQYSEKG

SEQ ID NO: 455147 - protein, 9 aa, Influenza virus
RTHQYSERG

SEQ ID NO: 455148 - protein, 9 aa, Influenza virus
RTINTASRS

SEQ ID NO: 455149 - protein, 9 aa, Influenza virus
RTIQNEDIP

SEQ ID NO: 455150 - protein, 9 aa, Influenza virus
RTISIASRS

SEQ ID NO: 455151 - protein, 9 aa, Influenza virus
RTISKDLRS

SEQ ID NO: 455152 - protein, 9 aa, Influenza virus
RTISKDSRS

SEQ ID NO: 455153 - protein, 9 aa, Influenza virus
RTISKDTRS

SEQ ID NO: 455154 - protein, 9 aa, Influenza virus
RTISMDSRS

SEQ ID NO: 455155 - protein, 9 aa, Influenza virus
RTISPKLRS

SEQ ID NO: 455156 - protein, 9 aa, Influenza virus
RTISPRLRS

SEQ ID NO: 455157 - protein, 9 aa, Influenza virus
RTISPRSRN

SEQ ID NO: 455158 - protein, 9 aa, Influenza virus
RTISPRSRS

SEQ ID NO: 455159 - protein, 9 aa, Influenza virus
RTISRDSRS

SEQ ID NO: 455160 - protein, 9 aa, Influenza virus
RTISTASRS

SEQ ID NO: 455161 - protein, 9 aa, Influenza virus
RTISYSSRS

SEQ ID NO: 455162 - protein, 9 aa, Influenza virus
RTIWTSGSS

SEQ ID NO: 455163 - protein, 9 aa, Influenza virus
RTKEGRRKT

SEQ ID NO: 455164 - protein, 9 aa, Influenza virus
RTKEGRRRT

SEQ ID NO: 455165 - protein, 9 aa, Influenza virus
RTKEMEGIC

SEQ ID NO: 455166 - protein, 9 aa, Influenza virus
RTKNLESRS

SEQ ID NO: 455167 - protein, 9 aa, Influenza virus
RTKSGGNTN

SEQ ID NO: 455168 - protein, 9 aa, Influenza virus
RTKSLESRS

SEQ ID NO: 455169 - protein, 9 aa, Influenza virus
RTLDFHDFN

SEQ ID NO: 455170 - protein, 9 aa, Influenza virus
RTLDFHDSN

SEQ ID NO: 455171 - protein, 9 aa, Influenza virus
RTLDFHDSS

SEQ ID NO: 455172 - protein, 9 aa, Influenza virus
RTLDLHDAN

SEQ ID NO: 455173 - protein, 9 aa, Influenza virus
RTLDLHDSN

SEQ ID NO: 455174 - protein, 9 aa, Influenza virus
RTLDMHDAN

SEQ ID NO: 455175 - protein, 9 aa, Influenza virus
RTLDQHDAN

SEQ ID NO: 455176 - protein, 9 aa, Influenza virus
RTLDYHDSH

SEQ ID NO: 455177 - protein, 9 aa, Influenza virus
RTLDYHDSN

SEQ ID NO: 455178 - protein, 9 aa, Influenza virus
RTLFQQMRD

SEQ ID NO: 455179 - protein, 9 aa, Influenza virus
RTLGFHDSN

SEQ ID NO: 455180 - protein, 9 aa, Influenza virus
RTLGLHDAN

SEQ ID NO: 455181 - protein, 9 aa, Influenza virus
RTLLAKSVF

SEQ ID NO: 455182 - protein, 9 aa, Influenza virus
RTLLMNELG

SEQ ID NO: 455183 - protein, 9 aa, Influenza virus
RTLLMSELG

SEQ ID NO: 455184 - protein, 9 aa, Influenza virus
RTLMSCPIG

SEQ ID NO: 455185 - protein, 9 aa, Influenza virus
RTLMSCPMG

SEQ ID NO: 455186 - protein, 9 aa, Influenza virus
RTLMSCPVG

SEQ ID NO: 455187 - protein, 9 aa, Influenza virus
RTLMSVEIG

SEQ ID NO: 455188 - protein, 9 aa, Influenza virus
RTLMSVEVG

SEQ ID NO: 455189 - protein, 9 aa, Influenza virus
RTLMSVKIG

SEQ ID NO: 455190 - protein, 9 aa, Influenza virus
RTLMSVKVG

SEQ ID NO: 455191 - protein, 9 aa, Influenza virus
RTLNTASRS

SEQ ID NO: 455192 - protein, 9 aa, Influenza virus
RTLTLNTMT

SEQ ID NO: 455193 - protein, 9 aa, Influenza virus
RTLYFHDSN

SEQ ID NO: 455194 - protein, 9 aa, Influenza virus
RTNEKFHQI

SEQ ID NO: 455195 - protein, 9 aa, Influenza virus
RTNEKYHQI

SEQ ID NO: 455196 - protein, 9 aa, Influenza virus
RTNGNLIAP

SEQ ID NO: 455197 - protein, 9 aa, Influenza virus
RTNGTSKIK

SEQ ID NO: 455198 - protein, 9 aa, Influenza virus
RTNGTSKVK

SEQ ID NO: 455199 - protein, 9 aa, Influenza virus
RTNLYGFII

SEQ ID NO: 455200 - protein, 9 aa, Influenza virus
RTNMINDKI

SEQ ID NO: 455201 - protein, 9 aa, Influenza virus
RTNQQFELI

SEQ ID NO: 455202 - protein, 9 aa, Influenza virus
RTPHRTLLM

SEQ ID NO: 455203 - protein, 9 aa, Influenza virus
RTPIAFLTS

SEQ ID NO: 455204 - protein, 9 aa, Influenza virus
RTPYRSLIK

SEQ ID NO: 455205 - protein, 9 aa, Influenza virus
RTPYRSLIQ

SEQ ID NO: 455206 - protein, 9 aa, Influenza virus
RTPYRSLIR

SEQ ID NO: 455207 - protein, 9 aa, Influenza virus
RTPYRTLLM

SEQ ID NO: 455208 - protein, 9 aa, Influenza virus
RTQDSECVS

SEQ ID NO: 455209 - protein, 9 aa, Influenza virus
RTQESECAC

SEQ ID NO: 455210 - protein, 9 aa, Influenza virus
RTQESECIC

SEQ ID NO: 455211 - protein, 9 aa, Influenza virus
RTQESECQC

SEQ ID NO: 455212 - protein, 9 aa, Influenza virus
RTQESECQR

SEQ ID NO: 455213 - protein, 9 aa, Influenza virus
RTQESECVC

SEQ ID NO: 455214 - protein, 9 aa, Influenza virus
RTQESECVR

SEQ ID NO: 455215 - protein, 9 aa, Influenza virus
RTQESGCVC

SEQ ID NO: 455216 - protein, 9 aa, Influenza virus
RTQESSCTC

SEQ ID NO: 455217 - protein, 9 aa, Influenza virus
RTQESSCVC

SEQ ID NO: 455218 - protein, 9 aa, Influenza virus
RTRALVRSG

SEQ ID NO: 455219 - protein, 9 aa, Influenza virus
RTRALVRTG

SEQ ID NO: 455220 - protein, 9 aa, Influenza virus
RTREGRRKT

SEQ ID NO: 455221 - protein, 9 aa, Influenza virus
RTREILTKI

SEQ ID NO: 455222 - protein, 9 aa, Influenza virus
RTREILTKT

SEQ ID NO: 455223 - protein, 9 aa, Influenza virus
RTREILTRT

SEQ ID NO: 455224 - protein, 9 aa, Influenza virus
RTRGILTKT

SEQ ID NO: 455225 - protein, 9 aa, Influenza virus
RTRGLFGAI

SEQ ID NO: 455226 - protein, 9 aa, Influenza virus
RTRSGGNNN

SEQ ID NO: 455227 - protein, 9 aa, Influenza virus
RTRSGGNTN

SEQ ID NO: 455228 - protein, 9 aa, Influenza virus
RTRSGGNTS

SEQ ID NO: 455229 - protein, 9 aa, Influenza virus
RTSDMRAEI

SEQ ID NO: 455230 - protein, 9 aa, Influenza virus
RTSDMRTEI

SEQ ID NO: 455231 - protein, 9 aa, Influenza virus
RTSDMRTEV

SEQ ID NO: 455232 - protein, 9 aa, Influenza virus
RTSHRTLLM

SEQ ID NO: 455233 - protein, 9 aa, Influenza virus
RTSISCLYK

SEQ ID NO: 455234 - protein, 9 aa, Influenza virus
RTSIWTSSS

SEQ ID NO: 455235 - protein, 9 aa, Influenza virus
RTSYRSLIR

SEQ ID NO: 455236 - protein, 9 aa, Influenza virus
RTSYRTLLM

SEQ ID NO: 455237 - protein, 9 aa, Influenza virus
RTTFESNGG

SEQ ID NO: 455238 - protein, 9 aa, Influenza virus
RTTFRGLIS

SEQ ID NO: 455239 - protein, 9 aa, Influenza virus
RTTFRGLLS

SEQ ID NO: 455240 - protein, 9 aa, Influenza virus
RTTNTYRNT

SEQ ID NO: 455241 - protein, 9 aa, Influenza virus
RTTSKDSRS

SEQ ID NO: 455242 - protein, 9 aa, Influenza virus
RTTSTASRS

SEQ ID NO: 455243 - protein, 9 aa, Influenza virus
RTTVDHMAI

SEQ ID NO: 455244 - protein, 9 aa, Influenza virus
RTVGQCPKY

SEQ ID NO: 455245 - protein, 9 aa, Influenza virus
RTVSINGRS

SEQ ID NO: 455246 - protein, 9 aa, Influenza virus
RTVSISGRS

SEQ ID NO: 455247 - protein, 9 aa, Influenza virus
RTVSNSGRS

SEQ ID NO: 455248 - protein, 9 aa, Influenza virus
RTVSSFYSE

SEQ ID NO: 455249 - protein, 9 aa, Influenza virus
RTVSTSGRS

SEQ ID NO: 455250 - protein, 9 aa, Influenza virus
RTWAKNILR

SEQ ID NO: 455251 - protein, 9 aa, Influenza virus
RTYNNTTGR

SEQ ID NO: 455252 - protein, 9 aa, Influenza virus
RTYVDGFEP

SEQ ID NO: 455253 - protein, 9 aa, Influenza virus
RTYVDGFKP

SEQ ID NO: 455254 - protein, 9 aa, Influenza virus
RVARCNTKC

SEQ ID NO: 455255 - protein, 9 aa, Influenza virus
RVAYERMCN

SEQ ID NO: 455256 - protein, 9 aa, Influenza virus
RVDDAVTDI

SEQ ID NO: 455257 - protein, 9 aa, Influenza virus
RVDDAVTDV

SEQ ID NO: 455258 - protein, 9 aa, Influenza virus
RVDFESGRI

SEQ ID NO: 455259 - protein, 9 aa, Influenza virus
RVDINPGHA

SEQ ID NO: 455260 - protein, 9 aa, Influenza virus
RVDINPGHS

SEQ ID NO: 455261 - protein, 9 aa, Influenza virus
RVDKLTQGR

SEQ ID NO: 455262 - protein, 9 aa, Influenza virus
RVDMNPGHA

SEQ ID NO: 455263 - protein, 9 aa, Influenza virus
RVDNHSMSD

SEQ ID NO: 455264 - protein, 9 aa, Influenza virus
RVDRLTQGR

SEQ ID NO: 455265 - protein, 9 aa, Influenza virus
RVDSESGRI

SEQ ID NO: 455266 - protein, 9 aa, Influenza virus
RVDTIIESN

SEQ ID NO: 455267 - protein, 9 aa, Influenza virus
RVDTIMEKN

SEQ ID NO: 455268 - protein, 9 aa, Influenza virus
RVDTNPGHA

SEQ ID NO: 455269 - protein, 9 aa, Influenza virus
RVDVNPGHA

SEQ ID NO: 455270 - protein, 9 aa, Influenza virus
RVECIGWSS

SEQ ID NO: 455271 - protein, 9 aa, Influenza virus
RVEEGSIGK

SEQ ID NO: 455272 - protein, 9 aa, Influenza virus
RVFLAMITY

SEQ ID NO: 455273 - protein, 9 aa, Influenza virus
RVFLTMITY

SEQ ID NO: 455274 - protein, 9 aa, Influenza virus
RVGCVILLN

SEQ ID NO: 455275 - protein, 9 aa, Influenza virus
RVGSRGHVF

SEQ ID NO: 455276 - protein, 9 aa, Influenza virus
RVKIDPVKL

SEQ ID NO: 455277 - protein, 9 aa, Influenza virus
RVKKQLREN

SEQ ID NO: 455278 - protein, 9 aa, Influenza virus
RVKMFDFIK

SEQ ID NO: 455279 - protein, 9 aa, Influenza virus
RVKMFDFSK

SEQ ID NO: 455280 - protein, 9 aa, Influenza virus
RVKMFDFTK

SEQ ID NO: 455281 - protein, 9 aa, Influenza virus
RVKRQLREN

SEQ ID NO: 455282 - protein, 9 aa, Influenza virus
RVKRRPVAK

SEQ ID NO: 455283 - protein, 9 aa, Influenza virus
RVLIRGNSP

SEQ ID NO: 455284 - protein, 9 aa, Influenza virus
RVLKENAID

SEQ ID NO: 455285 - protein, 9 aa, Influenza virus
RVLRENAID

SEQ ID NO: 455286 - protein, 9 aa, Influenza virus
RVLRENAVD

SEQ ID NO: 455287 - protein, 9 aa, Influenza virus
RVLTDTSRP

SEQ ID NO: 455288 - protein, 9 aa, Influenza virus
RVNSIIDKM

SEQ ID NO: 455289 - protein, 9 aa, Influenza virus
RVRHQLREN

SEQ ID NO: 455290 - protein, 9 aa, Influenza virus
RVRKQLREN

SEQ ID NO: 455291 - protein, 9 aa, Influenza virus
RVRKQLRQN

SEQ ID NO: 455292 - protein, 9 aa, Influenza virus
RVRLFDYSR

SEQ ID NO: 455293 - protein, 9 aa, Influenza virus
RVRLQLRDN

SEQ ID NO: 455294 - protein, 9 aa, Influenza virus
RVRMQLRDN

SEQ ID NO: 455295 - protein, 9 aa, Influenza virus
RVRNGTYDH

SEQ ID NO: 455296 - protein, 9 aa, Influenza virus
RVRNQSGRI

SEQ ID NO: 455297 - protein, 9 aa, Influenza virus
RVRRQLREN

SEQ ID NO: 455298 - protein, 9 aa, Influenza virus
RVSAGGDIW

SEQ ID NO: 455299 - protein, 9 aa, Influenza virus
RVSFYWTIV

SEQ ID NO: 455300 - protein, 9 aa, Influenza virus
RVSKMGVDE

SEQ ID NO: 455301 - protein, 9 aa, Influenza virus
RVSKTGVDE

SEQ ID NO: 455302 - protein, 9 aa, Influenza virus
RVSKVGVDE

SEQ ID NO: 455303 - protein, 9 aa, Influenza virus
RVSRMGVDE

SEQ ID NO: 455304 - protein, 9 aa, Influenza virus
RVTCVCRDN

SEQ ID NO: 455305 - protein, 9 aa, Influenza virus
RVTVSTRSD

SEQ ID NO: 455306 - protein, 9 aa, Influenza virus
RVWRQANNG

SEQ ID NO: 455307 - protein, 9 aa, Influenza virus
RVWWTSNSI

SEQ ID NO: 455308 - protein, 9 aa, Influenza virus
RVWWTTNSI

SEQ ID NO: 455309 - protein, 9 aa, Influenza virus
RVYVDGFEP

SEQ ID NO: 455310 - protein, 9 aa, Influenza virus
RVYWIREGK

SEQ ID NO: 455311 - protein, 9 aa, Influenza virus
RVYWIREGR

SEQ ID NO: 455312 - protein, 9 aa, Influenza virus
RWALGENMA

SEQ ID NO: 455313 - protein, 9 aa, Influenza virus
RWETTGRNC

SEQ ID NO: 455314 - protein, 9 aa, Influenza virus
RWKHVTNTI

SEQ ID NO: 455315 - protein, 9 aa, Influenza virus
RWLTLKLGQ

SEQ ID NO: 455316 - protein, 9 aa, Influenza virus
RWLTLKSEQ

SEQ ID NO: 455317 - protein, 9 aa, Influenza virus
RWLTLKSGQ

SEQ ID NO: 455318 - protein, 9 aa, Influenza virus
RWMKIIRVG

SEQ ID NO: 455319 - protein, 9 aa, Influenza virus
RWPGLVAGW

SEQ ID NO: 455320 - protein, 9 aa, Influenza virus
RWSYIVERP

SEQ ID NO: 455321 - protein, 9 aa, Influenza virus
RYELEIGAR

SEQ ID NO: 455322 - protein, 9 aa, Influenza virus
RYELEIGTR

SEQ ID NO: 455323 - protein, 9 aa, Influenza virus
RYERVKMFD

SEQ ID NO: 455324 - protein, 9 aa, Influenza virus
RYGDGVWIG

SEQ ID NO: 455325 - protein, 9 aa, Influenza virus
RYGFVANFS

SEQ ID NO: 455326 - protein, 9 aa, Influenza virus
RYGNGVWIG

SEQ ID NO: 455327 - protein, 9 aa, Influenza virus
RYGPALSIN

SEQ ID NO: 455328 - protein, 9 aa, Influenza virus
RYGPALSIS

SEQ ID NO: 455329 - protein, 9 aa, Influenza virus
RYGVKGFSF

SEQ ID NO: 455330 - protein, 9 aa, Influenza virus
RYGYIIEEY

SEQ ID NO: 455331 - protein, 9 aa, Influenza virus
RYGYIIEKY

SEQ ID NO: 455332 - protein, 9 aa, Influenza virus
RYICSGLVG

SEQ ID NO: 455333 - protein, 9 aa, Influenza virus
RYIPSGSLK

SEQ ID NO: 455334 - protein, 9 aa, Influenza virus
RYLEEHPSA

SEQ ID NO: 455335 - protein, 9 aa, Influenza virus
RYLEENPSA

SEQ ID NO: 455336 - protein, 9 aa, Influenza virus
RYLPDLYDY

SEQ ID NO: 455337 - protein, 9 aa, Influenza virus
RYNGQRSWM

SEQ ID NO: 455338 - protein, 9 aa, Influenza virus
RYPDVRCIC

SEQ ID NO: 455339 - protein, 9 aa, Influenza virus
RYPDVRCTC

SEQ ID NO: 455340 - protein, 9 aa, Influenza virus
RYPDVRCVC

SEQ ID NO: 455341 - protein, 9 aa, Influenza virus
RYPGVRCIC

SEQ ID NO: 455342 - protein, 9 aa, Influenza virus
RYPNVRCVC

SEQ ID NO: 455343 - protein, 9 aa, Influenza virus
RYREEAMQN

SEQ ID NO: 455344 - protein, 9 aa, Influenza virus
RYSGFVRTL

SEQ ID NO: 455345 - protein, 9 aa, Influenza virus
RYSGIKTDG

SEQ ID NO: 455346 - protein, 9 aa, Influenza virus
RYSGIRTDG

SEQ ID NO: 455347 - protein, 9 aa, Influenza virus
RYSIADKIC

SEQ ID NO: 455348 - protein, 9 aa, Influenza virus
RYSKADKIC

SEQ ID NO: 455349 - protein, 9 aa, Influenza virus
RYSRADKIC

SEQ ID NO: 455350 - protein, 9 aa, Influenza virus
RYTYRCHKG

SEQ ID NO: 455351 - protein, 9 aa, Influenza virus
RYTYRCHRG

SEQ ID NO: 455352 - protein, 9 aa, Influenza virus
RYVCSGLVG

SEQ ID NO: 455353 - protein, 9 aa, Influenza virus
RYVCSKFHS

SEQ ID NO: 455354 - protein, 9 aa, Influenza virus
RYVCTGILT

SEQ ID NO: 455355 - protein, 9 aa, Influenza virus
RYVEDTKID

SEQ ID NO: 455356 - protein, 9 aa, Influenza virus
RYVKQGSLK

SEQ ID NO: 455357 - protein, 9 aa, Influenza virus
RYVKQSSLP

SEQ ID NO: 455358 - protein, 9 aa, Influenza virus
RYWAIRTRS

SEQ ID NO: 455359 - protein, 9 aa, Influenza virus
RYYMGECPK

SEQ ID NO: 455360 - protein, 9 aa, Influenza virus
SAAFEDLRI

SEQ ID NO: 455361 - protein, 9 aa, Influenza virus
SAAFEDLRL

SEQ ID NO: 455362 - protein, 9 aa, Influenza virus
SAAFEDLRV

SEQ ID NO: 455363 - protein, 9 aa, Influenza virus
SAASYKRIR

SEQ ID NO: 455364 - protein, 9 aa, Influenza virus
SAASYKRVR

SEQ ID NO: 455365 - protein, 9 aa, Influenza virus
SACHDGASW

SEQ ID NO: 455366 - protein, 9 aa, Influenza virus
SACHDGISW

SEQ ID NO: 455367 - protein, 9 aa, Influenza virus
SACHDGSSW

SEQ ID NO: 455368 - protein, 9 aa, Influenza virus
SACHDGTNW

SEQ ID NO: 455369 - protein, 9 aa, Influenza virus
SACHDGTSW

SEQ ID NO: 455370 - protein, 9 aa, Influenza virus
SACITPNGS

SEQ ID NO: 455371 - protein, 9 aa, Influenza virus
SACKRTVSS

SEQ ID NO: 455372 - protein, 9 aa, Influenza virus
SACLRGGRN

SEQ ID NO: 455373 - protein, 9 aa, Influenza virus
SACYNPCFY

SEQ ID NO: 455374 - protein, 9 aa, Influenza virus
SADGDIWVT

SEQ ID NO: 455375 - protein, 9 aa, Influenza virus
SADHRIYWI

SEQ ID NO: 455376 - protein, 9 aa, Influenza virus
SADHRVYWI

SEQ ID NO: 455377 - protein, 9 aa, Influenza virus
SADMSIGIT

SEQ ID NO: 455378 - protein, 9 aa, Influenza virus
SADMSIGVT

SEQ ID NO: 455379 - protein, 9 aa, Influenza virus
SADPLASLL

SEQ ID NO: 455380 - protein, 9 aa, Influenza virus
SADPLLSLL

SEQ ID NO: 455381 - protein, 9 aa, Influenza virus
SAEHIEECS

SEQ ID NO: 455382 - protein, 9 aa, Influenza virus
SAESRKLLL

SEQ ID NO: 455383 - protein, 9 aa, Influenza virus
SAESRKMLL

SEQ ID NO: 455384 - protein, 9 aa, Influenza virus
SAFDERRNK

SEQ ID NO: 455385 - protein, 9 aa, Influenza virus
SAFDERRNR

SEQ ID NO: 455386 - protein, 9 aa, Influenza virus
SAGALASCM

SEQ ID NO: 455387 - protein, 9 aa, Influenza virus
SAGGAIWVT

SEQ ID NO: 455388 - protein, 9 aa, Influenza virus
SAGGDIWIT

SEQ ID NO: 455389 - protein, 9 aa, Influenza virus
SAGGDIWVT

SEQ ID NO: 455390 - protein, 9 aa, Influenza virus
SAGGHIWVT

SEQ ID NO: 455391 - protein, 9 aa, Influenza virus
SAGGNIWIT

SEQ ID NO: 455392 - protein, 9 aa, Influenza virus
SAGKDPKKT

SEQ ID NO: 455393 - protein, 9 aa, Influenza virus
SAGQISIQP

SEQ ID NO: 455394 - protein, 9 aa, Influenza virus
SAGQISTQP

SEQ ID NO: 455395 - protein, 9 aa, Influenza virus
SAGQISVQP

SEQ ID NO: 455396 - protein, 9 aa, Influenza virus
SAGQTSVQP

SEQ ID NO: 455397 - protein, 9 aa, Influenza virus
SAGQVSVQP

SEQ ID NO: 455398 - protein, 9 aa, Influenza virus
SAGRDPKKT

SEQ ID NO: 455399 - protein, 9 aa, Influenza virus
SAIDQITGK

SEQ ID NO: 455400 - protein, 9 aa, Influenza virus
SAIDQITGT

SEQ ID NO: 455401 - protein, 9 aa, Influenza virus
SAIDQITRK

SEQ ID NO: 455402 - protein, 9 aa, Influenza virus
SAIDQVTGK

SEQ ID NO: 455403 - protein, 9 aa, Influenza virus
SAINQITGK

SEQ ID NO: 455404 - protein, 9 aa, Influenza virus
SAKELVETN

SEQ ID NO: 455405 - protein, 9 aa, Influenza virus
SAKHIEECS

SEQ ID NO: 455406 - protein, 9 aa, Influenza virus
SAKHVEECS

SEQ ID NO: 455407 - protein, 9 aa, Influenza virus
SALFVYSLR

SEQ ID NO: 455408 - protein, 9 aa, Influenza virus
SALGSPGCD

SEQ ID NO: 455409 - protein, 9 aa, Influenza virus
SALILRGAV

SEQ ID NO: 455410 - protein, 9 aa, Influenza virus
SALILRGSI

SEQ ID NO: 455411 - protein, 9 aa, Influenza virus
SALILRGSV

SEQ ID NO: 455412 - protein, 9 aa, Influenza virus
SAMHIEECS

SEQ ID NO: 455413 - protein, 9 aa, Influenza virus
SAPEGMCYP

SEQ ID NO: 455414 - protein, 9 aa, Influenza virus
SAPGVKGFG

SEQ ID NO: 455415 - protein, 9 aa, Influenza virus
SAPHGLCYP

SEQ ID NO: 455416 - protein, 9 aa, Influenza virus
SAPHRLCYP

SEQ ID NO: 455417 - protein, 9 aa, Influenza virus
SAPPEQSRM

SEQ ID NO: 455418 - protein, 9 aa, Influenza virus
SAQEKNDLY

SEQ ID NO: 455419 - protein, 9 aa, Influenza virus
SAQHIEECS

SEQ ID NO: 455420 - protein, 9 aa, Influenza virus
SAQHVEECS

SEQ ID NO: 455421 - protein, 9 aa, Influenza virus
SARHIEECP

SEQ ID NO: 455422 - protein, 9 aa, Influenza virus
SARHIEECS

SEQ ID NO: 455423 - protein, 9 aa, Influenza virus
SARHIEEWS

SEQ ID NO: 455424 - protein, 9 aa, Influenza virus
SARHVEECS

SEQ ID NO: 455425 - protein, 9 aa, Influenza virus
SARQEKNPA

SEQ ID NO: 455426 - protein, 9 aa, Influenza virus
SARSALILR

SEQ ID NO: 455427 - protein, 9 aa, Influenza virus
SASACHDGI

SEQ ID NO: 455428 - protein, 9 aa, Influenza virus
SASACHDGL

SEQ ID NO: 455429 - protein, 9 aa, Influenza virus
SASACHDGM

SEQ ID NO: 455430 - protein, 9 aa, Influenza virus
SASACHDGS

SEQ ID NO: 455431 - protein, 9 aa, Influenza virus
SASACHDGT

SEQ ID NO: 455432 - protein, 9 aa, Influenza virus
SASACHDGV

SEQ ID NO: 455433 - protein, 9 aa, Influenza virus
SASALILRG

SEQ ID NO: 455434 - protein, 9 aa, Influenza virus
SASCHDGRA

SEQ ID NO: 455435 - protein, 9 aa, Influenza virus
SASGDIWIT

SEQ ID NO: 455436 - protein, 9 aa, Influenza virus
SASGDIWVT

SEQ ID NO: 455437 - protein, 9 aa, Influenza virus
SASGKADTR

SEQ ID NO: 455438 - protein, 9 aa, Influenza virus
SASGQAYTK

SEQ ID NO: 455439 - protein, 9 aa, Influenza virus
SASGRADTK

SEQ ID NO: 455440 - protein, 9 aa, Influenza virus
SASGRADTR

SEQ ID NO: 455441 - protein, 9 aa, Influenza virus
SASSISFCG

SEQ ID NO: 455442 - protein, 9 aa, Influenza virus
SASSQAHTK

SEQ ID NO: 455443 - protein, 9 aa, Influenza virus
SASSQAYTK

SEQ ID NO: 455444 - protein, 9 aa, Influenza virus
SASTGGQSF

SEQ ID NO: 455445 - protein, 9 aa, Influenza virus
SATACHDGK

SEQ ID NO: 455446 - protein, 9 aa, Influenza virus
SATACHDGR

SEQ ID NO: 455447 - protein, 9 aa, Influenza virus
SATACSDGP

SEQ ID NO: 455448 - protein, 9 aa, Influenza virus
SATACSDGS

SEQ ID NO: 455449 - protein, 9 aa, Influenza virus
SATGMALSV

SEQ ID NO: 455450 - protein, 9 aa, Influenza virus
SATGMILSV

SEQ ID NO: 455451 - protein, 9 aa, Influenza virus
SATGMTLSV

SEQ ID NO: 455452 - protein, 9 aa, Influenza virus
SATGPADTR

SEQ ID NO: 455453 - protein, 9 aa, Influenza virus
SATGPAETR

SEQ ID NO: 455454 - protein, 9 aa, Influenza virus
SATGVTLSV

SEQ ID NO: 455455 - protein, 9 aa, Influenza virus
SAVDQITGK

SEQ ID NO: 455456 - protein, 9 aa, Influenza virus
SAVLRGFLI

SEQ ID NO: 455457 - protein, 9 aa, Influenza virus
SAVNQITGK

SEQ ID NO: 455458 - protein, 9 aa, Influenza virus
SAYCNTDLG

SEQ ID NO: 455459 - protein, 9 aa, Influenza virus
SAYERMCNI

SEQ ID NO: 455460 - protein, 9 aa, Influenza virus
SCAAMDDFQ

SEQ ID NO: 455461 - protein, 9 aa, Influenza virus
SCAAMDEFQ

SEQ ID NO: 455462 - protein, 9 aa, Influenza virus
SCAAMEDFQ

SEQ ID NO: 455463 - protein, 9 aa, Influenza virus
SCASNINIR

SEQ ID NO: 455464 - protein, 9 aa, Influenza virus
SCATNINIR

SEQ ID NO: 455465 - protein, 9 aa, Influenza virus
SCAVVMTDG

SEQ ID NO: 455466 - protein, 9 aa, Influenza virus
SCDPDECRF

SEQ ID NO: 455467 - protein, 9 aa, Influenza virus
SCDPDGCRF

SEQ ID NO: 455468 - protein, 9 aa, Influenza virus
SCDPIGCKM

SEQ ID NO: 455469 - protein, 9 aa, Influenza virus
SCDPLGCKM

SEQ ID NO: 455470 - protein, 9 aa, Influenza virus
SCDPLGCRM

SEQ ID NO: 455471 - protein, 9 aa, Influenza virus
SCDPNECRF

SEQ ID NO: 455472 - protein, 9 aa, Influenza virus
SCDPSGCKM

SEQ ID NO: 455473 - protein, 9 aa, Influenza virus
SCDPTGCKM

SEQ ID NO: 455474 - protein, 9 aa, Influenza virus
SCDSPSNIN

SEQ ID NO: 455475 - protein, 9 aa, Influenza virus
SCDSPSNVK

SEQ ID NO: 455476 - protein, 9 aa, Influenza virus
SCDSPSNVN

SEQ ID NO: 455477 - protein, 9 aa, Influenza virus
SCEGECFYS

SEQ ID NO: 455478 - protein, 9 aa, Influenza virus
SCEPDECRF

SEQ ID NO: 455479 - protein, 9 aa, Influenza virus
SCFDGKEWL

SEQ ID NO: 455480 - protein, 9 aa, Influenza virus
SCFDGKEWM

SEQ ID NO: 455481 - protein, 9 aa, Influenza virus
SCFDGREWM

SEQ ID NO: 455482 - protein, 9 aa, Influenza virus
SCFILLAIA

SEQ ID NO: 455483 - protein, 9 aa, Influenza virus
SCFILLAIV

SEQ ID NO: 455484 - protein, 9 aa, Influenza virus
SCFILLAVI

SEQ ID NO: 455485 - protein, 9 aa, Influenza virus
SCFLLAALL

SEQ ID NO: 455486 - protein, 9 aa, Influenza virus
SCFLLIALL

SEQ ID NO: 455487 - protein, 9 aa, Influenza virus
SCFLLLAIA

SEQ ID NO: 455488 - protein, 9 aa, Influenza virus
SCFLLLAIV

SEQ ID NO: 455489 - protein, 9 aa, Influenza virus
SCFLLLAVV

SEQ ID NO: 455490 - protein, 9 aa, Influenza virus
SCFLLVALF

SEQ ID NO: 455491 - protein, 9 aa, Influenza virus
SCFLLVALL

SEQ ID NO: 455492 - protein, 9 aa, Influenza virus
SCFTIMTDG

SEQ ID NO: 455493 - protein, 9 aa, Influenza virus
SCFTLMTDG

SEQ ID NO: 455494 - protein, 9 aa, Influenza virus
SCFTVLTDG

SEQ ID NO: 455495 - protein, 9 aa, Influenza virus
SCFTVMTDG

SEQ ID NO: 455496 - protein, 9 aa, Influenza virus
SCFVFVALI

SEQ ID NO: 455497 - protein, 9 aa, Influenza virus
SCFVLLAAI

SEQ ID NO: 455498 - protein, 9 aa, Influenza virus
SCFVLLAIV

SEQ ID NO: 455499 - protein, 9 aa, Influenza virus
SCFVLLAVI

SEQ ID NO: 455500 - protein, 9 aa, Influenza virus
SCFVLLAVV

SEQ ID NO: 455501 - protein, 9 aa, Influenza virus
SCGILGTII

SEQ ID NO: 455502 - protein, 9 aa, Influenza virus
SCGPSECRT

SEQ ID NO: 455503 - protein, 9 aa, Influenza virus
SCHDGIGRM

SEQ ID NO: 455504 - protein, 9 aa, Influenza virus
SCHDGISRM

SEQ ID NO: 455505 - protein, 9 aa, Influenza virus
SCHDGKARM

SEQ ID NO: 455506 - protein, 9 aa, Influenza virus
SCHDGKAWL

SEQ ID NO: 455507 - protein, 9 aa, Influenza virus
SCHDGKEWL

SEQ ID NO: 455508 - protein, 9 aa, Influenza virus
SCHDGKFRM

SEQ ID NO: 455509 - protein, 9 aa, Influenza virus
SCHDGKSRM

SEQ ID NO: 455510 - protein, 9 aa, Influenza virus
SCHDGKSWL

SEQ ID NO: 455511 - protein, 9 aa, Influenza virus
SCHDGMSRM

SEQ ID NO: 455512 - protein, 9 aa, Influenza virus
SCHDGNAWL

SEQ ID NO: 455513 - protein, 9 aa, Influenza virus
SCHDGRARM

SEQ ID NO: 455514 - protein, 9 aa, Influenza virus
SCHDGRAWL

SEQ ID NO: 455515 - protein, 9 aa, Influenza virus
SCHDGRSRM

SEQ ID NO: 455516 - protein, 9 aa, Influenza virus
SCHDGVGRM

SEQ ID NO: 455517 - protein, 9 aa, Influenza virus
SCHDGVSRM

SEQ ID NO: 455518 - protein, 9 aa, Influenza virus
SCHIGVAPS

SEQ ID NO: 455519 - protein, 9 aa, Influenza virus
SCHTKCQTY

SEQ ID NO: 455520 - protein, 9 aa, Influenza virus
SCIASSIVL

SEQ ID NO: 455521 - protein, 9 aa, Influenza virus
SCIASSIVM

SEQ ID NO: 455522 - protein, 9 aa, Influenza virus
SCIASSLIL

SEQ ID NO: 455523 - protein, 9 aa, Influenza virus
SCIASSLVL

SEQ ID NO: 455524 - protein, 9 aa, Influenza virus
SCIASSTVL

SEQ ID NO: 455525 - protein, 9 aa, Influenza virus
SCIASSTVM

SEQ ID NO: 455526 - protein, 9 aa, Influenza virus
SCIASSVVL

SEQ ID NO: 455527 - protein, 9 aa, Influenza virus
SCIESIRNG

SEQ ID NO: 455528 - protein, 9 aa, Influenza virus
SCINRCFYV

SEQ ID NO: 455529 - protein, 9 aa, Influenza virus
SCKMYALHQ

SEQ ID NO: 455530 - protein, 9 aa, Influenza virus
SCLPACAYG

SEQ ID NO: 455531 - protein, 9 aa, Influenza virus
SCLPACIYG

SEQ ID NO: 455532 - protein, 9 aa, Influenza virus
SCLPACVYG

SEQ ID NO: 455533 - protein, 9 aa, Influenza virus
SCLVPCFWV

SEQ ID NO: 455534 - protein, 9 aa, Influenza virus
SCLYKLSQF

SEQ ID NO: 455535 - protein, 9 aa, Influenza virus
SCMDTIRNG

SEQ ID NO: 455536 - protein, 9 aa, Influenza virus
SCMEAIRNG

SEQ ID NO: 455537 - protein, 9 aa, Influenza virus
SCMERIRNN

SEQ ID NO: 455538 - protein, 9 aa, Influenza virus
SCMESIRNN

SEQ ID NO: 455539 - protein, 9 aa, Influenza virus
SCMETIRNG

SEQ ID NO: 455540 - protein, 9 aa, Influenza virus
SCMGLIYNR

SEQ ID NO: 455541 - protein, 9 aa, Influenza virus
SCPIGEAPS

SEQ ID NO: 455542 - protein, 9 aa, Influenza virus
SCPIGEVPS

SEQ ID NO: 455543 - protein, 9 aa, Influenza virus
SCPIGVAPS

SEQ ID NO: 455544 - protein, 9 aa, Influenza virus
SCPLGEAPS

SEQ ID NO: 455545 - protein, 9 aa, Influenza virus
SCPMGVAPS

SEQ ID NO: 455546 - protein, 9 aa, Influenza virus
SCPVGEAPS

SEQ ID NO: 455547 - protein, 9 aa, Influenza virus
SCPVGVAPS

SEQ ID NO: 455548 - protein, 9 aa, Influenza virus
SCSHLECRT

SEQ ID NO: 455549 - protein, 9 aa, Influenza virus
SCSHMECRT

SEQ ID NO: 455550 - protein, 9 aa, Influenza virus
SCSHSECRT

SEQ ID NO: 455551 - protein, 9 aa, Influenza virus
SCSIDECRT

SEQ ID NO: 455552 - protein, 9 aa, Influenza virus
SCSIHECRT

SEQ ID NO: 455553 - protein, 9 aa, Influenza virus
SCSINECRT

SEQ ID NO: 455554 - protein, 9 aa, Influenza virus
SCSISECRT

SEQ ID NO: 455555 - protein, 9 aa, Influenza virus
SCSQNILRT

SEQ ID NO: 455556 - protein, 9 aa, Influenza virus
SCSSPSGIE

SEQ ID NO: 455557 - protein, 9 aa, Influenza virus
SCSVSECRT

SEQ ID NO: 455558 - protein, 9 aa, Influenza virus
SCSYLECRT

SEQ ID NO: 455559 - protein, 9 aa, Influenza virus
SCTSPCLTD

SEQ ID NO: 455560 - protein, 9 aa, Influenza virus
SCTVVMTDG

SEQ ID NO: 455561 - protein, 9 aa, Influenza virus
SCVCRDNWQ

SEQ ID NO: 455562 - protein, 9 aa, Influenza virus
SCVMLLAIA

SEQ ID NO: 455563 - protein, 9 aa, Influenza virus
SCVNRCFYV

SEQ ID NO: 455564 - protein, 9 aa, Influenza virus
SCYDGKAWL

SEQ ID NO: 455565 - protein, 9 aa, Influenza virus
SCYMDIDVY

SEQ ID NO: 455566 - protein, 9 aa, Influenza virus
SCYPNDGKV

SEQ ID NO: 455567 - protein, 9 aa, Influenza virus
SCYPNEGKV

SEQ ID NO: 455568 - protein, 9 aa, Influenza virus
SCYPNLGIV

SEQ ID NO: 455569 - protein, 9 aa, Influenza virus
SCYPNLGKV

SEQ ID NO: 455570 - protein, 9 aa, Influenza virus
SCYPNLGQV

SEQ ID NO: 455571 - protein, 9 aa, Influenza virus
SCYPNMGKV

SEQ ID NO: 455572 - protein, 9 aa, Influenza virus
SCYPNNGKV

SEQ ID NO: 455573 - protein, 9 aa, Influenza virus
SCYPNSGKV

SEQ ID NO: 455574 - protein, 9 aa, Influenza virus
SCYPQYPDV

SEQ ID NO: 455575 - protein, 9 aa, Influenza virus
SCYPQYPNV

SEQ ID NO: 455576 - protein, 9 aa, Influenza virus
SCYPRYPDV

SEQ ID NO: 455577 - protein, 9 aa, Influenza virus
SCYPRYPGV

SEQ ID NO: 455578 - protein, 9 aa, Influenza virus
SCYPRYPNV

SEQ ID NO: 455579 - protein, 9 aa, Influenza virus
SCYVDIDIY

SEQ ID NO: 455580 - protein, 9 aa, Influenza virus
SCYVDIDVY

SEQ ID NO: 455581 - protein, 9 aa, Influenza virus
SCYVDTDVY

SEQ ID NO: 455582 - protein, 9 aa, Influenza virus
SCYVDVDVY

SEQ ID NO: 455583 - protein, 9 aa, Influenza virus
SDAPFLDRL

SEQ ID NO: 455584 - protein, 9 aa, Influenza virus
SDAQAFYKI

SEQ ID NO: 455585 - protein, 9 aa, Influenza virus
SDAQAFYKL

SEQ ID NO: 455586 - protein, 9 aa, Influenza virus
SDAQIDESC

SEQ ID NO: 455587 - protein, 9 aa, Influenza virus
SDDFALILN

SEQ ID NO: 455588 - protein, 9 aa, Influenza virus
SDDFALIVN

SEQ ID NO: 455589 - protein, 9 aa, Influenza virus
SDDNVYKAL

SEQ ID NO: 455590 - protein, 9 aa, Influenza virus
SDDSVYKAL

SEQ ID NO: 455591 - protein, 9 aa, Influenza virus
SDEALKMTI

SEQ ID NO: 455592 - protein, 9 aa, Influenza virus
SDFHFIDEQ

SEQ ID NO: 455593 - protein, 9 aa, Influenza virus
SDFHFIDER

SEQ ID NO: 455594 - protein, 9 aa, Influenza virus
SDFHFINEL

SEQ ID NO: 455595 - protein, 9 aa, Influenza virus
SDFHFINEQ

SEQ ID NO: 455596 - protein, 9 aa, Influenza virus
SDFHFINER

SEQ ID NO: 455597 - protein, 9 aa, Influenza virus
SDFICVGWS

SEQ ID NO: 455598 - protein, 9 aa, Influenza virus
SDFLCVGWS

SEQ ID NO: 455599 - protein, 9 aa, Influenza virus
SDFMCVGWS

SEQ ID NO: 455600 - protein, 9 aa, Influenza virus
SDGAFLAPR

SEQ ID NO: 455601 - protein, 9 aa, Influenza virus
SDGGPNLYN

SEQ ID NO: 455602 - protein, 9 aa, Influenza virus
SDGNLIAPW

SEQ ID NO: 455603 - protein, 9 aa, Influenza virus
SDGPGWLTI

SEQ ID NO: 455604 - protein, 9 aa, Influenza virus
SDGPGWLTL

SEQ ID NO: 455605 - protein, 9 aa, Influenza virus
SDGSGWLTL

SEQ ID NO: 455606 - protein, 9 aa, Influenza virus
SDHICIGYH

SEQ ID NO: 455607 - protein, 9 aa, Influenza virus
SDICYPGKF

SEQ ID NO: 455608 - protein, 9 aa, Influenza virus
SDICYPGRF

SEQ ID NO: 455609 - protein, 9 aa, Influenza virus
SDIEAMASQ

SEQ ID NO: 455610 - protein, 9 aa, Influenza virus
SDIEAMATQ

SEQ ID NO: 455611 - protein, 9 aa, Influenza virus
SDIGAMASQ

SEQ ID NO: 455612 - protein, 9 aa, Influenza virus
SDILVTREP

SEQ ID NO: 455613 - protein, 9 aa, Influenza virus
SDINIMASQ

SEQ ID NO: 455614 - protein, 9 aa, Influenza virus
SDKICIGYH

SEQ ID NO: 455615 - protein, 9 aa, Influenza virus
SDKICLGHH

SEQ ID NO: 455616 - protein, 9 aa, Influenza virus
SDKIDDQIE

SEQ ID NO: 455617 - protein, 9 aa, Influenza virus
SDKLYIWGV

SEQ ID NO: 455618 - protein, 9 aa, Influenza virus
SDKPFQNVS

SEQ ID NO: 455619 - protein, 9 aa, Influenza virus
SDKRIGSCT

SEQ ID NO: 455620 - protein, 9 aa, Influenza virus
SDKVDTLLE

SEQ ID NO: 455621 - protein, 9 aa, Influenza virus
SDLDYQIGY

SEQ ID NO: 455622 - protein, 9 aa, Influenza virus
SDLEALMEW

SEQ ID NO: 455623 - protein, 9 aa, Influenza virus
SDLIIERKE

SEQ ID NO: 455624 - protein, 9 aa, Influenza virus
SDLIIERRE

SEQ ID NO: 455625 - protein, 9 aa, Influenza virus
SDLNYQIGY

SEQ ID NO: 455626 - protein, 9 aa, Influenza virus
SDMRAEIIK

SEQ ID NO: 455627 - protein, 9 aa, Influenza virus
SDMRAEIIR

SEQ ID NO: 455628 - protein, 9 aa, Influenza virus
SDMRTEIIK

SEQ ID NO: 455629 - protein, 9 aa, Influenza virus
SDMRTEIIR

SEQ ID NO: 455630 - protein, 9 aa, Influenza virus
SDMRTEVIR

SEQ ID NO: 455631 - protein, 9 aa, Influenza virus
SDNADKICL

SEQ ID NO: 455632 - protein, 9 aa, Influenza virus
SDNEQTDLY

SEQ ID NO: 455633 - protein, 9 aa, Influenza virus
SDNGGLIAP

SEQ ID NO: 455634 - protein, 9 aa, Influenza virus
SDNRSGYSG

SEQ ID NO: 455635 - protein, 9 aa, Influenza virus
SDQICIGHH

SEQ ID NO: 455636 - protein, 9 aa, Influenza virus
SDQICIGYH

SEQ ID NO: 455637 - protein, 9 aa, Influenza virus
SDQICVGYH

SEQ ID NO: 455638 - protein, 9 aa, Influenza virus
SDQISIVPN

SEQ ID NO: 455639 - protein, 9 aa, Influenza virus
SDQLKLATG

SEQ ID NO: 455640 - protein, 9 aa, Influenza virus
SDRICIGYH

SEQ ID NO: 455641 - protein, 9 aa, Influenza virus
SDRLVLAIG

SEQ ID NO: 455642 - protein, 9 aa, Influenza virus
SDRLVLATG

SEQ ID NO: 455643 - protein, 9 aa, Influenza virus
SDSIKSWRK

SEQ ID NO: 455644 - protein, 9 aa, Influenza virus
SDTPRGEDA

SEQ ID NO: 455645 - protein, 9 aa, Influenza virus
SDTPRGEDG

SEQ ID NO: 455646 - protein, 9 aa, Influenza virus
SDTPRGEDN

SEQ ID NO: 455647 - protein, 9 aa, Influenza virus
SDTPRGEDS

SEQ ID NO: 455648 - protein, 9 aa, Influenza virus
SDTPRPADP

SEQ ID NO: 455649 - protein, 9 aa, Influenza virus
SDTPRPDDP

SEQ ID NO: 455650 - protein, 9 aa, Influenza virus
SDTPRPSDP

SEQ ID NO: 455651 - protein, 9 aa, Influenza virus
SDTPRPTDP

SEQ ID NO: 455652 - protein, 9 aa, Influenza virus
SDTPRPVDP

SEQ ID NO: 455653 - protein, 9 aa, Influenza virus
SDTTCWSWP

SEQ ID NO: 455654 - protein, 9 aa, Influenza virus
SDTTGWPWP

SEQ ID NO: 455655 - protein, 9 aa, Influenza virus
SDTTGWSWP

SEQ ID NO: 455656 - protein, 9 aa, Influenza virus
SDTTSWSWP

SEQ ID NO: 455657 - protein, 9 aa, Influenza virus
SDTVDTLTE

SEQ ID NO: 455658 - protein, 9 aa, Influenza virus
SDVLVTREP

SEQ ID NO: 455659 - protein, 9 aa, Influenza virus
SDVWLGRTV

SEQ ID NO: 455660 - protein, 9 aa, Influenza virus
SDVWMGRTI

SEQ ID NO: 455661 - protein, 9 aa, Influenza virus
SDWSGYSGS

SEQ ID NO: 455662 - protein, 9 aa, Influenza virus
SDYEELKHL

SEQ ID NO: 455663 - protein, 9 aa, Influenza virus
SEAPGWSWD

SEQ ID NO: 455664 - protein, 9 aa, Influenza virus
SECACINGS

SEQ ID NO: 455665 - protein, 9 aa, Influenza virus
SECACVNGS

SEQ ID NO: 455666 - protein, 9 aa, Influenza virus
SECICINGT

SEQ ID NO: 455667 - protein, 9 aa, Influenza virus
SECITPNGS

SEQ ID NO: 455668 - protein, 9 aa, Influenza virus
SECRTFFLT

SEQ ID NO: 455669 - protein, 9 aa, Influenza virus
SECVCHDGT

SEQ ID NO: 455670 - protein, 9 aa, Influenza virus
SECVCHKGI

SEQ ID NO: 455671 - protein, 9 aa, Influenza virus
SECVCHKGV

SEQ ID NO: 455672 - protein, 9 aa, Influenza virus
SECVCHNGI

SEQ ID NO: 455673 - protein, 9 aa, Influenza virus
SECVCHNGT

SEQ ID NO: 455674 - protein, 9 aa, Influenza virus
SECVCHNGV

SEQ ID NO: 455675 - protein, 9 aa, Influenza virus
SECVCHNST

SEQ ID NO: 455676 - protein, 9 aa, Influenza virus
SECVCHSGI

SEQ ID NO: 455677 - protein, 9 aa, Influenza virus
SECVCINGI

SEQ ID NO: 455678 - protein, 9 aa, Influenza virus
SECVCINGS

SEQ ID NO: 455679 - protein, 9 aa, Influenza virus
SECVCINGT

SEQ ID NO: 455680 - protein, 9 aa, Influenza virus
SECVCISGT

SEQ ID NO: 455681 - protein, 9 aa, Influenza virus
SECVCMNGS

SEQ ID NO: 455682 - protein, 9 aa, Influenza virus
SECVCQDEF

SEQ ID NO: 455683 - protein, 9 aa, Influenza virus
SECVCQNGV

SEQ ID NO: 455684 - protein, 9 aa, Influenza virus
SECVCVNGS

SEQ ID NO: 455685 - protein, 9 aa, Influenza virus
SECVRHNGT

SEQ ID NO: 455686 - protein, 9 aa, Influenza virus
SECVSHNGT

SEQ ID NO: 455687 - protein, 9 aa, Influenza virus
SECYNPCFY

SEQ ID NO: 455688 - protein, 9 aa, Influenza virus
SEDGVYKAL

SEQ ID NO: 455689 - protein, 9 aa, Influenza virus
SEDNVYKAL

SEQ ID NO: 455690 - protein, 9 aa, Influenza virus
SEDNVYKVL

SEQ ID NO: 455691 - protein, 9 aa, Influenza virus
SEDNVYRAL

SEQ ID NO: 455692 - protein, 9 aa, Influenza virus
SEDSRSGYE

SEQ ID NO: 455693 - protein, 9 aa, Influenza virus
SEEALRQKI

SEQ ID NO: 455694 - protein, 9 aa, Influenza virus
SEFICVGWS

SEQ ID NO: 455695 - protein, 9 aa, Influenza virus
SEFLCVGWS

SEQ ID NO: 455696 - protein, 9 aa, Influenza virus
SEFNEIEHQ

SEQ ID NO: 455697 - protein, 9 aa, Influenza virus
SEFNEIEYQ

SEQ ID NO: 455698 - protein, 9 aa, Influenza virus
SEFNKACEL

SEQ ID NO: 455699 - protein, 9 aa, Influenza virus
SEFSEIEHQ

SEQ ID NO: 455700 - protein, 9 aa, Influenza virus
SEFSETEHQ

SEQ ID NO: 455701 - protein, 9 aa, Influenza virus
SEGIGQAAD

SEQ ID NO: 455702 - protein, 9 aa, Influenza virus
SEGMGQAAD

SEQ ID NO: 455703 - protein, 9 aa, Influenza virus
SEGRGQAAD

SEQ ID NO: 455704 - protein, 9 aa, Influenza virus
SEGRTSDMR

SEQ ID NO: 455705 - protein, 9 aa, Influenza virus
SEGTGIAAD

SEQ ID NO: 455706 - protein, 9 aa, Influenza virus
SEGTGIVAD

SEQ ID NO: 455707 - protein, 9 aa, Influenza virus
SEGTGMAAD

SEQ ID NO: 455708 - protein, 9 aa, Influenza virus
SEGTGQAAD

SEQ ID NO: 455709 - protein, 9 aa, Influenza virus
SEGTGTAAD

SEQ ID NO: 455710 - protein, 9 aa, Influenza virus
SEHTAYSQI

SEQ ID NO: 455711 - protein, 9 aa, Influenza virus
SEIEGRIQD

SEQ ID NO: 455712 - protein, 9 aa, Influenza virus
SEIEHQIGN

SEQ ID NO: 455713 - protein, 9 aa, Influenza virus
SEIEHQISN

SEQ ID NO: 455714 - protein, 9 aa, Influenza virus
SEIEQQIGN

SEQ ID NO: 455715 - protein, 9 aa, Influenza virus
SEKLVLATG

SEQ ID NO: 455716 - protein, 9 aa, Influenza virus
SEKVDTLLE

SEQ ID NO: 455717 - protein, 9 aa, Influenza virus
SEKVNTLLE

SEQ ID NO: 455718 - protein, 9 aa, Influenza virus
SELGVPFHL

SEQ ID NO: 455719 - protein, 9 aa, Influenza virus
SEMDKLFER

SEQ ID NO: 455720 - protein, 9 aa, Influenza virus
SEMDKLYER

SEQ ID NO: 455721 - protein, 9 aa, Influenza virus
SEMDKLYTR

SEQ ID NO: 455722 - protein, 9 aa, Influenza virus
SEMKKLYER

SEQ ID NO: 455723 - protein, 9 aa, Influenza virus
SEMKWLLSS

SEQ ID NO: 455724 - protein, 9 aa, Influenza virus
SEMKWLSSS

SEQ ID NO: 455725 - protein, 9 aa, Influenza virus
SEMLNLYDR

SEQ ID NO: 455726 - protein, 9 aa, Influenza virus
SEMLNLYER

SEQ ID NO: 455727 - protein, 9 aa, Influenza virus
SEMNKLFEK

SEQ ID NO: 455728 - protein, 9 aa, Influenza virus
SEMNKLFER

SEQ ID NO: 455729 - protein, 9 aa, Influenza virus
SEMNKLHER

SEQ ID NO: 455730 - protein, 9 aa, Influenza virus
SEMNKLYEK

SEQ ID NO: 455731 - protein, 9 aa, Influenza virus
SEMNKLYER

SEQ ID NO: 455732 - protein, 9 aa, Influenza virus
SEMNRLFER

SEQ ID NO: 455733 - protein, 9 aa, Influenza virus
SEMSKLFEK

SEQ ID NO: 455734 - protein, 9 aa, Influenza virus
SEMSKLFER

SEQ ID NO: 455735 - protein, 9 aa, Influenza virus
SEMSKLYER

SEQ ID NO: 455736 - protein, 9 aa, Influenza virus
SEQAAEAIE

SEQ ID NO: 455737 - protein, 9 aa, Influenza virus
SEQAAEAMD

SEQ ID NO: 455738 - protein, 9 aa, Influenza virus
SEQAAEAME

SEQ ID NO: 455739 - protein, 9 aa, Influenza virus
SEQFPVQTD

SEQ ID NO: 455740 - protein, 9 aa, Influenza virus
SEQIIVTRE

SEQ ID NO: 455741 - protein, 9 aa, Influenza virus
SEQIVVTRE

SEQ ID NO: 455742 - protein, 9 aa, Influenza virus
SEQMETGGE

SEQ ID NO: 455743 - protein, 9 aa, Influenza virus
SEQNVPVTQ

SEQ ID NO: 455744 - protein, 9 aa, Influenza virus
SEQTKLYGN

SEQ ID NO: 455745 - protein, 9 aa, Influenza virus
SEQTKLYGS

SEQ ID NO: 455746 - protein, 9 aa, Influenza virus
SEQVIVTRE

SEQ ID NO: 455747 - protein, 9 aa, Influenza virus
SERGEDTIE

SEQ ID NO: 455748 - protein, 9 aa, Influenza virus
SERGEETIE

SEQ ID NO: 455749 - protein, 9 aa, Influenza virus
SERGEETVE

SEQ ID NO: 455750 - protein, 9 aa, Influenza virus
SERGLFGAI

SEQ ID NO: 455751 - protein, 9 aa, Influenza virus
SERGLQRRR

SEQ ID NO: 455752 - protein, 9 aa, Influenza virus
SERLVLATG

SEQ ID NO: 455753 - protein, 9 aa, Influenza virus
SERVDTLLE

SEQ ID NO: 455754 - protein, 9 aa, Influenza virus
SESGRLIDF

SEQ ID NO: 455755 - protein, 9 aa, Influenza virus
SESRSNIFN

SEQ ID NO: 455756 - protein, 9 aa, Influenza virus
SESSFYAEM

SEQ ID NO: 455757 - protein, 9 aa, Influenza virus
SETEHQIGN

SEQ ID NO: 455758 - protein, 9 aa, Influenza virus
SETGAPQLN

SEQ ID NO: 455759 - protein, 9 aa, Influenza virus
SEVEGRIQD

SEQ ID NO: 455760 - protein, 9 aa, Influenza virus
SEVPEWSWD

SEQ ID NO: 455761 - protein, 9 aa, Influenza virus
SEVPGWSWD

SEQ ID NO: 455762 - protein, 9 aa, Influenza virus
SEVPGWSWG

SEQ ID NO: 455763 - protein, 9 aa, Influenza virus
SEWSYIVEK

SEQ ID NO: 455764 - protein, 9 aa, Influenza virus
SFAGWILGN

SEQ ID NO: 455765 - protein, 9 aa, Influenza virus
SFAISCFLI

SEQ ID NO: 455766 - protein, 9 aa, Influenza virus
SFAISCFLL

SEQ ID NO: 455767 - protein, 9 aa, Influenza virus
SFAISCLLL

SEQ ID NO: 455768 - protein, 9 aa, Influenza virus
SFALAQGAL

SEQ ID NO: 455769 - protein, 9 aa, Influenza virus
SFALAQGTL

SEQ ID NO: 455770 - protein, 9 aa, Influenza virus
SFALAQGVL

SEQ ID NO: 455771 - protein, 9 aa, Influenza virus
SFAMSCFLL

SEQ ID NO: 455772 - protein, 9 aa, Influenza virus
SFATSCFLL

SEQ ID NO: 455773 - protein, 9 aa, Influenza virus
SFCLKNGNM

SEQ ID NO: 455774 - protein, 9 aa, Influenza virus
SFEGWIGGN

SEQ ID NO: 455775 - protein, 9 aa, Influenza virus
SFEGWIVGN

SEQ ID NO: 455776 - protein, 9 aa, Influenza virus
SFEKFEIFP

SEQ ID NO: 455777 - protein, 9 aa, Influenza virus
SFEQITFIQ

SEQ ID NO: 455778 - protein, 9 aa, Influenza virus
SFEQITFLQ

SEQ ID NO: 455779 - protein, 9 aa, Influenza virus
SFEQITFMQ

SEQ ID NO: 455780 - protein, 9 aa, Influenza virus
SFERFEIFP

SEQ ID NO: 455781 - protein, 9 aa, Influenza virus
SFERFEMFP

SEQ ID NO: 455782 - protein, 9 aa, Influenza virus
SFESNGGLL

SEQ ID NO: 455783 - protein, 9 aa, Influenza virus
SFESNGNFI

SEQ ID NO: 455784 - protein, 9 aa, Influenza virus
SFESTGNLI

SEQ ID NO: 455785 - protein, 9 aa, Influenza virus
SFESTGNLV

SEQ ID NO: 455786 - protein, 9 aa, Influenza virus
SFFRHMVWL

SEQ ID NO: 455787 - protein, 9 aa, Influenza virus
SFFRNIVWL

SEQ ID NO: 455788 - protein, 9 aa, Influenza virus
SFFRNMIWL

SEQ ID NO: 455789 - protein, 9 aa, Influenza virus
SFFRNMVWL

SEQ ID NO: 455790 - protein, 9 aa, Influenza virus
SFFRNVIWL

SEQ ID NO: 455791 - protein, 9 aa, Influenza virus
SFFRNVVWI

SEQ ID NO: 455792 - protein, 9 aa, Influenza virus
SFFRNVVWL

SEQ ID NO: 455793 - protein, 9 aa, Influenza virus
SFFSKLNWL

SEQ ID NO: 455794 - protein, 9 aa, Influenza virus
SFFSRLNWL

SEQ ID NO: 455795 - protein, 9 aa, Influenza virus
SFFYRYGFV

SEQ ID NO: 455796 - protein, 9 aa, Influenza virus
SFGASCFIL

SEQ ID NO: 455797 - protein, 9 aa, Influenza virus
SFGASCFLF

SEQ ID NO: 455798 - protein, 9 aa, Influenza virus
SFGASCFLL

SEQ ID NO: 455799 - protein, 9 aa, Influenza virus
SFGASCFTL

SEQ ID NO: 455800 - protein, 9 aa, Influenza virus
SFGASCFVL

SEQ ID NO: 455801 - protein, 9 aa, Influenza virus
SFGASCLIL

SEQ ID NO: 455802 - protein, 9 aa, Influenza virus
SFGASCVML

SEQ ID NO: 455803 - protein, 9 aa, Influenza virus
SFGASSFVL

SEQ ID NO: 455804 - protein, 9 aa, Influenza virus
SFGGFTFKR

SEQ ID NO: 455805 - protein, 9 aa, Influenza virus
SFGVSGINE

SEQ ID NO: 455806 - protein, 9 aa, Influenza virus
SFGVSGVNE

SEQ ID NO: 455807 - protein, 9 aa, Influenza virus
SFHLGTKQV

SEQ ID NO: 455808 - protein, 9 aa, Influenza virus
SFIDYWAEG

SEQ ID NO: 455809 - protein, 9 aa, Influenza virus
SFIDYWAKE

SEQ ID NO: 455810 - protein, 9 aa, Influenza virus
SFIDYWAKG

SEQ ID NO: 455811 - protein, 9 aa, Influenza virus
SFIGEEMAT

SEQ ID NO: 455812 - protein, 9 aa, Influenza virus
SFIQHPELT

SEQ ID NO: 455813 - protein, 9 aa, Influenza virus
SFKPNIGPR

SEQ ID NO: 455814 - protein, 9 aa, Influenza virus
SFKYGNGVW

SEQ ID NO: 455815 - protein, 9 aa, Influenza virus
SFLAHALKL

SEQ ID NO: 455816 - protein, 9 aa, Influenza virus
SFLTHALRF

SEQ ID NO: 455817 - protein, 9 aa, Influenza virus
SFLVHALKS

SEQ ID NO: 455818 - protein, 9 aa, Influenza virus
SFMDYWAEG

SEQ ID NO: 455819 - protein, 9 aa, Influenza virus
SFNDYEELK

SEQ ID NO: 455820 - protein, 9 aa, Influenza virus
SFNGAFIAP

SEQ ID NO: 455821 - protein, 9 aa, Influenza virus
SFNGAFVAP

SEQ ID NO: 455822 - protein, 9 aa, Influenza virus
SFNGEEMAT

SEQ ID NO: 455823 - protein, 9 aa, Influenza virus
SFNNYEELK

SEQ ID NO: 455824 - protein, 9 aa, Influenza virus
SFPDGAKIQ

SEQ ID NO: 455825 - protein, 9 aa, Influenza virus
SFPDGAQIK

SEQ ID NO: 455826 - protein, 9 aa, Influenza virus
SFPDGAQIQ

SEQ ID NO: 455827 - protein, 9 aa, Influenza virus
SFPDGARIQ

SEQ ID NO: 455828 - protein, 9 aa, Influenza virus
SFPQTTNTY

SEQ ID NO: 455829 - protein, 9 aa, Influenza virus
SFQGGHIEE

SEQ ID NO: 455830 - protein, 9 aa, Influenza virus
SFQGRGVFE

SEQ ID NO: 455831 - protein, 9 aa, Influenza virus
SFQLINNKK

SEQ ID NO: 455832 - protein, 9 aa, Influenza virus
SFQPNIGPR

SEQ ID NO: 455833 - protein, 9 aa, Influenza virus
SFQSGHIEE

SEQ ID NO: 455834 - protein, 9 aa, Influenza virus
SFQVDCFLW

SEQ ID NO: 455835 - protein, 9 aa, Influenza virus
SFQVDCYLW

SEQ ID NO: 455836 - protein, 9 aa, Influenza virus
SFRAYVDGF

SEQ ID NO: 455837 - protein, 9 aa, Influenza virus
SFRGRGVFE

SEQ ID NO: 455838 - protein, 9 aa, Influenza virus
SFRPNIGPR

SEQ ID NO: 455839 - protein, 9 aa, Influenza virus
SFRQSERGE

SEQ ID NO: 455840 - protein, 9 aa, Influenza virus
SFRYGDGVW

SEQ ID NO: 455841 - protein, 9 aa, Influenza virus
SFRYGNGVW

SEQ ID NO: 455842 - protein, 9 aa, Influenza virus
SFSFGGFTF

SEQ ID NO: 455843 - protein, 9 aa, Influenza virus
SFSIRGETT

SEQ ID NO: 455844 - protein, 9 aa, Influenza virus
SFSIRWETT

SEQ ID NO: 455845 - protein, 9 aa, Influenza virus
SFSISCFLL

SEQ ID NO: 455846 - protein, 9 aa, Influenza virus
SFSMSCFVF

SEQ ID NO: 455847 - protein, 9 aa, Influenza virus
SFSPSPGAR

SEQ ID NO: 455848 - protein, 9 aa, Influenza virus
SFSPSPGDR

SEQ ID NO: 455849 - protein, 9 aa, Influenza virus
SFSRTELIA

SEQ ID NO: 455850 - protein, 9 aa, Influenza virus
SFSRTELIN

SEQ ID NO: 455851 - protein, 9 aa, Influenza virus
SFSRTELIP

SEQ ID NO: 455852 - protein, 9 aa, Influenza virus
SFSRTELIS

SEQ ID NO: 455853 - protein, 9 aa, Influenza virus
SFSRTQLIA

SEQ ID NO: 455854 - protein, 9 aa, Influenza virus
SFTGEEMAS

SEQ ID NO: 455855 - protein, 9 aa, Influenza virus
SFTGEEMAT

SEQ ID NO: 455856 - protein, 9 aa, Influenza virus
SFTGWILGN

SEQ ID NO: 455857 - protein, 9 aa, Influenza virus
SFTITGDNT

SEQ ID NO: 455858 - protein, 9 aa, Influenza virus
SFTPSPGAR

SEQ ID NO: 455859 - protein, 9 aa, Influenza virus
SFTPSPGTR

SEQ ID NO: 455860 - protein, 9 aa, Influenza virus
SFVDYWAEG

SEQ ID NO: 455861 - protein, 9 aa, Influenza virus
SFVPSPGAR

SEQ ID NO: 455862 - protein, 9 aa, Influenza virus
SFVPSPGSR

SEQ ID NO: 455863 - protein, 9 aa, Influenza virus
SFVPSPGVR

SEQ ID NO: 455864 - protein, 9 aa, Influenza virus
SFVPVVGAR

SEQ ID NO: 455865 - protein, 9 aa, Influenza virus
SFVQHPELT

SEQ ID NO: 455866 - protein, 9 aa, Influenza virus
SFVQHPEMT

SEQ ID NO: 455867 - protein, 9 aa, Influenza virus
SFWMCPNGS

SEQ ID NO: 455868 - protein, 9 aa, Influenza virus
SFWMCSGHS

SEQ ID NO: 455869 - protein, 9 aa, Influenza virus
SFWMCSNGS

SEQ ID NO: 455870 - protein, 9 aa, Influenza virus
SFYAELKWL

SEQ ID NO: 455871 - protein, 9 aa, Influenza virus
SFYAELRWL

SEQ ID NO: 455872 - protein, 9 aa, Influenza virus
SFYAEMEWL

SEQ ID NO: 455873 - protein, 9 aa, Influenza virus
SFYAEMKWL

SEQ ID NO: 455874 - protein, 9 aa, Influenza virus
SFYAEVKWL

SEQ ID NO: 455875 - protein, 9 aa, Influenza virus
SFYGELKWL

SEQ ID NO: 455876 - protein, 9 aa, Influenza virus
SFYRNLAWF

SEQ ID NO: 455877 - protein, 9 aa, Influenza virus
SFYRNLIWF

SEQ ID NO: 455878 - protein, 9 aa, Influenza virus
SFYRNLIWL

SEQ ID NO: 455879 - protein, 9 aa, Influenza virus
SFYRNLLWI

SEQ ID NO: 455880 - protein, 9 aa, Influenza virus
SFYRNLLWM

SEQ ID NO: 455881 - protein, 9 aa, Influenza virus
SFYRNLVWF

SEQ ID NO: 455882 - protein, 9 aa, Influenza virus
SFYRNLVWI

SEQ ID NO: 455883 - protein, 9 aa, Influenza virus
SFYRNLVWL

SEQ ID NO: 455884 - protein, 9 aa, Influenza virus
SFYRNMRWL

SEQ ID NO: 455885 - protein, 9 aa, Influenza virus
SFYRNVVWL

SEQ ID NO: 455886 - protein, 9 aa, Influenza virus
SFYRSINWL

SEQ ID NO: 455887 - protein, 9 aa, Influenza virus
SFYRSIRWL

SEQ ID NO: 455888 - protein, 9 aa, Influenza virus
SFYRSMKWL

SEQ ID NO: 455889 - protein, 9 aa, Influenza virus
SFYRSMRWL

SEQ ID NO: 455890 - protein, 9 aa, Influenza virus
SFYSEMKWL

SEQ ID NO: 455891 - protein, 9 aa, Influenza virus
SFYTELKWL

SEQ ID NO: 455892 - protein, 9 aa, Influenza virus
SFYWTIVDP

SEQ ID NO: 455893 - protein, 9 aa, Influenza virus
SFYWTIVEP

SEQ ID NO: 455894 - protein, 9 aa, Influenza virus
SGAAGAAIK

SEQ ID NO: 455895 - protein, 9 aa, Influenza virus
SGAAGAAVK

SEQ ID NO: 455896 - protein, 9 aa, Influenza virus
SGADDDAYA

SEQ ID NO: 455897 - protein, 9 aa, Influenza virus
SGADDEAYA

SEQ ID NO: 455898 - protein, 9 aa, Influenza virus
SGADNDAYA

SEQ ID NO: 455899 - protein, 9 aa, Influenza virus
SGAVAVLKY

SEQ ID NO: 455900 - protein, 9 aa, Influenza virus
SGCITPNGS

SEQ ID NO: 455901 - protein, 9 aa, Influenza virus
SGCKMYALH

SEQ ID NO: 455902 - protein, 9 aa, Influenza virus
SGDDVWMGR

SEQ ID NO: 455903 - protein, 9 aa, Influenza virus
SGDIWITRE

SEQ ID NO: 455904 - protein, 9 aa, Influenza virus
SGDIWVTRE

SEQ ID NO: 455905 - protein, 9 aa, Influenza virus
SGDVWVTRE

SEQ ID NO: 455906 - protein, 9 aa, Influenza virus
SGDYARLYI

SEQ ID NO: 455907 - protein, 9 aa, Influenza virus
SGEQMLIIW

SEQ ID NO: 455908 - protein, 9 aa, Influenza virus
SGEQMLVIW

SEQ ID NO: 455909 - protein, 9 aa, Influenza virus
SGEVPGWSW

SEQ ID NO: 455910 - protein, 9 aa, Influenza virus
SGFAIASKD

SEQ ID NO: 455911 - protein, 9 aa, Influenza virus
SGFAIFSKD

SEQ ID NO: 455912 - protein, 9 aa, Influenza virus
SGFAIISKD

SEQ ID NO: 455913 - protein, 9 aa, Influenza virus
SGFAIVSKD

SEQ ID NO: 455914 - protein, 9 aa, Influenza virus
SGFAVVSKD

SEQ ID NO: 455915 - protein, 9 aa, Influenza virus
SGFEIIWDP

SEQ ID NO: 455916 - protein, 9 aa, Influenza virus
SGFEILLIE

SEQ ID NO: 455917 - protein, 9 aa, Influenza virus
SGFEMIWDA

SEQ ID NO: 455918 - protein, 9 aa, Influenza virus
SGFEMIWDP

SEQ ID NO: 455919 - protein, 9 aa, Influenza virus
SGFEMLKIH

SEQ ID NO: 455920 - protein, 9 aa, Influenza virus
SGFEMLKIP

SEQ ID NO: 455921 - protein, 9 aa, Influenza virus
SGFEMLKVP

SEQ ID NO: 455922 - protein, 9 aa, Influenza virus
SGFEMLRIP

SEQ ID NO: 455923 - protein, 9 aa, Influenza virus
SGFEMVWDA

SEQ ID NO: 455924 - protein, 9 aa, Influenza virus
SGFEMVWDP

SEQ ID NO: 455925 - protein, 9 aa, Influenza virus
SGFEVLFIE

SEQ ID NO: 455926 - protein, 9 aa, Influenza virus
SGFEVLKVP

SEQ ID NO: 455927 - protein, 9 aa, Influenza virus
SGFEVLLIE

SEQ ID NO: 455928 - protein, 9 aa, Influenza virus
SGFFGDNPR

SEQ ID NO: 455929 - protein, 9 aa, Influenza virus
SGFFPDGPQ

SEQ ID NO: 455930 - protein, 9 aa, Influenza virus
SGFVRTLFQ

SEQ ID NO: 455931 - protein, 9 aa, Influenza virus
SGGGDIWVT

SEQ ID NO: 455932 - protein, 9 aa, Influenza virus
SGGHIEECS

SEQ ID NO: 455933 - protein, 9 aa, Influenza virus
SGGIDKEPM

SEQ ID NO: 455934 - protein, 9 aa, Influenza virus
SGGIDKESM

SEQ ID NO: 455935 - protein, 9 aa, Influenza virus
SGGIDKIGT

SEQ ID NO: 455936 - protein, 9 aa, Influenza virus
SGGIDKIST

SEQ ID NO: 455937 - protein, 9 aa, Influenza virus
SGGIDKVST

SEQ ID NO: 455938 - protein, 9 aa, Influenza virus
SGGISKIST

SEQ ID NO: 455939 - protein, 9 aa, Influenza virus
SGGISKMST

SEQ ID NO: 455940 - protein, 9 aa, Influenza virus
SGGLLAPRY

SEQ ID NO: 455941 - protein, 9 aa, Influenza virus
SGGTINSPL

SEQ ID NO: 455942 - protein, 9 aa, Influenza virus
SGGYKDIIL

SEQ ID NO: 455943 - protein, 9 aa, Influenza virus
SGGYKDVIL

SEQ ID NO: 455944 - protein, 9 aa, Influenza virus
SGHDFEREG

SEQ ID NO: 455945 - protein, 9 aa, Influenza virus
SGHSCRICI

SEQ ID NO: 455946 - protein, 9 aa, Influenza virus
SGHWPDGSN

SEQ ID NO: 455947 - protein, 9 aa, Influenza virus
SGIAIALGI

SEQ ID NO: 455948 - protein, 9 aa, Influenza virus
SGIAIVLGI

SEQ ID NO: 455949 - protein, 9 aa, Influenza virus
SGICPVVFT

SEQ ID NO: 455950 - protein, 9 aa, Influenza virus
SGIEYNGKS

SEQ ID NO: 455951 - protein, 9 aa, Influenza virus
SGIFGDNPR

SEQ ID NO: 455952 - protein, 9 aa, Influenza virus
SGIFSVEGK

SEQ ID NO: 455953 - protein, 9 aa, Influenza virus
SGIFSVEHK

SEQ ID NO: 455954 - protein, 9 aa, Influenza virus
SGIFSVENK

SEQ ID NO: 455955 - protein, 9 aa, Influenza virus
SGIFSVESK

SEQ ID NO: 455956 - protein, 9 aa, Influenza virus
SGIGRFYIQ

SEQ ID NO: 455957 - protein, 9 aa, Influenza virus
SGIKSFSRT

SEQ ID NO: 455958 - protein, 9 aa, Influenza virus
SGIKTDGAT

SEQ ID NO: 455959 - protein, 9 aa, Influenza virus
SGIMKTEGT

SEQ ID NO: 455960 - protein, 9 aa, Influenza virus
SGIMKTEKT

SEQ ID NO: 455961 - protein, 9 aa, Influenza virus
SGIMKTGGT

SEQ ID NO: 455962 - protein, 9 aa, Influenza virus
SGINESADM

SEQ ID NO: 455963 - protein, 9 aa, Influenza virus
SGIPPLELG

SEQ ID NO: 455964 - protein, 9 aa, Influenza virus
SGIRSFSRT

SEQ ID NO: 455965 - protein, 9 aa, Influenza virus
SGIRTDGAT

SEQ ID NO: 455966 - protein, 9 aa, Influenza virus
SGKADTRIL

SEQ ID NO: 455967 - protein, 9 aa, Influenza virus
SGKQMLIIW

SEQ ID NO: 455968 - protein, 9 aa, Influenza virus
SGKVECVCR

SEQ ID NO: 455969 - protein, 9 aa, Influenza virus
SGLIAGWYG

SEQ ID NO: 455970 - protein, 9 aa, Influenza virus
SGLPVGGNE

SEQ ID NO: 455971 - protein, 9 aa, Influenza virus
SGLRILIRG

SEQ ID NO: 455972 - protein, 9 aa, Influenza virus
SGLRILVRG

SEQ ID NO: 455973 - protein, 9 aa, Influenza virus
SGLRNVPAI

SEQ ID NO: 455974 - protein, 9 aa, Influenza virus
SGLTHIMIW

SEQ ID NO: 455975 - protein, 9 aa, Influenza virus
SGLVAGWYG

SEQ ID NO: 455976 - protein, 9 aa, Influenza virus
SGLVGDTPR

SEQ ID NO: 455977 - protein, 9 aa, Influenza virus
SGMDPRMCS

SEQ ID NO: 455978 - protein, 9 aa, Influenza virus
SGMIDGWYG

SEQ ID NO: 455979 - protein, 9 aa, Influenza virus
SGMRILIRG

SEQ ID NO: 455980 - protein, 9 aa, Influenza virus
SGMRILVRG

SEQ ID NO: 455981 - protein, 9 aa, Influenza virus
SGMSANGDI

SEQ ID NO: 455982 - protein, 9 aa, Influenza virus
SGNAQHVEE

SEQ ID NO: 455983 - protein, 9 aa, Influenza virus
SGNCRFNVC

SEQ ID NO: 455984 - protein, 9 aa, Influenza virus
SGNCRFSVC

SEQ ID NO: 455985 - protein, 9 aa, Influenza virus
SGNGDPNNM

SEQ ID NO: 455986 - protein, 9 aa, Influenza virus
SGNLIAPEY

SEQ ID NO: 455987 - protein, 9 aa, Influenza virus
SGNNQVFPQ

SEQ ID NO: 455988 - protein, 9 aa, Influenza virus
SGNWPDGSD

SEQ ID NO: 455989 - protein, 9 aa, Influenza virus
SGNWPDGSN

SEQ ID NO: 455990 - protein, 9 aa, Influenza virus
SGPDDGAVA

SEQ ID NO: 455991 - protein, 9 aa, Influenza virus
SGPDNEAVA

SEQ ID NO: 455992 - protein, 9 aa, Influenza virus
SGPDNGAVA

SEQ ID NO: 455993 - protein, 9 aa, Influenza virus
SGPDSGAVA

SEQ ID NO: 455994 - protein, 9 aa, Influenza virus
SGPLKAEIA

SEQ ID NO: 455995 - protein, 9 aa, Influenza virus
SGPNDNASA

SEQ ID NO: 455996 - protein, 9 aa, Influenza virus
SGPNNNASA

SEQ ID NO: 455997 - protein, 9 aa, Influenza virus
SGPSFYAEM

SEQ ID NO: 455998 - protein, 9 aa, Influenza virus
SGQFPVQTD

SEQ ID NO: 455999 - protein, 9 aa, Influenza virus
SGQLKLATG

SEQ ID NO: 456000 - protein, 9 aa, Influenza virus
SGQNHGICA

SEQ ID NO: 456001 - protein, 9 aa, Influenza virus
SGRADTKIL

SEQ ID NO: 456002 - protein, 9 aa, Influenza virus
SGRADTRIL

SEQ ID NO: 456003 - protein, 9 aa, Influenza virus
SGREWSYIV

SEQ ID NO: 456004 - protein, 9 aa, Influenza virus
SGRIDFHWA

SEQ ID NO: 456005 - protein, 9 aa, Influenza virus
SGRIDFHWL

SEQ ID NO: 456006 - protein, 9 aa, Influenza virus
SGRIDFHWM

SEQ ID NO: 456007 - protein, 9 aa, Influenza virus
SGRIDFHWT

SEQ ID NO: 456008 - protein, 9 aa, Influenza virus
SGRIDFYWL

SEQ ID NO: 456009 - protein, 9 aa, Influenza virus
SGRIFQSGV

SEQ ID NO: 456010 - protein, 9 aa, Influenza virus
SGRINFHWL

SEQ ID NO: 456011 - protein, 9 aa, Influenza virus
SGRINFHWT

SEQ ID NO: 456012 - protein, 9 aa, Influenza virus
SGRISFYWT

SEQ ID NO: 456013 - protein, 9 aa, Influenza virus
SGRISIYWT

SEQ ID NO: 456014 - protein, 9 aa, Influenza virus
SGRLGFEII

SEQ ID NO: 456015 - protein, 9 aa, Influenza virus
SGRLIDFLK

SEQ ID NO: 456016 - protein, 9 aa, Influenza virus
SGRLMDFLK

SEQ ID NO: 456017 - protein, 9 aa, Influenza virus
SGRQEKNPA

SEQ ID NO: 456018 - protein, 9 aa, Influenza virus
SGRQEKNPS

SEQ ID NO: 456019 - protein, 9 aa, Influenza virus
SGRSGFEII

SEQ ID NO: 456020 - protein, 9 aa, Influenza virus
SGRSGFEVI

SEQ ID NO: 456021 - protein, 9 aa, Influenza virus
SGRSSFEII

SEQ ID NO: 456022 - protein, 9 aa, Influenza virus
SGRSSFFRN

SEQ ID NO: 456023 - protein, 9 aa, Influenza virus
SGRVSFYWT

SEQ ID NO: 456024 - protein, 9 aa, Influenza virus
SGSAQHIEE

SEQ ID NO: 456025 - protein, 9 aa, Influenza virus
SGSAQHVEE

SEQ ID NO: 456026 - protein, 9 aa, Influenza virus
SGSFIDYWA

SEQ ID NO: 456027 - protein, 9 aa, Influenza virus
SGSFIDYWD

SEQ ID NO: 456028 - protein, 9 aa, Influenza virus
SGSFIDYWN

SEQ ID NO: 456029 - protein, 9 aa, Influenza virus
SGSFIQHPE

SEQ ID NO: 456030 - protein, 9 aa, Influenza virus
SGSFMDYWA

SEQ ID NO: 456031 - protein, 9 aa, Influenza virus
SGSFPDGAK

SEQ ID NO: 456032 - protein, 9 aa, Influenza virus
SGSFPDGAQ

SEQ ID NO: 456033 - protein, 9 aa, Influenza virus
SGSFPNGAQ

SEQ ID NO: 456034 - protein, 9 aa, Influenza virus
SGSFSIRGE

SEQ ID NO: 456035 - protein, 9 aa, Influenza virus
SGSFSIRWE

SEQ ID NO: 456036 - protein, 9 aa, Influenza virus
SGSFTLPIE

SEQ ID NO: 456037 - protein, 9 aa, Influenza virus
SGSFTLPVE

SEQ ID NO: 456038 - protein, 9 aa, Influenza virus
SGSFTLPVG

SEQ ID NO: 456039 - protein, 9 aa, Influenza virus
SGSFVDYWA

SEQ ID NO: 456040 - protein, 9 aa, Influenza virus
SGSFVQHPE

SEQ ID NO: 456041 - protein, 9 aa, Influenza virus
SGSIISFCG

SEQ ID NO: 456042 - protein, 9 aa, Influenza virus
SGSLEFIAE

SEQ ID NO: 456043 - protein, 9 aa, Influenza virus
SGSLKLAIG

SEQ ID NO: 456044 - protein, 9 aa, Influenza virus
SGSLPDGAQ

SEQ ID NO: 456045 - protein, 9 aa, Influenza virus
SGSQKQEFK

SEQ ID NO: 456046 - protein, 9 aa, Influenza virus
SGSSFYAEL

SEQ ID NO: 456047 - protein, 9 aa, Influenza virus
SGSSFYAEM

SEQ ID NO: 456048 - protein, 9 aa, Influenza virus
SGSSIAFCG

SEQ ID NO: 456049 - protein, 9 aa, Influenza virus
SGSSISFCG

SEQ ID NO: 456050 - protein, 9 aa, Influenza virus
SGSWPDGAD

SEQ ID NO: 456051 - protein, 9 aa, Influenza virus
SGTCAVVMT

SEQ ID NO: 456052 - protein, 9 aa, Influenza virus
SGTDNYGVK

SEQ ID NO: 456053 - protein, 9 aa, Influenza virus
SGTNNYGVK

SEQ ID NO: 456054 - protein, 9 aa, Influenza virus
SGTSKACNA

SEQ ID NO: 456055 - protein, 9 aa, Influenza virus
SGTSKACSA

SEQ ID NO: 456056 - protein, 9 aa, Influenza virus
SGTYGAGSW

SEQ ID NO: 456057 - protein, 9 aa, Influenza virus
SGTYGSGSW

SEQ ID NO: 456058 - protein, 9 aa, Influenza virus
SGTYGTGSW

SEQ ID NO: 456059 - protein, 9 aa, Influenza virus
SGTYGTGTW

SEQ ID NO: 456060 - protein, 9 aa, Influenza virus
SGVAIALSI

SEQ ID NO: 456061 - protein, 9 aa, Influenza virus
SGVAIALSV

SEQ ID NO: 456062 - protein, 9 aa, Influenza virus
SGVCPVVFT

SEQ ID NO: 456063 - protein, 9 aa, Influenza virus
SGVESAVLR

SEQ ID NO: 456064 - protein, 9 aa, Influenza virus
SGVEYNGKS

SEQ ID NO: 456065 - protein, 9 aa, Influenza virus
SGVFGDNPR

SEQ ID NO: 456066 - protein, 9 aa, Influenza virus
SGVFGDSPR

SEQ ID NO: 456067 - protein, 9 aa, Influenza virus
SGVFGDTPR

SEQ ID NO: 456068 - protein, 9 aa, Influenza virus
SGVFSVEGK

SEQ ID NO: 456069 - protein, 9 aa, Influenza virus
SGVKGWAFD

SEQ ID NO: 456070 - protein, 9 aa, Influenza virus
SGVKLEENS

SEQ ID NO: 456071 - protein, 9 aa, Influenza virus
SGVLGDNPR

SEQ ID NO: 456072 - protein, 9 aa, Influenza virus
SGVMKTEGT

SEQ ID NO: 456073 - protein, 9 aa, Influenza virus
SGVNESADM

SEQ ID NO: 456074 - protein, 9 aa, Influenza virus
SGVNSFSRT

SEQ ID NO: 456075 - protein, 9 aa, Influenza virus
SGWLLGNPM

SEQ ID NO: 456076 - protein, 9 aa, Influenza virus
SGWLTLGIT

SEQ ID NO: 456077 - protein, 9 aa, Influenza virus
SGWTTANSK

SEQ ID NO: 456078 - protein, 9 aa, Influenza virus
SGYAADKAS

SEQ ID NO: 456079 - protein, 9 aa, Influenza virus
SGYAADKES

SEQ ID NO: 456080 - protein, 9 aa, Influenza virus
SGYAADKKS

SEQ ID NO: 456081 - protein, 9 aa, Influenza virus
SGYAADLKS

SEQ ID NO: 456082 - protein, 9 aa, Influenza virus
SGYAADQES

SEQ ID NO: 456083 - protein, 9 aa, Influenza virus
SGYAADQKS

SEQ ID NO: 456084 - protein, 9 aa, Influenza virus
SGYAADRES

SEQ ID NO: 456085 - protein, 9 aa, Influenza virus
SGYAADRKS

SEQ ID NO: 456086 - protein, 9 aa, Influenza virus
SGYAQTDCV

SEQ ID NO: 456087 - protein, 9 aa, Influenza virus
SGYDFEKEG

SEQ ID NO: 456088 - protein, 9 aa, Influenza virus
SGYDFEREG

SEQ ID NO: 456089 - protein, 9 aa, Influenza virus
SGYEILKVP

SEQ ID NO: 456090 - protein, 9 aa, Influenza virus
SGYEMLKVP

SEQ ID NO: 456091 - protein, 9 aa, Influenza virus
SGYETFKVI

SEQ ID NO: 456092 - protein, 9 aa, Influenza virus
SGYETFRII

SEQ ID NO: 456093 - protein, 9 aa, Influenza virus
SGYETFRVI

SEQ ID NO: 456094 - protein, 9 aa, Influenza virus
SGYETFRVL

SEQ ID NO: 456095 - protein, 9 aa, Influenza virus
SGYETFRVT

SEQ ID NO: 456096 - protein, 9 aa, Influenza virus
SGYEVLKVP

SEQ ID NO: 456097 - protein, 9 aa, Influenza virus
SGYEVLRVP

SEQ ID NO: 456098 - protein, 9 aa, Influenza virus
SGYFGVFSV

SEQ ID NO: 456099 - protein, 9 aa, Influenza virus
SGYGEDNES

SEQ ID NO: 456100 - protein, 9 aa, Influenza virus
SGYKDIILW

SEQ ID NO: 456101 - protein, 9 aa, Influenza virus
SGYKDVILW

SEQ ID NO: 456102 - protein, 9 aa, Influenza virus
SGYKEIILW

SEQ ID NO: 456103 - protein, 9 aa, Influenza virus
SGYKEVILW

SEQ ID NO: 456104 - protein, 9 aa, Influenza virus
SGYNFEKEG

SEQ ID NO: 456105 - protein, 9 aa, Influenza virus
SGYSGAFID

SEQ ID NO: 456106 - protein, 9 aa, Influenza virus
SGYSGAFMD

SEQ ID NO: 456107 - protein, 9 aa, Influenza virus
SGYSGAFTI

SEQ ID NO: 456108 - protein, 9 aa, Influenza virus
SGYSGAFTV

SEQ ID NO: 456109 - protein, 9 aa, Influenza virus
SGYSGAFVD

SEQ ID NO: 456110 - protein, 9 aa, Influenza virus
SGYSGIFSI

SEQ ID NO: 456111 - protein, 9 aa, Influenza virus
SGYSGIFSV

SEQ ID NO: 456112 - protein, 9 aa, Influenza virus
SGYSGSFID

SEQ ID NO: 456113 - protein, 9 aa, Influenza virus
SGYSGSFII

SEQ ID NO: 456114 - protein, 9 aa, Influenza virus
SGYSGSFIQ

SEQ ID NO: 456115 - protein, 9 aa, Influenza virus
SGYSGSFIV

SEQ ID NO: 456116 - protein, 9 aa, Influenza virus
SGYSGSFMD

SEQ ID NO: 456117 - protein, 9 aa, Influenza virus
SGYSGSFSI

SEQ ID NO: 456118 - protein, 9 aa, Influenza virus
SGYSGSFSV

SEQ ID NO: 456119 - protein, 9 aa, Influenza virus
SGYSGSFTI

SEQ ID NO: 456120 - protein, 9 aa, Influenza virus
SGYSGSFTL

SEQ ID NO: 456121 - protein, 9 aa, Influenza virus
SGYSGSFVD

SEQ ID NO: 456122 - protein, 9 aa, Influenza virus
SGYSGSFVI

SEQ ID NO: 456123 - protein, 9 aa, Influenza virus
SGYSGSFVM

SEQ ID NO: 456124 - protein, 9 aa, Influenza virus
SGYSGSFVQ

SEQ ID NO: 456125 - protein, 9 aa, Influenza virus
SGYSGVFSV

SEQ ID NO: 456126 - protein, 9 aa, Influenza virus
SGYVCSGLV

SEQ ID NO: 456127 - protein, 9 aa, Influenza virus
SGYWAIRTR

SEQ ID NO: 456128 - protein, 9 aa, Influenza virus
SHCRATEYI

SEQ ID NO: 456129 - protein, 9 aa, Influenza virus
SHCRIIQNE

SEQ ID NO: 456130 - protein, 9 aa, Influenza virus
SHEGEGIPL

SEQ ID NO: 456131 - protein, 9 aa, Influenza virus
SHEQMETGG

SEQ ID NO: 456132 - protein, 9 aa, Influenza virus
SHGKIIQNE

SEQ ID NO: 456133 - protein, 9 aa, Influenza virus
SHGRIIQNE

SEQ ID NO: 456134 - protein, 9 aa, Influenza virus
SHGRILKND

SEQ ID NO: 456135 - protein, 9 aa, Influenza virus
SHGRILKNN

SEQ ID NO: 456136 - protein, 9 aa, Influenza virus
SHGRTIQNE

SEQ ID NO: 456137 - protein, 9 aa, Influenza virus
SHGRVLKNN

SEQ ID NO: 456138 - protein, 9 aa, Influenza virus
SHGSLQCRI

SEQ ID NO: 456139 - protein, 9 aa, Influenza virus
SHGTGTGYT

SEQ ID NO: 456140 - protein, 9 aa, Influenza virus
SHGVKGWAF

SEQ ID NO: 456141 - protein, 9 aa, Influenza virus
SHHRSHRQM

SEQ ID NO: 456142 - protein, 9 aa, Influenza virus
SHISPLSGS

SEQ ID NO: 456143 - protein, 9 aa, Influenza virus
SHKICIGYH

SEQ ID NO: 456144 - protein, 9 aa, Influenza virus
SHLECRTFF

SEQ ID NO: 456145 - protein, 9 aa, Influenza virus
SHLKFKADL

SEQ ID NO: 456146 - protein, 9 aa, Influenza virus
SHLRNDTDV

SEQ ID NO: 456147 - protein, 9 aa, Influenza virus
SHMECRTFF

SEQ ID NO: 456148 - protein, 9 aa, Influenza virus
SHNGGLIAP

SEQ ID NO: 456149 - protein, 9 aa, Influenza virus
SHNGGLVAP

SEQ ID NO: 456150 - protein, 9 aa, Influenza virus
SHNGGRIAP

SEQ ID NO: 456151 - protein, 9 aa, Influenza virus
SHPGIFENS

SEQ ID NO: 456152 - protein, 9 aa, Influenza virus
SHPGIFESS

SEQ ID NO: 456153 - protein, 9 aa, Influenza virus
SHPGIFGNS

SEQ ID NO: 456154 - protein, 9 aa, Influenza virus
SHPGLFENS

SEQ ID NO: 456155 - protein, 9 aa, Influenza virus
SHRTLLMNE

SEQ ID NO: 456156 - protein, 9 aa, Influenza virus
SHSECRTFF

SEQ ID NO: 456157 - protein, 9 aa, Influenza virus
SHTAYSQIT

SEQ ID NO: 456158 - protein, 9 aa, Influenza virus
SHTGTYCSL

SEQ ID NO: 456159 - protein, 9 aa, Influenza virus
SHYEECSCY

SEQ ID NO: 456160 - protein, 9 aa, Influenza virus
SHYNQITQT

SEQ ID NO: 456161 - protein, 9 aa, Influenza virus
SHYNQMKQA

SEQ ID NO: 456162 - protein, 9 aa, Influenza virus
SHYNQMTQA

SEQ ID NO: 456163 - protein, 9 aa, Influenza virus
SHYNQVTQP

SEQ ID NO: 456164 - protein, 9 aa, Influenza virus
SHYNQVTQT

SEQ ID NO: 456165 - protein, 9 aa, Influenza virus
SHYREEALL

SEQ ID NO: 456166 - protein, 9 aa, Influenza virus
SHYVCSGLV

SEQ ID NO: 456167 - protein, 9 aa, Influenza virus
SIAASYKRI

SEQ ID NO: 456168 - protein, 9 aa, Influenza virus
SIADKICIG

SEQ ID NO: 456169 - protein, 9 aa, Influenza virus
SIAFCGVDS

SEQ ID NO: 456170 - protein, 9 aa, Influenza virus
SIAFCGVNS

SEQ ID NO: 456171 - protein, 9 aa, Influenza virus
SIAGWLLGN

SEQ ID NO: 456172 - protein, 9 aa, Influenza virus
SIAHKSCLP

SEQ ID NO: 456173 - protein, 9 aa, Influenza virus
SIAPIMFSN

SEQ ID NO: 456174 - protein, 9 aa, Influenza virus
SIASRSGYE

SEQ ID NO: 456175 - protein, 9 aa, Influenza virus
SIAVFCGTS

SEQ ID NO: 456176 - protein, 9 aa, Influenza virus
SIAWSATAC

SEQ ID NO: 456177 - protein, 9 aa, Influenza virus
SICEKLEQS

SEQ ID NO: 456178 - protein, 9 aa, Influenza virus
SICISGPNN

SEQ ID NO: 456179 - protein, 9 aa, Influenza virus
SICMSGPND

SEQ ID NO: 456180 - protein, 9 aa, Influenza virus
SICMSGPNN

SEQ ID NO: 456181 - protein, 9 aa, Influenza virus
SICTHLEVC

SEQ ID NO: 456182 - protein, 9 aa, Influenza virus
SICVSGPNN

SEQ ID NO: 456183 - protein, 9 aa, Influenza virus
SIDECRTFF

SEQ ID NO: 456184 - protein, 9 aa, Influenza virus
SIDGKAPIS

SEQ ID NO: 456185 - protein, 9 aa, Influenza virus
SIDLVETNH

SEQ ID NO: 456186 - protein, 9 aa, Influenza virus
SIDPKGLFG

SEQ ID NO: 456187 - protein, 9 aa, Influenza virus
SIDRFLRVK

SEQ ID NO: 456188 - protein, 9 aa, Influenza virus
SIDRFLRVR

SEQ ID NO: 456189 - protein, 9 aa, Influenza virus
SIDSGYVCS

SEQ ID NO: 456190 - protein, 9 aa, Influenza virus
SIDSNYVCS

SEQ ID NO: 456191 - protein, 9 aa, Influenza virus
SIDSSYICS

SEQ ID NO: 456192 - protein, 9 aa, Influenza virus
SIDSSYVCS

SEQ ID NO: 456193 - protein, 9 aa, Influenza virus
SIECVCRDN

SEQ ID NO: 456194 - protein, 9 aa, Influenza virus
SIEDPDHEG

SEQ ID NO: 456195 - protein, 9 aa, Influenza virus
SIEDPNHEG

SEQ ID NO: 456196 - protein, 9 aa, Influenza virus
SIEDPSHEG

SEQ ID NO: 456197 - protein, 9 aa, Influenza virus
SIEECLIND

SEQ ID NO: 456198 - protein, 9 aa, Influenza virus
SIEEPSHEG

SEQ ID NO: 456199 - protein, 9 aa, Influenza virus
SIENLEELR

SEQ ID NO: 456200 - protein, 9 aa, Influenza virus
SIENPSHEG

SEQ ID NO: 456201 - protein, 9 aa, Influenza virus
SIENQEELK

SEQ ID NO: 456202 - protein, 9 aa, Influenza virus
SIENQEELR

SEQ ID NO: 456203 - protein, 9 aa, Influenza virus
SIEPKGLFG

SEQ ID NO: 456204 - protein, 9 aa, Influenza virus
SIEPRGLFG

SEQ ID NO: 456205 - protein, 9 aa, Influenza virus
SIESEFNEI

SEQ ID NO: 456206 - protein, 9 aa, Influenza virus
SIESEFSEI

SEQ ID NO: 456207 - protein, 9 aa, Influenza virus
SIESEFSET

SEQ ID NO: 456208 - protein, 9 aa, Influenza virus
SIGITVIKN

SEQ ID NO: 456209 - protein, 9 aa, Influenza virus
SIGKVCRTL

SEQ ID NO: 456210 - protein, 9 aa, Influenza virus
SIGNLIAPR

SEQ ID NO: 456211 - protein, 9 aa, Influenza virus
SIGSSTYQN

SEQ ID NO: 456212 - protein, 9 aa, Influenza virus
SIGSWSHNI

SEQ ID NO: 456213 - protein, 9 aa, Influenza virus
SIGSWSQNI

SEQ ID NO: 456214 - protein, 9 aa, Influenza virus
SIGTSTLNQ

SEQ ID NO: 456215 - protein, 9 aa, Influenza virus
SIGVTVIKN

SEQ ID NO: 456216 - protein, 9 aa, Influenza virus
SIGVTVIRN

SEQ ID NO: 456217 - protein, 9 aa, Influenza virus
SIHECRTFF

SEQ ID NO: 456218 - protein, 9 aa, Influenza virus
SIHSRGLFG

SEQ ID NO: 456219 - protein, 9 aa, Influenza virus
SIHWTIVKP

SEQ ID NO: 456220 - protein, 9 aa, Influenza virus
SIIAFCGTS

SEQ ID NO: 456221 - protein, 9 aa, Influenza virus
SIIDKMNTQ

SEQ ID NO: 456222 - protein, 9 aa, Influenza virus
SIIEAESSV

SEQ ID NO: 456223 - protein, 9 aa, Influenza virus
SIIEKMNTQ

SEQ ID NO: 456224 - protein, 9 aa, Influenza virus
SIIFNMERI

SEQ ID NO: 456225 - protein, 9 aa, Influenza virus
SIIFNSIGN

SEQ ID NO: 456226 - protein, 9 aa, Influenza virus
SIIGKMNTQ

SEQ ID NO: 456227 - protein, 9 aa, Influenza virus
SIINKMNTQ

SEQ ID NO: 456228 - protein, 9 aa, Influenza virus
SIIPSGPLK

SEQ ID NO: 456229 - protein, 9 aa, Influenza virus
SIISFCGVN

SEQ ID NO: 456230 - protein, 9 aa, Influenza virus
SIISMCSST

SEQ ID NO: 456231 - protein, 9 aa, Influenza virus
SIITELPFQ

SEQ ID NO: 456232 - protein, 9 aa, Influenza virus
SIIVFCGTS

SEQ ID NO: 456233 - protein, 9 aa, Influenza virus
SIKEKDMTK

SEQ ID NO: 456234 - protein, 9 aa, Influenza virus
SIKKYERVK

SEQ ID NO: 456235 - protein, 9 aa, Influenza virus
SIKNGTYDY

SEQ ID NO: 456236 - protein, 9 aa, Influenza virus
SIKNQEELR

SEQ ID NO: 456237 - protein, 9 aa, Influenza virus
SIKRYERVK

SEQ ID NO: 456238 - protein, 9 aa, Influenza virus
SIKSWRKDI

SEQ ID NO: 456239 - protein, 9 aa, Influenza virus
SIKSWRRDI

SEQ ID NO: 456240 - protein, 9 aa, Influenza virus
SIKTKLPFQ

SEQ ID NO: 456241 - protein, 9 aa, Influenza virus
SILANNGKF

SEQ ID NO: 456242 - protein, 9 aa, Influenza virus
SILANNGRF

SEQ ID NO: 456243 - protein, 9 aa, Influenza virus
SILASSGSL

SEQ ID NO: 456244 - protein, 9 aa, Influenza virus
SILHKCNDS

SEQ ID NO: 456245 - protein, 9 aa, Influenza virus
SILKPGETL

SEQ ID NO: 456246 - protein, 9 aa, Influenza virus
SILKPGQTL

SEQ ID NO: 456247 - protein, 9 aa, Influenza virus
SILNLLIGI

SEQ ID NO: 456248 - protein, 9 aa, Influenza virus
SILNTSQRG

SEQ ID NO: 456249 - protein, 9 aa, Influenza virus
SILRTQESE

SEQ ID NO: 456250 - protein, 9 aa, Influenza virus
SILTDSQTA

SEQ ID NO: 456251 - protein, 9 aa, Influenza virus
SILYFWGVH

SEQ ID NO: 456252 - protein, 9 aa, Influenza virus
SIMSCDSPS

SEQ ID NO: 456253 - protein, 9 aa, Influenza virus
SINECRTFF

SEQ ID NO: 456254 - protein, 9 aa, Influenza virus
SINGKAPIS

SEQ ID NO: 456255 - protein, 9 aa, Influenza virus
SINGKEPIS

SEQ ID NO: 456256 - protein, 9 aa, Influenza virus
SINGKQPIS

SEQ ID NO: 456257 - protein, 9 aa, Influenza virus
SINGRAPIS

SEQ ID NO: 456258 - protein, 9 aa, Influenza virus
SINPVKLSS

SEQ ID NO: 456259 - protein, 9 aa, Influenza virus
SINTKLPFQ

SEQ ID NO: 456260 - protein, 9 aa, Influenza virus
SINTRLPFQ

SEQ ID NO: 456261 - protein, 9 aa, Influenza virus
SINWLTKKE

SEQ ID NO: 456262 - protein, 9 aa, Influenza virus
SINWLTKKK

SEQ ID NO: 456263 - protein, 9 aa, Influenza virus
SIPNDKPFQ

SEQ ID NO: 456264 - protein, 9 aa, Influenza virus
SIPNEKPFQ

SEQ ID NO: 456265 - protein, 9 aa, Influenza virus
SIPNGKPFQ

SEQ ID NO: 456266 - protein, 9 aa, Influenza virus
SIPNNKPFQ

SEQ ID NO: 456267 - protein, 9 aa, Influenza virus
SIQPTFSVQ

SEQ ID NO: 456268 - protein, 9 aa, Influenza virus
SIQSDKPFQ

SEQ ID NO: 456269 - protein, 9 aa, Influenza virus
SIQSKGLFG

SEQ ID NO: 456270 - protein, 9 aa, Influenza virus
SIQSRGLFG

SEQ ID NO: 456271 - protein, 9 aa, Influenza virus
SIQTRGLFG

SEQ ID NO: 456272 - protein, 9 aa, Influenza virus
SIRDNTYDH

SEQ ID NO: 456273 - protein, 9 aa, Influenza virus
SIRGEFNQV

SEQ ID NO: 456274 - protein, 9 aa, Influenza virus
SIRGEFSQV

SEQ ID NO: 456275 - protein, 9 aa, Influenza virus
SIRGETTGR

SEQ ID NO: 456276 - protein, 9 aa, Influenza virus
SIRIGSKGD

SEQ ID NO: 456277 - protein, 9 aa, Influenza virus
SIRIGSRGD

SEQ ID NO: 456278 - protein, 9 aa, Influenza virus
SIRLAAGGD

SEQ ID NO: 456279 - protein, 9 aa, Influenza virus
SIRLSADGD

SEQ ID NO: 456280 - protein, 9 aa, Influenza virus
SIRLSAGGA

SEQ ID NO: 456281 - protein, 9 aa, Influenza virus
SIRLSAGGD

SEQ ID NO: 456282 - protein, 9 aa, Influenza virus
SIRLSAGGH

SEQ ID NO: 456283 - protein, 9 aa, Influenza virus
SIRLSAGGN

SEQ ID NO: 456284 - protein, 9 aa, Influenza virus
SIRLSASGD

SEQ ID NO: 456285 - protein, 9 aa, Influenza virus
SIRNETYDH

SEQ ID NO: 456286 - protein, 9 aa, Influenza virus
SIRNGTYDH

SEQ ID NO: 456287 - protein, 9 aa, Influenza virus
SIRNGTYDY

SEQ ID NO: 456288 - protein, 9 aa, Influenza virus
SIRNGTYNH

SEQ ID NO: 456289 - protein, 9 aa, Influenza virus
SIRNGTYNY

SEQ ID NO: 456290 - protein, 9 aa, Influenza virus
SIRNGTYSY

SEQ ID NO: 456291 - protein, 9 aa, Influenza virus
SIRNNSYDH

SEQ ID NO: 456292 - protein, 9 aa, Influenza virus
SIRNNTYDH

SEQ ID NO: 456293 - protein, 9 aa, Influenza virus
SIRNNTYNH

SEQ ID NO: 456294 - protein, 9 aa, Influenza virus
SIRNSTYDH

SEQ ID NO: 456295 - protein, 9 aa, Influenza virus
SIRTGTYDH

SEQ ID NO: 456296 - protein, 9 aa, Influenza virus
SIRWETTGR

SEQ ID NO: 456297 - protein, 9 aa, Influenza virus
SIRWLTLKS

SEQ ID NO: 456298 - protein, 9 aa, Influenza virus
SISCFLLAA

SEQ ID NO: 456299 - protein, 9 aa, Influenza virus
SISCFLLIA

SEQ ID NO: 456300 - protein, 9 aa, Influenza virus
SISCFLLVA

SEQ ID NO: 456301 - protein, 9 aa, Influenza virus
SISCLYKLS

SEQ ID NO: 456302 - protein, 9 aa, Influenza virus
SISECRTFF

SEQ ID NO: 456303 - protein, 9 aa, Influenza virus
SISFCGVDS

SEQ ID NO: 456304 - protein, 9 aa, Influenza virus
SISFCGVNG

SEQ ID NO: 456305 - protein, 9 aa, Influenza virus
SISFCGVNS

SEQ ID NO: 456306 - protein, 9 aa, Influenza virus
SISFCGVSS

SEQ ID NO: 456307 - protein, 9 aa, Influenza virus
SISIGSSTY

SEQ ID NO: 456308 - protein, 9 aa, Influenza virus
SISNDKPFQ

SEQ ID NO: 456309 - protein, 9 aa, Influenza virus
SISSRNGFE

SEQ ID NO: 456310 - protein, 9 aa, Influenza virus
SISSRSGFE

SEQ ID NO: 456311 - protein, 9 aa, Influenza virus
SISVESSTY

SEQ ID NO: 456312 - protein, 9 aa, Influenza virus
SISVGSSTY

SEQ ID NO: 456313 - protein, 9 aa, Influenza virus
SITDIWTYQ

SEQ ID NO: 456314 - protein, 9 aa, Influenza virus
SITEVWSYN

SEQ ID NO: 456315 - protein, 9 aa, Influenza virus
SITFSHNGG

SEQ ID NO: 456316 - protein, 9 aa, Influenza virus
SITIGKCPK

SEQ ID NO: 456317 - protein, 9 aa, Influenza virus
SITQTLVSN

SEQ ID NO: 456318 - protein, 9 aa, Influenza virus
SITYIWTYQ

SEQ ID NO: 456319 - protein, 9 aa, Influenza virus
SIVAFCGTS

SEQ ID NO: 456320 - protein, 9 aa, Influenza virus
SIVALCGSK

SEQ ID NO: 456321 - protein, 9 aa, Influenza virus
SIVALCGSR

SEQ ID NO: 456322 - protein, 9 aa, Influenza virus
SIVASSGTL

SEQ ID NO: 456323 - protein, 9 aa, Influenza virus
SIVASSGTV

SEQ ID NO: 456324 - protein, 9 aa, Influenza virus
SIVLVGLIL

SEQ ID NO: 456325 - protein, 9 aa, Influenza virus
SIVMCGVDH

SEQ ID NO: 456326 - protein, 9 aa, Influenza virus
SIVMCGVDY

SEQ ID NO: 456327 - protein, 9 aa, Influenza virus
SIVMCGVEH

SEQ ID NO: 456328 - protein, 9 aa, Influenza virus
SIVMCGVNY

SEQ ID NO: 456329 - protein, 9 aa, Influenza virus
SIVMVGLIL

SEQ ID NO: 456330 - protein, 9 aa, Influenza virus
SIVPNIGSR

SEQ ID NO: 456331 - protein, 9 aa, Influenza virus
SIVPSGPLK

SEQ ID NO: 456332 - protein, 9 aa, Influenza virus
SIVRRATVS

SEQ ID NO: 456333 - protein, 9 aa, Influenza virus
SIVSMCSST

SEQ ID NO: 456334 - protein, 9 aa, Influenza virus
SIVSWSQNI

SEQ ID NO: 456335 - protein, 9 aa, Influenza virus
SIVTFCGLD

SEQ ID NO: 456336 - protein, 9 aa, Influenza virus
SIVTFCGLN

SEQ ID NO: 456337 - protein, 9 aa, Influenza virus
SIVVFCGTP

SEQ ID NO: 456338 - protein, 9 aa, Influenza virus
SIVVFCGTS

SEQ ID NO: 456339 - protein, 9 aa, Influenza virus
SIWFSHYNQ

SEQ ID NO: 456340 - protein, 9 aa, Influenza virus
SIWMCSNGS

SEQ ID NO: 456341 - protein, 9 aa, Influenza virus
SIWTSSSST

SEQ ID NO: 456342 - protein, 9 aa, Influenza virus
SIYASPQLE

SEQ ID NO: 456343 - protein, 9 aa, Influenza virus
SIYIEVLHL

SEQ ID NO: 456344 - protein, 9 aa, Influenza virus
SIYQNSFVP

SEQ ID NO: 456345 - protein, 9 aa, Influenza virus
SIYSCIASS

SEQ ID NO: 456346 - protein, 9 aa, Influenza virus
SIYSCVASS

SEQ ID NO: 456347 - protein, 9 aa, Influenza virus
SIYSSVASS

SEQ ID NO: 456348 - protein, 9 aa, Influenza virus
SIYSTAASS

SEQ ID NO: 456349 - protein, 9 aa, Influenza virus
SIYSTVAAS

SEQ ID NO: 456350 - protein, 9 aa, Influenza virus
SIYSTVASS

SEQ ID NO: 456351 - protein, 9 aa, Influenza virus
SIYSTVSSS

SEQ ID NO: 456352 - protein, 9 aa, Influenza virus
SIYSTVTSS

SEQ ID NO: 456353 - protein, 9 aa, Influenza virus
SIYSTVVSS

SEQ ID NO: 456354 - protein, 9 aa, Influenza virus
SIYWTIVKP

SEQ ID NO: 456355 - protein, 9 aa, Influenza virus
SIYWTLVNP

SEQ ID NO: 456356 - protein, 9 aa, Influenza virus
SIYWTVVKP

SEQ ID NO: 456357 - protein, 9 aa, Influenza virus
SKACNALTG

SEQ ID NO: 456358 - protein, 9 aa, Influenza virus
SKACNASTG

SEQ ID NO: 456359 - protein, 9 aa, Influenza virus
SKACNDISN

SEQ ID NO: 456360 - protein, 9 aa, Influenza virus
SKACNDTSN

SEQ ID NO: 456361 - protein, 9 aa, Influenza virus
SKACNNTSN

SEQ ID NO: 456362 - protein, 9 aa, Influenza virus
SKACNSISN

SEQ ID NO: 456363 - protein, 9 aa, Influenza virus
SKACSASTG

SEQ ID NO: 456364 - protein, 9 aa, Influenza virus
SKADKICIG

SEQ ID NO: 456365 - protein, 9 aa, Influenza virus
SKANQVFPQ

SEQ ID NO: 456366 - protein, 9 aa, Influenza virus
SKCFWKGGS

SEQ ID NO: 456367 - protein, 9 aa, Influenza virus
SKCFWKGGT

SEQ ID NO: 456368 - protein, 9 aa, Influenza virus
SKCFWRGGS

SEQ ID NO: 456369 - protein, 9 aa, Influenza virus
SKCHTDKGS

SEQ ID NO: 456370 - protein, 9 aa, Influenza virus
SKCHTDRGS

SEQ ID NO: 456371 - protein, 9 aa, Influenza virus
SKCHTEKGS

SEQ ID NO: 456372 - protein, 9 aa, Influenza virus
SKCHTNRGS

SEQ ID NO: 456373 - protein, 9 aa, Influenza virus
SKCKTKEGR

SEQ ID NO: 456374 - protein, 9 aa, Influenza virus
SKCQQSFTP

SEQ ID NO: 456375 - protein, 9 aa, Influenza virus
SKCRTKEGR

SEQ ID NO: 456376 - protein, 9 aa, Influenza virus
SKCRTREGR

SEQ ID NO: 456377 - protein, 9 aa, Influenza virus
SKCYNPCFY

SEQ ID NO: 456378 - protein, 9 aa, Influenza virus
SKCYQFALG

SEQ ID NO: 456379 - protein, 9 aa, Influenza virus
SKDLRSGYE

SEQ ID NO: 456380 - protein, 9 aa, Influenza virus
SKDNAIRIG

SEQ ID NO: 456381 - protein, 9 aa, Influenza virus
SKDNGIRIG

SEQ ID NO: 456382 - protein, 9 aa, Influenza virus
SKDNGIRVG

SEQ ID NO: 456383 - protein, 9 aa, Influenza virus
SKDNNIRIG

SEQ ID NO: 456384 - protein, 9 aa, Influenza virus
SKDNQVFPQ

SEQ ID NO: 456385 - protein, 9 aa, Influenza virus
SKDNSIQLS

SEQ ID NO: 456386 - protein, 9 aa, Influenza virus
SKDNSIRIG

SEQ ID NO: 456387 - protein, 9 aa, Influenza virus
SKDNSIRLA

SEQ ID NO: 456388 - protein, 9 aa, Influenza virus
SKDNSIRLS

SEQ ID NO: 456389 - protein, 9 aa, Influenza virus
SKDNSVRIG

SEQ ID NO: 456390 - protein, 9 aa, Influenza virus
SKDNSVRLS

SEQ ID NO: 456391 - protein, 9 aa, Influenza virus
SKDSRSGYE

SEQ ID NO: 456392 - protein, 9 aa, Influenza virus
SKDTRSGYE

SEQ ID NO: 456393 - protein, 9 aa, Influenza virus
SKEAQDVIM

SEQ ID NO: 456394 - protein, 9 aa, Influenza virus
SKEGSYFFG

SEQ ID NO: 456395 - protein, 9 aa, Influenza virus
SKEQGSGYA

SEQ ID NO: 456396 - protein, 9 aa, Influenza virus
SKEQLGSWS

SEQ ID NO: 456397 - protein, 9 aa, Influenza virus
SKERLGSWS

SEQ ID NO: 456398 - protein, 9 aa, Influenza virus
SKFESVAWS

SEQ ID NO: 456399 - protein, 9 aa, Influenza virus
SKFHSDTPR

SEQ ID NO: 456400 - protein, 9 aa, Influenza virus
SKFLLMDAL

SEQ ID NO: 456401 - protein, 9 aa, Influenza virus
SKFLLMDSL

SEQ ID NO: 456402 - protein, 9 aa, Influenza virus
SKGDIFVIR

SEQ ID NO: 456403 - protein, 9 aa, Influenza virus
SKGDIFVMR

SEQ ID NO: 456404 - protein, 9 aa, Influenza virus
SKGDVFVIR

SEQ ID NO: 456405 - protein, 9 aa, Influenza virus
SKGDVFVMR

SEQ ID NO: 456406 - protein, 9 aa, Influenza virus
SKGHVFVIR

SEQ ID NO: 456407 - protein, 9 aa, Influenza virus
SKGLFGAIA

SEQ ID NO: 456408 - protein, 9 aa, Influenza virus
SKGSSKQQH

SEQ ID NO: 456409 - protein, 9 aa, Influenza virus
SKHYIGKCP

SEQ ID NO: 456410 - protein, 9 aa, Influenza virus
SKIKMKWGM

SEQ ID NO: 456411 - protein, 9 aa, Influenza virus
SKILTDTSR

SEQ ID NO: 456412 - protein, 9 aa, Influenza virus
SKINEVKLE

SEQ ID NO: 456413 - protein, 9 aa, Influenza virus
SKINGVILE

SEQ ID NO: 456414 - protein, 9 aa, Influenza virus
SKINGVKLE

SEQ ID NO: 456415 - protein, 9 aa, Influenza virus
SKINGVRLE

SEQ ID NO: 456416 - protein, 9 aa, Influenza virus
SKINRQEIE

SEQ ID NO: 456417 - protein, 9 aa, Influenza virus
SKITLKFAF

SEQ ID NO: 456418 - protein, 9 aa, Influenza virus
SKKKSYINK

SEQ ID NO: 456419 - protein, 9 aa, Influenza virus
SKKKSYINR

SEQ ID NO: 456420 - protein, 9 aa, Influenza virus
SKKRLGSWS

SEQ ID NO: 456421 - protein, 9 aa, Influenza virus
SKLKRNEIK

SEQ ID NO: 456422 - protein, 9 aa, Influenza virus
SKLKRQEID

SEQ ID NO: 456423 - protein, 9 aa, Influenza virus
SKLKRQEIE

SEQ ID NO: 456424 - protein, 9 aa, Influenza virus
SKLKRQEIN

SEQ ID NO: 456425 - protein, 9 aa, Influenza virus
SKLNRNEIK

SEQ ID NO: 456426 - protein, 9 aa, Influenza virus
SKLNRQEIE

SEQ ID NO: 456427 - protein, 9 aa, Influenza virus
SKLNRQEIG

SEQ ID NO: 456428 - protein, 9 aa, Influenza virus
SKLNRSEIK

SEQ ID NO: 456429 - protein, 9 aa, Influenza virus
SKLNRTEIK

SEQ ID NO: 456430 - protein, 9 aa, Influenza virus
SKLPFQNIN

SEQ ID NO: 456431 - protein, 9 aa, Influenza virus
SKMGVDEYS

SEQ ID NO: 456432 - protein, 9 aa, Influenza virus
SKMQFSSLT

SEQ ID NO: 456433 - protein, 9 aa, Influenza virus
SKNILRTQE

SEQ ID NO: 456434 - protein, 9 aa, Influenza virus
SKNPYTLVS

SEQ ID NO: 456435 - protein, 9 aa, Influenza virus
SKNSRSGYE

SEQ ID NO: 456436 - protein, 9 aa, Influenza virus
SKPFQNASR

SEQ ID NO: 456437 - protein, 9 aa, Influenza virus
SKPFQNICK

SEQ ID NO: 456438 - protein, 9 aa, Influenza virus
SKPFQNTSK

SEQ ID NO: 456439 - protein, 9 aa, Influenza virus
SKPFQNTSR

SEQ ID NO: 456440 - protein, 9 aa, Influenza virus
SKPLQNASR

SEQ ID NO: 456441 - protein, 9 aa, Influenza virus
SKPLQNTSK

SEQ ID NO: 456442 - protein, 9 aa, Influenza virus
SKPQCHITG

SEQ ID NO: 456443 - protein, 9 aa, Influenza virus
SKPQCKITG

SEQ ID NO: 456444 - protein, 9 aa, Influenza virus
SKPQCLITG

SEQ ID NO: 456445 - protein, 9 aa, Influenza virus
SKPQCQIAG

SEQ ID NO: 456446 - protein, 9 aa, Influenza virus
SKPQCQIIG

SEQ ID NO: 456447 - protein, 9 aa, Influenza virus
SKPQCQIRG

SEQ ID NO: 456448 - protein, 9 aa, Influenza virus
SKPQCQISG

SEQ ID NO: 456449 - protein, 9 aa, Influenza virus
SKPQCQITG

SEQ ID NO: 456450 - protein, 9 aa, Influenza virus
SKRGGSGIM

SEQ ID NO: 456451 - protein, 9 aa, Influenza virus
SKRGNSGIM

SEQ ID NO: 456452 - protein, 9 aa, Influenza virus
SKRGSSGIM

SEQ ID NO: 456453 - protein, 9 aa, Influenza virus
SKRGSSGIV

SEQ ID NO: 456454 - protein, 9 aa, Influenza virus
SKRGSSGVM

SEQ ID NO: 456455 - protein, 9 aa, Influenza virus
SKRYELEIG

SEQ ID NO: 456456 - protein, 9 aa, Influenza virus
SKSDKICIG

SEQ ID NO: 456457 - protein, 9 aa, Influenza virus
SKSDRICIG

SEQ ID NO: 456458 - protein, 9 aa, Influenza virus
SKSLCKVEG

SEQ ID NO: 456459 - protein, 9 aa, Influenza virus
SKSRGYKMN

SEQ ID NO: 456460 - protein, 9 aa, Influenza virus
SKSRSIIFN

SEQ ID NO: 456461 - protein, 9 aa, Influenza virus
SKSRSNIFN

SEQ ID NO: 456462 - protein, 9 aa, Influenza virus
SKSRVDNHS

SEQ ID NO: 456463 - protein, 9 aa, Influenza virus
SKSTKSTVL

SEQ ID NO: 456464 - protein, 9 aa, Influenza virus
SKTGVDEYS

SEQ ID NO: 456465 - protein, 9 aa, Influenza virus
SKTLTDTSR

SEQ ID NO: 456466 - protein, 9 aa, Influenza virus
SKTNQQFEL

SEQ ID NO: 456467 - protein, 9 aa, Influenza virus
SKTQCQITG

SEQ ID NO: 456468 - protein, 9 aa, Influenza virus
SKVGVDEYS

SEQ ID NO: 456469 - protein, 9 aa, Influenza virus
SKVKMKWGM

SEQ ID NO: 456470 - protein, 9 aa, Influenza virus
SKVLTDTSR

SEQ ID NO: 456471 - protein, 9 aa, Influenza virus
SKVTCICRD

SEQ ID NO: 456472 - protein, 9 aa, Influenza virus
SKVTCVCRD

SEQ ID NO: 456473 - protein, 9 aa, Influenza virus
SKWGDILEG

SEQ ID NO: 456474 - protein, 9 aa, Influenza virus
SKWGDVLDG

SEQ ID NO: 456475 - protein, 9 aa, Influenza virus
SKWGNVLDG

SEQ ID NO: 456476 - protein, 9 aa, Influenza virus
SKWNVTYTG

SEQ ID NO: 456477 - protein, 9 aa, Influenza virus
SKYEEESKL

SEQ ID NO: 456478 - protein, 9 aa, Influenza virus
SKYHWNLAL

SEQ ID NO: 456479 - protein, 9 aa, Influenza virus
SKYQQSFSP

SEQ ID NO: 456480 - protein, 9 aa, Influenza virus
SKYQQSFTP

SEQ ID NO: 456481 - protein, 9 aa, Influenza virus
SKYRQSFSP

SEQ ID NO: 456482 - protein, 9 aa, Influenza virus
SKYWAIRTR

SEQ ID NO: 456483 - protein, 9 aa, Influenza virus
SLAIMIAGI

SEQ ID NO: 456484 - protein, 9 aa, Influenza virus
SLAIMMAGI

SEQ ID NO: 456485 - protein, 9 aa, Influenza virus
SLAIMVAGI

SEQ ID NO: 456486 - protein, 9 aa, Influenza virus
SLAVNVRGS

SEQ ID NO: 456487 - protein, 9 aa, Influenza virus
SLCEVNSWH

SEQ ID NO: 456488 - protein, 9 aa, Influenza virus
SLCKIEGWV

SEQ ID NO: 456489 - protein, 9 aa, Influenza virus
SLCKVEEWV

SEQ ID NO: 456490 - protein, 9 aa, Influenza virus
SLCKVEGWV

SEQ ID NO: 456491 - protein, 9 aa, Influenza virus
SLCLAILIA

SEQ ID NO: 456492 - protein, 9 aa, Influenza virus
SLCLAILVA

SEQ ID NO: 456493 - protein, 9 aa, Influenza virus
SLCLAVLIA

SEQ ID NO: 456494 - protein, 9 aa, Influenza virus
SLCMCSNGS

SEQ ID NO: 456495 - protein, 9 aa, Influenza virus
SLCNVEGWV

SEQ ID NO: 456496 - protein, 9 aa, Influenza virus
SLCSIWFSH

SEQ ID NO: 456497 - protein, 9 aa, Influenza virus
SLCSVEGWV

SEQ ID NO: 456498 - protein, 9 aa, Influenza virus
SLCYPGNFN

SEQ ID NO: 456499 - protein, 9 aa, Influenza virus
SLCYPGSFN

SEQ ID NO: 456500 - protein, 9 aa, Influenza virus
SLCYPGSLN

SEQ ID NO: 456501 - protein, 9 aa, Influenza virus
SLDEQNKLY

SEQ ID NO: 456502 - protein, 9 aa, Influenza virus
SLDKICLGH

SEQ ID NO: 456503 - protein, 9 aa, Influenza virus
SLEFIAEQF

SEQ ID NO: 456504 - protein, 9 aa, Influenza virus
SLEGIILGN

SEQ ID NO: 456505 - protein, 9 aa, Influenza virus
SLEGLILGN

SEQ ID NO: 456506 - protein, 9 aa, Influenza virus
SLEGLILSN

SEQ ID NO: 456507 - protein, 9 aa, Influenza virus
SLEGLVLGN

SEQ ID NO: 456508 - protein, 9 aa, Influenza virus
SLEPGTFDL

SEQ ID NO: 456509 - protein, 9 aa, Influenza virus
SLERRLENL

SEQ ID NO: 456510 - protein, 9 aa, Influenza virus
SLESRRGFE

SEQ ID NO: 456511 - protein, 9 aa, Influenza virus
SLESRSGFE

SEQ ID NO: 456512 - protein, 9 aa, Influenza virus
SLFEKFFPS

SEQ ID NO: 456513 - protein, 9 aa, Influenza virus
SLFSSIKKY

SEQ ID NO: 456514 - protein, 9 aa, Influenza virus
SLFSSIKRY

SEQ ID NO: 456515 - protein, 9 aa, Influenza virus
SLGAISFWM

SEQ ID NO: 456516 - protein, 9 aa, Influenza virus
SLGASCFLL

SEQ ID NO: 456517 - protein, 9 aa, Influenza virus
SLGAVSFWM

SEQ ID NO: 456518 - protein, 9 aa, Influenza virus
SLGDCSFAG

SEQ ID NO: 456519 - protein, 9 aa, Influenza virus
SLGGCSFAG

SEQ ID NO: 456520 - protein, 9 aa, Influenza virus
SLGIQSDAQ

SEQ ID NO: 456521 - protein, 9 aa, Influenza virus
SLIALCGSP

SEQ ID NO: 456522 - protein, 9 aa, Influenza virus
SLIASSGTL

SEQ ID NO: 456523 - protein, 9 aa, Influenza virus
SLIIAARNI

SEQ ID NO: 456524 - protein, 9 aa, Influenza virus
SLIIAARSI

SEQ ID NO: 456525 - protein, 9 aa, Influenza virus
SLILAAIIM

SEQ ID NO: 456526 - protein, 9 aa, Influenza virus
SLILAALIM

SEQ ID NO: 456527 - protein, 9 aa, Influenza virus
SLIMRTVIA

SEQ ID NO: 456528 - protein, 9 aa, Influenza virus
SLIQFPIGT

SEQ ID NO: 456529 - protein, 9 aa, Influenza virus
SLIQFPMGT

SEQ ID NO: 456530 - protein, 9 aa, Influenza virus
SLIRFPIGT

SEQ ID NO: 456531 - protein, 9 aa, Influenza virus
SLIRFPIGV

SEQ ID NO: 456532 - protein, 9 aa, Influenza virus
SLIRFPVGT

SEQ ID NO: 456533 - protein, 9 aa, Influenza virus
SLIRPKENP

SEQ ID NO: 456534 - protein, 9 aa, Influenza virus
SLIRPNENP

SEQ ID NO: 456535 - protein, 9 aa, Influenza virus
SLIRSNENP

SEQ ID NO: 456536 - protein, 9 aa, Influenza virus
SLISWPLSS

SEQ ID NO: 456537 - protein, 9 aa, Influenza virus
SLIWLWLVL

SEQ ID NO: 456538 - protein, 9 aa, Influenza virus
SLKGLILGN

SEQ ID NO: 456539 - protein, 9 aa, Influenza virus
SLKLAIGLR

SEQ ID NO: 456540 - protein, 9 aa, Influenza virus
SLKLAIGPR

SEQ ID NO: 456541 - protein, 9 aa, Influenza virus
SLKLASGLR

SEQ ID NO: 456542 - protein, 9 aa, Influenza virus
SLKLATGLR

SEQ ID NO: 456543 - protein, 9 aa, Influenza virus
SLKLATGMR

SEQ ID NO: 456544 - protein, 9 aa, Influenza virus
SLKLATGPR

SEQ ID NO: 456545 - protein, 9 aa, Influenza virus
SLKLAVGLK

SEQ ID NO: 456546 - protein, 9 aa, Influenza virus
SLKLAVGLR

SEQ ID NO: 456547 - protein, 9 aa, Influenza virus
SLKLAVGMR

SEQ ID NO: 456548 - protein, 9 aa, Influenza virus
SLKLAVGPR

SEQ ID NO: 456549 - protein, 9 aa, Influenza virus
SLKLSIEDP

SEQ ID NO: 456550 - protein, 9 aa, Influenza virus
SLKLVTGLR

SEQ ID NO: 456551 - protein, 9 aa, Influenza virus
SLLEMCHST

SEQ ID NO: 456552 - protein, 9 aa, Influenza virus
SLLGDPHCD

SEQ ID NO: 456553 - protein, 9 aa, Influenza virus
SLLHKCNDS

SEQ ID NO: 456554 - protein, 9 aa, Influenza virus
SLLLATGMK

SEQ ID NO: 456555 - protein, 9 aa, Influenza virus
SLLLATGMR

SEQ ID NO: 456556 - protein, 9 aa, Influenza virus
SLLLLQANL

SEQ ID NO: 456557 - protein, 9 aa, Influenza virus
SLLLQANLC

SEQ ID NO: 456558 - protein, 9 aa, Influenza virus
SLLNDKHSN

SEQ ID NO: 456559 - protein, 9 aa, Influenza virus
SLLNDKHSS

SEQ ID NO: 456560 - protein, 9 aa, Influenza virus
SLLNDRHSN

SEQ ID NO: 456561 - protein, 9 aa, Influenza virus
SLLNRLSIN

SEQ ID NO: 456562 - protein, 9 aa, Influenza virus
SLLQSAILS

SEQ ID NO: 456563 - protein, 9 aa, Influenza virus
SLLRDNAKD

SEQ ID NO: 456564 - protein, 9 aa, Influenza virus
SLLTEVETH

SEQ ID NO: 456565 - protein, 9 aa, Influenza virus
SLLTEVETL

SEQ ID NO: 456566 - protein, 9 aa, Influenza virus
SLLTEVETP

SEQ ID NO: 456567 - protein, 9 aa, Influenza virus
SLLTEVETY

SEQ ID NO: 456568 - protein, 9 aa, Influenza virus
SLMLATGMK

SEQ ID NO: 456569 - protein, 9 aa, Influenza virus
SLMLATGMR

SEQ ID NO: 456570 - protein, 9 aa, Influenza virus
SLMQGSTLP

SEQ ID NO: 456571 - protein, 9 aa, Influenza virus
SLMRPNENP

SEQ ID NO: 456572 - protein, 9 aa, Influenza virus
SLMWEINGP

SEQ ID NO: 456573 - protein, 9 aa, Influenza virus
SLNDYEELK

SEQ ID NO: 456574 - protein, 9 aa, Influenza virus
SLNGISPIH

SEQ ID NO: 456575 - protein, 9 aa, Influenza virus
SLNGISPVH

SEQ ID NO: 456576 - protein, 9 aa, Influenza virus
SLNGVSPIH

SEQ ID NO: 456577 - protein, 9 aa, Influenza virus
SLNGVSPVH

SEQ ID NO: 456578 - protein, 9 aa, Influenza virus
SLNISLYSK

SEQ ID NO: 456579 - protein, 9 aa, Influenza virus
SLNITAASL

SEQ ID NO: 456580 - protein, 9 aa, Influenza virus
SLNKKMEDG

SEQ ID NO: 456581 - protein, 9 aa, Influenza virus
SLNKRMEDG

SEQ ID NO: 456582 - protein, 9 aa, Influenza virus
SLNNKVDDG

SEQ ID NO: 456583 - protein, 9 aa, Influenza virus
SLPDGAQIQ

SEQ ID NO: 456584 - protein, 9 aa, Influenza virus
SLPDLYDYK

SEQ ID NO: 456585 - protein, 9 aa, Influenza virus
SLPFHNIHP

SEQ ID NO: 456586 - protein, 9 aa, Influenza virus
SLPFHNVHP

SEQ ID NO: 456587 - protein, 9 aa, Influenza virus
SLPFQNIHP

SEQ ID NO: 456588 - protein, 9 aa, Influenza virus
SLPFQNIHS

SEQ ID NO: 456589 - protein, 9 aa, Influenza virus
SLPFQNINP

SEQ ID NO: 456590 - protein, 9 aa, Influenza virus
SLPFQNINS

SEQ ID NO: 456591 - protein, 9 aa, Influenza virus
SLPFQNISP

SEQ ID NO: 456592 - protein, 9 aa, Influenza virus
SLPFQNVHP

SEQ ID NO: 456593 - protein, 9 aa, Influenza virus
SLPLALGMK

SEQ ID NO: 456594 - protein, 9 aa, Influenza virus
SLPLCPFKG

SEQ ID NO: 456595 - protein, 9 aa, Influenza virus
SLPLCPFQG

SEQ ID NO: 456596 - protein, 9 aa, Influenza virus
SLPLCPFRG

SEQ ID NO: 456597 - protein, 9 aa, Influenza virus
SLPNDKHSN

SEQ ID NO: 456598 - protein, 9 aa, Influenza virus
SLQNRIQID

SEQ ID NO: 456599 - protein, 9 aa, Influenza virus
SLQQIESII

SEQ ID NO: 456600 - protein, 9 aa, Influenza virus
SLQQIESMI

SEQ ID NO: 456601 - protein, 9 aa, Influenza virus
SLQQIESMV

SEQ ID NO: 456602 - protein, 9 aa, Influenza virus
SLRGRGSTL

SEQ ID NO: 456603 - protein, 9 aa, Influenza virus
SLRLAIGLR

SEQ ID NO: 456604 - protein, 9 aa, Influenza virus
SLRLALGLR

SEQ ID NO: 456605 - protein, 9 aa, Influenza virus
SLRLATGLR

SEQ ID NO: 456606 - protein, 9 aa, Influenza virus
SLRLAVGLR

SEQ ID NO: 456607 - protein, 9 aa, Influenza virus
SLRMKWMMA

SEQ ID NO: 456608 - protein, 9 aa, Influenza virus
SLRSILANN

SEQ ID NO: 456609 - protein, 9 aa, Influenza virus
SLRSILASS

SEQ ID NO: 456610 - protein, 9 aa, Influenza virus
SLRSIVASS

SEQ ID NO: 456611 - protein, 9 aa, Influenza virus
SLRSLIASS

SEQ ID NO: 456612 - protein, 9 aa, Influenza virus
SLRSLVASS

SEQ ID NO: 456613 - protein, 9 aa, Influenza virus
SLSGSAQHI

SEQ ID NO: 456614 - protein, 9 aa, Influenza virus
SLSISIGSS

SEQ ID NO: 456615 - protein, 9 aa, Influenza virus
SLSISVESS

SEQ ID NO: 456616 - protein, 9 aa, Influenza virus
SLSISVGSS

SEQ ID NO: 456617 - protein, 9 aa, Influenza virus
SLSLAIMIA

SEQ ID NO: 456618 - protein, 9 aa, Influenza virus
SLSLAIMMA

SEQ ID NO: 456619 - protein, 9 aa, Influenza virus
SLSLAIMVA

SEQ ID NO: 456620 - protein, 9 aa, Influenza virus
SLSPGMMMG

SEQ ID NO: 456621 - protein, 9 aa, Influenza virus
SLSYSTGAL

SEQ ID NO: 456622 - protein, 9 aa, Influenza virus
SLTEIWSYN

SEQ ID NO: 456623 - protein, 9 aa, Influenza virus
SLTHALREL

SEQ ID NO: 456624 - protein, 9 aa, Influenza virus
SLTSLPFQN

SEQ ID NO: 456625 - protein, 9 aa, Influenza virus
SLTVNVRGS

SEQ ID NO: 456626 - protein, 9 aa, Influenza virus
SLTVNVRGT

SEQ ID NO: 456627 - protein, 9 aa, Influenza virus
SLTVSVRGS

SEQ ID NO: 456628 - protein, 9 aa, Influenza virus
SLVALCGSP

SEQ ID NO: 456629 - protein, 9 aa, Influenza virus
SLVASSGNL

SEQ ID NO: 456630 - protein, 9 aa, Influenza virus
SLVASSGTL

SEQ ID NO: 456631 - protein, 9 aa, Influenza virus
SLVGIDPFK

SEQ ID NO: 456632 - protein, 9 aa, Influenza virus
SLVGIDPFR

SEQ ID NO: 456633 - protein, 9 aa, Influenza virus
SLVGVDPFK

SEQ ID NO: 456634 - protein, 9 aa, Influenza virus
SLVIAARNI

SEQ ID NO: 456635 - protein, 9 aa, Influenza virus
SLVKTTLFL

SEQ ID NO: 456636 - protein, 9 aa, Influenza virus
SLVLAAIIM

SEQ ID NO: 456637 - protein, 9 aa, Influenza virus
SLVLAALIM

SEQ ID NO: 456638 - protein, 9 aa, Influenza virus
SLVLAASIM

SEQ ID NO: 456639 - protein, 9 aa, Influenza virus
SLVLIVSLG

SEQ ID NO: 456640 - protein, 9 aa, Influenza virus
SLVLLFMII

SEQ ID NO: 456641 - protein, 9 aa, Influenza virus
SLVLLLMII

SEQ ID NO: 456642 - protein, 9 aa, Influenza virus
SLVLLVSLG

SEQ ID NO: 456643 - protein, 9 aa, Influenza virus
SLVLVVSLG

SEQ ID NO: 456644 - protein, 9 aa, Influenza virus
SLWDSFRQS

SEQ ID NO: 456645 - protein, 9 aa, Influenza virus
SLWMCSNGS

SEQ ID NO: 456646 - protein, 9 aa, Influenza virus
SLYASPQLE

SEQ ID NO: 456647 - protein, 9 aa, Influenza virus
SLYASSQLE

SEQ ID NO: 456648 - protein, 9 aa, Influenza virus
SLYDKVRMQ

SEQ ID NO: 456649 - protein, 9 aa, Influenza virus
SLYSSPQLE

SEQ ID NO: 456650 - protein, 9 aa, Influenza virus
SLYWTIVEP

SEQ ID NO: 456651 - protein, 9 aa, Influenza virus
SMAPIMFSN

SEQ ID NO: 456652 - protein, 9 aa, Influenza virus
SMCSSTEFL

SEQ ID NO: 456653 - protein, 9 aa, Influenza virus
SMDSRSGYE

SEQ ID NO: 456654 - protein, 9 aa, Influenza virus
SMEDYSIDS

SEQ ID NO: 456655 - protein, 9 aa, Influenza virus
SMEFSLTDP

SEQ ID NO: 456656 - protein, 9 aa, Influenza virus
SMELPSFGV

SEQ ID NO: 456657 - protein, 9 aa, Influenza virus
SMFLYVRTN

SEQ ID NO: 456658 - protein, 9 aa, Influenza virus
SMGEAMVSR

SEQ ID NO: 456659 - protein, 9 aa, Influenza virus
SMGFRYSGI

SEQ ID NO: 456660 - protein, 9 aa, Influenza virus
SMGIYQILA

SEQ ID NO: 456661 - protein, 9 aa, Influenza virus
SMGVYQILA

SEQ ID NO: 456662 - protein, 9 aa, Influenza virus
SMIEAESSI

SEQ ID NO: 456663 - protein, 9 aa, Influenza virus
SMIEAESSV

SEQ ID NO: 456664 - protein, 9 aa, Influenza virus
SMKWLTLKS

SEQ ID NO: 456665 - protein, 9 aa, Influenza virus
SMLKPGETL

SEQ ID NO: 456666 - protein, 9 aa, Influenza virus
SMMEAMVSR

SEQ ID NO: 456667 - protein, 9 aa, Influenza virus
SMMWEINGP

SEQ ID NO: 456668 - protein, 9 aa, Influenza virus
SMMWEVNGP

SEQ ID NO: 456669 - protein, 9 aa, Influenza virus
SMNNQVFPQ

SEQ ID NO: 456670 - protein, 9 aa, Influenza virus
SMPFHNIHP

SEQ ID NO: 456671 - protein, 9 aa, Influenza virus
SMPFHNVHP

SEQ ID NO: 456672 - protein, 9 aa, Influenza virus
SMPLHNIHP

SEQ ID NO: 456673 - protein, 9 aa, Influenza virus
SMQCRICIG

SEQ ID NO: 456674 - protein, 9 aa, Influenza virus
SMREEYQQE

SEQ ID NO: 456675 - protein, 9 aa, Influenza virus
SMREEYREE

SEQ ID NO: 456676 - protein, 9 aa, Influenza virus
SMREEYRKE

SEQ ID NO: 456677 - protein, 9 aa, Influenza virus
SMREEYRQE

SEQ ID NO: 456678 - protein, 9 aa, Influenza virus
SMREEYRQK

SEQ ID NO: 456679 - protein, 9 aa, Influenza virus
SMRWLTLKL

SEQ ID NO: 456680 - protein, 9 aa, Influenza virus
SMRWLTLKS

SEQ ID NO: 456681 - protein, 9 aa, Influenza virus
SMSCFVFVA

SEQ ID NO: 456682 - protein, 9 aa, Influenza virus
SMSDIEAMA

SEQ ID NO: 456683 - protein, 9 aa, Influenza virus
SMSGFRSNL

SEQ ID NO: 456684 - protein, 9 aa, Influenza virus
SMTEIWSYN

SEQ ID NO: 456685 - protein, 9 aa, Influenza virus
SMTEVWSYN

SEQ ID NO: 456686 - protein, 9 aa, Influenza virus
SMVEAESSV

SEQ ID NO: 456687 - protein, 9 aa, Influenza virus
SMVEAMISR

SEQ ID NO: 456688 - protein, 9 aa, Influenza virus
SMVEAMMSR

SEQ ID NO: 456689 - protein, 9 aa, Influenza virus
SMVEAMVSR

SEQ ID NO: 456690 - protein, 9 aa, Influenza virus
SMVKSDKIC

SEQ ID NO: 456691 - protein, 9 aa, Influenza virus
SMVRSDKIC

SEQ ID NO: 456692 - protein, 9 aa, Influenza virus
SMVTFCGLD

SEQ ID NO: 456693 - protein, 9 aa, Influenza virus
SNAASYKRI

SEQ ID NO: 456694 - protein, 9 aa, Influenza virus
SNAEGTGMA

SEQ ID NO: 456695 - protein, 9 aa, Influenza virus
SNAIDEGDG

SEQ ID NO: 456696 - protein, 9 aa, Influenza virus
SNAITRSGQ

SEQ ID NO: 456697 - protein, 9 aa, Influenza virus
SNALLKHRF

SEQ ID NO: 456698 - protein, 9 aa, Influenza virus
SNAPSGIEY

SEQ ID NO: 456699 - protein, 9 aa, Influenza virus
SNAPSGVEY

SEQ ID NO: 456700 - protein, 9 aa, Influenza virus
SNAQAFYKI

SEQ ID NO: 456701 - protein, 9 aa, Influenza virus
SNCKDPNEE

SEQ ID NO: 456702 - protein, 9 aa, Influenza virus
SNCKDPNNE

SEQ ID NO: 456703 - protein, 9 aa, Influenza virus
SNCRDPNDE

SEQ ID NO: 456704 - protein, 9 aa, Influenza virus
SNCRDPNEE

SEQ ID NO: 456705 - protein, 9 aa, Influenza virus
SNCRDPNNE

SEQ ID NO: 456706 - protein, 9 aa, Influenza virus
SNCRDSNNE

SEQ ID NO: 456707 - protein, 9 aa, Influenza virus
SNCRNPNNE

SEQ ID NO: 456708 - protein, 9 aa, Influenza virus
SNDDWSGYS

SEQ ID NO: 456709 - protein, 9 aa, Influenza virus
SNDKPFQNV

SEQ ID NO: 456710 - protein, 9 aa, Influenza virus
SNDNWSGYS

SEQ ID NO: 456711 - protein, 9 aa, Influenza virus
SNDQGAGYA

SEQ ID NO: 456712 - protein, 9 aa, Influenza virus
SNDQGSGYA

SEQ ID NO: 456713 - protein, 9 aa, Influenza virus
SNDTIHDRT

SEQ ID NO: 456714 - protein, 9 aa, Influenza virus
SNDTINYYN

SEQ ID NO: 456715 - protein, 9 aa, Influenza virus
SNDVWLGRT

SEQ ID NO: 456716 - protein, 9 aa, Influenza virus
SNEGSYFFG

SEQ ID NO: 456717 - protein, 9 aa, Influenza virus
SNENLIAPW

SEQ ID NO: 456718 - protein, 9 aa, Influenza virus
SNENPAHKS

SEQ ID NO: 456719 - protein, 9 aa, Influenza virus
SNEQGSGYA

SEQ ID NO: 456720 - protein, 9 aa, Influenza virus
SNETILETG

SEQ ID NO: 456721 - protein, 9 aa, Influenza virus
SNETVKDRS

SEQ ID NO: 456722 - protein, 9 aa, Influenza virus
SNGAFIAPR

SEQ ID NO: 456723 - protein, 9 aa, Influenza virus
SNGAFLAPG

SEQ ID NO: 456724 - protein, 9 aa, Influenza virus
SNGAFLAPR

SEQ ID NO: 456725 - protein, 9 aa, Influenza virus
SNGALLAPR

SEQ ID NO: 456726 - protein, 9 aa, Influenza virus
SNGGFLAPR

SEQ ID NO: 456727 - protein, 9 aa, Influenza virus
SNGGLIAPR

SEQ ID NO: 456728 - protein, 9 aa, Influenza virus
SNGGLLAPK

SEQ ID NO: 456729 - protein, 9 aa, Influenza virus
SNGGLLAPR

SEQ ID NO: 456730 - protein, 9 aa, Influenza virus
SNGNCRFNV

SEQ ID NO: 456731 - protein, 9 aa, Influenza virus
SNGNFIAPE

SEQ ID NO: 456732 - protein, 9 aa, Influenza virus
SNGNFITPE

SEQ ID NO: 456733 - protein, 9 aa, Influenza virus
SNGNLIAPE

SEQ ID NO: 456734 - protein, 9 aa, Influenza virus
SNGNLIAPL

SEQ ID NO: 456735 - protein, 9 aa, Influenza virus
SNGNLIAPR

SEQ ID NO: 456736 - protein, 9 aa, Influenza virus
SNGNLIAPW

SEQ ID NO: 456737 - protein, 9 aa, Influenza virus
SNGNLVAPR

SEQ ID NO: 456738 - protein, 9 aa, Influenza virus
SNGNLVAPW

SEQ ID NO: 456739 - protein, 9 aa, Influenza virus
SNGQGSGYA

SEQ ID NO: 456740 - protein, 9 aa, Influenza virus
SNGSCRCTI

SEQ ID NO: 456741 - protein, 9 aa, Influenza virus
SNGSCRFNV

SEQ ID NO: 456742 - protein, 9 aa, Influenza virus
SNGSLHGRI

SEQ ID NO: 456743 - protein, 9 aa, Influenza virus
SNGSLQCKI

SEQ ID NO: 456744 - protein, 9 aa, Influenza virus
SNGSLQCRI

SEQ ID NO: 456745 - protein, 9 aa, Influenza virus
SNGSLQCRV

SEQ ID NO: 456746 - protein, 9 aa, Influenza virus
SNGSLQCTI

SEQ ID NO: 456747 - protein, 9 aa, Influenza virus
SNGSLQFRI

SEQ ID NO: 456748 - protein, 9 aa, Influenza virus
SNGSLRCRI

SEQ ID NO: 456749 - protein, 9 aa, Influenza virus
SNGTAKDRS

SEQ ID NO: 456750 - protein, 9 aa, Influenza virus
SNGTIEDRT

SEQ ID NO: 456751 - protein, 9 aa, Influenza virus
SNGTIHDGT

SEQ ID NO: 456752 - protein, 9 aa, Influenza virus
SNGTIHDRA

SEQ ID NO: 456753 - protein, 9 aa, Influenza virus
SNGTIHDRI

SEQ ID NO: 456754 - protein, 9 aa, Influenza virus
SNGTIHDRN

SEQ ID NO: 456755 - protein, 9 aa, Influenza virus
SNGTIHDRS

SEQ ID NO: 456756 - protein, 9 aa, Influenza virus
SNGTIHDRT

SEQ ID NO: 456757 - protein, 9 aa, Influenza virus
SNGTIIKTL

SEQ ID NO: 456758 - protein, 9 aa, Influenza virus
SNGTIKDRS

SEQ ID NO: 456759 - protein, 9 aa, Influenza virus
SNGTIKDRT

SEQ ID NO: 456760 - protein, 9 aa, Influenza virus
SNGTIRDRT

SEQ ID NO: 456761 - protein, 9 aa, Influenza virus
SNGTIVKTL

SEQ ID NO: 456762 - protein, 9 aa, Influenza virus
SNGTKINTL

SEQ ID NO: 456763 - protein, 9 aa, Influenza virus
SNGTKVNTL

SEQ ID NO: 456764 - protein, 9 aa, Influenza virus
SNGTMKDRS

SEQ ID NO: 456765 - protein, 9 aa, Influenza virus
SNGTNKDRT

SEQ ID NO: 456766 - protein, 9 aa, Influenza virus
SNGTTHDRI

SEQ ID NO: 456767 - protein, 9 aa, Influenza virus
SNGTTHDRT

SEQ ID NO: 456768 - protein, 9 aa, Influenza virus
SNGTVKBRS

SEQ ID NO: 456769 - protein, 9 aa, Influenza virus
SNGTVKDRS

SEQ ID NO: 456770 - protein, 9 aa, Influenza virus
SNGTVKDRT

SEQ ID NO: 456771 - protein, 9 aa, Influenza virus
SNGTVKNRS

SEQ ID NO: 456772 - protein, 9 aa, Influenza virus
SNGTVNDRS

SEQ ID NO: 456773 - protein, 9 aa, Influenza virus
SNGVQDIID

SEQ ID NO: 456774 - protein, 9 aa, Influenza virus
SNGYKDVIL

SEQ ID NO: 456775 - protein, 9 aa, Influenza virus
SNIFNMERI

SEQ ID NO: 456776 - protein, 9 aa, Influenza virus
SNIGLNVSL

SEQ ID NO: 456777 - protein, 9 aa, Influenza virus
SNINIREWS

SEQ ID NO: 456778 - protein, 9 aa, Influenza virus
SNITVTSSV

SEQ ID NO: 456779 - protein, 9 aa, Influenza virus
SNKMARLGK

SEQ ID NO: 456780 - protein, 9 aa, Influenza virus
SNKMARLGR

SEQ ID NO: 456781 - protein, 9 aa, Influenza virus
SNKVARLGK

SEQ ID NO: 456782 - protein, 9 aa, Influenza virus
SNKVNSVIE

SEQ ID NO: 456783 - protein, 9 aa, Influenza virus
SNLDYQIGY

SEQ ID NO: 456784 - protein, 9 aa, Influenza virus
SNLEKRLEN

SEQ ID NO: 456785 - protein, 9 aa, Influenza virus
SNLERRLEN

SEQ ID NO: 456786 - protein, 9 aa, Influenza virus
SNLNDATYQ

SEQ ID NO: 456787 - protein, 9 aa, Influenza virus
SNLNDTTYQ

SEQ ID NO: 456788 - protein, 9 aa, Influenza virus
SNLPFQNIN

SEQ ID NO: 456789 - protein, 9 aa, Influenza virus
SNLPFQNVN

SEQ ID NO: 456790 - protein, 9 aa, Influenza virus
SNMDRAVKL

SEQ ID NO: 456791 - protein, 9 aa, Influenza virus
SNMGIYQIL

SEQ ID NO: 456792 - protein, 9 aa, Influenza virus
SNMGVYQIL

SEQ ID NO: 456793 - protein, 9 aa, Influenza virus
SNMSLNISL

SEQ ID NO: 456794 - protein, 9 aa, Influenza virus
SNNATDTVD

SEQ ID NO: 456795 - protein, 9 aa, Influenza virus
SNNDWSGYS

SEQ ID NO: 456796 - protein, 9 aa, Influenza virus
SNNRSGYSG

SEQ ID NO: 456797 - protein, 9 aa, Influenza virus
SNNSSDTVD

SEQ ID NO: 456798 - protein, 9 aa, Influenza virus
SNNSTDKID

SEQ ID NO: 456799 - protein, 9 aa, Influenza virus
SNNSTDKVD

SEQ ID NO: 456800 - protein, 9 aa, Influenza virus
SNNSTDKVN

SEQ ID NO: 456801 - protein, 9 aa, Influenza virus
SNNSTDTVD

SEQ ID NO: 456802 - protein, 9 aa, Influenza virus
SNNSTDTVN

SEQ ID NO: 456803 - protein, 9 aa, Influenza virus
SNNSTEKVD

SEQ ID NO: 456804 - protein, 9 aa, Influenza virus
SNNSTERVD

SEQ ID NO: 456805 - protein, 9 aa, Influenza virus
SNNSTNTVN

SEQ ID NO: 456806 - protein, 9 aa, Influenza virus
SNNTTNYYN

SEQ ID NO: 456807 - protein, 9 aa, Influenza virus
SNNTVKDRS

SEQ ID NO: 456808 - protein, 9 aa, Influenza virus
SNNWSGYSG

SEQ ID NO: 456809 - protein, 9 aa, Influenza virus
SNPGRVTVS

SEQ ID NO: 456810 - protein, 9 aa, Influenza virus
SNPITGSPC

SEQ ID NO: 456811 - protein, 9 aa, Influenza virus
SNPITGSPG

SEQ ID NO: 456812 - protein, 9 aa, Influenza virus
SNPITGSPS

SEQ ID NO: 456813 - protein, 9 aa, Influenza virus
SNPKCDLYL

SEQ ID NO: 456814 - protein, 9 aa, Influenza virus
SNQASYKIF

SEQ ID NO: 456815 - protein, 9 aa, Influenza virus
SNQDSFYRS

SEQ ID NO: 456816 - protein, 9 aa, Influenza virus
SNQGSFYRN

SEQ ID NO: 456817 - protein, 9 aa, Influenza virus
SNQGSFYRS

SEQ ID NO: 456818 - protein, 9 aa, Influenza virus
SNQKIITIG

SEQ ID NO: 456819 - protein, 9 aa, Influenza virus
SNRFQIQGV

SEQ ID NO: 456820 - protein, 9 aa, Influenza virus
SNRGSFYRS

SEQ ID NO: 456821 - protein, 9 aa, Influenza virus
SNRPIIDIN

SEQ ID NO: 456822 - protein, 9 aa, Influenza virus
SNRPIVDIN

SEQ ID NO: 456823 - protein, 9 aa, Influenza virus
SNRPVIDIN

SEQ ID NO: 456824 - protein, 9 aa, Influenza virus
SNRPVIDVN

SEQ ID NO: 456825 - protein, 9 aa, Influenza virus
SNRPVIQID

SEQ ID NO: 456826 - protein, 9 aa, Influenza virus
SNRPVIQIN

SEQ ID NO: 456827 - protein, 9 aa, Influenza virus
SNRPVIRID

SEQ ID NO: 456828 - protein, 9 aa, Influenza virus
SNRPVLDIS

SEQ ID NO: 456829 - protein, 9 aa, Influenza virus
SNRPVVDIN

SEQ ID NO: 456830 - protein, 9 aa, Influenza virus
SNRPVVDIR

SEQ ID NO: 456831 - protein, 9 aa, Influenza virus
SNRPWIRFN

SEQ ID NO: 456832 - protein, 9 aa, Influenza virus
SNRPWIRIN

SEQ ID NO: 456833 - protein, 9 aa, Influenza virus
SNRPWISFD

SEQ ID NO: 456834 - protein, 9 aa, Influenza virus
SNRPWISFN

SEQ ID NO: 456835 - protein, 9 aa, Influenza virus
SNRPWLSFN

SEQ ID NO: 456836 - protein, 9 aa, Influenza virus
SNRPWMRIN

SEQ ID NO: 456837 - protein, 9 aa, Influenza virus
SNRPWMRIS

SEQ ID NO: 456838 - protein, 9 aa, Influenza virus
SNRPWVRIN

SEQ ID NO: 456839 - protein, 9 aa, Influenza virus
SNRPWVRMN

SEQ ID NO: 456840 - protein, 9 aa, Influenza virus
SNRPWVSFD

SEQ ID NO: 456841 - protein, 9 aa, Influenza virus
SNRPWVSFN

SEQ ID NO: 456842 - protein, 9 aa, Influenza virus
SNRSGYSGS

SEQ ID NO: 456843 - protein, 9 aa, Influenza virus
SNSDFICVG

SEQ ID NO: 456844 - protein, 9 aa, Influenza virus
SNSDFLCVG

SEQ ID NO: 456845 - protein, 9 aa, Influenza virus
SNSDFMCVG

SEQ ID NO: 456846 - protein, 9 aa, Influenza virus
SNSDWSGYS

SEQ ID NO: 456847 - protein, 9 aa, Influenza virus
SNSEFICVG

SEQ ID NO: 456848 - protein, 9 aa, Influenza virus
SNSEFLCVG

SEQ ID NO: 456849 - protein, 9 aa, Influenza virus
SNSEGTGMA

SEQ ID NO: 456850 - protein, 9 aa, Influenza virus
SNSIAVFCG

SEQ ID NO: 456851 - protein, 9 aa, Influenza virus
SNSIIAFCG

SEQ ID NO: 456852 - protein, 9 aa, Influenza virus
SNSIIVFCG

SEQ ID NO: 456853 - protein, 9 aa, Influenza virus
SNSIVAFCG

SEQ ID NO: 456854 - protein, 9 aa, Influenza virus
SNSIVALCG

SEQ ID NO: 456855 - protein, 9 aa, Influenza virus
SNSIVSMCS

SEQ ID NO: 456856 - protein, 9 aa, Influenza virus
SNSIVTFCG

SEQ ID NO: 456857 - protein, 9 aa, Influenza virus
SNSIVVFCG

SEQ ID NO: 456858 - protein, 9 aa, Influenza virus
SNSLIALCG

SEQ ID NO: 456859 - protein, 9 aa, Influenza virus
SNSLKLAIG

SEQ ID NO: 456860 - protein, 9 aa, Influenza virus
SNSLVALCG

SEQ ID NO: 456861 - protein, 9 aa, Influenza virus
SNSMVTFCG

SEQ ID NO: 456862 - protein, 9 aa, Influenza virus
SNSNCKDPN

SEQ ID NO: 456863 - protein, 9 aa, Influenza virus
SNSNCRDPN

SEQ ID NO: 456864 - protein, 9 aa, Influenza virus
SNSNCRNPN

SEQ ID NO: 456865 - protein, 9 aa, Influenza virus
SNSRFESVA

SEQ ID NO: 456866 - protein, 9 aa, Influenza virus
SNSTTHDRT

SEQ ID NO: 456867 - protein, 9 aa, Influenza virus
SNTWLGRTI

SEQ ID NO: 456868 - protein, 9 aa, Influenza virus
SNVENLFDE

SEQ ID NO: 456869 - protein, 9 aa, Influenza virus
SNVGLKVSL

SEQ ID NO: 456870 - protein, 9 aa, Influenza virus
SNVGLNMSL

SEQ ID NO: 456871 - protein, 9 aa, Influenza virus
SNVGLNVSL

SEQ ID NO: 456872 - protein, 9 aa, Influenza virus
SNVKNLFDE

SEQ ID NO: 456873 - protein, 9 aa, Influenza virus
SNVKNLHEK

SEQ ID NO: 456874 - protein, 9 aa, Influenza virus
SNVKNLYDK

SEQ ID NO: 456875 - protein, 9 aa, Influenza virus
SNVKNLYDR

SEQ ID NO: 456876 - protein, 9 aa, Influenza virus
SNVKNLYEK

SEQ ID NO: 456877 - protein, 9 aa, Influenza virus
SNVKNLYNK

SEQ ID NO: 456878 - protein, 9 aa, Influenza virus
SNVRNLHEK

SEQ ID NO: 456879 - protein, 9 aa, Influenza virus
SNVRNLHER

SEQ ID NO: 456880 - protein, 9 aa, Influenza virus
SNVRNLYDK

SEQ ID NO: 456881 - protein, 9 aa, Influenza virus
SNVRSLHEK

SEQ ID NO: 456882 - protein, 9 aa, Influenza virus
SNVTVTSSI

SEQ ID NO: 456883 - protein, 9 aa, Influenza virus
SNVTVTSSV

SEQ ID NO: 456884 - protein, 9 aa, Influenza virus
SNVVLNVSL

SEQ ID NO: 456885 - protein, 9 aa, Influenza virus
SNWSGYSGI

SEQ ID NO: 456886 - protein, 9 aa, Influenza virus
SNWSGYSGS

SEQ ID NO: 456887 - protein, 9 aa, Influenza virus
SNYHQSFVP

SEQ ID NO: 456888 - protein, 9 aa, Influenza virus
SNYQQSFVP

SEQ ID NO: 456889 - protein, 9 aa, Influenza virus
SNYVCSGLV

SEQ ID NO: 456890 - protein, 9 aa, Influenza virus
SPCLTDKGS

SEQ ID NO: 456891 - protein, 9 aa, Influenza virus
SPDPGVKGF

SEQ ID NO: 456892 - protein, 9 aa, Influenza virus
SPEEVSEAQ

SEQ ID NO: 456893 - protein, 9 aa, Influenza virus
SPEEVSETQ

SEQ ID NO: 456894 - protein, 9 aa, Influenza virus
SPFPVGSGS

SEQ ID NO: 456895 - protein, 9 aa, Influenza virus
SPFRALISW

SEQ ID NO: 456896 - protein, 9 aa, Influenza virus
SPFRALVSW

SEQ ID NO: 456897 - protein, 9 aa, Influenza virus
SPFRTLMSC

SEQ ID NO: 456898 - protein, 9 aa, Influenza virus
SPFRTLMSV

SEQ ID NO: 456899 - protein, 9 aa, Influenza virus
SPGAPGVKG

SEQ ID NO: 456900 - protein, 9 aa, Influenza virus
SPGARPKVN

SEQ ID NO: 456901 - protein, 9 aa, Influenza virus
SPGCDRLQD

SEQ ID NO: 456902 - protein, 9 aa, Influenza virus
SPGDRPKVN

SEQ ID NO: 456903 - protein, 9 aa, Influenza virus
SPGMMMGMF

SEQ ID NO: 456904 - protein, 9 aa, Influenza virus
SPGNAEIED

SEQ ID NO: 456905 - protein, 9 aa, Influenza virus
SPGRVTVST

SEQ ID NO: 456906 - protein, 9 aa, Influenza virus
SPGVKGFGF

SEQ ID NO: 456907 - protein, 9 aa, Influenza virus
SPGVKGWAF

SEQ ID NO: 456908 - protein, 9 aa, Influenza virus
SPHRALMSC

SEQ ID NO: 456909 - protein, 9 aa, Influenza virus
SPHRSLMSC

SEQ ID NO: 456910 - protein, 9 aa, Influenza virus
SPHRTLLMN

SEQ ID NO: 456911 - protein, 9 aa, Influenza virus
SPHRTLMSC

SEQ ID NO: 456912 - protein, 9 aa, Influenza virus
SPIHLGDCS

SEQ ID NO: 456913 - protein, 9 aa, Influenza virus
SPINNGKGR

SEQ ID NO: 456914 - protein, 9 aa, Influenza virus
SPISVGSGS

SEQ ID NO: 456915 - protein, 9 aa, Influenza virus
SPIVPSFDM

SEQ ID NO: 456916 - protein, 9 aa, Influenza virus
SPKLRSGFE

SEQ ID NO: 456917 - protein, 9 aa, Influenza virus
SPLAGSAQH

SEQ ID NO: 456918 - protein, 9 aa, Influenza virus
SPLAVTWWN

SEQ ID NO: 456919 - protein, 9 aa, Influenza virus
SPLELRDCK

SEQ ID NO: 456920 - protein, 9 aa, Influenza virus
SPLGAINTT

SEQ ID NO: 456921 - protein, 9 aa, Influenza virus
SPLKLIDGQ

SEQ ID NO: 456922 - protein, 9 aa, Influenza virus
SPLKLVDGQ

SEQ ID NO: 456923 - protein, 9 aa, Influenza virus
SPLMVAYML

SEQ ID NO: 456924 - protein, 9 aa, Influenza virus
SPLPFQNID

SEQ ID NO: 456925 - protein, 9 aa, Influenza virus
SPLPFQNIN

SEQ ID NO: 456926 - protein, 9 aa, Influenza virus
SPLRLIDGQ

SEQ ID NO: 456927 - protein, 9 aa, Influenza virus
SPLRLVDGQ

SEQ ID NO: 456928 - protein, 9 aa, Influenza virus
SPLSGNAQH

SEQ ID NO: 456929 - protein, 9 aa, Influenza virus
SPLSGSAQH

SEQ ID NO: 456930 - protein, 9 aa, Influenza virus
SPLSRCRET

SEQ ID NO: 456931 - protein, 9 aa, Influenza virus
SPLSRCRKT

SEQ ID NO: 456932 - protein, 9 aa, Influenza virus
SPLTGSAQH

SEQ ID NO: 456933 - protein, 9 aa, Influenza virus
SPLTKGILG

SEQ ID NO: 456934 - protein, 9 aa, Influenza virus
SPLTKGMLG

SEQ ID NO: 456935 - protein, 9 aa, Influenza virus
SPLVLDDCS

SEQ ID NO: 456936 - protein, 9 aa, Influenza virus
SPMMWEING

SEQ ID NO: 456937 - protein, 9 aa, Influenza virus
SPNAYQAKF

SEQ ID NO: 456938 - protein, 9 aa, Influenza virus
SPNAYQAQF

SEQ ID NO: 456939 - protein, 9 aa, Influenza virus
SPNAYQARF

SEQ ID NO: 456940 - protein, 9 aa, Influenza virus
SPNVYQAKF

SEQ ID NO: 456941 - protein, 9 aa, Influenza virus
SPNVYQARF

SEQ ID NO: 456942 - protein, 9 aa, Influenza virus
SPNVYQSRF

SEQ ID NO: 456943 - protein, 9 aa, Influenza virus
SPPIVSNSD

SEQ ID NO: 456944 - protein, 9 aa, Influenza virus
SPPIVSNSE

SEQ ID NO: 456945 - protein, 9 aa, Influenza virus
SPPMVSNSD

SEQ ID NO: 456946 - protein, 9 aa, Influenza virus
SPPTVYNNR

SEQ ID NO: 456947 - protein, 9 aa, Influenza virus
SPPTVYNSK

SEQ ID NO: 456948 - protein, 9 aa, Influenza virus
SPPTVYNSR

SEQ ID NO: 456949 - protein, 9 aa, Influenza virus
SPPTVYNTR

SEQ ID NO: 456950 - protein, 9 aa, Influenza virus
SPPTVYSSR

SEQ ID NO: 456951 - protein, 9 aa, Influenza virus
SPPVVSNSD

SEQ ID NO: 456952 - protein, 9 aa, Influenza virus
SPQLEGFSA

SEQ ID NO: 456953 - protein, 9 aa, Influenza virus
SPQRTLMSC

SEQ ID NO: 456954 - protein, 9 aa, Influenza virus
SPRLRSGFE

SEQ ID NO: 456955 - protein, 9 aa, Influenza virus
SPRMFLAMI

SEQ ID NO: 456956 - protein, 9 aa, Influenza virus
SPRSRNGFE

SEQ ID NO: 456957 - protein, 9 aa, Influenza virus
SPRSRSGFE

SEQ ID NO: 456958 - protein, 9 aa, Influenza virus
SPRTVGQCP

SEQ ID NO: 456959 - protein, 9 aa, Influenza virus
SPSAPGVKG

SEQ ID NO: 456960 - protein, 9 aa, Influenza virus
SPSECRTFF

SEQ ID NO: 456961 - protein, 9 aa, Influenza virus
SPSNSRFES

SEQ ID NO: 456962 - protein, 9 aa, Influenza virus
SPSPGARPK

SEQ ID NO: 456963 - protein, 9 aa, Influenza virus
SPSPGDRPK

SEQ ID NO: 456964 - protein, 9 aa, Influenza virus
SPVHLGDCN

SEQ ID NO: 456965 - protein, 9 aa, Influenza virus
SPVHLGDCR

SEQ ID NO: 456966 - protein, 9 aa, Influenza virus
SPVHLGDCS

SEQ ID NO: 456967 - protein, 9 aa, Influenza virus
SPVLTDNPR

SEQ ID NO: 456968 - protein, 9 aa, Influenza virus
SPVNNGKGR

SEQ ID NO: 456969 - protein, 9 aa, Influenza virus
SPVPVGSGS

SEQ ID NO: 456970 - protein, 9 aa, Influenza virus
SPVSVGSGS

SEQ ID NO: 456971 - protein, 9 aa, Influenza virus
SPYNSKFES

SEQ ID NO: 456972 - protein, 9 aa, Influenza virus
SPYNSRFES

SEQ ID NO: 456973 - protein, 9 aa, Influenza virus
SPYRALISW

SEQ ID NO: 456974 - protein, 9 aa, Influenza virus
SPYRALMSC

SEQ ID NO: 456975 - protein, 9 aa, Influenza virus
SPYRALMSV

SEQ ID NO: 456976 - protein, 9 aa, Influenza virus
SPYRTLMSC

SEQ ID NO: 456977 - protein, 9 aa, Influenza virus
SPYRTLMSV

SEQ ID NO: 456978 - protein, 9 aa, Influenza virus
SQASYKIFK

SEQ ID NO: 456979 - protein, 9 aa, Influenza virus
SQDTEISFT

SEQ ID NO: 456980 - protein, 9 aa, Influenza virus
SQDTELSFT

SEQ ID NO: 456981 - protein, 9 aa, Influenza virus
SQEDCMIKA

SEQ ID NO: 456982 - protein, 9 aa, Influenza virus
SQEDCMMKA

SEQ ID NO: 456983 - protein, 9 aa, Influenza virus
SQEDCMVKA

SEQ ID NO: 456984 - protein, 9 aa, Influenza virus
SQEDRMIKA

SEQ ID NO: 456985 - protein, 9 aa, Influenza virus
SQEECMIKA

SEQ ID NO: 456986 - protein, 9 aa, Influenza virus
SQETRVWWT

SEQ ID NO: 456987 - protein, 9 aa, Influenza virus
SQFRALISW

SEQ ID NO: 456988 - protein, 9 aa, Influenza virus
SQGEGTAAD

SEQ ID NO: 456989 - protein, 9 aa, Influenza virus
SQGSGYAAD

SEQ ID NO: 456990 - protein, 9 aa, Influenza virus
SQGTKRPYE

SEQ ID NO: 456991 - protein, 9 aa, Influenza virus
SQGTKRSHE

SEQ ID NO: 456992 - protein, 9 aa, Influenza virus
SQGTKRSYE

SEQ ID NO: 456993 - protein, 9 aa, Influenza virus
SQGTTIRGK

SEQ ID NO: 456994 - protein, 9 aa, Influenza virus
SQGTTIRGR

SEQ ID NO: 456995 - protein, 9 aa, Influenza virus
SQGTTLKGR

SEQ ID NO: 456996 - protein, 9 aa, Influenza virus
SQGTTLRGQ

SEQ ID NO: 456997 - protein, 9 aa, Influenza virus
SQGTTLRGR

SEQ ID NO: 456998 - protein, 9 aa, Influenza virus
SQGVKGWAF

SEQ ID NO: 456999 - protein, 9 aa, Influenza virus
SQHKSHRQM

SEQ ID NO: 457000 - protein, 9 aa, Influenza virus
SQHRSHRQM

SEQ ID NO: 457001 - protein, 9 aa, Influenza virus
SQITNGTTG

SEQ ID NO: 457002 - protein, 9 aa, Influenza virus
SQKILCTSA

SEQ ID NO: 457003 - protein, 9 aa, Influenza virus
SQKLFALSG

SEQ ID NO: 457004 - protein, 9 aa, Influenza virus
SQKQEFKMN

SEQ ID NO: 457005 - protein, 9 aa, Influenza virus
SQLEGFSAE

SEQ ID NO: 457006 - protein, 9 aa, Influenza virus
SQLIWMACH

SEQ ID NO: 457007 - protein, 9 aa, Influenza virus
SQLKDNAKD

SEQ ID NO: 457008 - protein, 9 aa, Influenza virus
SQLKDNAND

SEQ ID NO: 457009 - protein, 9 aa, Influenza virus
SQLKKQEIE

SEQ ID NO: 457010 - protein, 9 aa, Influenza virus
SQLKRQEIE

SEQ ID NO: 457011 - protein, 9 aa, Influenza virus
SQLRDNAKD

SEQ ID NO: 457012 - protein, 9 aa, Influenza virus
SQLRDNAND

SEQ ID NO: 457013 - protein, 9 aa, Influenza virus
SQLTEVETP

SEQ ID NO: 457014 - protein, 9 aa, Influenza virus
SQLVWMACH

SEQ ID NO: 457015 - protein, 9 aa, Influenza virus
SQLVWMACN

SEQ ID NO: 457016 - protein, 9 aa, Influenza virus
SQNILRTHE

SEQ ID NO: 457017 - protein, 9 aa, Influenza virus
SQNILRTQE

SEQ ID NO: 457018 - protein, 9 aa, Influenza virus
SQRGILEDE

SEQ ID NO: 457019 - protein, 9 aa, Influenza virus
SQRGVLEDE

SEQ ID NO: 457020 - protein, 9 aa, Influenza virus
SQRSKFLLM

SEQ ID NO: 457021 - protein, 9 aa, Influenza virus
SQSGRISFY

SEQ ID NO: 457022 - protein, 9 aa, Influenza virus
SQSRTREIL

SEQ ID NO: 457023 - protein, 9 aa, Influenza virus
SQSRTRGIL

SEQ ID NO: 457024 - protein, 9 aa, Influenza virus
SQTATKRIR

SEQ ID NO: 457025 - protein, 9 aa, Influenza virus
SQTATKRLR

SEQ ID NO: 457026 - protein, 9 aa, Influenza virus
SQTIINNYH

SEQ ID NO: 457027 - protein, 9 aa, Influenza virus
SQTIINNYY

SEQ ID NO: 457028 - protein, 9 aa, Influenza virus
SQTVINNYY

SEQ ID NO: 457029 - protein, 9 aa, Influenza virus
SQVEQRINM

SEQ ID NO: 457030 - protein, 9 aa, Influenza virus
SQVERRINM

SEQ ID NO: 457031 - protein, 9 aa, Influenza virus
SQYICSPVL

SEQ ID NO: 457032 - protein, 9 aa, Influenza virus
SQYLCTGIL

SEQ ID NO: 457033 - protein, 9 aa, Influenza virus
SQYLCTGVL

SEQ ID NO: 457034 - protein, 9 aa, Influenza virus
SQYRALISW

SEQ ID NO: 457035 - protein, 9 aa, Influenza virus
SQYRALVSW

SEQ ID NO: 457036 - protein, 9 aa, Influenza virus
SQYREEALL

SEQ ID NO: 457037 - protein, 9 aa, Influenza virus
SQYRSLISW

SEQ ID NO: 457038 - protein, 9 aa, Influenza virus
SRACNNTSN

SEQ ID NO: 457039 - protein, 9 aa, Influenza virus
SRADKICIG

SEQ ID NO: 457040 - protein, 9 aa, Influenza virus
SRAGDILRT

SEQ ID NO: 457041 - protein, 9 aa, Influenza virus
SRAGYEMLK

SEQ ID NO: 457042 - protein, 9 aa, Influenza virus
SRARIDARI

SEQ ID NO: 457043 - protein, 9 aa, Influenza virus
SRARIDARV

SEQ ID NO: 457044 - protein, 9 aa, Influenza virus
SRARIKTRL

SEQ ID NO: 457045 - protein, 9 aa, Influenza virus
SRAVGKCPR

SEQ ID NO: 457046 - protein, 9 aa, Influenza virus
SRCHTDKGS

SEQ ID NO: 457047 - protein, 9 aa, Influenza virus
SRCRETRGL

SEQ ID NO: 457048 - protein, 9 aa, Influenza virus
SRCRKTRGL

SEQ ID NO: 457049 - protein, 9 aa, Influenza virus
SRDSRSGYE

SEQ ID NO: 457050 - protein, 9 aa, Influenza virus
SRERLGSWS

SEQ ID NO: 457051 - protein, 9 aa, Influenza virus
SRFEAVAWS

SEQ ID NO: 457052 - protein, 9 aa, Influenza virus
SRFESVAWS

SEQ ID NO: 457053 - protein, 9 aa, Influenza virus
SRFQIQGVK

SEQ ID NO: 457054 - protein, 9 aa, Influenza virus
SRGEVFVIR

SEQ ID NO: 457055 - protein, 9 aa, Influenza virus
SRGHIFVIR

SEQ ID NO: 457056 - protein, 9 aa, Influenza virus
SRGHVFVIR

SEQ ID NO: 457057 - protein, 9 aa, Influenza virus
SRGLFGAIA

SEQ ID NO: 457058 - protein, 9 aa, Influenza virus
SRGLFGAKA

SEQ ID NO: 457059 - protein, 9 aa, Influenza virus
SRGYKMNIQ

SEQ ID NO: 457060 - protein, 9 aa, Influenza virus
SRGYKMNNQ

SEQ ID NO: 457061 - protein, 9 aa, Influenza virus
SRGYKMNTK

SEQ ID NO: 457062 - protein, 9 aa, Influenza virus
SRGYKMNTQ

SEQ ID NO: 457063 - protein, 9 aa, Influenza virus
SRGYKMNTR

SEQ ID NO: 457064 - protein, 9 aa, Influenza virus
SRHCSKYHW

SEQ ID NO: 457065 - protein, 9 aa, Influenza virus
SRHHMGECP

SEQ ID NO: 457066 - protein, 9 aa, Influenza virus
SRHYIGKCP

SEQ ID NO: 457067 - protein, 9 aa, Influenza virus
SRHYMGECP

SEQ ID NO: 457068 - protein, 9 aa, Influenza virus
SRIAIGNCP

SEQ ID NO: 457069 - protein, 9 aa, Influenza virus
SRILTDTSR

SEQ ID NO: 457070 - protein, 9 aa, Influenza virus
SRINGVKLE

SEQ ID NO: 457071 - protein, 9 aa, Influenza virus
SRINMINSK

SEQ ID NO: 457072 - protein, 9 aa, Influenza virus
SRINMINSQ

SEQ ID NO: 457073 - protein, 9 aa, Influenza virus
SRINRQEIE

SEQ ID NO: 457074 - protein, 9 aa, Influenza virus
SRINTINSK

SEQ ID NO: 457075 - protein, 9 aa, Influenza virus
SRISFYWTI

SEQ ID NO: 457076 - protein, 9 aa, Influenza virus
SRKLLLIAQ

SEQ ID NO: 457077 - protein, 9 aa, Influenza virus
SRKLLLITQ

SEQ ID NO: 457078 - protein, 9 aa, Influenza virus
SRKLLLIVQ

SEQ ID NO: 457079 - protein, 9 aa, Influenza virus
SRKLLLVVQ

SEQ ID NO: 457080 - protein, 9 aa, Influenza virus
SRKMLLIVQ

SEQ ID NO: 457081 - protein, 9 aa, Influenza virus
SRLNRNEIK

SEQ ID NO: 457082 - protein, 9 aa, Influenza virus
SRLNRQEIE

SEQ ID NO: 457083 - protein, 9 aa, Influenza virus
SRLNWLTKA

SEQ ID NO: 457084 - protein, 9 aa, Influenza virus
SRLNWLTKE

SEQ ID NO: 457085 - protein, 9 aa, Influenza virus
SRMGVDEYS

SEQ ID NO: 457086 - protein, 9 aa, Influenza virus
SRMQFSSLA

SEQ ID NO: 457087 - protein, 9 aa, Influenza virus
SRMQFSSLT

SEQ ID NO: 457088 - protein, 9 aa, Influenza virus
SRMSICISG

SEQ ID NO: 457089 - protein, 9 aa, Influenza virus
SRMSICMSG

SEQ ID NO: 457090 - protein, 9 aa, Influenza virus
SRMSVCMSG

SEQ ID NO: 457091 - protein, 9 aa, Influenza virus
SRMTICVQG

SEQ ID NO: 457092 - protein, 9 aa, Influenza virus
SRNGFEMLK

SEQ ID NO: 457093 - protein, 9 aa, Influenza virus
SRNGKWREQ

SEQ ID NO: 457094 - protein, 9 aa, Influenza virus
SRNPGNAEI

SEQ ID NO: 457095 - protein, 9 aa, Influenza virus
SRPFQNASR

SEQ ID NO: 457096 - protein, 9 aa, Influenza virus
SRPRVRNQS

SEQ ID NO: 457097 - protein, 9 aa, Influenza virus
SRRYELEIG

SEQ ID NO: 457098 - protein, 9 aa, Influenza virus
SRSGFEIIW

SEQ ID NO: 457099 - protein, 9 aa, Influenza virus
SRSGFEILL

SEQ ID NO: 457100 - protein, 9 aa, Influenza virus
SRSGFEMIW

SEQ ID NO: 457101 - protein, 9 aa, Influenza virus
SRSGFEMLK

SEQ ID NO: 457102 - protein, 9 aa, Influenza virus
SRSGFEMLR

SEQ ID NO: 457103 - protein, 9 aa, Influenza virus
SRSGFEMVW

SEQ ID NO: 457104 - protein, 9 aa, Influenza virus
SRSGFEVLF

SEQ ID NO: 457105 - protein, 9 aa, Influenza virus
SRSGFEVLL

SEQ ID NO: 457106 - protein, 9 aa, Influenza virus
SRSGYEILK

SEQ ID NO: 457107 - protein, 9 aa, Influenza virus
SRSGYEMLK

SEQ ID NO: 457108 - protein, 9 aa, Influenza virus
SRSGYETFK

SEQ ID NO: 457109 - protein, 9 aa, Influenza virus
SRSGYETFR

SEQ ID NO: 457110 - protein, 9 aa, Influenza virus
SRSGYEVLK

SEQ ID NO: 457111 - protein, 9 aa, Influenza virus
SRSIIFNME

SEQ ID NO: 457112 - protein, 9 aa, Influenza virus
SRSLKLAIG

SEQ ID NO: 457113 - protein, 9 aa, Influenza virus
SRSNIFNME

SEQ ID NO: 457114 - protein, 9 aa, Influenza virus
SRSPGNAEI

SEQ ID NO: 457115 - protein, 9 aa, Influenza virus
SRSSCHDGK

SEQ ID NO: 457116 - protein, 9 aa, Influenza virus
SRSSFYAEM

SEQ ID NO: 457117 - protein, 9 aa, Influenza virus
SRTELINPN

SEQ ID NO: 457118 - protein, 9 aa, Influenza virus
SRTELINPS

SEQ ID NO: 457119 - protein, 9 aa, Influenza virus
SRTELIPPS

SEQ ID NO: 457120 - protein, 9 aa, Influenza virus
SRTELISPN

SEQ ID NO: 457121 - protein, 9 aa, Influenza virus
SRTELISPS

SEQ ID NO: 457122 - protein, 9 aa, Influenza virus
SRTHQYSEK

SEQ ID NO: 457123 - protein, 9 aa, Influenza virus
SRTREILTK

SEQ ID NO: 457124 - protein, 9 aa, Influenza virus
SRTREILTR

SEQ ID NO: 457125 - protein, 9 aa, Influenza virus
SRTRGILTK

SEQ ID NO: 457126 - protein, 9 aa, Influenza virus
SRVDNHSMS

SEQ ID NO: 457127 - protein, 9 aa, Influenza virus
SRVLTDTSR

SEQ ID NO: 457128 - protein, 9 aa, Influenza virus
SRYGYEMLK

SEQ ID NO: 457129 - protein, 9 aa, Influenza virus
SRYICSGLV

SEQ ID NO: 457130 - protein, 9 aa, Influenza virus
SRYSKADKI

SEQ ID NO: 457131 - protein, 9 aa, Influenza virus
SRYVCSGLV

SEQ ID NO: 457132 - protein, 9 aa, Influenza virus
SRYVCTGIL

SEQ ID NO: 457133 - protein, 9 aa, Influenza virus
SRYWAIRTR

SEQ ID NO: 457134 - protein, 9 aa, Influenza virus
SRYYMGECP

SEQ ID NO: 457135 - protein, 9 aa, Influenza virus
SSAASYKRI

SEQ ID NO: 457136 - protein, 9 aa, Influenza virus
SSAASYKRV

SEQ ID NO: 457137 - protein, 9 aa, Influenza virus
SSACLRGGR

SEQ ID NO: 457138 - protein, 9 aa, Influenza virus
SSAQEKNDL

SEQ ID NO: 457139 - protein, 9 aa, Influenza virus
SSASCHDGR

SEQ ID NO: 457140 - protein, 9 aa, Influenza virus
SSCAAMDDF

SEQ ID NO: 457141 - protein, 9 aa, Influenza virus
SSCFDGKEW

SEQ ID NO: 457142 - protein, 9 aa, Influenza virus
SSCFDGREW

SEQ ID NO: 457143 - protein, 9 aa, Influenza virus
SSCHDGKAW

SEQ ID NO: 457144 - protein, 9 aa, Influenza virus
SSCHDGKSW

SEQ ID NO: 457145 - protein, 9 aa, Influenza virus
SSCHDGNAW

SEQ ID NO: 457146 - protein, 9 aa, Influenza virus
SSCHDGRAW

SEQ ID NO: 457147 - protein, 9 aa, Influenza virus
SSCYDGKAW

SEQ ID NO: 457148 - protein, 9 aa, Influenza virus
SSDDFALIL

SEQ ID NO: 457149 - protein, 9 aa, Influenza virus
SSDDFALIV

SEQ ID NO: 457150 - protein, 9 aa, Influenza virus
SSDICYPGK

SEQ ID NO: 457151 - protein, 9 aa, Influenza virus
SSDICYPGR

SEQ ID NO: 457152 - protein, 9 aa, Influenza virus
SSDKVDTLL

SEQ ID NO: 457153 - protein, 9 aa, Influenza virus
SSDNEQTDL

SEQ ID NO: 457154 - protein, 9 aa, Influenza virus
SSDTVDTLT

SEQ ID NO: 457155 - protein, 9 aa, Influenza virus
SSEAPGWSW

SEQ ID NO: 457156 - protein, 9 aa, Influenza virus
SSEKVDTLL

SEQ ID NO: 457157 - protein, 9 aa, Influenza virus
SSEKVNTLL

SEQ ID NO: 457158 - protein, 9 aa, Influenza virus
SSEQAAEAI

SEQ ID NO: 457159 - protein, 9 aa, Influenza virus
SSEQAAEAM

SEQ ID NO: 457160 - protein, 9 aa, Influenza virus
SSERVDTLL

SEQ ID NO: 457161 - protein, 9 aa, Influenza virus
SSEVPEWSW

SEQ ID NO: 457162 - protein, 9 aa, Influenza virus
SSEVPGWSW

SEQ ID NO: 457163 - protein, 9 aa, Influenza virus
SSFEKFEIF

SEQ ID NO: 457164 - protein, 9 aa, Influenza virus
SSFEQITFM

SEQ ID NO: 457165 - protein, 9 aa, Influenza virus
SSFERFEIF

SEQ ID NO: 457166 - protein, 9 aa, Influenza virus
SSFERFEMF

SEQ ID NO: 457167 - protein, 9 aa, Influenza virus
SSFFRNIVW

SEQ ID NO: 457168 - protein, 9 aa, Influenza virus
SSFFRNMVW

SEQ ID NO: 457169 - protein, 9 aa, Influenza virus
SSFFRNVVW

SEQ ID NO: 457170 - protein, 9 aa, Influenza virus
SSFQVDCFI

SEQ ID NO: 457171 - protein, 9 aa, Influenza virus
SSFQVDCFL

SEQ ID NO: 457172 - protein, 9 aa, Influenza virus
SSFSFGGFT

SEQ ID NO: 457173 - protein, 9 aa, Influenza virus
SSFYAEMEW

SEQ ID NO: 457174 - protein, 9 aa, Influenza virus
SSFYAEMKW

SEQ ID NO: 457175 - protein, 9 aa, Influenza virus
SSFYRNLIW

SEQ ID NO: 457176 - protein, 9 aa, Influenza virus
SSFYRNLLW

SEQ ID NO: 457177 - protein, 9 aa, Influenza virus
SSFYRNLVW

SEQ ID NO: 457178 - protein, 9 aa, Influenza virus
SSFYRNVVW

SEQ ID NO: 457179 - protein, 9 aa, Influenza virus
SSFYSEMKW

SEQ ID NO: 457180 - protein, 9 aa, Influenza virus
SSGGLLAPR

SEQ ID NO: 457181 - protein, 9 aa, Influenza virus
SSGIAIALG

SEQ ID NO: 457182 - protein, 9 aa, Influenza virus
SSGIAIVLG

SEQ ID NO: 457183 - protein, 9 aa, Influenza virus
SSGNCRFNV

SEQ ID NO: 457184 - protein, 9 aa, Influenza virus
SSGNCRFSV

SEQ ID NO: 457185 - protein, 9 aa, Influenza virus
SSGNNQVFP

SEQ ID NO: 457186 - protein, 9 aa, Influenza virus
SSGSLEFIA

SEQ ID NO: 457187 - protein, 9 aa, Influenza virus
SSGSLKLAI

SEQ ID NO: 457188 - protein, 9 aa, Influenza virus
SSGTSKACN

SEQ ID NO: 457189 - protein, 9 aa, Influenza virus
SSGTSKACS

SEQ ID NO: 457190 - protein, 9 aa, Influenza virus
SSGTVKDRS

SEQ ID NO: 457191 - protein, 9 aa, Influenza virus
SSGYKDIIL

SEQ ID NO: 457192 - protein, 9 aa, Influenza virus
SSGYKDVII

SEQ ID NO: 457193 - protein, 9 aa, Influenza virus
SSGYKDVIL

SEQ ID NO: 457194 - protein, 9 aa, Influenza virus
SSGYKEVIL

SEQ ID NO: 457195 - protein, 9 aa, Influenza virus
SSIAFCGVD

SEQ ID NO: 457196 - protein, 9 aa, Influenza virus
SSIAFCGVN

SEQ ID NO: 457197 - protein, 9 aa, Influenza virus
SSIDLVETN

SEQ ID NO: 457198 - protein, 9 aa, Influenza virus
SSIGKVCRT

SEQ ID NO: 457199 - protein, 9 aa, Influenza virus
SSIKEKDMT

SEQ ID NO: 457200 - protein, 9 aa, Influenza virus
SSIKKYERV

SEQ ID NO: 457201 - protein, 9 aa, Influenza virus
SSIKRYERV

SEQ ID NO: 457202 - protein, 9 aa, Influenza virus
SSILTDSQT

SEQ ID NO: 457203 - protein, 9 aa, Influenza virus
SSISFCGVD

SEQ ID NO: 457204 - protein, 9 aa, Influenza virus
SSISFCGVN

SEQ ID NO: 457205 - protein, 9 aa, Influenza virus
SSISFCGVS

SEQ ID NO: 457206 - protein, 9 aa, Influenza virus
SSIVLVGLI

SEQ ID NO: 457207 - protein, 9 aa, Influenza virus
SSIVMCGVD

SEQ ID NO: 457208 - protein, 9 aa, Influenza virus
SSIVMCGVN

SEQ ID NO: 457209 - protein, 9 aa, Influenza virus
SSIVMVGLI

SEQ ID NO: 457210 - protein, 9 aa, Influenza virus
SSIYIEVLH

SEQ ID NO: 457211 - protein, 9 aa, Influenza virus
SSIYQNSFV

SEQ ID NO: 457212 - protein, 9 aa, Influenza virus
SSKANQVFP

SEQ ID NO: 457213 - protein, 9 aa, Influenza virus
SSKCQQSFT

SEQ ID NO: 457214 - protein, 9 aa, Influenza virus
SSKDNQVFP

SEQ ID NO: 457215 - protein, 9 aa, Influenza virus
SSKPFHNIH

SEQ ID NO: 457216 - protein, 9 aa, Influenza virus
SSKPFQNAS

SEQ ID NO: 457217 - protein, 9 aa, Influenza virus
SSKPFQNTS

SEQ ID NO: 457218 - protein, 9 aa, Influenza virus
SSKPLQNAS

SEQ ID NO: 457219 - protein, 9 aa, Influenza virus
SSKYQQSFS

SEQ ID NO: 457220 - protein, 9 aa, Influenza virus
SSKYQQSFT

SEQ ID NO: 457221 - protein, 9 aa, Influenza virus
SSKYRQSFS

SEQ ID NO: 457222 - protein, 9 aa, Influenza virus
SSLAVNVRG

SEQ ID NO: 457223 - protein, 9 aa, Influenza virus
SSLDEQNKL

SEQ ID NO: 457224 - protein, 9 aa, Influenza virus
SSLILAAII

SEQ ID NO: 457225 - protein, 9 aa, Influenza virus
SSLILAALI

SEQ ID NO: 457226 - protein, 9 aa, Influenza virus
SSLLLQANL

SEQ ID NO: 457227 - protein, 9 aa, Influenza virus
SSLMWEING

SEQ ID NO: 457228 - protein, 9 aa, Influenza virus
SSLPFHNVH

SEQ ID NO: 457229 - protein, 9 aa, Influenza virus
SSLPFQNIN

SEQ ID NO: 457230 - protein, 9 aa, Influenza virus
SSLPFQNIS

SEQ ID NO: 457231 - protein, 9 aa, Influenza virus
SSLPLALGM

SEQ ID NO: 457232 - protein, 9 aa, Influenza virus
SSLSGSAQH

SEQ ID NO: 457233 - protein, 9 aa, Influenza virus
SSLTHALRE

SEQ ID NO: 457234 - protein, 9 aa, Influenza virus
SSLTVNVRG

SEQ ID NO: 457235 - protein, 9 aa, Influenza virus
SSLTVSVRG

SEQ ID NO: 457236 - protein, 9 aa, Influenza virus
SSLVLAAII

SEQ ID NO: 457237 - protein, 9 aa, Influenza virus
SSLVLAALI

SEQ ID NO: 457238 - protein, 9 aa, Influenza virus
SSLVLAALN

SEQ ID NO: 457239 - protein, 9 aa, Influenza virus
SSLVLIVSL

SEQ ID NO: 457240 - protein, 9 aa, Influenza virus
SSLVLLFMI

SEQ ID NO: 457241 - protein, 9 aa, Influenza virus
SSLVLLLMI

SEQ ID NO: 457242 - protein, 9 aa, Influenza virus
SSLVLLVSL

SEQ ID NO: 457243 - protein, 9 aa, Influenza virus
SSLVLMGLI

SEQ ID NO: 457244 - protein, 9 aa, Influenza virus
SSLVLVGLI

SEQ ID NO: 457245 - protein, 9 aa, Influenza virus
SSLVLVGLV

SEQ ID NO: 457246 - protein, 9 aa, Influenza virus
SSLVLVVSL

SEQ ID NO: 457247 - protein, 9 aa, Influenza virus
SSMGEAMVS

SEQ ID NO: 457248 - protein, 9 aa, Influenza virus
SSMGIYQIL

SEQ ID NO: 457249 - protein, 9 aa, Influenza virus
SSMGVYQIL

SEQ ID NO: 457250 - protein, 9 aa, Influenza virus
SSMMEAMVS

SEQ ID NO: 457251 - protein, 9 aa, Influenza virus
SSMMWEING

SEQ ID NO: 457252 - protein, 9 aa, Influenza virus
SSMMWEVNG

SEQ ID NO: 457253 - protein, 9 aa, Influenza virus
SSMNNQVFP

SEQ ID NO: 457254 - protein, 9 aa, Influenza virus
SSMPFHNIH

SEQ ID NO: 457255 - protein, 9 aa, Influenza virus
SSMPFHNVH

SEQ ID NO: 457256 - protein, 9 aa, Influenza virus
SSMPLHNIH

SEQ ID NO: 457257 - protein, 9 aa, Influenza virus
SSMQCRICI

SEQ ID NO: 457258 - protein, 9 aa, Influenza virus
SSMVEAMIS

SEQ ID NO: 457259 - protein, 9 aa, Influenza virus
SSMVEAMMS

SEQ ID NO: 457260 - protein, 9 aa, Influenza virus
SSMVEAMVS

SEQ ID NO: 457261 - protein, 9 aa, Influenza virus
SSNCKDPNN

SEQ ID NO: 457262 - protein, 9 aa, Influenza virus
SSNCRDPNN

SEQ ID NO: 457263 - protein, 9 aa, Influenza virus
SSNCRDSNN

SEQ ID NO: 457264 - protein, 9 aa, Influenza virus
SSNCRNPNN

SEQ ID NO: 457265 - protein, 9 aa, Influenza virus
SSNYHQSFV

SEQ ID NO: 457266 - protein, 9 aa, Influenza virus
SSNYQQSFV

SEQ ID NO: 457267 - protein, 9 aa, Influenza virus
SSPMMWEIN

SEQ ID NO: 457268 - protein, 9 aa, Influenza virus
SSPNAYQAK

SEQ ID NO: 457269 - protein, 9 aa, Influenza virus
SSPNAYQAR

SEQ ID NO: 457270 - protein, 9 aa, Influenza virus
SSPPTVYNN

SEQ ID NO: 457271 - protein, 9 aa, Influenza virus
SSPPTVYNS

SEQ ID NO: 457272 - protein, 9 aa, Influenza virus
SSPPTVYNT

SEQ ID NO: 457273 - protein, 9 aa, Influenza virus
SSQDTELSF

SEQ ID NO: 457274 - protein, 9 aa, Influenza virus
SSQLEGFSA

SEQ ID NO: 457275 - protein, 9 aa, Influenza virus
SSRHCSKYH

SEQ ID NO: 457276 - protein, 9 aa, Influenza virus
SSRISFYWT

SEQ ID NO: 457277 - protein, 9 aa, Influenza virus
SSRNGFEIL

SEQ ID NO: 457278 - protein, 9 aa, Influenza virus
SSRPFQNAS

SEQ ID NO: 457279 - protein, 9 aa, Influenza virus
SSRSGFEIL

SEQ ID NO: 457280 - protein, 9 aa, Influenza virus
SSRSGFEVL

SEQ ID NO: 457281 - protein, 9 aa, Influenza virus
SSSACLRGG

SEQ ID NO: 457282 - protein, 9 aa, Influenza virus
SSSCFDGKE

SEQ ID NO: 457283 - protein, 9 aa, Influenza virus
SSSCFDGRE

SEQ ID NO: 457284 - protein, 9 aa, Influenza virus
SSSCHDGKA

SEQ ID NO: 457285 - protein, 9 aa, Influenza virus
SSSCHDGKS

SEQ ID NO: 457286 - protein, 9 aa, Influenza virus
SSSCHDGNA

SEQ ID NO: 457287 - protein, 9 aa, Influenza virus
SSSCHDGRA

SEQ ID NO: 457288 - protein, 9 aa, Influenza virus
SSSCYDGKA

SEQ ID NO: 457289 - protein, 9 aa, Influenza virus
SSSFSFGGF

SEQ ID NO: 457290 - protein, 9 aa, Influenza virus
SSSFYAEMK

SEQ ID NO: 457291 - protein, 9 aa, Influenza virus
SSSGNNQVF

SEQ ID NO: 457292 - protein, 9 aa, Influenza virus
SSSGTSKAC

SEQ ID NO: 457293 - protein, 9 aa, Influenza virus
SSSIVMCGV

SEQ ID NO: 457294 - protein, 9 aa, Influenza virus
SSSIVVFCG

SEQ ID NO: 457295 - protein, 9 aa, Influenza virus
SSSLDEQNK

SEQ ID NO: 457296 - protein, 9 aa, Influenza virus
SSSLMWEIN

SEQ ID NO: 457297 - protein, 9 aa, Influenza virus
SSSLVLAGL

SEQ ID NO: 457298 - protein, 9 aa, Influenza virus
SSSLVLMGL

SEQ ID NO: 457299 - protein, 9 aa, Influenza virus
SSSLVLVGL

SEQ ID NO: 457300 - protein, 9 aa, Influenza virus
SSSMMWEIN

SEQ ID NO: 457301 - protein, 9 aa, Influenza virus
SSSMMWEVN

SEQ ID NO: 457302 - protein, 9 aa, Influenza virus
SSSMNNQVF

SEQ ID NO: 457303 - protein, 9 aa, Influenza virus
SSSNAYQAK

SEQ ID NO: 457304 - protein, 9 aa, Influenza virus
SSSNCKDPN

SEQ ID NO: 457305 - protein, 9 aa, Influenza virus
SSSNCRDPN

SEQ ID NO: 457306 - protein, 9 aa, Influenza virus
SSSNCRDSN

SEQ ID NO: 457307 - protein, 9 aa, Influenza virus
SSSNCRNPN

SEQ ID NO: 457308 - protein, 9 aa, Influenza virus
SSSSCFDGK

SEQ ID NO: 457309 - protein, 9 aa, Influenza virus
SSSSCFDGR

SEQ ID NO: 457310 - protein, 9 aa, Influenza virus
SSSSCHDGK

SEQ ID NO: 457311 - protein, 9 aa, Influenza virus
SSSSCHDGN

SEQ ID NO: 457312 - protein, 9 aa, Influenza virus
SSSSCHDGR

SEQ ID NO: 457313 - protein, 9 aa, Influenza virus
SSSSCYDGK

SEQ ID NO: 457314 - protein, 9 aa, Influenza virus
SSSSFYAEM

SEQ ID NO: 457315 - protein, 9 aa, Influenza virus
SSSSIVMCG

SEQ ID NO: 457316 - protein, 9 aa, Influenza virus
SSSSTVFCG

SEQ ID NO: 457317 - protein, 9 aa, Influenza virus
SSSSVVMCG

SEQ ID NO: 457318 - protein, 9 aa, Influenza virus
SSSTVFCGV

SEQ ID NO: 457319 - protein, 9 aa, Influenza virus
SSSVLLVSL

SEQ ID NO: 457320 - protein, 9 aa, Influenza virus
SSSVVMCGV

SEQ ID NO: 457321 - protein, 9 aa, Influenza virus
SSSYRRPIG

SEQ ID NO: 457322 - protein, 9 aa, Influenza virus
SSSYRRPVG

SEQ ID NO: 457323 - protein, 9 aa, Influenza virus
SSTEFLGQW

SEQ ID NO: 457324 - protein, 9 aa, Influenza virus
SSTKEKNDL

SEQ ID NO: 457325 - protein, 9 aa, Influenza virus
SSTKEKNEL

SEQ ID NO: 457326 - protein, 9 aa, Influenza virus
SSTQEKNDL

SEQ ID NO: 457327 - protein, 9 aa, Influenza virus
SSTQERNDL

SEQ ID NO: 457328 - protein, 9 aa, Influenza virus
SSTSCFDGK

SEQ ID NO: 457329 - protein, 9 aa, Influenza virus
SSTSCHDGI

SEQ ID NO: 457330 - protein, 9 aa, Influenza virus
SSTSCHDGK

SEQ ID NO: 457331 - protein, 9 aa, Influenza virus
SSTSCHDGM

SEQ ID NO: 457332 - protein, 9 aa, Influenza virus
SSTSCHDGR

SEQ ID NO: 457333 - protein, 9 aa, Influenza virus
SSTSCHDGV

SEQ ID NO: 457334 - protein, 9 aa, Influenza virus
SSTTCHDGI

SEQ ID NO: 457335 - protein, 9 aa, Influenza virus
SSTTCHDGV

SEQ ID NO: 457336 - protein, 9 aa, Influenza virus
SSTVFCGVS

SEQ ID NO: 457337 - protein, 9 aa, Influenza virus
SSTVLVGLI

SEQ ID NO: 457338 - protein, 9 aa, Influenza virus
SSTVMVGLI

SEQ ID NO: 457339 - protein, 9 aa, Influenza virus
SSTYHNSFV

SEQ ID NO: 457340 - protein, 9 aa, Influenza virus
SSTYQNNFV

SEQ ID NO: 457341 - protein, 9 aa, Influenza virus
SSTYQNSFV

SEQ ID NO: 457342 - protein, 9 aa, Influenza virus
SSVASSLVL

SEQ ID NO: 457343 - protein, 9 aa, Influenza virus
SSVDLVETN

SEQ ID NO: 457344 - protein, 9 aa, Influenza virus
SSVKEKDLT

SEQ ID NO: 457345 - protein, 9 aa, Influenza virus
SSVKEKDMT

SEQ ID NO: 457346 - protein, 9 aa, Influenza virus
SSVLLVSLG

SEQ ID NO: 457347 - protein, 9 aa, Influenza virus
SSVNTNTIN

SEQ ID NO: 457348 - protein, 9 aa, Influenza virus
SSVREKDMT

SEQ ID NO: 457349 - protein, 9 aa, Influenza virus
SSVSSFEKF

SEQ ID NO: 457350 - protein, 9 aa, Influenza virus
SSVSSFERF

SEQ ID NO: 457351 - protein, 9 aa, Influenza virus
SSVSSFKRF

SEQ ID NO: 457352 - protein, 9 aa, Influenza virus
SSVTTNTIN

SEQ ID NO: 457353 - protein, 9 aa, Influenza virus
SSVVLVGLI

SEQ ID NO: 457354 - protein, 9 aa, Influenza virus
SSVVLVGPI

SEQ ID NO: 457355 - protein, 9 aa, Influenza virus
SSVVMCGVD

SEQ ID NO: 457356 - protein, 9 aa, Influenza virus
SSVYIEVLH

SEQ ID NO: 457357 - protein, 9 aa, Influenza virus
SSVYVEVLH

SEQ ID NO: 457358 - protein, 9 aa, Influenza virus
SSWHILSKD

SEQ ID NO: 457359 - protein, 9 aa, Influenza virus
SSYICSGLV

SEQ ID NO: 457360 - protein, 9 aa, Influenza virus
SSYLCSGLV

SEQ ID NO: 457361 - protein, 9 aa, Influenza virus
SSYMCSGLV

SEQ ID NO: 457362 - protein, 9 aa, Influenza virus
SSYRRPIGI

SEQ ID NO: 457363 - protein, 9 aa, Influenza virus
SSYRRPVGI

SEQ ID NO: 457364 - protein, 9 aa, Influenza virus
SSYVCSGLV

SEQ ID NO: 457365 - protein, 9 aa, Influenza virus
STAASSLAL

SEQ ID NO: 457366 - protein, 9 aa, Influenza virus
STAASSLVL

SEQ ID NO: 457367 - protein, 9 aa, Influenza virus
STASRSGYE

SEQ ID NO: 457368 - protein, 9 aa, Influenza virus
STAVAVIKY

SEQ ID NO: 457369 - protein, 9 aa, Influenza virus
STCVVVMTD

SEQ ID NO: 457370 - protein, 9 aa, Influenza virus
STDKDSNGV

SEQ ID NO: 457371 - protein, 9 aa, Influenza virus
STDKIDTLT

SEQ ID NO: 457372 - protein, 9 aa, Influenza virus
STDKNSNGV

SEQ ID NO: 457373 - protein, 9 aa, Influenza virus
STDKVDTII

SEQ ID NO: 457374 - protein, 9 aa, Influenza virus
STDKVDTLT

SEQ ID NO: 457375 - protein, 9 aa, Influenza virus
STDKVNTII

SEQ ID NO: 457376 - protein, 9 aa, Influenza virus
STDSEMNKL

SEQ ID NO: 457377 - protein, 9 aa, Influenza virus
STDTVDTIL

SEQ ID NO: 457378 - protein, 9 aa, Influenza virus
STDTVDTLI

SEQ ID NO: 457379 - protein, 9 aa, Influenza virus
STDTVDTLL

SEQ ID NO: 457380 - protein, 9 aa, Influenza virus
STDTVDTLT

SEQ ID NO: 457381 - protein, 9 aa, Influenza virus
STDTVDTVL

SEQ ID NO: 457382 - protein, 9 aa, Influenza virus
STDTVNTLI

SEQ ID NO: 457383 - protein, 9 aa, Influenza virus
STDTVNTLM

SEQ ID NO: 457384 - protein, 9 aa, Influenza virus
STDTVNTLT

SEQ ID NO: 457385 - protein, 9 aa, Influenza virus
STEFLGQWD

SEQ ID NO: 457386 - protein, 9 aa, Influenza virus
STEFLGQWN

SEQ ID NO: 457387 - protein, 9 aa, Influenza virus
STEKVDTII

SEQ ID NO: 457388 - protein, 9 aa, Influenza virus
STEKVDTLL

SEQ ID NO: 457389 - protein, 9 aa, Influenza virus
STEQVDTIM

SEQ ID NO: 457390 - protein, 9 aa, Influenza virus
STERVDTII

SEQ ID NO: 457391 - protein, 9 aa, Influenza virus
STERVDTIM

SEQ ID NO: 457392 - protein, 9 aa, Influenza virus
STETVNTLI

SEQ ID NO: 457393 - protein, 9 aa, Influenza virus
STETVNTLS

SEQ ID NO: 457394 - protein, 9 aa, Influenza virus
STETVNTLT

SEQ ID NO: 457395 - protein, 9 aa, Influenza virus
STGALASCM

SEQ ID NO: 457396 - protein, 9 aa, Influenza virus
STGAQSFYR

SEQ ID NO: 457397 - protein, 9 aa, Influenza virus
STGGQAFYR

SEQ ID NO: 457398 - protein, 9 aa, Influenza virus
STGGQSFYR

SEQ ID NO: 457399 - protein, 9 aa, Influenza virus
STGKDPKKT

SEQ ID NO: 457400 - protein, 9 aa, Influenza virus
STGNFIAPE

SEQ ID NO: 457401 - protein, 9 aa, Influenza virus
STGNHGSLV

SEQ ID NO: 457402 - protein, 9 aa, Influenza virus
STGNLIAPE

SEQ ID NO: 457403 - protein, 9 aa, Influenza virus
STGNLIAPR

SEQ ID NO: 457404 - protein, 9 aa, Influenza virus
STGNLVAPE

SEQ ID NO: 457405 - protein, 9 aa, Influenza virus
STIALFIGV

SEQ ID NO: 457406 - protein, 9 aa, Influenza virus
STIALIIGV

SEQ ID NO: 457407 - protein, 9 aa, Influenza virus
STIALLIGI

SEQ ID NO: 457408 - protein, 9 aa, Influenza virus
STIALLIGV

SEQ ID NO: 457409 - protein, 9 aa, Influenza virus
STIGDCPKY

SEQ ID NO: 457410 - protein, 9 aa, Influenza virus
STISCDSPS

SEQ ID NO: 457411 - protein, 9 aa, Influenza virus
STKALLIGI

SEQ ID NO: 457412 - protein, 9 aa, Influenza virus
STKEKNDLY

SEQ ID NO: 457413 - protein, 9 aa, Influenza virus
STKEKNELY

SEQ ID NO: 457414 - protein, 9 aa, Influenza virus
STKEWSKRY

SEQ ID NO: 457415 - protein, 9 aa, Influenza virus
STKEWSRRY

SEQ ID NO: 457416 - protein, 9 aa, Influenza virus
STKQVDTIM

SEQ ID NO: 457417 - protein, 9 aa, Influenza virus
STKSTVLKS

SEQ ID NO: 457418 - protein, 9 aa, Influenza virus
STLGLDIRT

SEQ ID NO: 457419 - protein, 9 aa, Influenza virus
STLKLATGM

SEQ ID NO: 457420 - protein, 9 aa, Influenza virus
STLPRRSGA

SEQ ID NO: 457421 - protein, 9 aa, Influenza virus
STLVLLVSL

SEQ ID NO: 457422 - protein, 9 aa, Influenza virus
STMLNLYER

SEQ ID NO: 457423 - protein, 9 aa, Influenza virus
STMSCDSPS

SEQ ID NO: 457424 - protein, 9 aa, Influenza virus
STNAHDRIC

SEQ ID NO: 457425 - protein, 9 aa, Influenza virus
STNAYDRIC

SEQ ID NO: 457426 - protein, 9 aa, Influenza virus
STNSSDKVD

SEQ ID NO: 457427 - protein, 9 aa, Influenza virus
STNSSEKVD

SEQ ID NO: 457428 - protein, 9 aa, Influenza virus
STNSSEKVN

SEQ ID NO: 457429 - protein, 9 aa, Influenza virus
STNSSERVD

SEQ ID NO: 457430 - protein, 9 aa, Influenza virus
STNSTEKVD

SEQ ID NO: 457431 - protein, 9 aa, Influenza virus
STNTVNTLI

SEQ ID NO: 457432 - protein, 9 aa, Influenza virus
STPLGSPPI

SEQ ID NO: 457433 - protein, 9 aa, Influenza virus
STPLGSPPM

SEQ ID NO: 457434 - protein, 9 aa, Influenza virus
STPLGSPPV

SEQ ID NO: 457435 - protein, 9 aa, Influenza virus
STPLGTPPT

SEQ ID NO: 457436 - protein, 9 aa, Influenza virus
STPSAIDQI

SEQ ID NO: 457437 - protein, 9 aa, Influenza virus
STQAAIDKI

SEQ ID NO: 457438 - protein, 9 aa, Influenza virus
STQAAIDQI

SEQ ID NO: 457439 - protein, 9 aa, Influenza virus
STQAAIDQV

SEQ ID NO: 457440 - protein, 9 aa, Influenza virus
STQAAINQI

SEQ ID NO: 457441 - protein, 9 aa, Influenza virus
STQAAVDQI

SEQ ID NO: 457442 - protein, 9 aa, Influenza virus
STQAAVNQI

SEQ ID NO: 457443 - protein, 9 aa, Influenza virus
STQATIDQI

SEQ ID NO: 457444 - protein, 9 aa, Influenza virus
STQEAIDKI

SEQ ID NO: 457445 - protein, 9 aa, Influenza virus
STQEAIEKI

SEQ ID NO: 457446 - protein, 9 aa, Influenza virus
STQEAIGKI

SEQ ID NO: 457447 - protein, 9 aa, Influenza virus
STQEAINKI

SEQ ID NO: 457448 - protein, 9 aa, Influenza virus
STQEKNDLY

SEQ ID NO: 457449 - protein, 9 aa, Influenza virus
STQERNDLY

SEQ ID NO: 457450 - protein, 9 aa, Influenza virus
STQKAIDEI

SEQ ID NO: 457451 - protein, 9 aa, Influenza virus
STQKAIDGI

SEQ ID NO: 457452 - protein, 9 aa, Influenza virus
STQKAIDGV

SEQ ID NO: 457453 - protein, 9 aa, Influenza virus
STQKAIDIM

SEQ ID NO: 457454 - protein, 9 aa, Influenza virus
STQKAIDNM

SEQ ID NO: 457455 - protein, 9 aa, Influenza virus
STQKAIDQI

SEQ ID NO: 457456 - protein, 9 aa, Influenza virus
STQKAIDRI

SEQ ID NO: 457457 - protein, 9 aa, Influenza virus
STQKAINEI

SEQ ID NO: 457458 - protein, 9 aa, Influenza virus
STQKAINGI

SEQ ID NO: 457459 - protein, 9 aa, Influenza virus
STQKAINGV

SEQ ID NO: 457460 - protein, 9 aa, Influenza virus
STQKALNEI

SEQ ID NO: 457461 - protein, 9 aa, Influenza virus
STQKAVDGI

SEQ ID NO: 457462 - protein, 9 aa, Influenza virus
STQKTIDQV

SEQ ID NO: 457463 - protein, 9 aa, Influenza virus
STQMAIDNM

SEQ ID NO: 457464 - protein, 9 aa, Influenza virus
STQPTFSVQ

SEQ ID NO: 457465 - protein, 9 aa, Influenza virus
STQRAIDGI

SEQ ID NO: 457466 - protein, 9 aa, Influenza virus
STQRAIDGV

SEQ ID NO: 457467 - protein, 9 aa, Influenza virus
STQRAIDNM

SEQ ID NO: 457468 - protein, 9 aa, Influenza virus
STQSAIDQI

SEQ ID NO: 457469 - protein, 9 aa, Influenza virus
STQSAIDQV

SEQ ID NO: 457470 - protein, 9 aa, Influenza virus
STQSAINQI

SEQ ID NO: 457471 - protein, 9 aa, Influenza virus
STQSAVDQI

SEQ ID NO: 457472 - protein, 9 aa, Influenza virus
STQSAVNQI

SEQ ID NO: 457473 - protein, 9 aa, Influenza virus
STQTAIDQI

SEQ ID NO: 457474 - protein, 9 aa, Influenza virus
STRGIQIAS

SEQ ID NO: 457475 - protein, 9 aa, Influenza virus
STRGVQIAS

SEQ ID NO: 457476 - protein, 9 aa, Influenza virus
STRGVQVAS

SEQ ID NO: 457477 - protein, 9 aa, Influenza virus
STRSDQISI

SEQ ID NO: 457478 - protein, 9 aa, Influenza virus
STRSRSGFE

SEQ ID NO: 457479 - protein, 9 aa, Influenza virus
STSCFDGKE

SEQ ID NO: 457480 - protein, 9 aa, Influenza virus
STSCHDGIG

SEQ ID NO: 457481 - protein, 9 aa, Influenza virus
STSCHDGIS

SEQ ID NO: 457482 - protein, 9 aa, Influenza virus
STSCHDGKA

SEQ ID NO: 457483 - protein, 9 aa, Influenza virus
STSCHDGKF

SEQ ID NO: 457484 - protein, 9 aa, Influenza virus
STSCHDGKS

SEQ ID NO: 457485 - protein, 9 aa, Influenza virus
STSCHDGKT

SEQ ID NO: 457486 - protein, 9 aa, Influenza virus
STSCHDGMS

SEQ ID NO: 457487 - protein, 9 aa, Influenza virus
STSCHDGRA

SEQ ID NO: 457488 - protein, 9 aa, Influenza virus
STSCHDGRS

SEQ ID NO: 457489 - protein, 9 aa, Influenza virus
STSCHDGVG

SEQ ID NO: 457490 - protein, 9 aa, Influenza virus
STSCHDGVS

SEQ ID NO: 457491 - protein, 9 aa, Influenza virus
STSIVVFCG

SEQ ID NO: 457492 - protein, 9 aa, Influenza virus
STSSRSGFE

SEQ ID NO: 457493 - protein, 9 aa, Influenza virus
STTAKAMEQ

SEQ ID NO: 457494 - protein, 9 aa, Influenza virus
STTCHDGIG

SEQ ID NO: 457495 - protein, 9 aa, Influenza virus
STTFPYTGD

SEQ ID NO: 457496 - protein, 9 aa, Influenza virus
STTGMTLSV

SEQ ID NO: 457497 - protein, 9 aa, Influenza virus
STTHDRTAF

SEQ ID NO: 457498 - protein, 9 aa, Influenza virus
STVAASLCL

SEQ ID NO: 457499 - protein, 9 aa, Influenza virus
STVASSLAL

SEQ ID NO: 457500 - protein, 9 aa, Influenza virus
STVASSLIL

SEQ ID NO: 457501 - protein, 9 aa, Influenza virus
STVASSLTL

SEQ ID NO: 457502 - protein, 9 aa, Influenza virus
STVASSLVL

SEQ ID NO: 457503 - protein, 9 aa, Influenza virus
STVASSSVL

SEQ ID NO: 457504 - protein, 9 aa, Influenza virus
STVFCGVSG

SEQ ID NO: 457505 - protein, 9 aa, Influenza virus
STVFCGVSS

SEQ ID NO: 457506 - protein, 9 aa, Influenza virus
STVLGVSIL

SEQ ID NO: 457507 - protein, 9 aa, Influenza virus
STVLKSDKR

SEQ ID NO: 457508 - protein, 9 aa, Influenza virus
STVLVGLIL

SEQ ID NO: 457509 - protein, 9 aa, Influenza virus
STVMVGLIL

SEQ ID NO: 457510 - protein, 9 aa, Influenza virus
STVNEEALR

SEQ ID NO: 457511 - protein, 9 aa, Influenza virus
STVQVDTIM

SEQ ID NO: 457512 - protein, 9 aa, Influenza virus
STVSCDSPS

SEQ ID NO: 457513 - protein, 9 aa, Influenza virus
STVSSFERF

SEQ ID NO: 457514 - protein, 9 aa, Influenza virus
STVSSSLVL

SEQ ID NO: 457515 - protein, 9 aa, Influenza virus
STVVNNITT

SEQ ID NO: 457516 - protein, 9 aa, Influenza virus
STVVSSLAL

SEQ ID NO: 457517 - protein, 9 aa, Influenza virus
STWLGRTIS

SEQ ID NO: 457518 - protein, 9 aa, Influenza virus
STYKILSIY

SEQ ID NO: 457519 - protein, 9 aa, Influenza virus
STYQNNFVP

SEQ ID NO: 457520 - protein, 9 aa, Influenza virus
STYQNSFVP

SEQ ID NO: 457521 - protein, 9 aa, Influenza virus
SVAGWLLGN

SEQ ID NO: 457522 - protein, 9 aa, Influenza virus
SVAHKSCLP

SEQ ID NO: 457523 - protein, 9 aa, Influenza virus
SVAPIMFSN

SEQ ID NO: 457524 - protein, 9 aa, Influenza virus
SVASSLVLL

SEQ ID NO: 457525 - protein, 9 aa, Influenza virus
SVAWSASAC

SEQ ID NO: 457526 - protein, 9 aa, Influenza virus
SVAWSATAC

SEQ ID NO: 457527 - protein, 9 aa, Influenza virus
SVCISGPNN

SEQ ID NO: 457528 - protein, 9 aa, Influenza virus
SVCMSGPNN

SEQ ID NO: 457529 - protein, 9 aa, Influenza virus
SVCYNPCFY

SEQ ID NO: 457530 - protein, 9 aa, Influenza virus
SVDLVETNH

SEQ ID NO: 457531 - protein, 9 aa, Influenza virus
SVEGWVVIA

SEQ ID NO: 457532 - protein, 9 aa, Influenza virus
SVENGTYDY

SEQ ID NO: 457533 - protein, 9 aa, Influenza virus
SVENLEELR

SEQ ID NO: 457534 - protein, 9 aa, Influenza virus
SVENQEELR

SEQ ID NO: 457535 - protein, 9 aa, Influenza virus
SVEPKGLFG

SEQ ID NO: 457536 - protein, 9 aa, Influenza virus
SVEPRGLFG

SEQ ID NO: 457537 - protein, 9 aa, Influenza virus
SVESSTYQN

SEQ ID NO: 457538 - protein, 9 aa, Influenza virus
SVEYASKTR

SEQ ID NO: 457539 - protein, 9 aa, Influenza virus
SVFNCLYAS

SEQ ID NO: 457540 - protein, 9 aa, Influenza virus
SVFNNLYAS

SEQ ID NO: 457541 - protein, 9 aa, Influenza virus
SVFNSLYAS

SEQ ID NO: 457542 - protein, 9 aa, Influenza virus
SVFNSLYSS

SEQ ID NO: 457543 - protein, 9 aa, Influenza virus
SVGGIDTNK

SEQ ID NO: 457544 - protein, 9 aa, Influenza virus
SVGGINTNK

SEQ ID NO: 457545 - protein, 9 aa, Influenza virus
SVGGINTNR

SEQ ID NO: 457546 - protein, 9 aa, Influenza virus
SVGKEFSNL

SEQ ID NO: 457547 - protein, 9 aa, Influenza virus
SVGSGSFPD

SEQ ID NO: 457548 - protein, 9 aa, Influenza virus
SVGSSIYQN

SEQ ID NO: 457549 - protein, 9 aa, Influenza virus
SVGSSTYHN

SEQ ID NO: 457550 - protein, 9 aa, Influenza virus
SVGSSTYQN

SEQ ID NO: 457551 - protein, 9 aa, Influenza virus
SVGSWSQNI

SEQ ID NO: 457552 - protein, 9 aa, Influenza virus
SVGTSTLNL

SEQ ID NO: 457553 - protein, 9 aa, Influenza virus
SVGTSTLNQ

SEQ ID NO: 457554 - protein, 9 aa, Influenza virus
SVGWSATAC

SEQ ID NO: 457555 - protein, 9 aa, Influenza virus
SVHRNTFGD

SEQ ID NO: 457556 - protein, 9 aa, Influenza virus
SVHRNTIGD

SEQ ID NO: 457557 - protein, 9 aa, Influenza virus
SVIEKINTQ

SEQ ID NO: 457558 - protein, 9 aa, Influenza virus
SVIEKMNIQ

SEQ ID NO: 457559 - protein, 9 aa, Influenza virus
SVIEKMNTQ

SEQ ID NO: 457560 - protein, 9 aa, Influenza virus
SVKEKDLTK

SEQ ID NO: 457561 - protein, 9 aa, Influenza virus
SVKEKDMTK

SEQ ID NO: 457562 - protein, 9 aa, Influenza virus
SVKEKDMTR

SEQ ID NO: 457563 - protein, 9 aa, Influenza virus
SVKKGTYDY

SEQ ID NO: 457564 - protein, 9 aa, Influenza virus
SVKLSSGYK

SEQ ID NO: 457565 - protein, 9 aa, Influenza virus
SVKMEKIVL

SEQ ID NO: 457566 - protein, 9 aa, Influenza virus
SVKNGTYDY

SEQ ID NO: 457567 - protein, 9 aa, Influenza virus
SVKNGTYEY

SEQ ID NO: 457568 - protein, 9 aa, Influenza virus
SVKNGTYNY

SEQ ID NO: 457569 - protein, 9 aa, Influenza virus
SVKNGTYYY

SEQ ID NO: 457570 - protein, 9 aa, Influenza virus
SVKTGTYDY

SEQ ID NO: 457571 - protein, 9 aa, Influenza virus
SVKTLTDNH

SEQ ID NO: 457572 - protein, 9 aa, Influenza virus
SVLINTYQW

SEQ ID NO: 457573 - protein, 9 aa, Influenza virus
SVLKPGETL

SEQ ID NO: 457574 - protein, 9 aa, Influenza virus
SVLKPGQTL

SEQ ID NO: 457575 - protein, 9 aa, Influenza virus
SVLLGSSPN

SEQ ID NO: 457576 - protein, 9 aa, Influenza virus
SVLLVSLGA

SEQ ID NO: 457577 - protein, 9 aa, Influenza virus
SVLNLLIGI

SEQ ID NO: 457578 - protein, 9 aa, Influenza virus
SVLNLLIGV

SEQ ID NO: 457579 - protein, 9 aa, Influenza virus
SVLQPGETL

SEQ ID NO: 457580 - protein, 9 aa, Influenza virus
SVLRPGETL

SEQ ID NO: 457581 - protein, 9 aa, Influenza virus
SVLRPGQTL

SEQ ID NO: 457582 - protein, 9 aa, Influenza virus
SVLVNTYQW

SEQ ID NO: 457583 - protein, 9 aa, Influenza virus
SVLYFWGIH

SEQ ID NO: 457584 - protein, 9 aa, Influenza virus
SVLYFWGVH

SEQ ID NO: 457585 - protein, 9 aa, Influenza virus
SVNTNTINR

SEQ ID NO: 457586 - protein, 9 aa, Influenza virus
SVNTVLSII

SEQ ID NO: 457587 - protein, 9 aa, Influenza virus
SVPASRYLI

SEQ ID NO: 457588 - protein, 9 aa, Influenza virus
SVPASRYLT

SEQ ID NO: 457589 - protein, 9 aa, Influenza virus
SVPLGSSPN

SEQ ID NO: 457590 - protein, 9 aa, Influenza virus
SVPMGSSPN

SEQ ID NO: 457591 - protein, 9 aa, Influenza virus
SVQPAFSVQ

SEQ ID NO: 457592 - protein, 9 aa, Influenza virus
SVQPTFSVQ

SEQ ID NO: 457593 - protein, 9 aa, Influenza virus
SVQRNLPFD

SEQ ID NO: 457594 - protein, 9 aa, Influenza virus
SVQRNLPFE

SEQ ID NO: 457595 - protein, 9 aa, Influenza virus
SVQRSLPFE

SEQ ID NO: 457596 - protein, 9 aa, Influenza virus
SVQSRGLFG

SEQ ID NO: 457597 - protein, 9 aa, Influenza virus
SVREKDMTK

SEQ ID NO: 457598 - protein, 9 aa, Influenza virus
SVRGSGMRI

SEQ ID NO: 457599 - protein, 9 aa, Influenza virus
SVRIGSKGD

SEQ ID NO: 457600 - protein, 9 aa, Influenza virus
SVRLSASGD

SEQ ID NO: 457601 - protein, 9 aa, Influenza virus
SVRNGTYDY

SEQ ID NO: 457602 - protein, 9 aa, Influenza virus
SVRNGTYKY

SEQ ID NO: 457603 - protein, 9 aa, Influenza virus
SVRNGTYNY

SEQ ID NO: 457604 - protein, 9 aa, Influenza virus
SVSECRTFF

SEQ ID NO: 457605 - protein, 9 aa, Influenza virus
SVSSFEKFE

SEQ ID NO: 457606 - protein, 9 aa, Influenza virus
SVSSFERFE

SEQ ID NO: 457607 - protein, 9 aa, Influenza virus
SVSSFKRFE

SEQ ID NO: 457608 - protein, 9 aa, Influenza virus
SVSSRSGFE

SEQ ID NO: 457609 - protein, 9 aa, Influenza virus
SVTELWSYN

SEQ ID NO: 457610 - protein, 9 aa, Influenza virus
SVTQTLVSN

SEQ ID NO: 457611 - protein, 9 aa, Influenza virus
SVTTNTINR

SEQ ID NO: 457612 - protein, 9 aa, Influenza virus
SVVEKMNTQ

SEQ ID NO: 457613 - protein, 9 aa, Influenza virus
SVVLVGLIL

SEQ ID NO: 457614 - protein, 9 aa, Influenza virus
SVVLVGPIL

SEQ ID NO: 457615 - protein, 9 aa, Influenza virus
SVVMCGVDH

SEQ ID NO: 457616 - protein, 9 aa, Influenza virus
SVVSCDSPS

SEQ ID NO: 457617 - protein, 9 aa, Influenza virus
SVVVFCGTS

SEQ ID NO: 457618 - protein, 9 aa, Influenza virus
SVWAGRTIS

SEQ ID NO: 457619 - protein, 9 aa, Influenza virus
SVWAGRTMS

SEQ ID NO: 457620 - protein, 9 aa, Influenza virus
SVWAGRTVS

SEQ ID NO: 457621 - protein, 9 aa, Influenza virus
SVYIEVLHL

SEQ ID NO: 457622 - protein, 9 aa, Influenza virus
SVYKALSIY

SEQ ID NO: 457623 - protein, 9 aa, Influenza virus
SVYSTVASS

SEQ ID NO: 457624 - protein, 9 aa, Influenza virus
SVYVEVLHL

SEQ ID NO: 457625 - protein, 9 aa, Influenza virus
SVYWTIVKP

SEQ ID NO: 457626 - protein, 9 aa, Influenza virus
SVYWTVVKP

SEQ ID NO: 457627 - protein, 9 aa, Influenza virus
SWAGDILRT

SEQ ID NO: 457628 - protein, 9 aa, Influenza virus
SWAGDIMRT

SEQ ID NO: 457629 - protein, 9 aa, Influenza virus
SWAGNILRT

SEQ ID NO: 457630 - protein, 9 aa, Influenza virus
SWASNSIVT

SEQ ID NO: 457631 - protein, 9 aa, Influenza virus
SWAVGRCPR

SEQ ID NO: 457632 - protein, 9 aa, Influenza virus
SWDDGAILP

SEQ ID NO: 457633 - protein, 9 aa, Influenza virus
SWEGDILRT

SEQ ID NO: 457634 - protein, 9 aa, Influenza virus
SWEGNILRT

SEQ ID NO: 457635 - protein, 9 aa, Influenza virus
SWEMGLAPS

SEQ ID NO: 457636 - protein, 9 aa, Influenza virus
SWEMGQAPS

SEQ ID NO: 457637 - protein, 9 aa, Influenza virus
SWFNSFLAH

SEQ ID NO: 457638 - protein, 9 aa, Influenza virus
SWFNSFLIH

SEQ ID NO: 457639 - protein, 9 aa, Influenza virus
SWFNSFLKH

SEQ ID NO: 457640 - protein, 9 aa, Influenza virus
SWFNSFLTH

SEQ ID NO: 457641 - protein, 9 aa, Influenza virus
SWFNSFLVH

SEQ ID NO: 457642 - protein, 9 aa, Influenza virus
SWGMGQAPS

SEQ ID NO: 457643 - protein, 9 aa, Influenza virus
SWHDGAEII

SEQ ID NO: 457644 - protein, 9 aa, Influenza virus
SWHDGAEIT

SEQ ID NO: 457645 - protein, 9 aa, Influenza virus
SWHDGAILP

SEQ ID NO: 457646 - protein, 9 aa, Influenza virus
SWHDGAVLP

SEQ ID NO: 457647 - protein, 9 aa, Influenza virus
SWHIFGKDN

SEQ ID NO: 457648 - protein, 9 aa, Influenza virus
SWHIFSKDN

SEQ ID NO: 457649 - protein, 9 aa, Influenza virus
SWHILSKDN

SEQ ID NO: 457650 - protein, 9 aa, Influenza virus
SWHIYGKDN

SEQ ID NO: 457651 - protein, 9 aa, Influenza virus
SWIPKRNRS

SEQ ID NO: 457652 - protein, 9 aa, Influenza virus
SWKGNIMRT

SEQ ID NO: 457653 - protein, 9 aa, Influenza virus
SWKKQILRT

SEQ ID NO: 457654 - protein, 9 aa, Influenza virus
SWLGRTISK

SEQ ID NO: 457655 - protein, 9 aa, Influenza virus
SWLGRTTSK

SEQ ID NO: 457656 - protein, 9 aa, Influenza virus
SWLHVCVTG

SEQ ID NO: 457657 - protein, 9 aa, Influenza virus
SWLTIGISG

SEQ ID NO: 457658 - protein, 9 aa, Influenza virus
SWLTIGVSG

SEQ ID NO: 457659 - protein, 9 aa, Influenza virus
SWMKIYWDL

SEQ ID NO: 457660 - protein, 9 aa, Influenza virus
SWMKIYWHL

SEQ ID NO: 457661 - protein, 9 aa, Influenza virus
SWMKIYWSL

SEQ ID NO: 457662 - protein, 9 aa, Influenza virus
SWMKIYWVL

SEQ ID NO: 457663 - protein, 9 aa, Influenza virus
SWMKIYWYL

SEQ ID NO: 457664 - protein, 9 aa, Influenza virus
SWMKLYWHL

SEQ ID NO: 457665 - protein, 9 aa, Influenza virus
SWPDDAELP

SEQ ID NO: 457666 - protein, 9 aa, Influenza virus
SWPDGADIN

SEQ ID NO: 457667 - protein, 9 aa, Influenza virus
SWPDGADLP

SEQ ID NO: 457668 - protein, 9 aa, Influenza virus
SWPDGAELP

SEQ ID NO: 457669 - protein, 9 aa, Influenza virus
SWPDGAEVP

SEQ ID NO: 457670 - protein, 9 aa, Influenza virus
SWPDGAKLP

SEQ ID NO: 457671 - protein, 9 aa, Influenza virus
SWPDGALFP

SEQ ID NO: 457672 - protein, 9 aa, Influenza virus
SWPDGALLP

SEQ ID NO: 457673 - protein, 9 aa, Influenza virus
SWPDGANID

SEQ ID NO: 457674 - protein, 9 aa, Influenza virus
SWPDGANIN

SEQ ID NO: 457675 - protein, 9 aa, Influenza virus
SWPDGANIS

SEQ ID NO: 457676 - protein, 9 aa, Influenza virus
SWPLSSPPT

SEQ ID NO: 457677 - protein, 9 aa, Influenza virus
SWPQSSPPT

SEQ ID NO: 457678 - protein, 9 aa, Influenza virus
SWRKDILRT

SEQ ID NO: 457679 - protein, 9 aa, Influenza virus
SWRKKILRT

SEQ ID NO: 457680 - protein, 9 aa, Influenza virus
SWRKQILRT

SEQ ID NO: 457681 - protein, 9 aa, Influenza virus
SWRRDILRT

SEQ ID NO: 457682 - protein, 9 aa, Influenza virus
SWRRQILRT

SEQ ID NO: 457683 - protein, 9 aa, Influenza virus
SWSCIVERP

SEQ ID NO: 457684 - protein, 9 aa, Influenza virus
SWSGYSGIF

SEQ ID NO: 457685 - protein, 9 aa, Influenza virus
SWSKNILRT

SEQ ID NO: 457686 - protein, 9 aa, Influenza virus
SWSKPQCQI

SEQ ID NO: 457687 - protein, 9 aa, Influenza virus
SWSLQCRIC

SEQ ID NO: 457688 - protein, 9 aa, Influenza virus
SWSQNILKK

SEQ ID NO: 457689 - protein, 9 aa, Influenza virus
SWSQNILRT

SEQ ID NO: 457690 - protein, 9 aa, Influenza virus
SWSWHDGAE

SEQ ID NO: 457691 - protein, 9 aa, Influenza virus
SWSWHDGAI

SEQ ID NO: 457692 - protein, 9 aa, Influenza virus
SWSWHDGAV

SEQ ID NO: 457693 - protein, 9 aa, Influenza virus
SWSWPDDAE

SEQ ID NO: 457694 - protein, 9 aa, Influenza virus
SWSWPDGAD

SEQ ID NO: 457695 - protein, 9 aa, Influenza virus
SWSWPDGAE

SEQ ID NO: 457696 - protein, 9 aa, Influenza virus
SWSWPDGAL

SEQ ID NO: 457697 - protein, 9 aa, Influenza virus
SWSYIVEKL

SEQ ID NO: 457698 - protein, 9 aa, Influenza virus
SWSYIVEKP

SEQ ID NO: 457699 - protein, 9 aa, Influenza virus
SWSYIVEKS

SEQ ID NO: 457700 - protein, 9 aa, Influenza virus
SWSYIVEKT

SEQ ID NO: 457701 - protein, 9 aa, Influenza virus
SWSYIVERL

SEQ ID NO: 457702 - protein, 9 aa, Influenza virus
SWSYIVERP

SEQ ID NO: 457703 - protein, 9 aa, Influenza virus
SWSYVVERP

SEQ ID NO: 457704 - protein, 9 aa, Influenza virus
SWTKIYWYL

SEQ ID NO: 457705 - protein, 9 aa, Influenza virus
SWTPKRNRS

SEQ ID NO: 457706 - protein, 9 aa, Influenza virus
SWTSNSIVT

SEQ ID NO: 457707 - protein, 9 aa, Influenza virus
SWTSNSMVT

SEQ ID NO: 457708 - protein, 9 aa, Influenza virus
SWVPILNTS

SEQ ID NO: 457709 - protein, 9 aa, Influenza virus
SWVPKRNRS

SEQ ID NO: 457710 - protein, 9 aa, Influenza virus
SYCRATEYI

SEQ ID NO: 457711 - protein, 9 aa, Influenza virus
SYEQMETDG

SEQ ID NO: 457712 - protein, 9 aa, Influenza virus
SYEQMETGE

SEQ ID NO: 457713 - protein, 9 aa, Influenza virus
SYEQMETGG

SEQ ID NO: 457714 - protein, 9 aa, Influenza virus
SYEQMETSG

SEQ ID NO: 457715 - protein, 9 aa, Influenza virus
SYFANLKGT

SEQ ID NO: 457716 - protein, 9 aa, Influenza virus
SYFFGDNAE

SEQ ID NO: 457717 - protein, 9 aa, Influenza virus
SYFFGDNAK

SEQ ID NO: 457718 - protein, 9 aa, Influenza virus
SYFQLFLVC

SEQ ID NO: 457719 - protein, 9 aa, Influenza virus
SYGRIIQNE

SEQ ID NO: 457720 - protein, 9 aa, Influenza virus
SYGTGSWPD

SEQ ID NO: 457721 - protein, 9 aa, Influenza virus
SYICSGLVG

SEQ ID NO: 457722 - protein, 9 aa, Influenza virus
SYIIEKENP

SEQ ID NO: 457723 - protein, 9 aa, Influenza virus
SYIIERPSA

SEQ ID NO: 457724 - protein, 9 aa, Influenza virus
SYIIRALTL

SEQ ID NO: 457725 - protein, 9 aa, Influenza virus
SYIMEKENP

SEQ ID NO: 457726 - protein, 9 aa, Influenza virus
SYINKTGTF

SEQ ID NO: 457727 - protein, 9 aa, Influenza virus
SYINRTGTF

SEQ ID NO: 457728 - protein, 9 aa, Influenza virus
SYIVEKANP

SEQ ID NO: 457729 - protein, 9 aa, Influenza virus
SYIVEKDKP

SEQ ID NO: 457730 - protein, 9 aa, Influenza virus
SYIVEKDNP

SEQ ID NO: 457731 - protein, 9 aa, Influenza virus
SYIVEKDSP

SEQ ID NO: 457732 - protein, 9 aa, Influenza virus
SYIVEKENP

SEQ ID NO: 457733 - protein, 9 aa, Influenza virus
SYIVEKNNP

SEQ ID NO: 457734 - protein, 9 aa, Influenza virus
SYIVEKPNP

SEQ ID NO: 457735 - protein, 9 aa, Influenza virus
SYIVEKSNP

SEQ ID NO: 457736 - protein, 9 aa, Influenza virus
SYIVEKTNP

SEQ ID NO: 457737 - protein, 9 aa, Influenza virus
SYIVERENP

SEQ ID NO: 457738 - protein, 9 aa, Influenza virus
SYIVERETP

SEQ ID NO: 457739 - protein, 9 aa, Influenza virus
SYIVERPKE

SEQ ID NO: 457740 - protein, 9 aa, Influenza virus
SYIVERPNP

SEQ ID NO: 457741 - protein, 9 aa, Influenza virus
SYIVERPSA

SEQ ID NO: 457742 - protein, 9 aa, Influenza virus
SYIVERPTA

SEQ ID NO: 457743 - protein, 9 aa, Influenza virus
SYIVERQSA

SEQ ID NO: 457744 - protein, 9 aa, Influenza virus
SYIVERSSA

SEQ ID NO: 457745 - protein, 9 aa, Influenza virus
SYIVERSSP

SEQ ID NO: 457746 - protein, 9 aa, Influenza virus
SYIVERTKE

SEQ ID NO: 457747 - protein, 9 aa, Influenza virus
SYKILSIYS

SEQ ID NO: 457748 - protein, 9 aa, Influenza virus
SYKRIRLFD

SEQ ID NO: 457749 - protein, 9 aa, Influenza virus
SYKRVRLFD

SEQ ID NO: 457750 - protein, 9 aa, Influenza virus
SYKVGYLCA

SEQ ID NO: 457751 - protein, 9 aa, Influenza virus
SYKYDNGVW

SEQ ID NO: 457752 - protein, 9 aa, Influenza virus
SYKYGNGVW

SEQ ID NO: 457753 - protein, 9 aa, Influenza virus
SYLCSGLVG

SEQ ID NO: 457754 - protein, 9 aa, Influenza virus
SYLECRTFF

SEQ ID NO: 457755 - protein, 9 aa, Influenza virus
SYLIEDPAA

SEQ ID NO: 457756 - protein, 9 aa, Influenza virus
SYLIEDPGA

SEQ ID NO: 457757 - protein, 9 aa, Influenza virus
SYLIEDPNA

SEQ ID NO: 457758 - protein, 9 aa, Influenza virus
SYLIEDPSA

SEQ ID NO: 457759 - protein, 9 aa, Influenza virus
SYLIEDPTA

SEQ ID NO: 457760 - protein, 9 aa, Influenza virus
SYLIRALTL

SEQ ID NO: 457761 - protein, 9 aa, Influenza virus
SYLIRTLTL

SEQ ID NO: 457762 - protein, 9 aa, Influenza virus
SYLLLNKSL

SEQ ID NO: 457763 - protein, 9 aa, Influenza virus
SYLNVRCVC

SEQ ID NO: 457764 - protein, 9 aa, Influenza virus
SYMCSGLVG

SEQ ID NO: 457765 - protein, 9 aa, Influenza virus
SYNADLLVA

SEQ ID NO: 457766 - protein, 9 aa, Influenza virus
SYNADVLVA

SEQ ID NO: 457767 - protein, 9 aa, Influenza virus
SYNAEFLVA

SEQ ID NO: 457768 - protein, 9 aa, Influenza virus
SYNAELLIA

SEQ ID NO: 457769 - protein, 9 aa, Influenza virus
SYNAELLVA

SEQ ID NO: 457770 - protein, 9 aa, Influenza virus
SYNAGLLVA
